United States Patent 7,868,149 (PLANT GENOME SEQUENCE AND USES THEREOF) - sequence listing, part 101

SEQ ID NO: 54220 - DNA, 16640 bp, Oryza sativa
agtaacgtcattgagagaaattttctttaagattagacatgaatgaatgatgatgcgtgcaagcaatttctaagctacaaaaaccatcttataaacataatttcttttcattgtttgtcttattaagacatgacctacactatctattccatacttgggggtaaactaagatcttttaccctatttgtgtacttgtgtgtatgagtgactctgattcggctcttgaggattgtgtgggcacacccacgacaaaatacctaggtccgccacttggtggtgagatcgagctgcatattgatgagatggatgtcgagacacagtggaagatttatcgatctgcaacaactccaacaagaatcgacgggctgcaaattgttgaacggtgaaaatgctgatgtcattgatgctttcttggctaacaatagtgatgatgtgctgatgaagtgtacaacggtgaggtggtaatggcaatagtaatagcaacatgctttgttcttggctcctgttagctctccagtaatcaaatcacatattgttcattgaacagcttgccacactttttttccattaaatagtctcgacgtctagtagtgtctatcacaataaaccgtctgtcagataaaataaaatctgatctgacaatagagaatgagatgagggtagtgttatcacaatgttgctagaagccgagaaccatgatgtaaaaaaccacatggagtattgtgggagcggaaaaatagacaaaaatgatagaaaaattaagtagacacgtctactctagtttctacatgatatggcaatctcgtacatcaccgccggacccttgtgtattgcttaatttgtacgttcagattgcttggtagcattctgcattggtaagttagctctttgctgcataaattgatatcgagttcttccagagatggtgggaggccctcttctggcaaccttgtgatgcgagtacaatgccaaatctccaacctcttgagtgagggaaggcggtgtaatccggcaggaaaatctatgaattcgctgcacgcaaatttgagctcttgcagggaccagaggtgctgaagcgctttctcttgctcatccaatagtctctcctctccgcgtctgtgtttttcaagctctaggcgtttgagggagccaaggtacttgaagaaccatgtagaaaggattctgggatcatcgatctctagtctttccaatcgagggaataactcatcaacccgccctggaaaccaaagaaaagatggggacaagctggggcatttgtatactttcaaaaacctgagattgcagagggattgcgagaccctattttggtgagctgtgaacattctcgaatctccaactcttcaagtgccgtgcagcattgcaactgcagacattccaaacttgcgttgttctgcactagtaattttttgaggcggacgggcttccctataaaacagggtagcgccgtttgtagggaataatcatgtacgctcgcctggtcatcatttttgccgttatgcacagaagacaagctgaaattgcgagatttgtctgaacaactgcaatgaatcttcttcagagaggagacgagatttaacggaattcgcaggagtccgtcttcagctgagcttatcgaagcgtcacttggatgtcttgacgaggaagcctcaagatctaacaaaagctctagttgacacttttcctcctctcccatcgatagtctcgttaccgccaggcaatttcttaatgtcaattcctgtacgccctgcacatgttgcagtatctgagatagccacttccccgttattccacattctgtaatactgacaagttcaagagatgggcggtcattgcgatttccaattccagctaccatgtcttcacgggtagaagtaggctcttgcggaacatctgaagagaaaagattttgacactcgtctatcttcagcctcttcaaatggatcagttgcctgagtccttccaacgaaatatatctcagatttcggcattgtgatatatgcaaagtagttacaaacctactaaggttgtggtagggcaacactgttttatccatcgctgtcagcttatcagaaaatgagttactcctaatataaaatattccttcgtttgacctcatcgttggaagtgttgaaattccattgatgaagaactctgaaacagtagttgaagggggaaaaggatgaggcacagtgaaatcaggacaatcatcgatggtgaggttgctgaggtggggcaaccatgagcaccccaagttacggcagttctcaaacaacggaaagaccttcagaaccgggcaccttttaatcttcaggatccttaaactggagttgaagtccaccatggaagtgcaagagcacgtatgcaagttttgcattccaattaaaataatatcctgcggtgaacggattgagagcaccgatgcattcttcatctcgatcaacacaagctttctaagcaatgatagcccttctaaagaaagtgtatgccattctgcacaattttctagacgaagtgtttgcagataggtaagtgaagtggaaagccaagttggggctttagttccattgtaccaagatatccgtagatacttgaggttgtgatggggttcaagaccttcaagctcctcacttgctatgtctagaatatgatctaaactaggggcaccattgctatcactcatttgcaatctctccccttctgtttctgagtgcatagaaggttcggatatcatgttaccatcgcattcattttcagagctcccaccactgtcgtatctattcccgtcactgtcatatccattccgtacacccttccagaacaaatgtagtccctccaagcaatggttgcttttcaggcttgctccactggcctcttgctgagttgtaacgttttcaagtcgagacacacccggttctacgggctcgctcatgcattgaagttgtgttatctcaaagccaatagaattctcaaccttgaaatttgttagcttctgaagtgaggccatttctcctatgctagcaatggaagaacacactcccttttgggcaagatgccgcaggctgacaagattatttatgtcatcaggtataaggggacttccatatgaaccaatatctagtacttgaagatggtagcacttgctcagagcatggggcaaagcttcgtgggtcactctttctaagagaagatgaaaagctccatgggactctttgttcttaaatcttagatacctgagatgggtagtgttcgccaaactggaaaggaaggaatcaagatcagcataagctgcagtgatatgcagcagtcgcaaatgctgagcctccctgaaagcatcttggaaggatttaaaaaaatgatggttatattgcccaattagtaccaatgtcctcaacttactccttgacataactttcatcaaacttttctcaaattcctcattacgagataattttccattttgatacttgcagtatgcagaattagttactatcgacaaatgacgtatactcggtgctaactctctgcactctgatccatctatagttgcacattctgtttgtgaaaccagtcgtgctaaatcatgcataagatcatgcataacaaaaactactgatgaagaccaccaactttcagcttgctgaaagaaacccgagttcaccaactcagttagatattcccatcctttgtgctcgaacttctcactggatttttccacaaatccttgagcaatccatatttttatcagttgtgctttactgaaagagtaacccttggggaaaagagaacaataagagaaagattgctgtagctggttaggtagataatcataactgaacttcagcacatgcatgatgccatcagtatgtttcagggattgccattctttgttctctataatgttgatccaatggtcttcagtaagatttcttcgtagtagggagcccacagtttttgctgccaaggggttgccttttagctccttaattgttttcctcccaagattctctaaattttgattactaccatgttgatcagtactaaatgcatatgctttaaatagtgaccatatatcaccatcttccagagcttctaaatttattgatcctgccgttccacacctttgagcgacagtcagtattcgagttgtcacaatgatcatattacctgtcacttctgatgcattcacatgattaggtcttaaaggacccagtagtttgttccaacagtcttctgtagtgacatcccagacatcatccaaaacaatcagaaacttcttagatttcatgtgtttctcaagatcctgctgaagcatgttaaagttgcttattccttggtaacttcggttggagacacaccctaaaatctcccttgtgatcctaaccacatcaaatttatcagatacatggacccatatcttgatctcaaactgatttccgatttccggatcattataaacatgttgggacagagtggttttccctatccctcctatgcctacaattggtaggacggttatgtcattggatttatttcccatgattagatttttgatggattccatctctgcatctctcccatacattttgggctcaagaggataagatgatgttattgcatttggggccaggggtgtactctcacacctctgatttaaacttgcatacccacatagcctcataaccccatttacagcctcttgtaactgatgagtcatatgttggatcatgttggagagttcacccctgttccaaggatgcgtgctaactgcctcgtggagtgttgaagtgccatccatcctcatcctttttctgccaactgaattaccaggtgcatttggtgcaccctcaccggcactgcaaaagaatgtgatcgtggttcggcaattagcaaagtcagcgatataacacgatcttaagcagataaacgcagacggttaactcagcggaattaagagctactccctccgtttcataatgtaagtcattttaccatttcccacattcatattgatgttaatgaatctagatctagattcattaacatcaatatgaatatagtaaatgctagaatgacttatattgtggaacggaggaagtacgtgccttatgtggctacgtaaacattctattgaagattacagagcttcaattctccgtttttatatttgacttttattaccatgatctacatcataatggctgacgcgctaaaacgcatctacatatgcgataacttaaaaagatgttccttatatagaaataaaatttttaaagcgggttacatcatcctcaaattactcttatcgcaccctttttttattagtagtggtcatagtaaaatctttaatgcattagttgactattaatccataccaaagggcaaatggacttattatagttactaggaatgtagcctgtgtatacgcacggacatgttgtttaatgttgttagaatttttattacgaatatttatgtgtggatgatatttttgaaatatttatttaatctattttaaacgtgtatttgttaataactggtttggtcgtattactactagaaactgtatatccttaaatttcttagaaacaaacgtgtcacaataatggagttggttcgtagctatttgtattatgtgtgattctatttttaaaatttttcgagtttccgaacttatataacattttttattttgtatgccatagattactttaagtagcattttaattttattatatatttctaaaatatattttctattaaaaatatacttcatccattttatattataagactttctagcattgcccacatttatataaatgttaatgaatctagacacctatcaatctagacacataggtgtctagattcattaacatctatatcaatgtgggcaatagctaatgatactacttcatctagccaaagatgatttatattacttatacttcctctgtcacataaatcggaggagttaaattttattctaaaacaatagaataatttatatgtaactgagacaaagtaattttttaaaatactagcacgataatctccaaagtaccgtattatatttttgacagatatctatagtgtaatgcacgttagttcagtgtctggtttcttttcaacacctattctttctaacgacatgagacacctttagtaatttggagaatacgtatgtacatttaaattagcattgtatattcatcaagtttttttacacctaagatatgatgtgaaattattatcatagcgttaattattacttgtcggttccatatgttttgatgtattttgggctatagacattatcaatttattgatttaaaggaatacaacgggatcacaaattggatatataattttaaaataatttaaaagatagaacacttaaaaagcattgattggacattttatattatatttgtgtaaatttcaagattattatattttatctttaaattgaacaaaactagttgggcagcccgcgcaattgcgcggctagcatcaatttaaaatcatatatttttacatataattttatttaaaattttattcccttgattctaataattttatattttctttaaaagccatgctagtcgctaccccttactcttttgacactttttttttgcttactcgatctacctctgtttctattcatcctctttagaactttataaattaggccttatagtttttagagtttattgtcttgttgggtttcgttttcataatttttagaagtatctttaaacatcaccaatttactactctacggccgtccactaccacctctctttattgtcatttggattttaaaattagaatataattattgtttgtattccttttttactttttataagtctcatcaaatcgttagtggcttcgccactatactcatctacagcccgcctgctgcctgccctccttattgttgtagagattttaaaaatccttaattattacttgtcggttccatatgttttgatgtatttagggctatagacattatcaatttattgatttaaaggaatacaacgggatcacaaattggatatataattttaaaataatttaaaagatagaacacttaaaaagcattgattggacattttatattatatttgtgtaaatttcaagattattatattttatctttaaattgaacaaaattctatttttaggactcccaatctttttggctttattataagtatgttttctattgttccggcaaatgatacgtaatcatcattgttctttaaatcatatgtacgtatggagtactttttctggttaatagctatatgtttctcatgtatccgtatatacgataatttttttatttttaaataataaatctaatataatggtgtaaaataaaaaaactaaattgtgttgttttcatttctacatatgtatatttaaattagcgttgcatatttatatttgtgatatttgagaccctaaaatatgatatgaaataaaattagcatcacattagaaatagatatgcatatttatttgcgaggagtagcggtgggctcctgctcgtgtgccatttttgagcctggcagacgccacgtcacctgatctaagggcaaaatgactatcttgtccttcttcttaattcatttctcctccccttcctcagtcccttttacatctttccttttccttgccagtgagctgcttaggctccggcgagctccccgccttgtgctcctccctccctcactcgactccctacatccccagcccctcctctattcctactgccaacgtcatcaaggatcagcgggcatggctgtccggcaatgtgatgccattgctggtgcctcactccatcatcgatgtcatcgttgtcctctgagcacagagcgtcgtcctcctctcggatcttctccactctcccccgacgtcgacggctgcgtcagacccagccttagggcttcccctgcctcattgttcgctgcccgatgcaggaggtgagggtgcacattgggtggtagaagagccaggggccgttcgtctcctccatagccattcggcagcgggacgctcgaggtcctcttcacgtcgtcctggccttggcttgatggtttggcattggtggtgatggcatcaccagctcatgcgcaggaagaaggttgaaggagagagaccccaagctggaggaagaagaaaggcaaaatggtcattttgccctcatatctggtgacgtagcgcctcaccagctcaaaaatggccaatgagaaagaaatcatctctctccaatggtaaaaaaagcaaagttctttggaagagtggcatttgagaacacgccatccgggaaagtggcaaatagtccaaaatcccttggaccgcagcattgctgggccgcgcgcgcttcatgggctatgtgcgtgaataccctagcaagccggcgggggtccgacaaggccttttttttcctttcgatttttcttttctttttttagaactttctttctttatttcagaatatattttcttaaagggctcatatcatgaaaaactaaaccctaatcagataatatttttatcttggatataatttttgtttacccgttccaacgcatgggcattttttctagtctaattttgaatttaattttgttttaattctaaatttaaatctgtcgacgagtgatactcgtagaccggataagtagagtattggggtacattggaacgagggtctatgtagtacgacatcaagcagacaaaagacaaagattatactggttcagggcccttatcaggtaatagccctagtccagtttatatggaattgatgatgatgagaacacattacaaagagagtagtcgaaacagatggtaccgacgagatcgtagtcgagagattcgacgagatctcccactgagttggctccgtgtactccggcttcataaacttcgggaggtgtgttgaagatgagatacgattccctgaacccctcccaggggtcccttttataccgtggatcatcttgccccccaagaaaagcttgaggatatcggacctggtacagtataacagaaactctatcctttccgagtaggattttggaaatcacttgacccgtagagatattttctataatttgaagtagtttccatgtgacatttacaggaacaatccatatacgcgaaggtatacctaatcgatatatctcgtaagtcgtaggacatgaggtatgccttatctgtaaccctaacaaattcaatcccgagttgggctttagaaggactgttttttttcaactttcgttatttctattccaaatttaagttatttataaattgtatttctacttaattttttttctaatttaggaatttattttattgtttattttgaattttaattaaactcgtgttgtgttcgattattatttcaataatattcttttatttcgaattttagtcatttcaaaattgtattcctactcaaactcttttttttttccttttcaaatcccagaaaaaatattttggattttaattaatcacatattatgttcttatatggactcttttttcagtattgcttatttttaattcttaattcagttatttattagattgtattcttacattgactaaattttagttatttaaaaattgtattcctcttaaactctcatttcttttcctaatataagaatttattttattttttattttaaattttaattaaactcgtgttgggttctagattgattgttttttttcactattttctatttcgaattttagttatttcaaaattatattcctactaaaactctcttttttatttttcttttcataattttctaatttttattccgaattttaattaataaagtattaatgcattattataaggactcttattccaatattgcttatgtttaattccgaattttaattattatttttaatactgtattcctacttgaacaaaatcttagtcatttataaattgtattcgtacaaaaactcgcttttttatttttctgatttaggatttttttttattttttattttgaattttagttatttcaaaatttattcctacttgaactttcttctttctttttctaatttcagaattttttctgaaatttaatttatggattcttatatggattcttcttccaatattacttatttttaatttcgaatttcaattgttttttagattgtatttctatttgtactattcttttctttttcatagccaacatgggaatttctagccttcatagctatcgtgttgtctttttttatatatatagatagatagatagatatgggaatttctagaaatctaaaggcagtatggtgtctctttttagctatcattcacagattggtagtatacctggaagggtctggtggcggaccaattgcttcacgtttcttcttacaattgtcactcttcagatggttgtgtaaaactgacgtccctttgtcggaaccgcacttgaccaccgtgtgacagtggatacatctggccttcaccgcctttccgttttccttttccgtgatatcgaagtcctcccaagccttggatcgttttttgccaccactgctactcgctatgccagcgttgcaactcggtctcgctgcttgctctactccatgttcatccgcgcatgaatctgaaccaagattaaaacgtgcaacggaaattggaatcaagtgtactacctcttttcaggttacaagactttctagcattgtccacatctatctattctatctattatattattaaaatagctctaaaagaagacaccacgttcgctgtgggggctagaaatttccacattaatcgaagaaaaagagaaactattttgatcgttagattatagctgtttagatttttcaatggtgcagattaacacatgaaaaatattggagtccaactagaaaacgactacagaaaattgggaccgacctatattctatatagagtgatggcaagttaattaaacctttatgattaggattaggagtcggacatatttgcatggagatcctgtaatcaaatacagagtacaaatctaaccagtgtaggacacgttaactcaaggtagaaataaaaaaaaatcaaataaccaatacagttggaataaaacaatgtaagaatatcattatgcatgagcaaatggaccaggaacgtaacattaggcgtgcaagtaggaatacattttaaaaataactaaaattcggaataaacaataagtaatattgaaagaagattacatataagaatccaatacgatattaattaaaatttagaataaaaataaaataaaacccaaaattagaaaaataaaggacataagagtttaagtaggaatacaaattaaaaataattgaaattcgaaactaaaaataagcaatattaaatgaagagtccatataagaacctaatacaatattaattagaattcagaataaaatataaaataaaaataacataagtttaattaaaatttgaaataaaaatcaaattaaattctgaaaatataaaaataattataggagttcaagtataaatataatttataaataatataatatcggaataaaaaatatgaaattttcaataaacaccatccatctataaaacgcaacaatgacgaataacaataaagagggaagaagcaacaaagtcgtaaaggaattaagtgacagcagttgatgggacatctaaaaactataaacaaaacccaaatagaatcccaatggcgatcaaaaggagggacgacggataggccgttaagtagtacgatcacggtggttggctggatttctagaaagtaaaaaaataaacctcaatgatattaaagagggaagacaacaagggtaaaaacaataaacaaaaccacaaatagaatcccaatgacgggtaacctgttaagcagcacaaacacgatggttagcaggaaagtaaaaaaataaaccataatgagaatcatgttcgaattttaaaatcacaatgacaattaaaagggaagacatcgggcgggccatataggagtataatggctaagctgctgacggtttggtgggacttctacaaagttaaaagtgaacaccgacgatcattatatttgaattttaaaacccaaatgacgataaagagagaaggagacggacgggcataagtggagtagagtggcggcgtttgatgggacttctaaaaattataaaaatgaaagccaatgagttgattaagtctaaaatttataaggttctattttaaagttcaaaggaggacgaatagatgccgtagtagatcgaacaagcaaataaatgggtgaaaaagagcaagaggtagcggcaagtgtgactttaaaaaactataaaattagaaaaatagagatgataaggttagtcttttaaagtcctaatatacaaggaagctatttaacaaattttaagtaaactcatatgtaaataattttgtatggatactatccgcgcaattgcgtaggccaccttgctagttcatatagatggatgttaaagattctaggcatatgggtaatataaaaaattcttataatatgaaacagagaaagtacgtacgacgtcctgcgttacgaagaagggaagaacaatgtattttttatgtacacgctttacctccttggagctgatgctggagcctgtagtattcgagctcgtcgaccgcgtcgtcggcgtcgtacagcacctcccttagacgaccgagtgatcgggccagcggtttgttcgcgatcgccctccccttgacagcaccgaccaccacctccaccctctcgacctcagaccggagcttttcggtgtcatcggcgagcccgacctggctaatccacgcgccaaacttgtcgttgtccaggttctccactatggtatccgccagccatccaatcgaggactccagcaaattaccttctatctcctccatccgcaaatgagaagttattagtaactcttaaccgatggtctatggttataagcaaaatacgcgaatgatatttgggaacgggagcaccggagcagccgagaagagaagaacaaacaacgacaacaaagtacaattacagccggggggactcaccgcagcccgcatataaaagcagtacagaagtcagaactcagaagtccgacatggttttggaccgagtgagagacgatgactttgctctccccatattcaaaaggataaacctcgagcaagcctttcaaaccgcacgcattttagatttcgcgtcgtcagatttgcatatgttatcattacgcatacgactgcagcaatttgactgaggatataaacattgtaatgaatgaacttttagagttgaaataatccctccccgacacggctgactcagaagctctgcagtacgcaaataaaacaatttggagaaccgcacgctgaaagcggaagatggattctaatccctcaggccttgttcggttgctagggattaaatcctaaggggaagcaaaccagggagggattgagtgaatccccccaatttcactcaaaccctgtggggactaaatcccttgtttcttccaatccctctcttagaaactctgtgttcgttttgacagggactatagcagctattggcagggaatataggagcgtattgctagctctctttatgatctggacttgtattactactattagtacatttggttaccactatttacctaaaaccagtagtgctagtaccctgtgacggcagcgtaggagcaagatcaaaagtaccattagtccatttcagagaaaactagaaaacaatatacacgcatgttacaacttcctggatcaagaaagttgatgccaatgtagtgccagccaaaattacaggaaatgcttgtaatattccaattatatgatataataaaaagattgttctgattccatttaactgcttgaaaggttgttaaagatggctgaatgaactgcattcaggcattgttgaagatctgacatgtcacaatgtcaacaattacacctgatcaagaaataagctattttcagttggaggcatagtgttattatccaaaattaatcattcattcgatggttaattagtggccactggtttctttagcacacacatcagtagacactgatactgagcaagttgaatccatctgtggcgacttcgatgattgattagtctaaatgcacaacaaaatccaaacttctcccaacatccctaaaatgacacatcagtaatacccttcattggatagttaattagtctataaatgacaccatcacgaaactgctaccatcaaagaaattctatggaacatccctaccagtcaatttcaaggagtctgcaaggaaaatcagtgagtagacatcagtttacctatcacagaaatagagaagaaaacaaaactactaccatccaattattctttttccttctactagacataacgcaatgaacattataatgcacaaagtttcagaatcaattgtatagtagatgtgaatcttgagttgcctgaattttaagaagatatagaaatcatgtatagtggatagacagatatatttccgagttgagctcgcttccgtgtggaccgtgtaaaaaaatggcataacagtgaacccaaatccatcaccaattcacaatcggctcaaatctgatttgaggagctgggcatagccgcaaccagcagttgggttcttcatacgcaatcgacaagcagcaccatgttcaaggccttgttcttgatggtggatgaggaggagcccttgcagttggagacggagataaaccaagaaacaaggaccaagaaccaaaccctaggtaggataggaagaagagaggagaaggaagagagactcaaaagtgagaaggtggccagcggaggagacggtcgccggaggggagagcgccgcgtcgtcggagcgccgtcgaatcccagtcacgtccgtgtcaaggagcaaccactgtccgagggcgctaagtcagttgcagaagacgctggagatgatgctgattccggaaggagggaagatgaacttgaagcagctgaaggagaagtggtgcgccgtgcaacaaggcccgtcaagataaacctgaagtactatgggcctgactgggccgtgtaattaagtctaattcctgtaatagttcttcgtgcgagaggggaaagaactgagtaggtgaggaagataagagagagagaacacgaggtgaactctgtctttggcgaccatggtggcgtaggcggcggtggctccattcctgtcggaatcggagaaatatctcagtaatagaggtgccaattccttcgtgttctaatccgtgcgttcattctggattgcttttcctgtgcaagttcgttaacaattggtatcagagcctctacgctccaagaattccttggcgcggttgtaaaattccagggggaggattggaattgttcttagaacagattccacaataaggcaacttgccttctcttggttaactgagttcgggaaggagcgggggattctagatctagttgggttcgctcacaaattccaggatgtcgcaggagagtaaacttgatgtcttgttgagaactattgaggagaatgagaagaagagaatggaggcggaggcgaggactcgggatgatctcgctgatctgaagaagatggtggagatttgtcttcccaagatggaggagaaggtggaaaaactcagcgagtccgtgcagacactaagccacaaggtggagctgatggaaggtggcgcgatcaaacaagaaaccgctgcagatgcttcagcacaaggaactccatggttgcatggtaagcggaatcctcctcccatctcacctagtccattttctccggattctactgtgcaatcaccaacttcttctagcatcacaccgatctgagtactagtcttcctcctatgacttgccctaagtttgatggtgagaacccacagatgtggaagagcaattgtgagcaatactttgatatctatggtattaatcctatgcattgggtcaaggtggccacactcaatttcagtggtaatgcagcattttggcttcagtcgatccgttctcaaattatgggtattacttggcaaactctgtgtgacttgatctgtgctagattcactagagatatacaggaagcactaattagaaaatggttccatgcgcaacagaacagcacagtcactgaatatgttgaacaatttgacagtatcatgcaccagctaatggcatatgacagtgctctcacccctgtgtattttgttactaagttcattgaagggctcagggatgatgtcaggggtgcagttatgctacagagaccccaggaccttgactcagcttgttcaattgccttgctccaagaagaaatcctggaaagtaataagtctactacacacagaaggtctgataatcacattgcgttcaggccagtaccaaaactcaacaattatgtgccagtgcctccaggacagagatctgtagctgttagtgcacatgatgacaaaaagggagtggaatctgctaagtccagagaggacaaatttgcttctcttaa

SEQ ID NO: 54221 - DNA, 982 bp, Oryza sativa
gtgggcctcattcctttaagtagatctgtaactgtgaaaatagcagatggtggtactatgaagtgcacacagcaaattctggggtgtggttggtggactcaaggtcattatttcaagagggacttcaagctgttgaatttgggctcttatgatgctattcttggcatggactggctagaacaatttagtcctatgcaggtggattgggttaacaaatggctagaggttgtgattgatgggcagcctgtcagactgtatggtgttactcatcaaaccgacagatgctcctctattactcctgatcaatgtttgggaatggctaaggttgggtcactgctatttatggtacagttgatgtctatatctcattctgaaaagactgaaatccctgatgacattcagtcaatcctagacccaagggattacccccaaagagaatatgtgatcatcacattcctttacttcctgggtccaagcctgttaaccttcgcccttatagattcaatccagccctcaaggatgaaattgaggcacaaatttcagagatgttgcaaagtggtgttatccaaccgagtcagagtgcctttgcatctccagcccttctagtcaggaagaaggatggcacttggaggctagtaattgattacagacaactgaatgccatcactgtcaagtgttcctaccccatgcctgtgattgatgaattgctagatgaattacctggggctaaatggttttcaaaacttgaccttagggctggttatcatcaaataaggatgaaggaaggagatgaatataaaacaggctggttatcatcagataaggatgaaggaaggagatgaatataaaacagcctttcacactcatactggtcattatgaatacaaggtcatgtcctttggactgacaggagctccagcaacctttcagggtgccatgaatgagacatttaaatcagtcctgaggaggtttgctctggtat

SEQ ID NO: 54222 - DNA, 26347 bp, Oryza sativa
attgggaaacaccaacaaccaaaaagaaactcaggggattcttgggtttggctggctattaagaaagtttgtgaaaggatttggattaatcagtaaaccaatcactcagttactacgaaaaggggtgccatataaatggactttggagactgaaactgccttccaacaattgaaacaagctctggtttctgccccagtgctggcattacctgattttagtttgccttttactgtccaaattgatgcttcagattcagggattggggctgtcctgtctcagaacaaacacccaatagcctacattagcaaggcacttggtccccgaaatcgagggctatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaaacaataaagatctaagcagcggaaaaataagataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaaatgcacaggataacaaaggatggcatagtagggtttcatttgcaaaagcagcatttagcaaacatttcagaatttaataaaacagttaagtattaaacaatattaatccaacgctacacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgggactaatcacgacagacattgttagacccgcccataaccgcgggcacggctattcgaatagttttactctgatcagaggtgtaccactgtacccacaagacacaaccccacatcatgtcaccatgtgcctcaataccaccacggtacctcggaaaagagttgtgacaataccccttgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcattaaataatagtgagtcataagttatcccaatagtgtgctaatgtttctaatcagggctaagcaattatatctaatatctagttgaaccaataaataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggatctaagatgaattagttatgaatttttaaagattaaatcggattaaaacacttaaactgattttaattgaattatgacccaataatgaattattttttgaaaaggaaaagaggatttattgcgtcagcgggctagggtttcggtggaccgagcgcacggcggcggttcacgcgaacggacggccgagatcgacttgatccaaaacagacggccgagatcgatcggtccacgaccggtcacgggagagggcgacgatgacgtcggcgatgacgtcaccaccggcggcggcggctcggcggctcggacggcgcacgctcgccggcgaacggcggcgcttcggcacgaacggaggacaccaacgggtagcggacggcacggcgaactcaccggcgaccaaagcgatggcggaagaggaacggacggtgacggcgacgaggaggaagcggcggcaaacttcgggttgacggcggcgacggtgctccggcggtcttcggcggcggcgaaggagtggacgaggacggcggcgacttggcgaccacgacggcggtcttcccgagcgacggcgacggctggaacggcggcggcgcacggctggagcgacggcggcgacggcggcgctagggcacacggcgctagggcgtttccgacgacgagaggcgaaggcaaaggtggcggcgggtagaggagacaccggggagccttttaaaggggctaggaggcaacggcgaaggcccacgtcggccggcgacgagaaggaaagttcgggaaaatcgaatccgaaacaaactcgaatccacgaatttccaaacgatttagccgatgtttccaaaggagaaaaggtagaggagatctcgaagatcatttcccttctattgattcggccggagaaggaaaggatcggccgaattggaaagcggcggcgacgcgctagggtttcggccggaggaagacgacgatcccgacaggtgggacccacctgtcagcgacagcgcgctcgcgcgggcggctgcggctgcggactgggccggctgggccgaggagagagagagaggggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctggccccactttatattggaatttattaattaaaattagatcttcttttctaggcttttaaaataatttctaaaaattccatttaaacaacaatttatatattttgaatttttagggtgtgacaggctatcaacttatgagaaggaatgtatggctatcttgttagcagttgatcactggaggtcatacttgcaacttggggaatttataattctaactgatcaccatagcttgatgcacttatctgatcagcgtttacataccccatggcagcacaaggctttcaccaagttattgggcttaaactataaaatttgctatcgtaaagggaccagcaatgctgctgcagatgctctatcaagaaagtttcaaagtgattctgagttgtccatcatctctagttgtgttcccagttggttgcaagaggttgctaaggggtatgaacatgatccctattcttctgatctgctttcagccttgtctgttcagcttgactgcaaacctggatttcagttgcagtctggaattattaagtacaaggggcgcatttggattggtaatcatccttctctctagtcacaattgattgctgagttccatgctagtccaatggggggacactctggttttccagtcacttacagtaagatcaagaaactgtttgcttggcagggtatgaaatctcaagtaaaggattttgtacagcaatgtcaaacttgtctgcaagcaaaacctgacagatctaagtacccagggcttctacaaccattacctgttcctgatggatcttgggaagtcatcatcatggactttattgaaggtttgcctaagtcaaagatcttataactgcataatggttgtggtggataaattttctaaatatgcacatttcttgcctttggcccaccctttcactgctcttgaagtagccaaggtgttcatgttgaatatttataagttgcatggtctaccattggtgattatatcagatcgtgacaaaatttttactagccagctatggacttatcttttctctgcttctggaacaaaacttaatctgagcacttcttaccatccccagtctgatcgacagacggaacgagtaaaccagtgccttgagatttatctgcggtgttttgctcatgccaatccttctaaatgggtcacatggttgcacttggctgaatattggtacaatacttcttaccattcctctttaaagacttccccatttgaagtcctatatgggcactctcctaggcattttggaatcaatgtggacacttgtgaaattcctgatttgcaagaatggctaaaggagaggaaactgatgcaagcattggtgcaacagcatttacatagagcaaatcagcaaatgaagcatatggctgacaagaagagaagtttcagatcttttgcagttggagattgggtatacctgaaacttcaaccttatcggcaatcctcagtggcactccgagctaatcataaattggccttcaagttttttggtcccttttaggtgttacggaaaattggcacagtagcatataaacttcagcttcctgcaactgccagtgtgcatcctgtctttcatgtatctcagttaagggcggctaagggttataaagagctttcatcacttcagttgcctaaagctaactctgctctgcaagttccttctcagattcttgatagcagggtggtcaagagggctaccgatgctgttcttcaagtgctgatccgctggtctgattctgcagccgaggatgccacttgggaaaacatggaggacttacgcactcgatttcctactgctttggcttggggacaagccaaatttcaaggggaggggattgtcaaggagcaaccactgtccgagggcgctaagtcagttgctaaagaccctggagatgatgctgattccggaaggagggaagatgaacttgaagcagctgaaggagaagtggtgcgccgtgcaacaaggcccgtcaagataaaccagaagtactatgggcctaactaggccaagtaattaagtctaattcctgtaatagttcttcgtgcgagagggggaagaactgagtaggtgaggaagataagagagagagaacacgaggtgaactctgtctttggcgaccatggtggcataggcggcggtggctccattcatgtcggaatcggagaaatatctcagtaatagagttgccaattccttcgtgctctaatccgtgcgttcgttctggattgcttttcctgtgcgagttcgttaaccgtccgctccaccgccaccgctttccctgcgcgctgctcttctcctgtgcgcgagggtttttttccactccatatgggtagctgtttctttcccaacctaggacgagggggaaaggccggatcggcctcgattcaatccgcgacgggattaaccgaatgcaaacttttctgtgggccgggtttcaatccgcgtctatccaatccacggggattgcagcccaatcccggccaaacccgggccaacctaacaaggcctcaaagggatgcccactttacatgtttttacacttttacttctcaaaagatgttacatacttcctatgtcccaaaaagaatcaacctctagctgtgtatctacgatataggctatatccgaatacatagccagaagttggcattttttgggacagagggagtatatatctatatatttatctataaaagtgaacggtaaggacccctttgaatcgcagagttgaaaagattggaggaatagaaaaaacacaggattctaataggaattgaagtgtaaaacagaggattgcaaaacataggaaaaatacaaaaatgatcgtttgattggaccgcggtaaaaacacagaaatcatatgagagagatagattcaaaggaaattttccaagaggttggacctcttgctaagtttcctccaaaatctatatgctatgtgtcattccataggaatttcataggatttgaaaagtttcaatcgtttgaatcaaaggacgaaatagaaaaattttgtatgaaatttgaatcctataaaatttttatataaatcctttgattcaaatgggtcctaaatcttgaaacttcaccagattgttccacgtaatcaccattggatagagaaaaaggagatggcaaaaccgttggatttggtgggtaaaaagcagtaaaaaaatgttctggaaaattccagtgtattccctcaaacatggaagttaggagtagcaacaaacgaaatactaaaaaaagaacaaaatgcagcgccgagaaaattaactgcatgaccaaggatgggcctacttgtaaagcaaatatactgatgtacctatatagtagaagagttgactttctttgaaaaattagctatataattcattgttacaattagtccaattaattttttactgtgttaatctatctacctattatatatttaaaaaactaaaagtccattaacatcctacaaacgctattaaactcccatgtggctctctaaaataagaccaaaggaaaataacaaatccagtctatttaaggatatacttaaaaatatgaaaccgcctagtcgctgtcttcacggtttttctttgaagtcagtttgatcttggtaaactttcatacatgaatcgacctctttccttaattgaattcactaaaaagccatactaaattttggtgttaacattgggtattggcaaaatttgctacaggacactcaaagtttgtggcgtttgctgtaagacacccaaagaacgtgtattctctcgtggacactgtaaaaatgtggtaattagctgctagacactcgtctcattattttattattttcgatagaaacggagagagacattggttaaagacagatttgtccatgagcccacttgtcaatccctctttctctgttcatcttcttcctcctgcggcttcggatggggcaacggcgaagtgggcgccgccgctgcagcagcaactagagcacagggcggcgcggagctggctgggctggagcacggggcggtgcgggactggctgggctggagcacggggcggcgcgccgctgctaggagtcctccccagggctccgcttcggatggggtagcggcgaagtgggcaccgccgccgtcggccaaatccttgcgcgggacgcatgccccgtccgccatttccgccacgggtggatcgacagggatggctcattttttcattttttttcccttttgagatcccctcttctgttcttcctctccgtccttgacctcgcaaggagcagtagtgcgagcgaaatcaggggcatactgcatacctactccccttggggcccttcctgctcctgctggtgctgctcgcactcgctaaggggtatcgaatcaacgccgttttccagtttgcacacggctcggcttggcattgctgctgctgcaggtgtcaatacatacgttccagaacgaggccaacggggacatctgctacacggggctagcatgtacctggatgccatcgtgcttgcccttgccagatggagccgttggtctgctgtggcatggcagtgtgagaggagaagaaagaagaacagaagctggaagaaaaacagtgtcaggggtgttttggtactttcaatgctctttctctctccatttccaccgaaaataataaaagggataataaaataatgaggcagatatccagcagctaattaccacatttttacggtgtccacgagaaaatacacgttctttggatgtctcacagcaaatgccacaaactttaggtgtcttgtagcaaattttgccttgggtatttcaccactagtggagcagaaggacaccagttcattcaaatattacaagcagattggaatgagttattgcaacatgggagtatatcctttatctaccatgtgccatctaccagtacggcagtaccaactgaccaacttctaatataaccaaaaccctcattctcttgggctcaagctgtcattgttagccatggccgatggcaagctagagctggacgacagcgtcgccgtcgcaaggctggtcgacgagtaaccaacaacctccgacccaacggaggtcatgctgtcgccgtagtacttcatggtggaagccgcgaacggctgcaggtacactgccaccggcatcctcggcggcagcaccggcatcctgaacttcctcgactgcaacgcctccgccgcctgcctgatcgccggccgcgccttcgggtcggggtgcgcgcaccacagcccgacgcccaccacacgctccatctcccaccggtcgaacgcgccgccgagccgtgtgtcggcgatggcgtcgagcgacgactgatcatcatcaccccggccgtagagctcccacgcccactccaccaggcggaacacctgtccgccgccgtcgtcgtcgtccttcccaccacccgcggtggcagcggctgcacgaggtgtcactaccattggtcgcctcccgcttgccacctcgagcaggacgatgccgaagctgtacatgtcggactcggtggaggccttgccggtgatgacgcactccgggtcgaggtagcccggcgtgccggcaacggcggtcatggtctggaggctcatgccgtggtcgatgaggcgcgcgaggccgaagtcgccgagcttggcgttgaaggattcgtcgagcatgatgttgctgggcttgatgtcgccatggacgacgcactgatcccattcctggtggaggtacagcaccgcggaggctagtccattaataatctggtacctgacaaaaattagtcacataatatgatacacagatacagggaaagtatatttgattttcacagagaatttacatatgagtttacgtgcaataccgcgcttaatttcggatttttttagatcatatgagttattgtgaatttatagcattctttttagagaaaaactccaaattaactcctaactattacgatagtacgaatataaatgtgatgtggtaatttgtataatacatcaccttattactaactgttatgcgaagataaaatcgaactttcgatcagagtactactcatttttccccgtcctttccaatttgatctatcatatttgcaaatgttaccgagatcaacgcaaaaaatatcactccttttagaagtaaacctcatcggtcatgatgttgtactaggcatgtatgtggatatgaaaacgtgtagttgaattaatgtgaggtatgcaacgatgtcatttactcatacacagatgaacgaacatatatacaacgatgtcatttactactgcacacctaaacgaacatatatagaacaatgttatttacttctacacgaataagcaaatagataacagttagataatgatcgatttagaaactaagacgtacaaattttagggtatgattaattgggatagagccatagaggcagtagtaattactcccacctttcaaattataaggagttttgatcaaagttaaactactctaagtttaaccaaatttataaaaaaatagtaacatttttaacataagacaaatatattaaaaaaatatattcaattatagatttaatgaaaataatttggtgtcttattatattgtttataaacttaattaaatttagagtaaaatgattttgatcaaattcaaaacgaattataatctaagatggagtagtttatggttctcgtaggacaagaatcatcaacatctatctattatatactaaaagttcattaaacttcctacaaactcttctaagccgccacatagcactcctaaaaacactcctaagtcgctatgtggcgctttaaaaaattttaaaatccgataggcccattatttctagccattagatctattataaaaaatataattaaatttatctcaaaaactcgcatagtacgtgcacgtataggtattcccaaaaacaacaagtacgtccatactttgatacgtacactgggcccacatcattcctttttttttcttttttctttctcacttattagatggaaaaccaaactacctatatttataatcgtctcactttccagaaaacactggtggagaaatgctttctagtcccggttcataaccccctgtagtcccggttttccaaccgggactacgaatccgggactaaagatcgctatctttagtcccggttcaaataaccgggactaaaaatcaatctacctcatatactacggaattgggccgaccgaccaaagatggtttctccaccagtgaaaagacaaaacttaattatctacctcatatactacggagaaaaacgataaatcaaaaaatatatcaatatattaatagtaaaatcggaaagaaatactaatcaacaaaaatcataaacaccggcacttattgttgtcaatagcctttcaactatgattttgttaaaaataatactatacaaaaataagtagggggcaaaaattataactattttcatcacctcctcctttttgtccctccatgtccttcaatgcagcgtctagtgtttactatgccatcgtaaatattacaggcatatacatatggttgagttaaggtggcgtcagtaaaagatcactataggcaatgtatctaaagtgacattcttactaatgcaatcctttgtgggtgtgctcatagtgaactaagtgttaaaatggtgccataggctggtctttagggtcacggctacgtcgatgtggaaccaatgtttcagggcattatataagaaagctttggtagatacagtcgatgatgtggaaataagtgatgaacatcgagttaagtagtgtagattattttttagtgtattaataatatataatttattttagtggtactaatacagtttcatttattaaaaatgcacatagcttttaaaacaataacaatagaggagtttatatatgaccacgacaaaatgatttttatttaaatatgagatgtattcttattcttatcatatttagtagtatattaaaatataccatctattttacggtaaatatatttcttttttattgtaagaaaatttacattcccttacagtatatatatatatatatatatatatatatatatatatatatatatatatatatatatatatatagtgatgtatgatttattttaccattctttttcttgaacaacaaataagatgtcagtgtatctctgcgggctttattttcagtttatattttgaaaatgttttctgatttatattccatccttatagtgttttgaaatacaatctacgatacatgcccacgtaaatgggcgggctcccttccttgttaatcataagagatttactcccatccagcagctctcctctgtcatttactgattactataatttgagtgacttcaaatgttcaatacccttccctattctcttttccggttcccaatttagacgactagatttgattttgtaccttccgatactattacctaccggtacaatccgccggactggagcaatcatctactcataattcatgcacccggacgccgggactcggggacacgtcaccatccatggttaatgtattttcatcagtccagccaaattgccctgttgatggaatctacaggcagcgctatcgtaaatgcggccaagatgtgggccccacaaaagccacttcgtcaaggtaggaacacgcctgatcgatggtaacatgggcacatacgtacgtacctgagcggccaggtcaaggtctccttgttgctgtagaggtggccgtcgaggctgccgttgcgcaccagctcgtacaccagcagcagccggcggcggccatggcaccaccccatcagctgcaccaggttccggtgccgcagccggctgatcaccgtcacctccgacctgtactccttcctcccttccatggacgccccccgggtgaacaccttgatcgccacgtcccgcccgagctccctcacgtgcccgccgtacacagaccccgacccaccctccccgagcttgccgatctccgcgaacccgcccgtcgccgccgccagctgcgcgtacgggattcgccgtggccccgtgcccgactccatgtcctcctcgtcgtcgtcgtcgagggagtcgtcgtaggagacgccgtcgtcgcgtcggcggcgtttcctcgctcggcgaatgaggatggtgatggcgaggacgaggagtaacagtgctatgccggctgcggccacggcggcgctgagatgagccgtcttggctgacgaggtggatggcggcggcgggttggtcgtcctcgtcggcagcgtcgagctgaaggtgaaggagagcacggtgtggttgctggcgaactggtcgccggtggccgccgagaagcctacggcgacctgctccggcagcacgcttcgcaggtggacggccgcggagaggttgtacgttgcggttgcggcgccgccgccgatggcgagggcgacgtcgagccgcctcgcgccgctgtcgtaggacaccgtggcggacatcacgccggcgtcgacgaggctgtcctccggcaagaccacgtagttcccgcggcgcgagtcgacgttgttgatgtcgacgccgacgtgccggccgctcgggtcccacccgtccatgtgcgtgtcgaactcgacggcgacgaagctggcggcgcctgaggcgttgcccatggtggcgctcgccgtgttcctcgtcaagctctggtcgaagaggccgaggcatccctcgtagcactcctgcggcatgtcgggcatgaacggcgcgaggaagaacgtcatgccgtggccggcgagggcgttgcccctgccagccaccgaccggatggtgaagttgaagctcgcggcgaagctggcctcctcgccggtggcgccgtcccagagctgcaccggccgcttgtacagcgcgcgtcccctggcccgcgccgcgaactcctcaccgagcagctcgatccggccggcggtgaccatggcgtcgtcctcctgcctgaaatcttcggagacgaaggagtccgcgtcatagctgaaggtgagagaggtggcggggacggcaacgagcagcaagtggagcaagagtagtagtagctgctgctgctgcggcggccgcggcgttgctttgctgcttgaggaagacgaagggtttaggaggacagccatggaatggtgctaccgtacgtggttgcagtgcagttgcactgccacgatgacttgttcatacgccctaattagttaaccaggcatcttgacttactgccacgatgattttgatcgcagttagacagttctcagttgggtcccacataattattaatttccaacaaaagttggagattacttctgtccggtcgcctgaggtcgacaccaaaattcggagaccagaatgctcgcgtgcttgcataatgagtctgtagagtactactgctacggagtagcaaagcaaatagacaaccttattggtgggtgtaagggcattctcaatgtacatgtaacaatgggtagtaatataacggtcgggctcagtgaaaaagaactagctataacaaactccacaatggttaaaacctatgggaggaaataagatgggtcccacttagtcaaaatacagtgcttctttgaagtcttctactacctccatccctaattagtgatcactttgacttttttcttataatgtttggccattcttcatgtatgaaaaattaatgcaaatataaaaaataataagttacactcaaagtacttatgataataaagcaagtcacaaataaaataaataataatttcatatttttttaataagacgaatgaccacaaattataaaaaaaaaactcaaaacgacaactattttaggacggaggtagtattactcaaggaatgaattgactccctcctttgtgcagtacttttattcttttttttttctcttgtgaccaagccataagcttacggtcaactttagcatttaatggcctattgttacgttccacaatatttaaggctgagatcatttggagaatatgggaacaaatctcctacgcatagaaaacggagtggtccattagcttgtgattaattaagtattagctattttttctcaaaaatggagcaatatgattttttaagcaattcttgtatagaaactttttataaaaaatacactgtttagccgtttgaaaagcgcgcgcgtagaatatgcgggagaggtattgggaacataggctgccgaacacaacctaaggctagtcacaagctgccaactcaaccttatgacccttgttatgttcacattggatgccctatgttttcgtaaaatgattttatctcatatgttacttatccaatcgattattcgattataccgttatttttgtcacaattaaatatttacaataagatatcactcaaatatatttcgatgaaaaaatatacatgtttcgatagttgaagtcaatgtttcacctagaaactgactatgttaattgcatattttttaagttttttatgttgcaatagttatttggctaatgtttcacatcatgtgtatttagatgtttaaataaatatattatgatatttcactagagcattttaaaatgttacacgtaatggtgttatatgtttcagtaaatattttatgatgtttcaataattatatattaaatgtttcaagtataatataaaaatgtttcaattagaaatatggtatatatattattcaatatatagtcatgtgagagcttgttgtacgatttaatatcaaagaacacaatggtgtaattgggtcacagattgaatcattaatttaccattaaaaatagtttaaagtttgagaaaggtttatattagaaaaagaagaaacatgttgagttacacatgcatgaagaaatacgaaaaagaaagttgttgtattagcatgcatgcagcagaggaggaaaaatcaagaagaaagaagctgtacaaagagcgagcgcccgatatcatattgtttttattggtcgactgatttgttgttagccccacaaaagttacattatcatgagtaaaaaagtcgagtcgcagcacgccacgtgacaggcaacgaaataaaacatatcatggtagtggggtttgagtatgctatgtatttggggtgggtctagcatggcataacatctcttcatgcctaattatgtgattactttttttgtttcttcagttataaaccaaatccatgctgccacacaaattttactttactagattcgttcaattggattctttttttcaaaaaaaatattgggtgctgcatgatcagcatttttaatatctattaaagtttatgcactaaactttctaattgcaaatataaattttattatggacatgaagtctatatagaaacattttatatataaagtctatatattgaaagttcatatacataaaatctatatagaaactctatatatgtaaagtctatattttgggcttcgcatatataaagttaatgtatgaagaaagtctccacaaaaataattcatattaaaaaattccattaatagaactataaaaaagactaacaaaagaaagaaatatgaaaaaaaggaagtggaaaaaacaaaaaaggtttatatgtataggaggatcacgtgaaaagaaatggaaaactgggaatagaacaataccacttcatggttcatcctctaatcatcctcgtatagatccgtttgcgagattatcggtgggtgaaagttcactcacaagccctaccgatgtatttgttgctggtgctaaggatttttcgttggtaatttaaagtttttttcttgctaaattctaagtatccacaaaaataatttgtattaaaaattccattaataaaactataaaaaaataattcatattaaaaattccattaataaaactataaaaaataattcatattaaaaattccattaataaaactataaaaaagactaacgaaagaaataaatatgaaaaaaggaagcggaaaaaacaaaaaagcttgatatgtataggaggatcatgtgaaaagaaatggaaaattgggaatagaacaatactacttcatggcgcgtcctgtaatcatcctcgtatatatagatccattcgcgagattatcgatgggggaatgttcgctcacaagccttaccagtatatttgtggctggtgctagggatttttcgttaatacaaaaacgaaaaacgattttccattaatacaagaacgattttaatgtatttgttttgtgctaatttccattaatacaaaaacaattttaatgtacgaggacccctataggttgtaggcagatcataattggttgcttctgcaaaaatcaacctctattttcgcatgcagcttctcaagaggctcgtatgcaaaaatatattttcgttggtggacctattaaggggccacatgcaaaaatgagcctatttttgcatgcgggcgtcttaagtgatccgcaagaaaaaaaaacttcctctcgtccaaaattttttttctcccctcctctcttttcccacttagccacttcaaatttttttcacctcttctcctctctcttcttttcatttttccacaccctctcaccttatctccttactccctcccccactcatttttctctcctcctctcccacttcctactccaccgctgggtgggagtgatggtggcaggagcagcaggatgctcctcggcttctcctcttgcacagtcgggcgggagcgaggcaagagagacttgtgctggctggcgggaggctcctcctccaccgccgagcgggaatgcggcgggcgggagacgtggcaccagcggatctggttcccccctctccctccaggccggatgtggccactgctccgcccctcatgcatgcggatccagcggtagcggagcggatctggcctgggcaatggtggagcggatctggcacgtccacatgcaaaaattgattttagccaaacggaaaaaatcaatctgtatacatcactcagctttggttttaaacaaaccattgtacaaggaactaatacttcatcctcggagtattttgccttgtgggtaatggcctagctactccttcctatgttgattataccatttttgaaaaaaaaattaacaatgtaacagaacgataagtcatggtaaaaaaatactacagtgggcaaaataataatacttaatttgataggtgaaaaagaaactatagtaatagtatataaagtcccaggaccacaaaaatctagcctttacattttatattttatgataaattagtgcaaagacaaaattcttgtactacgggcagagggagcagctgaatttatccatagatgatgtggatggcctcgccttctactcttgactagtgtagcaaggaaaatttatactagtccaagtctagttttattccatagttggattgagaagtgttaggttggacttgcatgccttttcttattaacacgcgagttttttctacacgtagccatcgatcaaatggatatataccatctttgtttcttcctttcttattttctttcattttttctacaacggaggcatctgttcttttgaagggcctgaatcccgcgacccactcacgtggataggccgagagtccggatttgggccaggttcacggcctgtgtgttaaacaggttcaccctactgatcggtttataaaaaacgaataagctcatctgagatctcttaacttgtcgacgaatccgatttccgtccctcagctggaaaaccaaacacaacggtcccttaactatcaaaaccggtgcagataagatcccttggcagttttgagggcggttttagctgacgtggcgcctacgtggctaatttgacttggtcttcatctgacgtggcactgatgtagcgcctacgtggcaatttaatctggaaaaataataaaacccatgggacccacatgtcagctccacacataaaataataaaaaatggtgggacccacgtaggctccacatgtgatcctctctctcccctcttctccctatcccttctctctctccggctgatggagaggggcgagcggcggtcggcagaagcgggcgtcgcgcggggaggagctgggcgggcagcggccgacggcgggtgttggtatttcttacgtccacagataaatccgcaagagcacggaataccactgtagcacttaaccttcgggtgaccccaaaaggatatcgaactcagggaacgcgtataatctacctaaggctaaggctatccaaggacaacaactgatggtaggtaggctagagaggactttctatgagtgttaattatataagctaagcaaaggtaattttctatctgttgcttcgggcaccgacccctgctggtctgccagcgtggttccggctatagctttatgatgtatccgaatatggaggattactgggacggaatttaaggctgtcaccacctgccgcctatctctgacaaatccgtgggaaggtaatctctaacctagacaccacgtctaagttattaattactactctaatacttgcgcaggaacttccttctctatccagagtcctagtactagagcacttagtacaaatactaaacaatgaacccgcagagatggaaatcttattttacttagacaaagtaattaaataacataagaaaggaacacgaatacttactttatagaagaagttctccgaacctggagcagagtgtaccgacagctccggtactcctccggaattcctcctaagaagctacactcatcgaggtagaagtcggatgagcgccaaacttccgggcactcctcgagagcttcccctcactctctaccttattctaatgaacaaaagatacaatagagtctcttgtaattcagctcaaagttgtgtgttggaaatgagagtaggctcctccttttataggcaggtatgactgttacagcctatgcgaaataaccaagctaccccggaaccaccatcaggaagtaatcagggccgtccacgtcgaatctcgcgatcaacagcctcataagtggttcggccgaacccaggagggctccgttggacctgtttttcctcctggacactaattttgagaccctcagcccattggcatgatggttgggcccatttgcagttttttaattgacttatggggcctccaatacgtgtaaatgtatcctgaatgcacagaggtgcagtttgtcgctcgacggatgtgttttcttctcaaaatacctgtatatacatatttcaccaacactagtggaaataattagtaataatccttaccactaagttggacaccatgttttatttcattatatacaagtattgatagtcagatattatgatttaaggaaaataagtaagaaggagcagtagtagtaggaagccttaagtgacttcgttcatttacgttgagatagacgagtaactacctttttctattttagtcaccgtggtgggcagccatcacgatgagcgattgctgttcttccagcagcgccttcttcctgttttcaagaatgcggatttggttctgaacaagaactatatcatcttgtatgatcactgctggatcgacgaaagccagaaataaaggctccccgaggacacccagcatttgctctagttcgagcttagtgttttctatatcagcgatttcttgaggaatcgctgatagtcttgcagcgatatccatggctttgactctttctttcttgtcccgcaaaatatagagtgcgccgaagctctatttataggcgagcctattctttagcagaagaatttcttattagaagtcctttttttaatagactgtaacatagataatttgcccagaattcatgtcctccattagtgcgaaaaagaatgaatcccttgagtccggcccccccccgggtatcgacacgcgggacagcgggctaggtcaggtccgcggcacgcggggccatagagcgcagacggcggcgactgccggcgttgtgcagaagggcgtcggcggcatcggcaggagcatctcctctgagtactgaaaccacgacgccgacccatcctccgccatcgccatcgccatcatcgtcgtcctttccggcctcggtggcttccgcggcgcctgtctgcatgacgacgtggccattgcagtgctcagatcatcaggaaaaagcaagataagagagatattcttcttttcttttctcaaaagagattcaccatcaggaaggatgatcacttgagcactagcactatataccagtatgcatgcatggacgatcaatcgataaagaagaagaagagaactgaacagtaaattcaggattggggtgccaaaatgtgtggtgggtgagaggggaaacctccaacctcagataaaaactataatatctatgaatctatctatccagttgacttgttgaaacacacagcaacaacacacaaaaccaaacaaaagacaagaagtagaagaaaaagagatatggatatagtcatgtagtagtacaaaagaaacaagaaactccatctacctttgctgattgattctgaatctggttgtttcagatatataactgtaatctgaaaaaagcctctgcttcctggtgatcagctcacacctgcagctctctctctctctctctgagctgagctgagctgagatgacaggagatgagctgagctgaggtgtgaagtgagtagaagtagagaaggagatgctagttgcaattgcgaaagaacaagggcactgtgtctttttaacagggcaagatgatgcagaaacagcaacagcagaagcagaagcagcgccgtgggtgaactggaggattccctgcggccagccattctcctgcagcgcctccttcttcgcggggagggcggcgatggcggcctccatctcccccatcgtcattcggattgccggcggcggcggcggctagccccggccccgcggcgaggtccgtcgcgacgcccgatgcagccccgccctgctccaccggccagccgctccgtcccgcctgtcgcccgcttttgccagccgccgctcgccctgctccatcggtcggagagagagaacggatagagaggaggggagagagagaatagagagaggagggaggagtgaggatgacatgtggggctcacgcaggtcctacgattttttttattatttcgtgtgtgaaactgacatgcgggtcccacgggttttattatttttctggatcgaattgccacataagcgtcgcgtcagatgaaaaccgagtcaaattagccatgtagatgtcacgttaaccaaaaccgtcatcaaaaccaccgagggacctcatctgtaccggttatgatagttgagggactcattgtgtatggtttttcagttgagggacgaaaatcggattcgttgacaagttaagggacctcagatgaacttattccttataaaaccgagccgttttagttggtatccctataaatgtcgtttggtttccactggtttttctcagttttcggcaaatcaatttgaacagattttctcctcgaaatggtaattaaggtaattatccataaaattttgtatttctcggacaactctctacacgaattattgaactgtcaaatcgaataattttcaactaaaattgtaaaattttcaaactcaaatataagaactttcatgttcataattacctggggagagttgaaagtttagtttagattaacccatcagagaaggccggcctgcattccggacgcatgcatgttacgaggaataagtccactttccggctgtaatttttatctcgaatttaatttgcatccctaaaccgcaatacccccaacttacaaaaacagttcaaattaagtcctctaatagtatggaaggttagttttactgatatggcaatttgacctagtccactcatgttgactagactcttacgtacgtgacaaaaatgaaagtggcccaacctatcattctaactctcctactcctaccttctctcttccccctgctctctctgtggtctcctctctccctcctcccctctctctcccctgcactcagtctctcctccatcaaggcatcacggtggtgatgacgaggtgaatggcggaggtggcgccatgtggtggtgtagcggtgtagattggaaagacaatggttccgacatgagtccagaccagcggtgtcgaggctgaaactccttggttgacgccggtgttggtactgccgtcaggatggtttgaagttgtattggcagatccttaagcaccaagccctccctacctggcgcgtcactgtcgacgagtaatactcatggaccggatgatttgagtattggggtacgttggaacagggatttgcgttgtatgacatcaaacaagcaaaagagacagattatactggttcaggcccctcgatgggtaatagccctagtccagttagtatgggattatatgaaaataccacatattacaaagaagtagacgaaactgacgattccgacgagattgtaatcgatggggatcaacgagatctcacggccacttggctccgagtactccggcttcgtaaactatgatgggtgtgttggcggttttggtcgatctcttccacccacgcctaggggttccttttatagcgtggatcatcttaatctctaagtcaaacctcgagacatcggatctggtacgatataacataaaccttatcctctccaagtagaactttggaaatcacttgactcgtggagatattttccataattagagataaactttcttaatgtatacgtgaacgaaccgaatgcgcgaaggtataccgtatatgtatattcgatgagtcgtaggataggaggcatgccttatccgtaagcttgacagcagccatggcggcgaggaggtgggctgagggcgtatattcgatgagtcgtaggataggaggcatgccttatccgtaagcttgacagcagccatggcggcgaggaggtgggctgagggcgtcggctgcggcctgtggcagcgacgggaaggcaagacgaggcgacgccaactaggggtgtcgaggaggtagtggtgacgatgcagcactagttgtgggggcggcgacgaggcaccaagcaatgctctagccgatgatgtggtagccatatctggcaaaggccaccaggttaaccctccccaccggtagcatgtaaggccgcagttgctccgcctcaacacctcgtttcacgcgcttcaaccagccttcacccttcatgcaggacggatccaagaggtaggcttcatcaggctcgagcctaccatctgatttttgcaaaaaaaaaattaattatatagcatctatcccatgggagtagctggagaaggcttggagaagagaagaggtgaagaactgtctctgttggcgcgaggaagaagatcaggagcgatggaggtagctgaaccggtacgcagtatgcataaaatggcccatttatcactttagcaaaagcccacttggcccatttgtctattttatccattgacttagggttttggagtctggaggctgcgtgggcgtggctgctggccttggctttgccctgtggggatttttttttgtggaaaaagtacaccgaaggtccctcaacttgtcatcgagttacaaaatcgtccctaaccataaaaccatatatatgacatctctcaacttacaaaaccgttcacttaatgtccttaaatggttttgaccccggttttatccgacgtggcagctgagtcagcgtgggacccacgtgagccccacatgttaggattcagcaccctctcttttccccctccccttccttcctcctctctctctctctaactttttctcttctccgggcaatccggctggcgggtggggagaaggtcactggagcgaggtgggaggaggtccggcggccggtggcgacacggacgcggttacatagtatttccctccggaataacgcggcggcggcaccacggactcatgcgatccacagtaggagctcatgcgggaaagcttcctgctcaattcctaagcttggggcgccgtggcgaattcgtttgatgagatggagggtgagttcttggagtacctgaacgtggtgcttcggccatggccgcgtgtggccgcctataggcggtcgcccccggcgacggcgtcggagatcgacaatcgcttcgttcagagatgttataaaaatcgatgcacaacggagacacaaattttacgtggaaaacccttacgggaaaaaaccacgggcgccgactggcaatcatcattatagaggagttgattacaaacgtaggggaataacaatgggaacgtcaccccttcctgtacggcttacaagagtatatataggggataaaagaaagacacctaataggatagacataaagtgctactaggaaactaatccgaatatattgtgggcccaaaattcggatcacatatttaacaagaaatcaaaagaacatcgacaccgtactgcgcccatcgattccgtcaagggcgccgttaccaagttcggatgaactgttgattggagagaagtaaattacatcgatctccattgctactgatcttgtcttgtggttaagcttagacagtgattagcattttgattttcttgtgatttgcccgtttctagtgtcgactgctgcgtgcagaggcacaaacaagtgcagggtgagcttgacctggtgcaggatgaggccaccgagtgccacaagagatcagaagaagcggaggccggcaaggcacatgcggtgaaggacctaggcggcaccaatgcgccttcttgatgagctaagacgaagcttggagaaggcgcaagccgagaaggcacgagcacggcaagacatggagctcgccgagctgcgtctccgagagacgcagcgagcgtcagcgagagccctgcggcgaagtcggaattcgtcgtcgccagggacctccatgccaccgccgaaatgagcatgcggccgctaccactgaggtggacgtccccgcttccaccgcccacctgtgcgctgcccctctcccaccgcccgcccacagctcctcccctcaccaccgctgcatcgcccgtggccggccgccgatgccctcgtcctctcaccggctgagtcaaagaagggagagagagatgaggaagggagagaagaggggaagagagagagagaggaggctgaggtggtagccagacatatgggtcccatgttggtcccacgctgactcagccgccacatagaataaaaccagggtcaaaaccgccgaaagacctattgtgaccggttttgattagttaaggggcaccggatatctggttttgcagttgaggaatgattttgtaactcgatgataagttgagggaccttcggtgtactttttccgttttttttggcgtcgagccgtcgacggcgtgcgattgccaataagatatcagacgattggcttaatgatttgatggtatgctatactgagcgagagatattcaaaagtattgatgataatgcaatcatgaagcgattccaagccttgaaaacccccaaaatatcctttcctcgtgaataaattgtaacagcttagtggtatgtggtatgttgcttcttttagttagcatttgtttacttctaccatttatgcaatactaattttgctcatttatatattcaggtggctgctcactttactctttgctaaggcccaagaaaattagcatcttaagtcaaggactcaaggtattcttttataagtatatttttctattaaatcatgtaagtgttacatttgaattgataatggcatgtgccttattttagcattatcaacttaaatttagacttctagtccagcctatcctcaatttttatcctggattcgccacttgggctaccttacactagtacagatccttccatctgtgacggcccataacaagactggaatttgcgggccgtcacaaggaagtaatttcaatcgggccgaagtttcgcccgattgagatatggtcgcacagccatggtatatcggcataaaactaaagcccatcacggatgacacttatctgtgacgggctatagttcaggcccgattgagatgagggtaccatatctcaatctgatgaaggacttgca

SEQ ID NO: 54223 - DNA, 1881 bp, Oryza sativa
acgaggattcatggagggctatacatgttgggtgaagcatggagagcaagaatcaggaagtggagcagcagcagacataagtgtgtgcataatcaggaagatgaaaatgagcatgacatgtttataccttctccattgggcggtgaaatggttgatgtggatcacgatctgctgcaagacatgttacgtgatgttgaggacctagcccagaatgagagagatggaatgaaattcagcaggttggtaagtgattccgagacgcctttgtacgctggatgcaaagcaaaacacactaagttgtcagttaccttgaacctaatgaaggtaaaggcaagtagtggatggacagacaagagtttcacagatcttttaggaattttgaaggctatgcatcctgttgagaacacattgcccgagacgacatacgaagcaaagcaggttctgtgtccactggggttagaggtccgtagaattcacgcttgtcccaacgactgcatattgtaccacaagcaatatgcggacttggatgcttgtcctgtctgcaaggtttcacgatacaagcgaaagaaaagtgctgacgaaggaaataagtcaaagaggggtggtccggcaaaggttgtgtggtatctacctatcattgatcgtttcaaaagaatctttgccaacccgaacgaagcgaagttagtacgttggcacgccacggaaagaaggaatgatggtatgcttagacacccagcggattcgattgaatggaggaatatagatcgaaaacacaaagactttgctgccgaccctagaaacatgaggatatgtctttgtacggatggcatgaatcctttcggtgacatgagtagtactcacagcatttggccagttcttattgcgaactataacctcccgctatggttatgctttaaacagaaatatattatgttgtgcttgttaatctaaggtccaaggcaacccggcaatgatatcgatgtattcctggagcctgttatcgacgatctggagattctttggaaagaaagtgtggaaacttgggatgcatatggtcaggagaacttcaagctaagagttctattgttctgcaccattaatgactaccctgcactcggtaatctttccggacaaactataaaaggaaagaaggcatgctccgattgcaaggaacatccacgaaaccggtggctgaagaaatcacgaaagatggtatacatgggtcaccggaggttgctcccggtacgtcacacatttagaagaaagaagaaaatttttaatggtaagagagaacttcagcctgctcccaaagatttgtccggagatgaggtccacaatatggtcaaggacataagcaatgagtttgggaagaaaagaaaacgtagcaagacaaaggagaagggtatgtggaagaaaaaaatccatattttggcggctaccttactggaaagatcttgatgtccgtcattgcattgatctcatgcatgtagaaaagaatgtgtgtgagagtttggttggcctgatgttgaatattcccgggaagacaaaggacgggttgaacgcgcgccttgatctacaggacatgaatattcgcagcgaactccagcccaaacgagatgcagagataggtaaagtgtacctccctccagcctgccacacactgtcggaggatgagaagatcgcaatgttatcatgcttgaaggatattaaagttccatcgggctattcagcgaggataagtaagtatgttaaattggacgatctaaaacttgttggaatgaagtctcacgattgccacgtgctaatcacacaaatcttgccagttgctatcagaggcattctaccaccgaaagtgcgtcacacgatccaacgtctgtgcgc

SEQ ID NO: 54224 - DNA, 5568 bp, Oryza sativa
  unsure (1)..(5568): unsure at all n locations
aatatcaatggatgctagtgttacacaaaccaaatcgagatcacatagaactaacgaaccagccagaagtttagtaggattatagatggaagtctcatgaatgctctgagagctaaatgcttccctgaagtgttcaacagaaattgagatgctctccaagcttaggcagtcacaataaaaaactgaaggaagaattcccgtggggaccagtcgagcggctgcggcgtacctggtcctcgaggtccatctgggtgggcttgcccttggcggccgggtcagagtcgacgtccatcggcagacggcggcggccacgcggcaagctggtggaggacaaccacgatgacggcagcgggcaggaagaagcgggaggaggaagaggaggagaggactgcaaggtggcctgccgcacgctgctctcctcccaccgccgccggtggatccgtgcgaggtcaggcgagggacgcccgccgccactggatccgggcggaggacgaccgtcgtcaccggattcgagcgggggacagccccgccgagcccgtcgctcgccattgccgcagtgcgtcgccgtcgcccgtcgccgcatccatccccgagcacaagccacagccgcaggggagagggtgggcgccttctctgcttcgtcgccgtcacctcccaagtctggtatcccctcccacacggcggcggcggcaggcggacggggaggcggtggtggcggcgatggaaacgaggcggagcggcttggctaactgcggtgtacgggagggctagatccgaaaataatggagagcgcggggaagaagcaggggcggtttctggggtggggccacagttgacgattactatacgaggagggggggggggggggtgctgcngggggtgtgttttaacgcctacacctcatatgtagtatagtatctatataatataagactattatatttatgactttattataccaggtattttttatgaaaaagtttaattttatataatgacataaaactaatatttatttacttattaaaacagtatatgtagcttttttttatgatagttcaacatattttctccagttgtatatattatataggaatgttttccaaaactatatttatcattttaaaaagtgctacacatactttttaatatatattattttttatgtacaacaaacttatgcatatgataatcacacaacaaattttatacttccaacaatacagtttacaaatttctacttatttctcacatattgaagggtaaaactaacttttctatacctattaaacggtcaactaatggtcaattgatggcaagggtacgaaagggatccaaatcaaaattcagaggtatataaaggagtgaagaaaattcaggggcatagaaggaatcggctaaaatttcaaggatatagatttgaaatgagtggacgaaaataggagtattgcaattgatgctagctttgagcaggaaatgcaaaagtgtttggatcttgattttgcttcgcagttaccatccactgaatttttggggccgttgttcaggtgctgtccaaatggaaggaagggagtaatacaagcaaagggacatcacaggagaaatgaagtcaacactatgcccatatcctaaatgcaattgtgatgctttgctgaaaatatgctcacggatattgcgctataaaaaatgggttgtaactgcaaagacaaatcaatatcccaacacttctatcatgttcctacttcctagcacgaagcagagtggagacatggactatagaaccatttttatgataatatcatgaatgaaaccatgcctggaagcaaatcacccggccggaatgatgaaagtgatttgttaaatgtgaaggtaactttttatgccatgacacttcatgttcagtcattagatctaggaggtttcaacttattggcttgggaacaacctgaatttaaagcaaaggggattgctaggaccggtggctagcaacaggtcaatacaagttgagttgttgtattaactcactatggctggcccaagcaagcacaaggaagagaacaaaggcaacaacaactgctttttcaaaggaattgaacaaacttttggccttgtactccttccatcttctaacaccaactccactactgtacataaagtactttggttcttccaaccctcaattactttgtgtactgatacctgctattatttgagttcgagaggtgggttcctaatggattccaacccaacgctagctagaaagtactaaaatatgaagatacttgtgaaaactatgtatgatgattaataaactgatgtcggcccaatatagaaactccttggttgcaatgtacaccactgtgaagtagagaatattcacacactatgaagaatttttcacataaattttaaatagtgtagagtgtttccttaatgacttctagcttgtgaactgatgtgcaattaacaatacaccataaaaccacactgattagtgtaaataaattaatatcaatggctaatgttgatttcaatgcgaaatcagatttgattggcaatgctgcctcaacagtgatggtggtaggggagcatgtccatggaaaaatgttactgtcaactatggtgaaaactgttggaattaatagatgggctaagacccattcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagagggggaacacacgcgcgctcgctcgcctggcaaggtagggcaggcggcgcgcgtgcctaccttgcggcgcgcgtgcacgatgttacgcgtcgaatgatccacaaaattggctcatcacccttggcgaaaattcggatttgttttgttttggaaacattccgaaaaatccggataagttacgcgcgacttatccggttcggttacgcggaatggagatcgtccgggcgccctgatcaagcgacctatctctatataaaccgagccgccgcattcacgcaaaatacacgaaatcaatctagggtttgcctcctactctgtgttgcgccgtcgcttgtggactactccatcccgcttgccagcgtgcaccggcgatcgggagagcaggtctccggaacctctgccttcgacgtcctgcaccgggagaaggcagcaataaggtttttgggaagcgcttcgcgcgactgctcccttttcgtccgcaacggctcgccttcctctccgctcgcgtcctgcgcgccttcgtcgacgctcgctaccgcgagtagttcctgccgagcaaccggtctttccgccatctcggtacgtgttcgatatgttgcgcatatttgatctgttcatgttttattgcttagtttacatgtgtagatctaatgatgcgttaatgctagtatacatctgtaatgtcatgatttatttatggaatatattaaatcattatatgcctatattctcaacaaaaacaaggaaactatgcatggcaatttgtattcatggtggaatagaatctatttaactagtactccctcagttttataatataagtcatatagttttgttctaagtttattttcttgaagacgcaagaagcgtatcattgcgtcaataggagaagaaataaggcgtccaaacacaccaagcactaagaagtacacgaactcgttacacgaccaaaaggaacttaaaaataaaaggccctagctgaggtctataattacaaagagccccttagtccctgccaaactccacaaatggttgataatcttggaggtactccattgaagacgcaatcgttcatatagaccaagctccttgcataatcaacctatttatacccttcctggtacttgcacaaaccataccattgatttggttccaccattcatcaaagttcacaaccataggttgtggttaaagagcccaagggacaacttgatgcaaaagggagaaccacatctgtctaaacacacataagataaaaaggggatgttgaatggtctcgtcttcttagtcacaaaagggggcattgatgaggatgcagtagacctcgtcatgctatgcatggcaatttgtattcatggtggaatagaatctatttaactagtactccctcagttttataatataagtcatatagttttgttctaagtttattttcttgaagacgcaagaagcgtatcattgcgtcaataggagaagaaataaggcgtccaaacacaccaagcactaagaagtacacgaacttgttacacgaccaaaaggaacttaaaaataaaaggccctagctaaggtctataattacagaaagccccttagtccctgccaaactccacaagtggctgataatcttggaggtactccattgaagacgcaatcgttcatatagaccaagctccttgcatgatcaacctgtttatacccttcctggtacttgcacaaaccataccattgattcggttccaccattcatcaaagttcacaaccacaggttgtggttcaagagcccaagggacaacttgatgcaaaagggagaaccacatctgtctagacacacataagataaaaaggggatgttgaatggtctcgtcttcttagtcacaaaagggggcattgatgaggatgcagtagacctcatcatgctaggtgatctgcattttgttttctaacattaactgagtttataaataagtgcatcaatatatacatcaatttagtttcattcaatccacaatattatgtcttgatagtgcatttatttgttattgtagatgttgatgcttttttataaagatcttgagaaccgcttattctgatgagcatcctaatgcatagacttgagaaataacattaacttcacttgctcaaattcaatgtttcagatcctctgctctcatcttgagtttgatgacggtgttaagtagatgatggcacatatatactctaggccgattggcccatgaagagaaggatcagtatattattctatggaacatatctcctaaccatcttctcaactgtcagacataggtgatagatcaagttacatgtataagtgaaagttataggtattgtcattatcatttggtaaaatattgacacaggtcacttaaacatagcttgtttgttggtaaacatagcaaaaggtgggagaacaccttcaaaaactggtaatttgccaaaggtcgacaccacatccattattttgttatttccagtccaatcggcgagatatatttcaaaaggacgatattgcccctcgggctagaagcttctaagctatctctagaatgaagaaggaatatgatatatggtagcaatatatttagggtaaaaaatgaaaacctattttttttaaaaaagggggaaaggttgcaaaatatactcatggcctggtttggtttggtctagttcgaccaaaccaatcatagtaacatatgttggcccgagggacaaatttatcattataatgggttt

SEQ ID NO: 54225 - DNA, 10990 bp, Oryza sativa
gattccggtgcataaaagagtttcaaaatagtccatacaagaagagataaatcaaacgtcagtcacaaataattcaaccaagtaaccgcattaaatgcaaccaaaataagagggaatataaaactcatatttgttatatcaaggtttattgtcatgattacaagtaataaaattaattacaaatagattttctaactcttctagagctatcaaaatataccaacaacatttaaaaagcaaacatcctttactgaccttcatgtgcgggatacactataaaacatatcggactaggaaaatttgatcatagataaagctaaacttgtcgtacgaaacgaaaatcaacagttttcagaagaaatattattttattcaagatagggttagctcagtcaacggtagaattttcaattaagatttaaaccaatgatttttttcgttattccgtagcaaaaccaccaatggaatgaaatgtgaatattttatggagtacatcataacatggtccactatcctaatattaaatagattgagctggaatatcaccaaaaccatccaattccatgttacatttcaaatccagtttaaattcactcttaatgtaagaaaccgaaacaaagtcctcaaaacagtatgatgagctgtggatgcttgcctttgaatatatgttcttttagttggttttggctgtttttttttctcgcattcctaattgcatttgcatgcattattttaacttggaaaaataaattaaatgccatctaatgtttgaaaaaattatggaaacaccaacacaaatactaggtggcatgaatagcctgcaataaaagattgatgattttatcacttgagttggtaccccaattaattcagtcaaaacaatcaagctcaatagaaattcgaataaaatacagccaaatttctgcacccaaaaccaataaaccatgcactgtaaaatttcgatattttttttatcataagctcatcaatcatcatggtatccatcacacagtaatttttgtactcactttggagcactacagccttgaggaaacttcaagcaaacctgcaactcaattcaacttccaagaaaagtcacttcagctctacctctctgtcctaccatatcaacctggttgggcgtgctactcatgagagggttaaaaacctctgcccttcttcatttgtagcacacgttatgcaccagatgttatcgagaatatctgttgatacgaccactaagttcccaggtgttgagaggaacacccaataacatcaattagaacttagcatataggagccttcccttatctagtaatgcattataccagtgaaggagccaggaatttcacaaagcatgggaaagtctaaccaaatccgctacccacatgtgtaatgcctatacgctcattttactactaattaaaggcaaaacaattttgttagttcaaaatgcatgtaaaattttcaatagttgaaagacaagatgattcgtataagcttgagcatgccatatgttattcattgtgatagggctcaattgcatgctacagggctgtaagcctataaggcttgctgcttgtacagcccaactagagtagttaaatctaatctacttggtttgtgcaggaagtaattaaatccatggattttaccgtagagaaatcagtccagtttgatagtttgcgttcatatagcctggacaactgcctgcccaagccgggtggtaaatccaccactgcattataccgtgaaagaaactgggaatcaatgcaacaacaatatatatcaccactatttcttccatttcacgacccatgaatcatttcagtccaagctagtttttgcaaagtaaacagggcaagcaaaaaaaaatataatcaaagaaaaagggataacaaaagaggaagaatacaaaaaaaacttcacaagcaatttgcatatgtttcaagtttcaataatgcagcagcttaatgtctgaacctgaggaagtgaaagttgcacccccactatgagttcaattattcccaaattaaatgatatcatcccaatctgaatgtcaccaaagataataagataatactacttcttaaaaacttttaaacatcccaagtatgcaaggaaacacatcatggaagaacttcttgatcctgtttagggttaaccttctcagcttctgaaaagtctggaatcatattcttgccatcaacttctaacgcattggggtcggctctttccacaccagtgaaagtgcaatcctcaatttgtactaaatcagccacattctcagcagctattccatccaatgtttcagttgaagtcacaacattcctggcatctgcatcacctggtgcagagcttgtcctagcccatttgccacctttccccttcccggcaccggcggtacgcttgtgaggctgctgaacttccaccttgttttcagtattatcaacattagtaacagaattcaaatcaacagattcagttatcatgtcctcaggattgttgcaacctccctcatccagattaccatcatcttggttctcccaagcagtgtcattttcatcatcagaatctacaagtgctgcactgctgccttctccactcaccctagcatgatcttccttctcagcttctttttggagtgattcaataacgttcataatgtcacggtttaccttacaacaaagaatacatcatctaagaatgggaaagatgactgaaatccctcgcaaaaaaatgactaaaatctatacaaaattaatttttgctactattttactgtacctgaggattctgtacgaaatcagcgatatcacttggacaagaagggcactttttaacaatctttcgtgcccggagggtccgaccaccacggcttctctcctctgtaagggaaagattatcatatgacccaagcaggcatttcttgcagaagttgtgagcacacggtgttgtcactggctcttccatcacgttcctacatatggagcatctgaattctataataaagaaaatatatgactgaaatcagtggaaatgcaatgccaagcagccactactatgaactgcaattcatagacaaaaaaaaaaaaaacctttcaacagcctttctctcattgacaagttatttgtatgccttgctgctccttgcattttcttgcctctaggatctccagttacgacagccttcctgctgatgggtggagtaatcatccacttccatccatctgttgcctataacaagaaaaaggagatgtcacaatatgtgcaagctaatattttttctgagaacataatacaacaacttacatcaaaatcccatgctgggtttcctttcctctcagtaatatcaattgcatttttcagctcttcgatatctggtaatggccttggatggtctccatgttcatcacttcaagtaaatatagaaaattaaatggaaaagtaaataaatagaataacaatagcaatgtatacatgagataagggatgtataagaaacctagtccatggtgctggctcgttgtcgcaccgcacaaagagatacctgcacactttgaatgtaccctgaggccaaaaaacaaaaactccaacaatcatcacttatattgataagttgataaactataattttggatacattcagttttgtaaatctaaaaaaaaaatcattgcagcctacacaaaaaatatctgtaatgtttcatgaaaactataaatacctgaactccagttttcctccagcatttctcaatcctatagattccatcatacctaacaccagactctggagcatatggtgagcgcttctctttaaaagaccttttaataaacaaacagaacaacatatacaaaaacaaaaattgggattactttttccaaagaaatgaaacaagattgttcgtattagatgtagtggaaacatactaaacgtaacactgaaagccttaaaagacaataaccttgtgtgagtacagttattcgcaacgtatcataattacataacaataatggaacaaataatatcttgcaacatatagaggtctacatatattctccgtgcattaccagaagaacgtccttctgtgatggctttgattttttgtgatggtcccggaagcaacccataggaaataatataatgatgattttacataaactaacactaaatttgtcatggatgcacatagagaaaaaaaaacattaccgtacaactctcacgggatagccatttaagcagctaacacgtaatgcagcattcagcttctcaaacttctgatcaaaagactgctccttgcttgttcgcttgtttccacttagatcccttcctccactgccaaatgtagaaaataatggattaactagtttttgataaaccacagaaacaaatcgcaatgtaaggtcaggtagtaatattaaaccttccagtatagaggaaccactctccatgatcttcatcatctaaataacctcctgagagggcaactgattgagccccatgtgtagattggccggcaatcccagcaatatgagggaaatgagcaccccactgtctaccttccattctatctttccaatggtccccgactcgaacaccgcggttcctccttgggtcatgatcttcaagaattggaccaaaatagtctggtgcaatagtcacaaatatttgtccacttgaagcatttgccattccagctctctttgctctttcagtagtgaaagctctgtcaggtttatcttcattttctttataatgataaaccgttgtttcaccagttgtgctagcattgtttgcagccttggccatgcggatagcttggactagtgccaagttaattcttagatcttgtgctactttttgtgtaataggtgctcggcagatcacacaagctcttttaccattttcaatccaccttcggaagcatttcaggcagaagttgtggccacatggtgtctgcacaatacatgtaagcaaaggaaaatattatgtgatgacaattgatggacatggatgctataataatggaatttgatgttcagcaaagtaaaatattctgaaacacaggtataaatggtgttcaaattcctatgtattcggttaattagcattatcttcataggataataatgtagttacatgaaaaataacatgaaaatgaactagccagataataatgagtctcagccgactagtctgtccatggaaatatatcctttgtaaacaataaatgaagcttccacaaatttcaatatttaaataaaggacggagataaaaagtaacatgaacaaaaccactttttgtgagatcattagtcatttcactgtgataaattatggtaccagacaaatgcatatgctatgaaacgaggcgttcttgctaacaaggagcagattaaaaattgtcgagataatacaaatatccaaaacacatatgtgcatggttgattcgacttagttgtgcatggttcatagtgggtgcaaatggcaataggtattgtattagaaagttatactgaatgcagaactattagctatgcaaggcaataggaggcgatcatatgtgactttggctacgaatatgtgcatgacatttttgtaatgtaaattttccaggttgagacagatcgatggcaacataaattaagctcataggaggagggctagcatataagcaacgagatgccatgcatgtaatgatcactgtccctatagaagaaaactatacatagctctttcctaactggaagatcctatagcctgataatcaagagagaaaggttcttaacaaggtgaaaattataaagttggcaagaaacatcgggaaggtgggtgctgctgaagagaggacacaactgtcgagaaggaagaggagatactggcaaaagtcaaaggagatcaattgcatccacagaggcatatctcagagcagtaaaacaggctaaatagatggagaaaccaacaatccagtagctccctgtattttcatgtatatatcatacttgatgtaatttgcagtagaagtacagcaattgtagatcaattcaaataaaatcagaacaacttaatcataatttatttgtgtgctaataggagcctatcttcagtgtgatctgagatctaagtaatggtacaaacttacactttatgagcttacatattatgacatgtagtgcctcatggaaacatttctatatttttctaggctgttccaaagcaaaggttgacagggttggcaaaagagcaatcatacttacagtgacaggtcgctctggaagcagcatacaaaatgagcagttgatgttcttgttcagcatagacaaaggattgttgctctcactgtcctctacgttttccccaacagcttcagttattgcagcccctgcatcaccggcatggccaagaagttcctggcgacgacgagccttctcttggatggacagcaccggatcagcctcaatcacacgaatcgcagcgatgaggctgctctccggacgaacaacatcagatggcgggtagctggctgtgacatcaccggagcaatctggacagacccagtgggccacatctgtaaggggcggtatgctggagaggcagggagtatgccatggcgtagcacaggtgctacaacgcagctgctctacctctgttgtaagcaccttgcataacatgcatacaccatcactagagcagggaagatttgatggatttgatgacgaagccatctgattacgcggttctctccccctctactctcctgaacttctcaactctctagatttcaaatagctaattttcagatgtcagactctcaatatccctagctttctctctatctctctctactatatagaactctttgtcgatctgaagtgagaggagaaggggatggggtggggaagaggtgggacatgtgaggtgggaaaggggagggggggtggttttatgctttcaagaaaggcaaacatgttcaacatgcctcggatacatctaatttattatgaaagatttggtcatacaccctcccttaatttataattcttggacataccctcctatatcatcgatatatgagtcatataaggtcactgacatataagccaataggttttatcttcaattttaatataaaagaagggggtaagtgacaaaattttgcatttatttattcttcactgggactagttggctctacattaattgcctctgtttttgctatgcattaattgcctctatttttaaagatttttcattcatggttcacaaatgtgaaatggttggacgatgtgagaattaattgtttccttatatgaatttatcctagcctattttctaattatgatatagttggacgatgtgagtattaattgcttccttatatgaatttatcctagtctattttctaattatgatatggttggccgatgtgagtattaattgcttccttatatgaatttatcctagcctattttctaattatgatatggttggccgatgtgagtattaattgcttccttataagaatctaatatagcctattgtctaattatgatatggttggacgatgtgagtattaatggcttccttttatgaatttatcctagcctggtttctattttttttgcattaataaatttatttgcatgtaaatagctaagacttgaaaaaaatatttatcatttcagcacaatgcaaaatttcataaacattctaataaatactccatccacccaaaagtcatatttcttttgtcaccaaaatcatggaggaattaactcatcctccacgtaacaaactaatgaagtatttgcagatagttgcttgggttctagtcaacaatttaactatgcacatgaaaactacaaatctgaccatctcaattggaaaaaaaaccaaaaaataaaatatgcttaagaattttggatagagggagtatgaagtagcatccatatagccatctgcacaaattatataattttgtcaaatacattggtgcctatttaaatttgttagtaaggttaaatgtagaatacaaccatacacggctatgcaatttttatcatgtgttcaccatgtgtgttcactgtgacctcctgcccttatagtaaaattaacagcaatgtatgtacaggtagcgcatgagtggaagaacctgccatatgttttcatccatttcacatctaatatttcagtcacttcttatatccacccttgtcaatgatgcctggggccatagacccacatcgagccaattgctgcacccctctcgctctctcgcctcctcttgcacaccgcaacctctagtagatatgcaaaggccggcgtatctatatatggatggtccaagttagaagtataaattgatcaaatatgcatcataatacattaataaagaagcttttttttcttttttcaaaattttattttcacatatatatatacatatatatgcattgagctaggatttttttaggtggtcctgggagcacggggacaatgaggaccacccctagatctgctatgtagacgtgtacatgagttcaatgaactcatggcccttcccaggtggactacaccctagccacactgttgtttgccaatggctagcacaaacggacaagccaccatgcatgtcttgctttggttcaccgacaggccggtggagcccactcgtagtcagttattacctacatagtataagaaaactacttagtttaccaccttaaagagatcaagatttctatatatagttgttcatgcataaccattatttctatcgacaacttaatcagatgtatgtatgtagtccttattttcctaaaaccagaaaagcaaaaacccagaaatcagcggccgactcctgccgatcaaatttcggtcccataactataggtgactgacgttcaaagcggaagataactcggagagtaattgagttatataaatcagtcattcatccaaatgccaccattgccatcaaacccaaccaacacagacatcgccataaggatgccgcaccaatagggaacctctaatgagacgccttgtagcaggctacgacattgggaatgtcactatcgatatttcacatatcacctccatgatggtgtgtggtgcctactagcgtcaccgatatctgtgcttgagcgacaaatgacagtgacggtggcatatgtctggccggttggcggcaccacagaagcccaagctagagggctagccctccaccgccacatccatcgttgctccgtgtgcagcacagccgcctccatcactactgttgtcgtgtcctccagaccaagcccggctggaattgctaatattccccccaaaaaaattatttaaatgttgaattgctcatgtttgggtccgtggtcatcaaaatgttttaaactagtcatttatgaaaaatatattccacttaagcatatttacgcttttggttcccatgaaacatatgtcttcgtgtgctaacattttcaattaatatattagcattgttggattgaatcaatgatctttaaatatattttctcaagatatattcaagttatttccctataacaatttccaattttcaaacgattgttggtaaggatttctatattggacattccatttttttctgtgcaaggtggttttggtatgcaagagctttttcatcgtagcaagtgcttcatgtgtcatcacaaggtgacaaatatggtcagcttttccaagggatgtgtagcaaacaacaataatagcacaaaattcccatataccaataaagacctttttgtcttcatctctacctcttcttgttcttatgtttgcaaacctttcctcaagtaattgtgcaatatgttcatattttgatataatgcaagatgttaatatttacagagaaagatatggagcaaagcaattgatatatgtaagatgaaacatgttaaaattcattcatgattaacctttcctacaattaggtgataaggatacaatttgttcctacgagctcttccagggggaatgaaagctgttttagttgggatttgaaaatgaaaaggtcgaaaaagccccttaaatctttgaggctgtttcattataaccttgaagtagaaaatgccccaacaaacaattagtggcctggccccatgactgcactgatgaatatatgctataaatgccaagctggatgtgcatatctccaatttgtagtggcccatgacctatttattaactgtatctgttgtttctagatacaagaatatatccatattaattatgcacattaaagatcatcatatattccaaaactgatcccgaaaagaaaaaaatatcaacttccagagcaaattaaaccaaagccttgccatttcactatatatgaactatccacaagccaagggacccaggtcaccttgcgcaacatctcccattctcaacggtgcgaccaacagagtttcatgaggattgggcatctgatgcttatggcccttgccatcctggcgatgagttcaggtaactttaatttgcacccaactccaacactgatttgctgaacaagcatatccttcaagagtactttttcacataaatttgttgcattttttggccacagaagtgccggcaagcaagttggcagcggaccaagcgcagaactgcacaacggtggtcatatctccgggtacggcgtgtgatccgcagacgtgtgaggtggattgctacagaatttttcgcaggcatgggacctgtattaacactgggtgtgcttgcctattctgccatccagggaaaagtaacgaaggaagaagctaccaaatatagctttgatatatataatggctacatttctttcaatggttccatggttgcagatgtaataattaagtgaacagtgggaaatagttaactgtccctggtttagatttatgatactatctatacatcgcttatttcccctcttcacatcgcacaaattttaagattcgtgcagcaccccccacc

SEQ ID NO: 54226 - DNA, 15962 bp, Oryza sativa
cagccctagcatgccactgacccaccacccttctcttcctcttcccctagcttcactttcctccgaacagtagtagagtgcccctgcaccttcttccccgtccttaacgattcgccctaaccactctagatcccacgtccccgccaacacaagtccaccgaccttctctcccactgtcgaggctactggtaccaccgccttgccactccaccatggccaccagcccaccatcccttactctcatcatcacctcttatccctctaagtcgggaacacctcctacttcctcttccaagttcatttttttgtcgggcccggtcaagatagaccaaccaaatttatttaagattgaggaatatgtacaaaatttgccaagttcatcactcgtcggagctcaacagatagaggacgtacaatgaatctagaagcataatggaaggtagggaattcgtgtgatttgcccccttaaaatgtgtagaatgatgtattaccataactgtatttttaactcagccatcaccgaccatcagaatttcattttgttttgttttattttcgtgaaaaatgagtgttcaatgtgaaaactggcccatgccaagtctggtccagctgctccttctacatcataagaaaatttctggattcgctacaaaccacacaactaccttgcatttgtgccaaacaaaagaaaaaaaggccaattttttaaaaaatgtatttttttaattttgtcaagattgttgttcctacttattcaagcaacagtgataaggtgtctgcaacaccgatcaccaggttcttttatcgggcggaagggcatgtgacctgagtagcacctcaaggctctgagttcaaatctttatatgagcgaattttatattgggttgtttgataggctaagttcctaatgtaaaaatgttatctgaattcaaatctccatatgagtaaatttcagattgagttgttttgaggggttaagtttccaatttaaaaaggctcacatgcatccgattggatgtagaggccaggtaaaatataaccttgtaaaaaaagttcatttatccgtgtttgggtcggacttgggagagagtagagttgttcggcaagattatgggaaatggagaggtcgaacaaatctagctccgatgacaatacatatttgaatcctcatcgcagctgccatcattaaatctccatatttaattatcttagagtatccctttaattttctttggagcatgtttcatatatttctccaaacatttgttccaaaaactcaatcactcaccagaaccatcgatcgtatgtactacatttcattgcgtgtcgtgtgtcgcagaaacagatgagatcattgtcaatatggccgctggccgacgatgttgcccggcgggtagtagtcgcagacggcgacggtgtcgacgccgttgcggcaggtgcggcgcgcgcagccgagctgcgtcgtggcgcgccacaccacctgcgtgtacgcgccgcaggtccggccgggcggcgccgcgcaccggccggcgtcgcggtcgtaccaccgccggccgtccgcccagaacgccgccacctccgcgccggtgtggcgccggccgtacgccttgaacaggttccggccgtagacggcggcgccgtcgccggtgccccgcgccgcggtgggcggcggcggccgcaggctgcattccgtccggagctcgccggcgtaccgcgccgcatccagctgcagcgtcccgttccacgacagcggcggcacgcccaccgccgcgcgtgcctcgttgtgcacccgcaggaactgcaccggcgtcggctcgacgggggtctgcacggcggagacggagatggatgccgccgccaccggcgatgcggaggcccgcgggaggcacaggacggcgacgagacagcagtagagtggagacatggtggtttcggggtgaagttgtggtgaactcgcgattgtatatatatagcgggggttcttattaattaatggctgccgttttgtgagtcctttggcttttaatttgtacttttaactcatggttttttactaggggagttatgctacaccgactgtgaaagtgtgaatagctttcatatgcaatggttgacggtcttgcagttattatattttgaatgttgcatctctctggaacatcttatgaagcaaattgaaacaattttttataagtgataaagcatcaattaattattttcattaaaatatagttatgttagatcttgttgtaaagatttaattaaaaaaatacaactatgcaatcatattgcattatttgtatatgggattaataatttaagagaaaaaataatttaaacatgttaagaaaagctagatatgcatcgataggggaaagtgagggtagtattggatattgcatgtagctgagatgtaggcataggaagcaagtagctggcatgcagcattcatgcaatgaatgtgtagaggggagcgcacaggagggggacccgatttttctctcaaaaatccgacgcccgattcgtagttgcctcgcaaagatatagtaataaaagaggagaaaataaaattaatgtcgggacctagggatggaattccggaatatccgaagagtttaggcacgatgattcgctagtacacgtatcacaaccttattatcacatccacacaacatacacatacgtagaagcaataagattttcataacttattaagcacatgtggccgaccgaccaaataaaagatataaaatgcagtgaaatattttttttcctttaattgatttcctccgtaatttcctaattcctcccatgcatttaatataaacaagcatatagaagcaagaaactgaatcgatgtattgcagcactaggcagcgagcaaaaaggtaacaaagcaatgtactatcatcatacaagcaagcttgatactctgataaaagcagaatcaggatggatcaggaaaagccagggccggccctggggctatgtagccgaggcgatcgctgggggcccatgatggtggggggccaacacctaatactagtagtctagtatctgcctatggcctacctagaagcagaaatgcccgagagacgagaggagttgcagcgtcataggcaactcgacaaacgacatcgcattgcacagggcacaaccgtacaggcgcacagaagtgcagatccgataaaacagccctcacctagatgtggagacgttgcctttgctttagtgcaggtggaggaggcgtagcggaagagtaggtagagtgcgtatctaccaagcacccatggcggcactgctagatatggcgggtaatataatgctagcactggtcatttccagtggattaaactcgaggaattagaactatgaagtacttgagactatctattattatggttaaatgatttttcgtaagtgatgtctgaaacacccatctgtaaaaaagttctcaaaagtgaatgtcttcaataaccacctacgaaaactcttttcataggtagatgtgtcagagcgtcacctgtataaatcggtgggccccggtttgtttttaaatagttcaaaatatttaaactagcggactagttgtccgtaaaaaagaattttgcagacggttatctgtagaagccgtccacaataataatttccaaagttttgaaaattttatctgagatgttgtcgctgttgttatcctcctaactagttttcatgctctgcagatggagtggtgaaaccctgtatggctagagtgaatggggaggaggtcatgaggcgcagtaagtgagagcacaagtgggtggcgataaaactcccattgtcctcagtcccctatttattagaataaaaatatgtggcatgggagatagagaggcgagccatggtagtggaggacgtgatcggcgtatagcggttcatcttccgaggaggaagtgaccagcatggcagcgtccacgcaaaaaccgattgttttgaatgtcgttgagaacattaagtagtggcgtgaggaatacgaaccgtaacaatcatttcattaaaaacgtccacgcttgtactgtgctttaataatatataaaaaaacagggagtagagttcttcaacaattagaacgtgcttctcagttttttgacggctttatatgtagtattaatttgtcaaacatttgttccaatgcaagaacaaaaacgttcttgaaagttgatcacgcacgtgttattacaccacaacattttatgagctcgcacgtgcatgtgctacatatatataccgcggcatatatatgcgttagtaagggcgctggccggcgatgttgcccggcgggtagtactcgcagacggcgacggtgtccaacacgagagggcacgtgtcgcccaggcagcggcacaaccagcgcgcgcacccgatctgcgtcgtggcgcgccacaccatctgcgtgtactcgccgcagcaccgccccggcggcgccgcgcacgagtcgccgtcgcggtcgtaccaccgcgcgccctccgcccagtgcgccgacgcgtccgcgcccgcgcgcacccgcgggccgctccccctgtacaggttccgcccgtacaagccgtcggtgccccacgcccacaccggccgcgcctcgcagctcgcccggagctcgccggcgtaccgctgcgcgtccagcgcgatcgtcgcgttccacgccagcggcggcacgcccaccgccgcgcgggcctcgttgtgagcccgcaggaactgctccgccggcaacaaactgttggccggaggctccgcggcggcggacaccgagatggacgccgcggccggcgacgccgacgccagcgacaggacggcggcgaggcagcagtagaagggagacatggtgtgttggttgattaatttgtttgtggagaagttgtggtgaactcggggttattatatactgcggtgattgattaattaattgctgctgttaattttgtgggggtttggcttttgaattttactttgtatagttaactcatgggatttattaccggggttatgcaagggggagtgttaatttcgattgattaatgactgttaataagttgtttattacttggattgatcgctcgtggttacgagcaaactagactcgaaagtcgaaactgttgagacgaacaagttcgtaatgacaataatgcggacattcttaataggatttcagcgccatctctaaaaacggcatattcttttctttatgttatatttctcgtaaatggtggaagtattgtttcacgatttctccgattattaggggattttacgaaaaaaacatgtgtgcgtgtcctacatgcatgccctcaccgcccatatccagttgacagaaccggacacgaggggatcaccatgcacaagggaaacaatgccatggtcgctggaacggcgtgccaccggttccccttgcccaactccaaaaaaactatatgacaaccaatccgagaagccaaaataaattcatgtaactgtgaaaagagtgagggtaggggagttatgagctgttgatattatttcctttcaggtctcaaagttgtatgaagttgtgcctccaatcctccatgagataggcaaggtaaatgttctaccaggtttataatgatatatcctctaatttcatgtttgtggttgttatggtcatcatgttctggctttgtatcttcaggtcaaaaatccatggcccaatgatgatgctcacaaacaaccttacccacatgctgacataacataagcaatcacagactaatagacaccaatacaaaataatacaaaataaaaaactcattctatttatgaatctccattcgaatacacgtaacatcttgtatttgtccttggcatctctttgagttttgtgtcgtggcctcgtggggcaacgctaggtctgtgcataccccaggttgcgtcgaggcacagccatgtctgacaccaccgctctcgctggtgcaaacaaatatgctagtctgtctgattgcctctaatttacttcatcctgtcgtgtaaacgtatcgttttgaacatttacaaagccttcagtatagcaataatatccatagatatacattcttcacaaaacctgatgataaaattatactgtttcatgcctattctaaacataaattgtcatgtatatatctagtctaaagtatttaaaatatatattgatattctatgctttgaatattgtttggttcgttgtttttcagaaaaatgaatacgagagcataatcttcacaatttagctcaagacattacagatcaaattgtactaattcaaaattaaattatatttgaagaaaatatatataatgcacaagcattagagcacaacggcttattgggcagaatagtaattcactcgcatgcacaacgacctacactctctgtcccataaaaaaaataacttgtaaagatgaacacatacatatattggttcaaatttgtccgtataaattgattttttttaggacggagtgagtatgtgattattctccggggcacggcactatatgtataacacgatcagtatggtcggccggtgccgtagttccccggcgggaagtagtcgcagacgagcagcgagtcgccggagtcgcacacgatgcggccgcacccgacctgcgtcgtgttccgccacaccacctgcgtgtaccgcgtgcacggcgacgacgacccggacgacgcggccgccgccgcgccggcgcacgtgttgctgccgtagtcgtaccgccgccggccctcgtccacccacgccgccgccagcgccggcgcgttccaccgccgccccttcccgacgaacgcgttctcgccgaagttgaacagcggcgagcgccgcggcgcgcagtcgccgcgccgcgacgctgcgtaccccttcgcgtaccgggcgatgcccgcgctccacgccagtggcgccacgcccaccgcgcgccgcgcctcgttgtgcaccgccaggatccccgccaccgtctgcgcggcacgcgcgcggcgtccggcgtccgcgcccgagacgccattgccggcgccggtggtggcagcgaagcactgggaagccattgccaggattacaacgacagcgacatgggacacgtaggtgttagacattttcgtctctttcttgtctgcgacttctgattgttttttagaagggagagcaatgcaaagcatgcgatgatggaatgttttgggttcagattttgatgcgaatttatagacgattttgcgtgagaatattttaaattattgcgatttctgaattcgcgctgtggatgatccagtacgtggatatagctttgaacgctcgcatggcggctagctagctacataattaattatgtgtgtgatctagcttgttcttgcataacttcttggtacctaagtaacaagagaatctcacacattgtttgatggtgattgtgtgattgaccagataaccgatatgaagaacatgcatgcatgatttgtatatttatttgttgagtgtagagtaggcatgcatggttgctggttttaggggctgatgatgtgtgtgtgttcctgtcattgatcacagctgagagcgaagattaagcactacgccagaaccctacatctatgacggcacattagtgacgggtttataaattggtcacagatgaccgtcacctttgacgggtcgttaggtttaccgtcattggtgaggcatctagccgtggcccgtcacaggtatcacctcacctgtgacgggccagaattttaagccgtcacaggtaagacagtgacaagtttgacttccaacccgtcactggtatgacctcatttgtgatgggccagggagttacaacccgtcacaggtgatgggccgtcacctgtgacggatatgacttctggcccgtcattgattttaagtttgcacccgtcaaaggtgatcaattttgacatataaaaaaggaacccccaccccccacccatggggcccaccgccacctgctcagtctctctcctcctcctctcagtctctcttctcttcttcccaccgaccgccggcctccttcgcccacctccaaaggtcgccgcctccttcgccctccgccccatggtcgccgccgccgtctctccgccaccccgtcatcggctccttcgcctaccgcctccgggtcgctgcctccttcgcccaccacccacggtcgccgcctccttcccgcctccaccacgccagatccaggtcatatcgagccaaagacgaagacaacgccggtgccaggaccatcggccaatggggcaccacgcggctgcccaacgccatcgacaagcccctccgtccatcgtcgcttatctccggtcgacgacgagcttctacatcccccagcctccccctgacggtcccagcaaccatgaactcgggggctccagatccggacaccctgaactcacaggtcgcggatccaaccatcccgagtttgggtgctccagatcctgcggtcctagcttcagcgataccagatccgttcgtgaggtaagcggtccgccgtccacaccacaccacgtcgtcgaggtcaacctgccgtggggagagcaggcgtcggctgtccccttccaccccatcctcggtagtcaccgtcgcctcatctattttactcagtttagtgctaagcagaagtcaccctttccttctcttgcatccagatctgagcttgcagtcaaccaattccggcgtctcctgtggttcctgtggctaaatccttgtccaaggatgcatctagctttaaccccatcaaaaatcatgagctattggatcattagttagatgctctttgtgtactagtattttgtttggatagtgggcatgcatgttgtttcgctttgttttcttgttctatttaagttgatgcatcactaaatctgtttttattttccttgttagacctcttaccagaagtttcttttggttgtgttcttgcatactctacaaatcccccaatttctatactaggggggattctttgctaataatcagtcaattggcaggagagtatggatgcaagaatgatacattgatagtttattatgagaagtgccacgaactaatgaaagagtttcggctggttactttaaagcatgtctctcgagaacaaaatgttgaagctaatgatttagctcaaggggcgtcggggtataagccgatgatcaaagatgttaaagttgaaattgcagcgatgacagccgatgattggaggtatgatgtgcatcaatatttgaataatccatctcaatcggcttctaggaaattaagatataagccattaaagtatacactgttggatgatgaggtttattattggacgattgatggagtgttacttaagtgcttgagtgccgatcaggctaaagttgcaatcggcgaagttcatgaaggaatttgtggtactcatcaattggctcataagatgaagtggttactttggtgtgcagggtatttttggccgacaatgctggaggattgtttcagatattataaggggtgtcaagattgtcagaagtttggagcaattcagcgagcgccgacgtcggctatgaatcctattattaagccatggccattcggaggttggggaattgatatgatcggtatgataaacccaccatcgagtaaaggacataaatttatattggtggcaactgattatttcaccaagtgggtgcaggcgattgctttgaagaaagttgattctggggatgccattcaattagttcaagaacatataatctaccgatttggtattccttaaactattactacagatcagggttcaatcttcgtgtccgatgagtttgttcagtttgccgatagcatgggtatcaaattgttgaattcttcaccttattatgcacaaactaatgggcaagccgaggcgtctaataaaattttgatcaaattgattaagcggaaaatttctgattatcctcggcaatggcatgctcggttggccgaagcgttgtggtcttctaggatggcttgtcatggatccatccaagtccctccttacaaacttgtttatgggcatgaggctgttttgccgtgggaggttagaatcggctctcgaagaacggagttccaaaacgatttaacagtcgatgagtattacaaccttatggccgatgagagggaggatctggttcagtcacgattgcgagcccttgcaaaggttaccaaggataaggaacgtgttgctcggcattataataagaaagtggtacctaaagatttttcggaaggagaacttgtatggaagttggttttgccgattggtactcgtgatagtaaatttggcaagtggtcgccgaattgggaaggaccgttccaaatttataaagttgtgtctaagggagcatatatgctgtaagggcttgatggtgaagtctatgggcgagcgctcaatggcaaatatttgaagcaatattacccaagtgtttgggttaacgcatgatcgtctagcattgccgatgcatgacagccgatgtgtttacatcgccttgagacggccgatatggttatatcgcccttagttgtttttcatggtgtaatcggttgtggtttgccgatgtacagtggctgatattgttatatcgcccttagttgttttataattttaccagtgcttttgacactgtaaaattaggggggcacatatatatatcaaaatgcaatgcaaatttttgagcgaatttcaaagtcatattaaaaatcatattaatcggcacaaaggattgtcaagacagtaaagtattagaacgtcttagccgattacaaaatttctaagtcctattacacaaaagttattgagacaagtatcgctggatagccaaaatagccctttgcctaatttgttctacttcttcaatagcttgggcatcttgagcatcagttccagggatgacttttagggacttggtcaagttcgcaacattcttgatagccgatttcagccttgttttttgttcttcaattgattttgggagatcgactagttttttgtgttccatatctagcgcggcattgcattcttcaagttgcaccaagagctcaatcttgcgagcttcaagctgatcaatattggatttgatcggaccttcagatagctgatcaagtttggttttttcctcatgcacaagctgccgattagcttggattgtgacctcaatctctttgcgctcacggcgttcggctagtcttagcttggctttttccagcttgaactgatgttgctcgagataagcggctggagttaggacatcggccaaatcttcgggaatcagagcctgaatttcatgcagccgtgacctaattgatccacagtcaactaccaagctatctaaagaagaggcttctagccgatgagagatgtcttcaagtgtttttcttacatcatcggataggggagctagggctttgcttgaagtgtcttcgtctgcctcatcaaggtaatctctgatatcaaaagagaagatatcggctagaacctgcagagacaatttccgaaaaagtaagagttgggtaaattatagccgatctaattgttgagacacaaggaaaacttactgggatagcaggagcagctggttgttcttcctccttgatgtgatgactccccacagccgatggagtctggtcacttgacgattgctatacaggaggagaagcaagaggaggctgtagaatagacaagtgttatatagagccggttgagtttgattaagtaaaagaattaaagtcatcttactggtggagccgacttggcaatcgttgctgctggctttttcttcacagcagttttctttttctgcaaccacaaagtctatgagtaattagccgaagagggaagtaattttagaagatgtcaaagagagatacttactcttgtaaaatgaatgggggcagaaggagttggaggcgtttgcttgggtgaagcccatggtgttctttctgtgtcactcatttcggctacagcctggtcaacatcttcaccaatttcctctgcatctaaagcttgttcaatagatgtatccaaggcgggtagatcatcagccgacttatcagtcggtttagttttcttgaatttggcctttttctttggagctaagaccaaggtactcatggccgatgatctggttttccttttcttgcgtgcatcggctagttccctggttaggccgtgaagaagagttgaagtcttgggggcatggtagctgataacagggggagatagtccacctccattcggaattagaccttgagcatattcaatgtccttgccactattactttgatgaggaggggaggactctgttgtctgcaaaataggagaaaaagattagtcaagtaatgaatcggctaactgattatgcaatttagtaatgacaaagtttacctggggtatgacgtcagggaatagatctgtcatatacattgaagccgattgatgaaatagatgcagcttccattcaccccaccatctgtcaaagtttttgcttctaaatcctgccaactcaatattatcaatgctgcccagagggggtcttggtaggttaagtagccgatccatcattagagtggatgtgatttgtcctcggcattgaatcttgtcggcaaagaataagccgattgggagttggcccaatccaagttgtctggccgagctcattgggtgataaaactcgtaggagacttggatgtttctcccttggtgaatgccgacggggaggatgcataggctgattgtagctataagaacttctctggatttttggaatttttcatgattaatgtcttcaaatctaaagtccgatggaagttcaaggtctgctgagtcttcatagggaaaccagattcgtgcatctttcttaaaaccttcataggagctgcagaaccaattcttaagtagctcagccgatagcttcgctccagcatcggttggtgtggatgcatattctccatatgacatgcatctgcgatgggtgcgctcttctccatcgtctcctgcaatcggctctggcagtgggaattcagcttctgtcatagagggccgattgacaaccttcatgactatcaggactaaccaggtttgcagcagccaccatggtccgcctgctccaactattgagccgacggctattttagccgatgcgttgttcaatgtttggtacagatagccgagatggattttgcccaaaggaaattctttctttgattctaaggcttcagctacaaattgcctgttggttgtagggccacaactagatccatagaaggggaacttttctaaccacatgagcaagaaagctacatgttcccgaggggtaacagacccttggcccatatatgctgccacatagccagactagccacctatgcttttggtcttgaagtcaaattggttcttggtgttcatactcatagggttagccaatgaagttacatctaatccagtaatcatggtgatgtcgattaaagttggagtcatcggcccttggttgaataagaaagcattgatggtgttggaccaaaagtaggtggcggtagccatcagaggttcatccttagcagaattggctatggtgagagcaagcgcttggccgattccaatctcatcccagtgaactttcttactagacgatacgcgttggtaccaggtggtccagcttttatcaggtgtgggtttttcgagagatggccaagacttgaaggtattcttccagtgacccaggttagggttggctagtctaaaggggatccggttggtttcaccaatgatgaaatcagtggggtcgaggttgccgattgggccaagaaaatagtggattttgtgcgaaaggctgggaatcgcgactaggttgaagagatgctacaaatccaaaacaacagagaaaaagagagcaatgtaagataagagaaaatcgatctgctgctaagaaaggggatcaagccgacgggaacttacctcagcatactcggctgaaggcgcatcagatgggttggtgcaggacgacatcgctgcaggcggaaatctcgccgaagatgaagtcacctggaagtcgcttttgcgtcggaggaatcgctggagagagagaagacaaagtttcgcttgagcggtgaaaacggaagtcacggtgtgagatttctcgagggtgacgtttaatatttaaagcatggcagtaacggtcggaaaacggcaaagtgcgaacttactcggggtcgatttacagcaaatccgaaacattaccaaatattccggacttggggggcatgtgttaacaaccaaatttggtaatatcggcatcgggaaagaatattagatcgaagcaaagtcggaggcggagattgagttcagaaacagagcaggaatcggctggagtccagatcggctacgattaggatcggctgggtctgagtcggactaggtaagctgatacaaccgattccgataatgcaacttgatgtatgatattgggttgaattaaggcgcttcaagatgattgccgcacatggatagagtcttgagaagtcaattgtatctattaattaggatattttatgtaatttccttagagatatgcttgggcaaaagtctgccgtaaagacttatggtatcttagagtttgttaaagatattagtcgtgtccgttatgggcatatcttgtaattctcgggtataaatagacccgagccctatgtaacttttaacacacacgttcaatacaatttcggcgcatcgcccaccctttttgctttagttttatttcgacgagttcttgctttcgggttgagctgcatcggtttcgatcttcaacaaaaggtaaaacttgttatgacgacttgtgttctcgggattagtgcttccatctttgtgatactctgatctcgtttatgtaattcgtcgaactatcatatatcttacataatctctggcaataccactatctaatctacaatcggctaacatctgtcggtagaggacagccgattaggttagatttcgatgttgacgtagattatataagatatctaccactctatgaaacttccagcagcttgattgtctagatattgttcttcttttcatacttaatgctgtatcagttgagtttgatctattaagtcgtgcttaaaaaatcaacctctagcctgccttctagttgctgattagggtagcatcagagtttcagccgatcttatctgatttaactatatttactctatatgctttattgacatgttaaatctgccctttattttaagatcttattgcatttaagtatattaggcctttatttgatatattctacttgctttaatatcttagtatagagtggtatcggagtattagccgatacatgctagatctatatgatcggctctgctatgaacatatgtagtcccattattaatatatatttcgatttaagtgatttatactgtctcggcatggcgtccgatctatcccaatcacttgatttaagtatatatcgatacaaggagtatatattgtgaatacctacagccgatcgagtagatttagttccttcttgtttattcatgactgccgatcgatacatatatgacatcggctcaaagataaatgatatgtcatcggcacctagccgatcgactatcatttatagatttaaccgcggtttctttgcttctattttttgttgattacaggatcaaatcaactggcacgctcatacattcgaaggcgagctttggacctgcactagagttaagcagatctcccaggtcacgtgttttctgtcaacacaccagcccttgaggtttgctgccaacccgtagaagtcactcatgctctccaccccgccacctcgcgaggagcaacacatctagcatcctggctcagaggagctcgttagcaccatccccaccaacttccacaccgtgcacggtcgaggaggat

SEQ ID NO: 54227 - DNA, 10165 bp, Oryza sativa
aaccgctatatggcatcttaacaaaccggtaggtccaatatttttgtctattagaattttattaaaaaaataaccccacaaactcccctaccctctcctctccccatgggcccatccttcaactggacgtacaactcaagttcgtacgtccgtaggtacgtcttccctcccctcctatccaatctcttcttcttttttctttagttatacaaatttttaaacaataataaatcttaaataaccatattttttctatagttatttgcacgtagtctatcaacaattaaaaaatatatggtgttctttaacctatatgaaatatttaattttttatcacctcctaaactttgcataacacggaaaactgtcatataaaatagggaaaaattgataatgtagattacacaatcatatatcaattcacagaatatgcatgaacaaattaagttagatctattatataacaaacttttctaagccaccatgtggcatcctgcaagcgctacttactaagacaccacgtgtcactgtaataaattagagaaatttctaaaaattttaagaaaaaaccaaacatctagacattaattttcattaaattatgtggacccattatttaccaccattagatttgtctttaaaagaactccctaacccccaaaccggatccaaattgggactgtatgtagcgtacgttttcttaaggattcttaaggatagtacgtgcgtacgttagtaacgtacatccaccccttcatccctcaatttcttcatatttttgcacatatttcttcccctattatcatatactttattagttagaaaatatattttttgtgttaaacaattcaacaactataacatctaaatcatacaactaacttttaatccgcttatatcttaaaattatttatgactgcatctacaggcaaagaccaaaattccacaataattcaactttgaggaaaaaaatgacactttggattatatttccagacttttgcgtaccgttcaagcaattacaataaatatgaaataatattattatagactctatcattgtgcataacttcataagaattaaattatatctacaatcataaaatctaaaaaaatagctatgagtaatgttcccaaaatatataagttagaaagcaagagttatacgaaaaaaataagcagctataacatctcaatcatgagatcccctatatcatacgagtaatatttttgcttatgtattttgattattttacatttaaagacccatatttggggttatattatctgacttttatgtgccattcaaacaattataaaattgtgaatagtaatgatatatattttatcattgtatataagttcacaataattcaattagatatgtaatgacaaaaaggtaaaatgaacctaataacactaagtattgttccaaaaatttactcctcccattatgatattataataaagcaaaaataacagtagtagatttgtaatgttcacattttcaatattgtatactatgtaggaaaagacgagtaaaaaagatagatcttaatcaatcaataaagcttttattttatttttagttaataaagtaataataagtaaaacacaataaatgtaaaaaaataattatatgtacacatactttgtcccattcgactttctcttcttctcctatctcactcaactcctctatcttataatttttaactaattaacaaaataataaaaaatgatcaataattacaaagctaaataattatgattcttatgtcataactgttttttagtttatttgaactgttattttttttataattaaataaataattgaagatgcatattactcatatttcactccataaaaatgaaaatactccatttaagcacacacacctatatatcctttgcatggtaaccaaatagaaaaaaaatagagcattataaaaaaagtgacaataagtattgcatcacctcaaatcattgtacatcctctgtagcacatttacagtggtatgtaacttacgtgttacatcttaattaaaagtaagaccttagaaattataagaaaagacatctgaccatcagtttccacttaataggtggatctattattttaaccaatagatataatattagagaaaatcttaagctgccatgtgttacgccttaaaatttagacgcaaaggatattaaaaattttgacaaaaaaagtggatcatcggttttcacttaaatcattagatgtgcacaacacagtactacccatcccctccccccccccctcctgtctcagcttgagttctccactctctcctttacccctcctttttatagcgagaaataatcaataatattaaaacatgcaattttttagctgtacatctaatttctaatctaactattgctctattcataattaaatcatcaatttaaaggttcataacctctatagtttgaactggtataaaataaaatttaaaatataaaatatcaatatggactaagttgaactatttggagaaaatcaaataagttcgtacctttcactaaaattggaccaagcattacatgctctatttttataatttttttaaatgcttacatattaatgcccttgcatctattctataccatggtataatgagtttctcagcctattaagccacactatggtagcagtatacatatagttagttgaaaatttatatttattactattaaatttaaatttttgaactcatgttaactatattttcttttagaaaagatactataggtcaaacatattacaaggaagcgatggtctacgatatgtatttgttaatttatatgtaagtatgtaacaacttgtgtgaatctaaaccaactaaaaagaggactaacttgatggtacaaataaaacatgtttactaacaataatagtgctttaggatttgttaaaaaaagccactaaacattcaattaaacaagacaaaatattttacttttaatttacgtttaatttgttagatatgttttttccaaacaaactaaatagatactttgaaacatgacaaatgtttatacggatcatagataattgtttatacgaatgaattaaatattatatattttaaaagctaacaaatagtttggaaaaattatctaagcaatgccgatgaagtaaaattatggagaaatagtacttatgaaacatggcaatgtcattgagttgatattcgatctatgtaagtttttcgaacacaataaaatacatgcccgcgcaatgcatgggctaccttcctagttcatattaaagttaatgaagtctagattcattaacatcaatatgaatatggaaaatgctagaatgacttacattgtgaaacggagaagtagaacaaaatcatgcgaagcttctaggtgatcttcaagtgcgcttaatcttggttttaggacaaactacgctagctctttcttttattttataaatagaatgagatattttggttcgaacgcttaatttggagttggattagctgcattttaaatgctctttgttaggcaagatctgcttagccttaattaccaggatgtcactataacttggattgcacagaagtaaattaaaaagtaggagtataagcttcgcttgggctcaattcaatttacatattccgtaaatattgttacatgcccaatccagctattcttgaattaaaaaaaatccaactattcttcttctattttatttcaccatgactttatgttacgacttacaaaaaatacctaagtagaatgggcttatatatagtagcaaaattccttacacgcacctacaacctacggacctcacgttcactttaggaccagtactgtattaaaaaggagttgattcagcttgtccatatcccgattaatcgcttggtgccttctcacaaaaaaaaaatatttctctcaaaaaatcgcttggtgccttggtggtaccataagatttggacagccaccataagcttcccctttcccaacatgggctgagtgaatcagtacgtagtgcaataggctgttccagtgagggagtggagatgcttcctacttcctccgtttcacgatgtaagtcactgtagcttttctcacattcatatttatgttaataaatctagataaatatatatgtctagattcattaacatcaatatgaatgtggaaaatgctagaatgacttacattgtgaaacggatggagtattttgtaacatgggaataacttcactttaagtcttttatttttacatcaagtttagattatatccttcaaccacaatacatgaaatgttgaatccccaacattaaaaacctggttacataaaatcctaaggcagcatggatggttgttttgattgacgtggtattctagtacgcagaggcataagattctaacactagaacggataccctcatctcaatcgggcggtaagccccatctcaatcgggcacagcgtccgtcacaggctagaagtcactgatgtaaagagttatctcaatcgggcaaacggccgtcacgaatgaatatatctcaatcgggccctaagtaaagcccgtcaccgatagctttgacccagacgaccagtcaaactatagcccgtcacagatgacctatctctatcaggccacaactagcgcccgtcacagatgactactaacctttatcgggcctaaactagagcccgtcacagatgatactcatctcaatcgggcctaaactatagcccgtcatagatgactgatgacctcaatcgggcctaaactagagcccgtcacagatgactgctgacctcaatcgggccaaaactagagcccgtcacagatgactagtgacctcaatcgggcctaagctagagcccgtcacagatgacctcatctcaatcgggcatttagttatggcccgtcacagatgactataatccacaaaaaaaaattgttttttggctagcctctggcctttgctagccatgcccgctgtaaaaataacagaaacaaacacagatatccaatatccccagctccccagcatcacccattcatacatatgcattcacatacacagacatcaacatatttcacacaaccacacattcacagccatctcatatttcacatccattcacatatttcacatccattcaaatatttatcatattttacctgtaaaaccgagttaattggatcaaatatttatttagcaagtcttaacataaacatataaaatatatacataaatataagcatcacagtgacatcatcacagttgcataataagtgttcatcattgcctaaacatagaagttcaacattgttcatcattttagtttaagcctaaacattcctttggggttaattatttcgcggaggatgaagctggctatctcctcgcgaacctcctcaaagctggtagtcagagacttggttattgtgccctacattgtcataaatccagattagttgatcgatcatataaaagtactaaaatgtagttagtctatcacaattgagaccaccgacctcaaactcagccaaagtcttcaccttttctctatacagaagtcgcatgttgtggcacacatggaatccgcactggttacctatttgttgcttcaccgggaagtcttttttgtggatgagggtgtcatgtcctgtcttcctgaggcctcctctttgcacgtattgggcccacgcttcatctatcgctagttgaattggggtccaatcatatgcgttcttatcaattctggagttcaggtaatgacatgtactccatttaggtgttatgaccagaaggatccaatgggcactgcggcattaatatagtgaaagttaattaagtactcaaggaatgtgtcatgctgttgtgtatatttagttaacacacttactattgattataggcacacataatgtactccttgtctcggcgggaccacaaggtgtcgtagatgtagttgaccattcattgacggtcattatggagatttgtgacagtgaccacttgtggatcaaggaaggcaacttctggtgcatgcttctgacaccattgccaacttaacctacacacaggatcaacgatcttgtaagcaagttaaaccgattgttattaccagaatgagttgggcgacaatacttacaaggagtagcacttaaggaggcttgtgtccaccgctcggagcctgtagaggtcgaaaagatccttgaagtcgaccacgatataatttgttggaccaaggaatggctttccatcgtgctgtccaaggatatcggtagctttatttggcttcctggcgttagatttctccatgtagtataagtgaaggtccttgcaagcggtgcccattgcgggaagcacgtcatctccaaccaatggcatgcctagttggaactcctgtggagcgacgtatttcttcttgacctctttgcccttagtctcttcctggctcttgcccagatctagctttcttggagctagaagcgaggcctgcacctttcctccccttcctcacccctttgcttcgggtttatcgagagtaattctctaaggggaagagtgtgccttcctgctcttcttcatcggtgggggttcattaatcgccttgctgtcggcctccgttcggtcctccccaaaatccgtatcgtactgcaactacacattgtaagattgtgcatgacgatcttgagcaggaggggctgaaggagtagaagcgggtctctttggtggacgaccgcctggtgcagtggttggcctcgctgtaacctgatctcaatgaggtccttgggccattggatgaaggtaccacgggcatttcctagtgagaggacctcgtcgtttggtagatacttcagagggaacagctcgtattcgggcttcgccgagtcgacttgaacttttgcacagtcggccctgagttgcgctccatgcactcttgtctctggggtcggcttgtacgcaagtccctcggctgctggaacagtgaaggtcggcatcaccctaactgtgagggtgcagctcgttggttcctgtgatagattaatcaatttttttagaatattatatatcatatggatttgttacgtctttcatgtattgagtaagttcacggttaccgttatgtggtcgacggcgctgtcgaccgatgttggattttccgccaactcagttgatgcgcaactgctgcgtttttcggtgggacttcctaactctttgtgcgcagcagcaacgacggcctgggggatctattgctcttctcggatctcttgcctaatcttggccctcatcgactcgagcttttcgtcgaattcagatgtcagctcagctcgtatcgactcctggatcttggcttcaaggtgtgcatctttctccgccttgttggaagtccgcttcttgtactgccacgcgtagtctggaaatccatacttccaaggaacagaagacccaatgccccgtgtccgtccacggtgttccttgttgcccaacgctttcgtgaggaggtcgtcctcgcgtctttgagagcaggcctcttgcgaggcttgttgctcggcaaccaactccttctgcattacaatttagtggggtcaaataaactgcacgatgggaaacaatgcgaacatctagtttgactagacacttactatagcttcgtatactcgttgatcttctgcatttggcatgaagattgtgccatcatcatgtttctggtacctagccctggcccagttcctagcccgagggtgtgggatatcgccaaacacgagcggtgtgcacgattcctccgcttcttcatcctcacgctgccattcctcttccttaccggcatatccagtggtaccaagccggtgcggatgctggttcctggtctggagcaagcgatatgcctcgcttctagctctggactcgggggtcgacttcttcgcatggaattcctcccagacctgttctgtgatccaaggaaatttctctcttggatctggatttgccgggttgtagacgaactcgccgactagcttagttttgaagttcttccaagcagtgcccataaccttgaaagcagcccgcctgagacggtcctcatgctccgcaggataatcaaagctctccttgaacattagccaagcaatgtccttctctgcggccggcatgagcttgaagtcgtcttacagaatactgaatttctgcctccctatgaccccgcagatagacctaaatcggctcaatattttccttggagatgtcggcaaccctacggcgtccaccgctgttatgcggaaccgttccttaggaattttgttccctgtcctaggagtacgtgcccttgaggacccactagttgtcgtcgacattggttcgccttgctgagacattatctacttttttccaaaaaaacaaaaaaaaacataatttagtgctacaatttattacaatctattaaccacatttcacaataatttcattaatgcaccacatttcatcccaacataaataaaccacatttcatcccaacataaataaactacatttcatcccaacatgaataaaccacatttcatcccaacataaataaatctcatttcatcccaacataaataaatctcatttcatcccaacataaataaaccacatttcatcccaacttaaataaaccacatttcatcccaacatgaataaaccacatttcatcccaacatgaataaaccacatttcatcccaacatgaaccacattgcatataaataaagttaaatgaaccacatttcatcaattactacaatcatctatcacaaaattcataaatgcaccacatttcatcccaacatcgacatgtctcactcacagttcaatcacatatcatccacatccacatttcaatgacatgtcattcacagttagtagagggcgacgcgatggaggactcacctgaggatggccggtggggctcggcggcgcccgggctcggtggagggcggcgccggtcggtggagaccccgatcgggcaggtcggcaccgggcgggcggcgtcgtgctctatgggggtcggcgacgtgggtcggtgaggacgcgggcggcgacgacgaggaaggccaacactggtccgatcggtgtaaaggctcggtggcggcggcggcttcctgctcggggggagggtcgtcggtgaggaggctcggcggcggaggtctgaatggagggccgaggaggctcggtggtgacgacggcaggcttggcgagggaggacgactgcggtggcggcgggctcggtggcgacggcggcgggctcggtggcgacggcggcgggcttggcgagggaggatgacggcggcgctagggttctaaggaggcgggaaactgtagcgggacttagaaaaattttcgatccgatctgagaaaccctagttatattagagtgatgagtcatctcaatcgggctttgccgtagggcctgtcacagatgactcatcggtgacgggctccatactaatgcccgattgagatgacagtcaggcccgtcacggatgactcatctgtgacgggccctaagataatgcccgatagagatagattaatctctatcgggcttgaactaaggcccgtcactgatgactatttttccatttcccagataagtctttatatttgtgagtacaaaatatatagctgttgtataataattcattttattagtcataacatattttcggatagtaaattatttcaaatcgaaatatggtcaacaacaaaattgtagaggttatcaagatctacaacttttattttggtcatttgtctatataactttgtttccaacagcttgaaattgattttgataatatgacaaatctaaacagcatttgtaaatactaaatgatttgaaatggaaatatggtcaacaacaaagttgatcctctcatcaagaactacaacttttattttggtcatttatctatataactttgtttgtaacagcttgaaattgattttcacaatatgacaaatataatcaacatttgtaaatactaaatgatttcaaatggaaatatggtcaacaacaaagttgatcctctcatcaagatctacaatttttattttggttacttcttcatccgacaaagtgatagttatattattcacaaaaatca

SEQ ID NO: 54228 - DNA, 1032 bp, Oryza sativa
ctcaatcgggcattagtatggagcccgtcaccgatgagtcatctgtgacgggccctacggcaaagcccgattgagatagattaatctctatcggccgtaaactaaggcccgtcaccaatgactcattttccatctttcatttgttgtgggtgcaaaatatatagcagctgtgtaataattcattttattagtcataatacattttcggatagtaaaagatttcaaatggaaatatggtcaacaacaaagttgtagagcctttcaagatctactatttttattttggtcattattctatataatttttttcccaatagcttgaaattgatttcgacaatatgacaaatctaattaacagcatttgtaaatactaaatgatttcaaattgaaatatggtcaacaacaaagttgatcatctcatcaagatctacaacttttattttggtcatttgtaataaaacaaaattagccatattaatgactacatatatcaagtctttgcaataaaacaaaatactccattcattacaatagataagtataaatgcatcagtcataaggttatgccttcggtatgatctgaacgagcatatgccacagactcttggggatcatcgtcaaggtcaatgtgaggtcttacatgaagattatggttgtattcttcttcatcgacgacgttgtcaactcctacaatttggcgctttccatccctcacgatgtgcatcttcttgtttgaagggtcttttgtgtagaatatctgctcgacctgtttcgcaagtacaaatggttcatcggcgtatcccaccttagatagatctactaaagtgaaaccttccttgtcggctttgacactagtgcgtagattcacccaacggcagtggaacaaaggaaccttgaacttgacgtagtttagctcccagatctcctcaatgcggccgtagtatgtgtttgacccaacttgatcctggaatgcatctatacggacgccgctgttttgcactgtgcttttgtcatcttgtttgacggtgtaaa

SEQ ID NO: 54229 - DNA, 1957 bp, Oryza sativa
gtacacgaaaaatacaaacacaagcataacttctccataggggagtaccgagcttcagcatccaagagtcgacgactgagatagaatacaactcgttccttcccttccaactcctgaatcaagactgagccgattgacttctcaccggccgataaatataacctaaacggtattcctttttgtggaggatcaaaacaggaggagagctcagatattccttaatattatccaaagccttttgctgctctgcccccaagctatagtgactgatccggctgttcatatcgtctaacacaatgggatgtaaaaaggcttgctaactattccaggacataattagaaaataaatcttctaacaaaatttatcccccgatcatctcttgtaattctgtcttattctctggaggctaaatcttcttgatcgcattaacactcctttgagttacctcgatccccctttcatgaacaagaaatcccaaaaactggctagccgatacaccaaaagcacatttcgtcgggttcatcttcaggccatattttctggttctctcgaaaaccttcctcaaatcggttatatggtcctctatttctttagacttaacaaccacatcatcgatgtagacttcaccaaccagccgattaaattacgatgtatgtaattcatggctctttgatatgtagctccagcacttttcaagccgaaagtcatgacaacccactcaaataagccgattgcaccaggacacctaaaagctgtcttatgaatgtcttcttcggccataaaaatttgattgtatcccgcgtttccatccataaaactcaaaatcttatgtcccgaagcagcatcaactaattgatcggctactggcattgggtattcatctttcggagtggccttattcaaatttcggaaaacaatgcataccctgaccttgtcgtttttcttgataacaggaactatactagaaacccattcagtgtatcggcaaggacgaatacaaccagcatcatacaatcgtttaatctcagctttgacaggttcaagcatatcggccttgtacctcctcggaggttgttgatgcggcctaacccctagtatgataggtagccgattttcaacaatcgattggctaactccaggcatctcataatactcccaagcgaagcaatctctaaacccttttaagagctctatcagcttggttctaaactctggagataagttcttactaataaatgtcggccttggccgatcgcctggacctatgtctatttctaccagatcatcggccgacatgaaaccttgaccttgcttgtcatcgagatcatctactgtatccttagtgtagacatttgaaccctccacgacgccctcaaaataatagcttgggttctccatcttcgattggctgtatatcagaatcggacacttttagaaaatctccatcctagactttttcagataaacaatcaaggccatccatctctcaaagagctaaatcggcactggcaacattaactgacctgtcggctggcatgatctctatcttgtcgccttgccattgaatcaaacactgatgcatagttgaaggaatgcaacaattggcgtgaatccaatcccttccaagcaacaagctgtaagaacccttcccatcgatgacaaaaaacgtggtaggaatagtcttactgtcgactgtcagctccacattcagaacacctttggtttccgatggattaccaccaaagtctttgagcatcatgtttgtcttgatgaaatcctcggcatttctacccaactttctgaacgtagcataaggcatcaaatttaccgcggcctcaccatcaaccatcattttagacatcggcttcccattgacgtagccgtttatatacaatggtttaagatactgattctctgtcccctcgggtttctcgaacactgcctgttctggtgaca

SEQ ID NO: 54230 - DNA, 7094 bp, Oryza sativa
atttcttgttcaacctcctgaaggcgctccctgttcctcaatctttgaacccttctcttctgattcttcgtgaaaataccagaaggacaccattgattcttcctgattacattgtcctcttggccatgatcttgattcactggacctaatctttgatgaacggaaactcttgtctgccttagccgattacccttattatatgatcggcttgaactctcgacaatatcactgcacccaggcagttttcaatagatggcaacctcataccttcattccagcagaatctaaagaactcacaaccccaatgaggatcaaaaccatcattgtattcttcattatgcttctcctgctgcctgtcatacttcctctgatatttgttgataatcttagccgaattcacctaaaaaccccttgcacgggtcctatcggctgtttggccagctgtatgcaccatattaacaggaaaagggttaccatcgaccttcatcggctttttggaatcatcaaacctaatcttgcctccctcaatggccacctgaatctgctctctaaaaaccttgcaatcgttagtagaatgggacccagaattatgccatttgcaatacctctttttgcctaattcctcagccgatgggattgtatgaccagcagaaagttgaatttgcttctctcggagtagcagatcaaagatcttgtcagctttagtaataccaaagtcatacttctcctcttttccagaactttttacccattggcatggtatgacatttttactcctcacccattcggctgcagctatttcagaatcgtcctcgtcatcattcaacccatagatgtatggacaaacatgattaactttcttagagcttttcctaacttccgcgaacctatgttcatgcaaggttactttctgtatcggatgtgataagctatcaaagtcttcagacaagaacttctccctaatcggagcaatcataccctgaaagaccaaatcgactaactgggcatcagttaaactcaagctgaagcatttgttcctcatctccctgaatctctaaatatactcgtgcacggttcatcatgccgctgcttaatcgctgtcaagtcagataatttcatctcatgaaccccactgtagaaatagctgtggacttgcttctccaaatcggcccaactattgatcgacccatacggcaaagaggaaaactaagtaaaagtcgatccagacaaagataaccggaacaacctaaccttcaaagcgtctatagccgatgcttcaccacactgagctaagaatcggctaatgtgctcataagttgacacaccatcttgtcccaaaaatttggataagtctggaactttgaactgattgggcagaggaactctctcaaaccagtcagggtaaggctgccgatacaagcttccagtctcttttggtttaagcccaaactgttccctcattacatcagcaattacatctgcccatggtcattgttgagctgccccttgtgactgttgctgcatgggctcgaactgaccgtattgagacgcaaactgaggttgagccaatccccctggctgatattgggcttgcggggaaggaggctgatattgataattcaagttacccccttggtaattgtgaagattcagctggatattacgtaccaagtgctcagggacaacttgaggcattaatgtgccatccggttgtacgtggtgaaccaagtgttctgggacaacttgatttaaaaattattgcaccggctgaccatcaggcgtcgcaaacccggccgatgcgcttattgaaccttggtgctggatcggctgaacaatttgctgtcttaacggcgtttgctgaatcggctgcagaggctgctgccttggtggtgtttgttgaactggttacctagcctgttgctggattggttatacaacctgctgaattgggggtgtctgctgaatcggctgctgctgaatcggctgttgctgtattggatcaacaacaggttgaggtgggagaaacatggcagcaacctgatcttgggttagccgattcgcaacctgcccactatgctgtggctgctctctcattaacaaccgagggttcaccggctggcctggcgccatggctgatgaagtaggtaggggagttgatgccggcgccgttggctgagtcgttggtgcaatggagggaaccgcctaagtagatggctgaacatcggtaatcaaagaccgataatttgggaagacacctccttgcaaataaaccgggcctacagcctcatgctcagctattgaaccatcaactattgacttcatcatgtttgataagatattgactaacaccctagactgattgatcaaagcatgatgcacaacataatcaacccgatcttggaagttattgaaaaatcctgtgccacatcgctattctgattaagatttcctccctgtagcccctgagcaccatctccatgcaccccgtcaccttgtactccacggactccttgagaattgtcgccttgatttcctagagagccgtcggtagcacctttaatactcggctgagccgagccgtctggagcttgtttcccatctccctccttagaagaactggtcctaggatcatcagcgaccacttttattttgtacttctaaacaagtgtccccttgcgggtctgcatgaatgagttcaagaactgatcccgtgcttgctgcaaaatttgcttcaaactctttcttctgctcgggtgtgaatttttcttgatcgatcggcatgacgtttccttcattgacgtcagcaatcctaacttcagcatcttgtccttaacagagtctgggcaagatggtggtggtggctatttctcagccaagaggaagaattgttggctgacttcgtaaaggtcccaccaggcatgccaaaagcgtgttgatagaaaacacgtggcttgggagatctgcttaactccagtgcaggtccaaagctcgccttcgaatgtatgagcatgccagttgatttgatcctgtaatcaacaaaaaatagaagcaaagaaaccgcggttaaatctataaatgatagtcgatcggctaggtgcagatgacatatcatttatctttgagccgatgttatatatgtatcgatcggcagtcatgaataaataagaaggaactaaatctactcgatcggctgtaagtattcacaatatatactccttgtatcgatatatacttaaatcaagtgattgggatagatcggacgccatgccgagacagtataaatcacttaaatcgaaatatatattaataatgggactacatatgttcatagcatagccgatcatatagatctagcatgtatcggctaatactccgataccactctatactaagatattaaagcaagtagaatatatcaaataaaggcctaatatacttaaatgcaataagatcttaaaataaatgccagatttaacatgtcaataaagcatatagagtaaatatagttaaatcagataagatcggctgaaactccgatgctaccctaatcggcaaccagaaggcaggctagaggttgattttctaagcatgacttaatagatcaaactcaactgatacaacattaagtatgaaaagaagaacaatatctagacaatcaagctgctggaagtttcatagagtggtagatatcttatataatctaagtcaatatcgaaatctaacctaatcggctgtcctctaccgacagatgttagccgattgtagattagatagtggtattgccagagattatgtaagatatatgatagttcgacgaattacataaacgagatcagagtatcacaaacatggaagcactaatcccgagaacacaagtcgtcataacaagttttaccttttgttgaagatcgaaaccgatgcagctcaacccgaaagcaagaactcgtcgaaataaaactaaagcaaaaagggtggcgatgcgccgaaattgtattgaacgtgtgtgttaaaagttacatagggctcgggtctatttatacccgagaattacaagatatgcccataacggacacgactaatatctctaacaaactctaagatactataagtctttgcggcagacttttgcccaagcatatctctaaggaaattacataaaatatcctaattaatagatacaattgacttctcaagactctatccatgtgcggcaatcatcttgaagcgccttaattcaacccaatatcatacatcaagttgcattatcggaatcggttgtatcagcttacctagtccgactcagacccagccgatcctaatcgtagccgatctggactccagccgattcctgctctgtttctgaactcgatctccgcctcagactttgcttcgatctaatcttctttcccgatgctgatattaccaaatttggttgttaacatggtggtgtgagatgcaagcggctgggtggcggcgacgattcaacgtcccggttatcgccaaaggaacctcctctccatggatctccttccctgctaaggttagattcctgttttggtcgactgggcttggtggctggaggaacagggtggtggttcgaattcggcgatggtcattgtgtactagatgggaaagcgctagtgaaagccttgcatggcctttggctggcgtcgacaccgttaggcattattcccttccttggaagggtctttatggtgttttctatgtctctaccaatctccaagtgaaaagcttgatccagtcgctggccgacgagcggttgtagcatttcacgtcatgtcctccatggggatgctgttttggagagatctacccatgcaacgatggccgttgatggactcttgtgcttccgaagcactgtacacctaggtgtttggaatggccttagccgtcttggctactttcttgttcgtggtgggcatccagctctcttcgttcgtctttgctaggtggagtcgaagttgttacattgttacagtgcgatgaagcttggcaacgataacacattgcagtctctttctggggggtactggtgttagccgggtggaggaaatggtgcgtcgttttgttgttttggtgatgcctttgccaacgatgacgtgatctctatggagtcaaacctgttgcgtcactaggcagcaagctcaggcctcggcaacattgacacttgctttgcgaagttgaagctgtttgccgcttttttagctagcttgacattgatgtccaccgttgggtttcatcgttgtttagttggtagttggttagagttgtgtggtattccatgtgttgggttattctactagctgcgattgaggtgcttttggcgagtctcttcttgttgagagattgtttttttcttttccttgtaaagtgtctgggttttactcttgcttaattaattgaaatgaaattgacatttctcctatcggtttagtttttctttaaaaatatatcactttcacccctttctataatttttatagaaattctgaaaacttataaactaagtgagagtttcagaaatggccgtttcccccctgtaatccacggtcaaactttctatgcgctagacggctagagcctagatgtctaaaaaacaagggatagaatgacgcaccgcttggtgaagaactgaagttaatggcttccttcttccttcactacactggacaaggtcaccagtgacgggcccaaaccctcacctttgatggctttaggcttggtcagtgatcagtggtcactagtgagttcggtcacctttgacgggtggaagaccattactgatgacagtcacctctgacgtgctagaactctacggcccgtcagaggtaagtgtctgtgctaacccatgccattttgcaacccgtcatagatgactcacctgtgacggctcagagtaaaaaactatgtcacttgtgacgacatgtatgtgcaaaaccgtcactggtatggtcacctgtgacggcttttgcaatatgaaccatcagtggtgagcttacatctagaaaaaaaaataatttcccctaggatttgctaaccatgcctctggaaaaacagaacatacacatgcaatatatatgtctccagtttcagcccattgcattaaaagtttcaaactaacatcacatgaattccaagttgtcaccgaaaatccatagacattcacacacatgcattgcaagttctcaaattgagccaagccgatgcttcaaagcaccagaaataaatccagaaaaaaaagagaacatacttcgatgccaaaatactgaaaaatgagaaatacagcctaagtgccacaaacttgaacatagcatttccatctttggtttctgagcctgacgaatatggtatgacatacaaacttacaattagatcagcataagtacagcccccagtgcctgtaatgacatcattcagagaagtttaatgcaacaatatcctaacagcctaacaaccagatatatgttacagatgggatgacagtagcaggaacagcttcgatatgttacaaatgcatataactatgcaagaatagcctaacagctagataatcagcataagctgctccaaaacaacaaattaaaatggggtcactctgactgagaaggcaaaaataagtttacctcagattagtattcattagctagcttttcaaccatccttgatagtcatccatatgcatgtcagtagttaaatattatctgaaagaaacggaaatagatcaactggcagaggaagctcaccatttgtagaaagaactagcgtctaatttgttcagctagtatagaaattgggggatttgtagagtatgcaagaacacaaccaaaagaaacttctggtaagaggtctaacaaggaaaataaaaacagatttagtgatgcatcaacttaaatagaacaagaaaacaaagcgaaacaacatgcatcccactatccaaacaaaatactagtacacaaagagcatctaactaatgatccaatagctcatgatttttgatggggttaaagctagatgcatccttggacaaggatttagccacaggaaccacaggagacgccggaattggttgactg

SEQ ID NO: 54231 - DNA, 1126 bp, Oryza sativa
gtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaaccgcaggccgagttggctctggccggaaaggtggccaaatac

SEQ ID NO: 54232 - DNA, 767 bp, Oryza sativa
cacaaagctcagcaaacaatcctttcaaccaaactgattctttacatgcttcagcaatagccatgtattctgcttcagtggtagactaggcaacaacaggctgcaatgttgccttccaactcacagcacaactactaatggtaaacacataacctgtgagtgaccttctcttatccaaatctgcagcaaaatcagaatccacatatccaacaagccccttatcagtcctgccaaacttcaagcaagcatcagctgtacctctgagcctgaaaatccactgaacagctttccagtgttctttactaggattcgccatgtatctactaaccaaactcatagcatgagataaatctggacgggaacaaaccatggcataaatcaaagaaccaacagcactagaatatggaactctagacatgtattatacatcctcatcagtactagcacattgtaaagctgataatttaaaatgaggtgcaataggagtactaacaggctttgcatcatgcatgttaaaacgctgaagaaccttcttaatgtagctttgctgactaataaataacaaaccagaatttctgtctctagtgatttccatacctagaattttcttagcagcaccaagatccttcatatcaaactcactactcaactgtttcttcaatgtagtgatttgttccttgctcttggcagcaatcggcatatcatcaacatataacagcaagtatataggtgatccattaacaaatttaatatacacacagctatca

SEQ ID NO: 54233 - DNA, 2061 bp, Oryza sativa
ataatggtaagcatataatgagcaccaccaagagagggcttacgagaaggcccccacaaatcagcatgtacataatcaagtatacctttggtgcgatgaactgaggtattgaattttaccctcttgtgcttaccaaaaacacagtactcacagaacttcatgttaccctgagtgcagccatccagcaggttcctcttcatcaattctgccataccaagttcactcatatgtccaagacgcatatgccacaggttagtcttactaggttcatctttagaaacaacagcagcggtaacagaaccatgtaatgtacttcctctaaggacatataagtttgcagaattcatatcaccaatcatgtaaacaagagaacctttcgatacctttacaactccacctgaaccggagtatttgtatccttctgcatcaagtgtgctgagagagatgagatttctcgccatccctggtatgtgtctcacatctttcagcgtacgtgtcatgccatcatgagtcttgatctgaacggagccaatgcccacgatctcacgtgggttatcatctcccatgcgcacaacatctccattctgcacagacttgtaagaactaaaccaatctctgttaatgcagatatgaaacgaacatgcagtatcaagtatccattcatcatgactagcaacacaaccagcaaaaacaacaagacaatctcctgaatcagagttttcagcactagtaacaacagaggccttaccatcagatttccttttctccttattctgcagcttccaacattcttcaatgaagtgatttttctttttgcaatacttacagaactttttacctctggatttagaacggcctctactctgactcttgtcacgatcattgctgacgttgtaggttttctgctcagatctgcctctgacctgcaatgcttcgcccttagaggacgacgcatcagactaaaccatacctttcatcttctccctgttttggagcgcctcataaacttccgctagggttagttcatcacggcttaaaagtatggtgtcacgaaaatttgcatatgaactaggcagtgagcataacagtaaaagacctaaatcttcatcatcaaactgtacctccatcgacactaggtcggcaacgatctccttgaagaccacagaaccactctcctgcaacttgtgcgagaacaacttcatcttgatatgcatcttactggttagatctttagacatgtagatcgattccagtttgagccaaagttctgcaacagtcttttcctgcaacacttcttacaaaatatcattagatatatgaagttggatcagcgacagagccttacgatctttccgcttctcctcagcggtccattcagtcgatttcttcttcccgaagctttccagcgcctcatcaagatccgaagtttgcgccagaacagcctgcatcttgacttgccacagcgagaatctcgtcttgtagtctagcagcggtagatcatacttcatcgacgccatcgcgaaaccctaatgtgggaacaagctctaataccacttgttaggaaacgataagcgaacaaacgataaagaacaatagatcaatcacagaagacacgagatttaacgtggaaaaccctcccaaaacaggagagaaaaaaaccacgggcgccagccagcaaaatatcttcactatatctgaggtgaggttacatcgccgcatggcggcttacaagaggtatatatatggtggaaccctaaaagggatgacgatccatatcgttccgctacggcagaagctggcctttattaagtgcaaatgaatttggatcacaactcaacagaaactatcccttttaaaaaataaggttcatacagagaaacgaaactatcccttttgaaaaaaggaatgctagtaggtgaaatgaagaaggttgtacggtcttgtgaattagattatcagtctcttcctcggtacagcacggcccaacaatcagaagaagggagcgaaaataggcttattccagccattagacacggtccaaagagatgagataggtaaaat

SEQ ID NO: 54234 - DNA, 1375 bp, Oryza sativa
acaagtacgagcggaataggatgacgtcacctcatggagcttgaggagctcgaggatggcgaggacgatgtcgttgacgtagcagaagccggaggcctcggacttcttggcgtggtgcaacccgccggaccagttgatggcgatgtcgtgggtgccgtggttgagcttgacggcggcgccgacggaggcccccgcgtaggtctggcagtaggcgtagaggccgtcgaagacggggcagtccgggccgatgttgaagcggcggagggcgcggacctggccgagctgggtctccggggtgacggcgcggaggaaggcgacgtagtcgtccgagtggaagcggcagaggtcgatgccgcgggcggggagcgggcggagcacctccatcttggccggggcgaggaggccgtagtgggcgagcagcgcgtgggtcatcctcacccggtggggcttcatcgggtggccctgaccgtagtagtagttgcccacctccgggtcgtagaagtagcacacccgccgcttctgcgcgtcgccgcacgacgccgacgccagcgagttgccgcccgcgcccgccgacgaggggtccatcgccgccgcctccgccgccgccgccgaattcggggttgggttttttctctctctcgaggtcgaggagctcgcgtgtgtgttgtggtcgggtgcttgctggagaaggaagcgaagcagaggaggcgagcgatgccgcgatgggcgaggaggggaagggggggtttatatacagggggcggagagatggagaggagacggctgtgtcaacaatgggctctcgcctctcggcgcctcgtcgttttccctgcacaaaatcaccgatcattaaaatttaaaatttaaatttaaaggtaattttatgatattttcaatgcaatttttctttttatatttgttttaagttttttagaacacgtgtataaaaaatttactcataaattattttttaaatcgttgatagattgttttaacttgcaatcagctcacgatcaattcagtggggccctagatattccatgaattatcagggtcaaggctaatataatttagtctaaagttaatcataagtctaaaatgatataatttttttatatatgtgttcttagtaaaatcatttctaaaatataactataatgcagaaaaaatcaactctaagtgttattcgaattttggttgtggcataagttgaaaaacaaacgatggagctttaatttcttaggtagtttcctttttgtttctgcaggggtggctcacatagctttattttttttctttgatattccgcaaggtatatacggcgatcatgatggtattggcattcaagagatattttacaactataaatttctac

SEQ ID NO: 54235 - DNA, 2689 bp, Oryza sativa
ggtatctaccaccctgaaaatcacacaaaaatgtttgattttctagatattatgtttcttttcatacttagtattgcattagttaagtctgatctattaagtcgtgcttagaaccataatctctagcccgcttcttgattgctaataaggatttcattgaggtttcagcaaatgagttatctggacgttgcttcggcttacaaggattgcatacaagttggatttagcccgttgcaacaaaggtttcattgtttatctaatcttgtggattttatgacatcggacattcagccgatgtatgttttaaccttcggatcagtgcttattctattatatcattgttagccgattggtttctactggatgttattattgttttattacattgctatcaatcaattgtatttatatcgttatctatattggacatatatccgattgctcaaaaccctattgacatcggctggtatcggcatcagctgaattactccatcggcttgacaaccaattggcttattgatatgctatttgtatatcttgtcagttgcatgatcaaactgactggcacgcccgtatcttatcaaccggtggatctgcacagaagctaagcagatctcccaggccgttgtgttcgtcgacctagtacgtgccaacacagacccgacattatcagccaaacgtggatttttttgtcaacacataacacatagagaatcatgaagaagactctgaccatgccaatacgaagcgtggcagggaagaaaaaaaaggaagatcatcattacaaataatcttataatatgtatgagtaattgaaacaaaatttataatgaacagacaaacaatccttcaactggctatcatatctgttactccctccgggttgataatacgtgtcgttttggacaaaaatgatatttaaaaatatttttgaccactatttttcttttacaatatatatagaaatatcaatacatatgattttatgaaaagactttttaatactaatctatacatatggtcttcatatgtttaaagtttttaaagtttaataatagacttgttcaaaatgacaagtattattactcgtaaggagtaacttcttattagagtttttaacagtttttattacaacctctgttgatcacagctgaatcatttcctcgttcaagtgttcttgttgtgccatcagaggtgttccttctctgatcagttgcctggctgcttatttctttctataggagtgacaggagtttcacgcggtccatccccagggtctgaaatgatgtaagtaataaactttaggcaaaatttgctacaggatactcaaagattgtggtctttgctgtgagacacccgaagatcgtgtatttgctcgtggacaccgtaaaaaagtggtaattagctactggacactcctcccattattttattattttcgatgaaaacggagagagaaacttaagttaaagacaagtttgtccatgggcccacttgtcaatctctctttctctgttcttcttcgacagcaacgcgaaggttttgccggggggcgcgaggcgctctacctcgctctattacggcctcctcgacctcttccgcgaggcacggtgggggccgttcgacggggaccagctgcatctggcggcgtccatggcagggaacgccgcgggcgacgggacggctgtccgcgccgcgcccgacggcggctgctgcgtcgcgcacggcagcgctgtgcgcgtgtacaaatgagcgatggaggagcggcggcgacctgcgcgtgataactgccttcccggcgacctgcgccacctcttccgcatcgcgcgtgtacaactggagatggcaggcgcgaatcggccgcgtctcgggcaacaagggacattcattgagtgttcttcttcctccccaatctctgcaactgcaccatgatccactagtagttattcttgtccggattcttctctacatgaatggccatatcatgcatcatgtgatcgatcagcaatgagcagcaaagtgtgtatgaggttggctttgcagaggctgtcacggtttaaggatgcagggtgcatcctgtcacaatgatcataagacctcagtcagctataggtggcattggcgtctgggactgcaccaccggcgagcaggccgacttcttctacgagccgccgggctgtgcactcggcgacgccgacaagctccagtgactcgacggcacgagcacgctcatggcagcgaccatgttcccacggacagacacctccttcatcatcctgctggacttccgggacaagaagaacgtggcctggtcgtggtccgacgtcggcacgccggcgtcgctggaggacaagaacgtgctgcacgccatcgcgatggaggacgggcggtgcgcgcgccccctctcccccgctgccgtgccgcgcgccgctactctccgccgccgagctcgccatcgcgtcggccgtctctctccctctctccagcgccgccgccccctgctccgccgccggccgcctcacgcaagtctgccaccacgcctgctcgagagaggagagaaagaagagaaaaagaaaggatgtggggcctacaccgccccgccgccgcctcgccatggctgagccgtccaggctcgggccagccgccgtcgcacactcgcacctctgctctgctgcaaggaagaagaagg

SEQ ID NO: 54236 - DNA, 1961 bp, Oryza sativa
atatcgatgtatacttaaatcaagtgattgggatagattggtcatcatgccgagacagtataaatcacttagatcgaaatatatgtcaataataagactatatatgtttatagcatagacgatcagatagatctagcatgtatcggctaatactccgatactactctatatcaagatattaaagcaagtgtaatatattgagcaaaagcctaacatacttagatacaacaatatcttaacataaagggcagatttaacatgtcaataaggcatatagaacaaatgaagttaaatcagatacgaacggctgaaactccgatgctattctaatcggcaactagaaggcaggctagagatcgatattctaagcacgacttaatagatcaaactcaactgatgcagcattaagtatgaaaagaagaacaatttctagacaatcaagccgctagaagtttcatagaatggtagatatctcatataatctagatcaatatcaaaatctaacctaatcggctgccctctgcatacagatgttagccgatagtagattaggtggcgatattgctagagattatgtaaggtatatgataactcgatgaattatataaataagatgagagtatcataaagatggaagcactaatcctaagaacacaatccgtcataacgaattttacctcttgttgatgatcgaaatcgatgcagctcaacccgaaagcaagaactcgtcgaaactaaagcaaaaagggtggcgatgcgccgagattgtattgaacgtgtgtgttaaaaattacatagggctcggggtctatttatacccgaggattacaagatatgcctataccggacatgaccactatctctaacaaactctaagataccacaagtctttgcggcagacttttgcccacacttatctataagaaatttacataaaatatcctaattaatagatacaattgccttcccaggactccatccatacgtgacaatcatcttgaagtacattaactgaaccggatgtcgcgtacaagtcatattgtcggaatcggctatatcggcttatttagctcgactcagactcagccgatcccaaccgtagccgatccgggcatcagcagattcatgctttgtttccgaactcgatcttctcttccgactaagcttcgatgtaatcttctctccgaggctgatgttaccaaatttggttgttaacacagaccaacaaggctcaaactgaatttattaaaaaaatgcagtttgttgagaatgatgaccgaaattaacttaaagaaatagggactgtctagtattgtcaactaaaaaaatcatttaattttttgaactgattgtacaagattcatgcggaaacacgcaacaaccttaacctcaccctttttttcccttttccttttcccgtgttcacttaggctccgttcataagtcctagttcctaacttcctccgcctcattttccgcgcgtacgtttcccaaactgctaatggtaccttttttttaaaaaaaaatttatacgaaagttgtataaaaaatcatattaattatttttgaaaaaaaaaactaatacgtaattaatcacattctaatgcattgctccgttttcccattccagcgaacacagccggagctagtcctgcgcatccgcatcttggaagaagaaacgagcaaaatacaacacgcaaaagagtgtttccctatgctgacggctcacgtcttctttttcttttttcgaacgactcacattggatggtgcgaagttctattgataaaacaggaaaaaattaaaagattacaatctgtaaggtcgtaaccaggaaaaacaaggcttaaagtcttcaagataagtttttaaaacgagtccaagccgccgggcagactgcgaatttgcaaacccgtcgaatgccagccagtgcacccacaacttgttacttggcttgaatcaa

SEQ ID NO: 54237 - DNA, 1358 bp, Oryza sativa
aagactatacactgtaacttggttcatgttacatgttctgtactcggcagtacattgatcagactaatgtctccacgtccagtattgcctggacactttggaattcttcaacaaaagaaacagttgtaatttgtaaactcctacagaagaaacagtcatacaacacctcggagtaagtaactaatagcatgcaggaatccgtggcataagagctggtggcctgaagtgggttagttcatagtgagcttcccggttcattcttggcgttgcctggcgcgttgatggccatcgaatttgcatccgcagtctatcgttgataagcaatgtgaagatgaaaagatttgttagagcagattaaaccatggtgttggataattctatatccatataggcattatgcaatgcagagtttgtgctatggatttgcagatggatagagaagacgacgacttacaggaacttgcttggaggaaccaagatcgtctgccatcggttctggtactttatgttcagttgttaatctcttaccatgctgcagaatgtgtaaatcagaaagtgttagttcaacaaaagatcacacaaagatgcaagtccgtgctgcaagaatttcaaagggctcgtttcgcataaatgcaaggtagattctaaataatctggatgagattatgcacaacccaaaaaaaaatcctgtgagataaaaaaaggtacaaccaatgcggccttaaatttcatttagatgaaaatgtcaatacatgatgagcacatgttttcatcagcacaccagtcttcctccacaactcaacagcacaagagaatttcactatgtttctagcaccgatatggataagattataattcacatatagcagcaagccagcaagaacagaattctataaagaaaacctcattgttactccctacgttccatactttcatattataagtcatttaacctttttcctaatcaaacttaactaagtttgaccaaatttatagaaaaaaatagcaaaatctaaaataccatactagttttattaaatcttacactgaatacattttgataacatgtttgttttatgctgaaaatactaatatatttttttataaatttggacaaactaaaaaaaattgactaggaaaaaagtcaaacgacttataatatgaaacggagcaagtatataaataaacccaaaaggggaatgccaccttctttaaacgggacaattgcttatttgaccccgttttgagccctaactaccaatttgaccctactttttaaagtttgcttatttgacctccttttcaaaaacgaagctcccgtatgaccctgttctgttaagggcatcgaacggtgttaa

SEQ ID NO: 54238 - DNA, 1212 bp, Oryza sativa
gatgacagctaccagtccatcttcaagccgatcatcagcaaagtcatggagatgtatcgtcctggtgcagtcgtgcttcagtgcggcgctgattcgttgtccggtgataggttgggctgtttcaatctctcaggcaaaggtcatgctgaatgtgttaagttcatgaggtctttcaatgttccgttgcttcttcttggtggtggtggatataccatagaaatgttgcacgctgctggtgttacgaggtatctatactttcccccgtttttttttccttatgcctttaacaaacaattaattaattctattaattatggatgacaaaacaaagccatgagctcggtaatgtgttagaacctaatttgcttttgtgtttccactttgttccttgctcagcatcaagaacttgtcttctagtagttggtacctactgcctggctttgttgattgatccatgttgctgtaattttacaatcaccaaactaagattttggtttgtactgagctgatgactgaaatgcacagaacacctatctcccatttacatgtaatgcttaatgtatttattttctactctgtttcattcaaatgcattaatttgtgagaacttgtgcagtaacaaatcatccggtgtttctcaaagcattaaagtgtggttatttttaaacagataagtatcaggcaaggcactgctagctaactgttaacccttgcaaaatcatatgcttcaggccaccacctgttcctcagttgttagctttcatcagagatgtctttaataaattagcaacccaaaatctggtctctttggaccttgcaagcctggtttcgttgccttttgtgaatttataaatctgaacacacaacaggctaaacatggcgaacaagtggaatggctgcacttatgcttgcttgagtaaattatctcttatatcaggaacacctgttgctacagctatggttttatcctctgactgtttatttggttttttatttggccagacaggagttgcacttggtgaagagctacgggagaagttgccttataacgagtattatgaatattttggtccagaatacagtctttacgttgcagcaagtaacatggagaacagaaatacaaacaagcaattggaggaaataaaatgcaatattctggacaatctttcaaaacttcaacatgcacctagcgtccaatttcaagagcgaatt

SEQ ID NO: 54239 - DNA, 1685 bp, Oryza sativa
gtacagtacttcatcatccgattttaaaaagcgatgttaaatacataaacttgaaaagtcaaattagtggttagactacaaggtgaaatgagcaattaccccttcttatattggaaggaacacactgaaagtctaaaactgtactctctctgttccaatttacttgttatccaggcaaataccgtgcaaaccatgaagatgtgaaagattacatggttgcccttgtcagatacatcttaattatcttttcaaagtagatgagccaattatgaccgcatcaatatgtattgctgcattactgtaggtagggagggaataatatcgatcacctttaaaatttctttggatcgagaaaacgacaaataatttaatataaaattaaatcctagaacgacgacgatgagtaatatgaaacagaaggaagaacatgaataagcagtgcacattctagttgttcctgcctctgcttaaatccttccatggcctttctccatttgagttatgcatgtcccggcgacataggaggattgtgtcccccgtttgggccgcctgaaatgtactcatattaagtatggacttgaagagttggagtgatatcaattccaattaaatcatatgtacaaaagaaaataatattcactctggttaaaaatatgtgtccttttggttttcaagaaaggtaatgcattttttaatgtaaaatttagtatccttaagtacatcagttacctgagggagaggggaccgacctgagaggtgacgagcagcaagagctccactggatttgtaccgtcatctaggtttggagcctgcgacaacagcgaggttgagcgaagaacggatcactgatgaggggtgagctcgagagcctggcaacgtgccgttctcctcttgtcgctgcagccaccgcctccttgacgtctgttctgtcaccaccgccgtttcttcgatggcggcggcaacagagggcgcagcagcggccatcgacgatggtgacgaaggatgtagtggcggctgtaacaccctaggtaaccacgtacctagagtgccacaccaaaatacactcaaaacctaagtcccaaaattattagaaatttcggtaaaatctcccctaaaaaatacggacatccacgacaggcagttataagaaaaatcagtaccgatataatccacacaatacaaaccattctagctccacaaattccatgtgaaaacaggtagttataagaaaagtcaataccgatataatccacacaatccaaaccatcctagctccacaaattccacgtgaaaataaggaccagaactttaaatgacctttacaagttctacgcaaaacttgtgctatgcataaacatagtctaaaactaaatttcaatagtgtgcaataataaagtgtagtccaagggtgctactcccgccccatgccgatcaatgtcattaggtacctaaaaaccaaattaaacacaagagtgagtaaagaatactcagcaagtacaatcttgaactagtaaacatacgcatgatttatgcattaagaaaccaacatgaagggttggatttactttatttttaaaccaaagaagtcaaaagatagtagttccctcccgggcaggtgtgaatatcctcttagcattaccggtaagccaagcaagcgtaatcagcgcttcacaaggatcatgaat

SEQ ID NO: 54240 - DNA, 1727 bp, Oryza sativa
aatgatcaaactcggtagaagaaagtaaatgattagcaacaaacatgtcaattgctgttgtttggaaaacatcatacttgaactcccagcattgccgaaaaaattgataaggctgaacaagcattcggcacacttgtcattgttttttttcagaatatttggctggagaggaacagaagaatctttcagcagcaacagaaagacaactgcaaatcgccttcatggcaattcagaacatcacacagatggagttgccaatctctgccgacagaattaacctgcagaaatttatgtacatcaattagatcctaacagttgttttctttcggttcttgtatcaggacacgtaatttgaacctactcagttgatattcttcttaatataaatcaaggcagatctcctgccagtttctcgaggaaaagaaaaaccctccatttgcatcttactaaaagatgaaaagacctggacaatctcccgtggtgtgcacagtctgcagacccattaatcatcaggttccatgtaaaactgtccggcactcaggcttgaaaccttctgtttatcatgaacaaccctgtgtgccagataacccgagatcatggtattccaagacaccaagctttgttcctccacggctgataaaagccgataagcactaactgcaccttgcatacatgacaacaggtgtttaccaagtgacaatgctgacaaacttgtgcatgctgacaacaccagcgaaatcattcccattaggttcttcactgaacccaaatatcatttctccaacagtatccaagggcatggtgtgctcatcattcctcaataacccagaatccatcgcattgtaacgctagcaattcaaacaagccaagccaatgcaactgctccccgtgcttgaccaccgcataagtaaggcaggcagccatgacagagctctggggctggcaacccttcttcccggaggggactcaaactcgtgcctcgcctcatcatcttccccgcgctgcgcgagcccagcgaagagggcgttgaagcgggcgacggtccgcttcggcatttcgtcgaacaccctgcgcgcgaccccgaggcggaggagctcgcgagttcggcgccagctcgtagcgtaggcgcaggaggagaaagcccgaattggcgaggcgggcgtggacctggatcgtggaggcttcgtcccgggccggagctcgactaggtgaaggccttgagcaagcagggttaggtgaaggcgggacggaggctggaggagtaggcggtgagggtttcttgtcggagacgagctctgatgatttctttccacgaggaggaggcgatggtggccgcggggcgtctgccattggaaacgcgagcgagctcgcggagatgctgctcccatggcgtcaatggcggcggcggcggcacggcaacggttcgcgtgggaacttcgaacggggagataaatttgcagttatggggctgcagaagttataaatttcatatactagatacttttgcatcttgtcagtgaatatattcaatttacatataagtataagaggagtatttgatttgaagcaagttgaatattgttactactccctccgtcccataatataagggattttgagtttttgctcgtagtgtttgaccgctcgtcttattcaaaaaatttatgcaaatataaaaaacgaaaagttgtgcttaaaatactttgggtaataaagtaagtcaaaaa

SEQ ID NO: 54241 - DNA, 717 bp, Oryza sativa
tacttgagtgctgaaaggtttccaagtgaggcaggaatggagcctgccagctgattagaaccaagacctagtccaacaaggccagcaagatcacctatctcctctgggattcccccagtgaggttgctgaattgcaggttcagagtcatgaggtttgcaaggtttccaatctctgatgggatgcttccggtgagggtgttcatgccaaggctgagtaccctgaggccgcgcaacgagcagagctccggcggtatctcgccgtggaacctgttgttgtacagagcgaggatctcgaggccggtgcagttggcgagcgacgccgggatctgcccctggaaggcgttgtcactgaggttgatgtgtctgagctcagcgaggccgccgagctccggcgggaggacgccgtgcagccggttgccggcgaggtggagccgcctcaggtatgtgaggttgccgaggtccggtggcaccgtgccacggaggccaagccccggcatgctcacagcgccacgacgcggacgcggcgccggcctctcgcgccgcacgccacgccgcgccaccggcacacggggacggaccggttcccccacgtctgcggcggcggcgagccactgcccgtcgacatgcgctccatgaacgccgtcagcgcgaggccgtcgtcgacgtctaccgccgccgcggcggcggctgctgctagccacgccagtggccataccg

SEQ ID NO: 54242 - DNA, 719 bp, Oryza sativa
atactcttcttgtatccccttatatctcttcttcgcttcgctcgttcacgcactcacgcgcacagtctttcagcacctcttcctcctcgcccgactggtgcccctaaccttgccacctgaccagaagacgtcaatggtgcttgtaatccctatacctgaccggcctcctcccccttccacccctacctctcttccatcctaagccagtgtgggtaccattcccctatgccatcgggtatgattcaccaccactgaccgccatggcctccctcatccatactgctagccctacccaccgctagtgcttccattcccgtagctccgccgccacgcctttgcccatcgtcaacacccaccaccaatctcgccgccagcccatccttctaagcccagaaaacccactttttcccatccctagcccactctttaggctgttgcagtaaaaatattactattatggatgtgtgtggagagcgtgtcttgagagtaacaaaattactatgagggttatgagtgagtggtgggagaaggtcgtgaggcatgtcacgtagctatgtagcatgtagtgtgccatgtatgaagttctccctctttcttagatataaatctgtagttatcgttagcattctttgcaatgtggagaatgctaagccgtgaaaacatggcaataggcttgtgtatacacatgctgccgagtgcagatatgctacctttggctg

SEQ ID NO: 54243 - DNA, 1109 bp, Oryza sativa
agacatccatgtatgttttctgatagtattcatatgattggcggttaagacttaagacatgctattagatacatgattaatcgtgtttttcatgttttgtattaatatttttagtcattattcaaacgatgacaatctacgcgagcattccattcaagaggtatcccatatcagtatatccttaccctaccagtcacttaaagagatctatgtgctcaaaatctattgtccttcaaataggtggatatggagacagaagacactgatggggccagtaacacagcaactagtactgaagctgaaaacacacagaaggctgtgtgtgaatcactagataatggacatgatcaaggtacagattcctattattcttcagtgattagtgttggcattcctttgccacaatttattgtaacatttaaaccttcaaaactatgaggaaatactgtaagttactttacacataaatgtagaaagcctttttcttgttctgttgtgttagttagtacttataatacaaccaaatacttatttggcaatactgatgaaatgtggagagatcaaatcccctgcaaaacaagcactgtgggtttgaaatagatggttaaataagtgcaacagacaccctgccattgtgaatatcaataatagtaaacttgtactattcactgtaccatgaatgtggacccactgttctgatattgtagtgcatgcatcagcagtagcagactgttagtttgatttggaagttatccttaagcattaaaattataagaaacactataacggattcttagtgaaagtattaaggacatgttaagtcagacctgtaaaattctgtttagacatctcaggagcagggaagaagtgggactcgtcagaagaagacgacctggatggctacaaagagctaggacagagtaaatggtcaaaagattttgatgaggataccgagaagtctgaccatgcagaaggaagtacgcatgctctttctggattggctcaaacctacagcacgcatcgaaaaacagttacctggggagatcgggtatgcctttttgcttaaagggaaaaaatgcattgttttcttgcattttgttaatatcaaa

SEQ ID NO: 54244 - DNA, 1349 bp, Oryza sativa
tcactgtgatctcaagccaagcaatattttcctagatagtgaaatggttgctcacgttggtgattttgggcttgcaagagtcctgcatcaagaccatagtgacatgttagagaaatcaagtggctgggctacaatgagaggaatggatatgctgctccaggtatgcttctaacagctacaatccacggttttctttctaatttattcagaaacctttccattgatccatacttaagtagatcgttttgctattcagatgtgtgcaatttgttatgaaaaaactcaaattcttgcaaatgataattatgcagcagtgtaaattatatattattagactgaagcctacatataaatttaaatataaatgcttaaacttgcaacaatttcctttatgtaacattttcttatgattacagagtacggtttgggcaatgaggtttcaattctgggtgatatctacagctatggtatactgttgctggagatgtttaccggaaaaagaccaactggcactgaatttaaagaagctctcagccttcataattatgtaaagatggcacttccagacaatgtgatcgatattgcagaccaacacttactatcagagaacaatgatggagaagaaagaaactcagatggcaaaagaaagagacacgagaatagcctgcatcatatcaattctgcagattggagtttcctgctcaaaggaatctccagcagatcgcatgcatatcggagatgctttgaaagagttgcagagaacaaaagacaagtttagcgtgtccctgcgttgaagcatcaaatctctgaataatttggcataataatccccaggctataatagatatttacagccgagcaaccgaagccttatcagcataggttcaggttgtatgagtagcttcatgatgttcacacatgcagggtgctgtttttttttagataaaggattatcaaacccggcctctacacctttgtggggtgtacacagccaaatgcagggtgctgttactgaacaaaatataagaaccatgaaccatttagcatttgcaggaagaatatgtaaatcgactaactgcacatacagttttttttgtttttgttttttcgcttgtaacctacaaactgttttgatggaagcattcgatagcacgcaagttcagagactcacagcaaacagctcctctcctgaaaaatcccaattccaatggttcagtactgcaactgcactaaactaacctaaaggaatggacatttaccaagatccattaccacaaagtataatgttttatgtttccccatttggttgagaagttgcaaactcaaatgcatcgacatcatcccaagca

SEQ ID NO: 54245 - DNA, 891 bp, Oryza sativa
gaagttgcagcactgggcattttgatgttgaaaggatatgatctcccagactgcagtatacttcataacccacatagatgtgtttctgttgtggaatctgtatactgtacatgggagtattgtccatcattcacattttcgataattgcagcatgagtaattgtttttttcatgtatttcactatttatcatttgatgtagtaattttgctaaatttcttctttattggacagacgtacatatcaagcatgttgaacgcatttaagaagacccttgatgaagggaattttacatttgtgattggtatgacatattttaaatattgttgctttaggatgaattaatgatttaatgatttaattcatggtggtggtcattactttggtggttatgattatgttctgcctcattatttatcataaatttcattgagtacggaaaaagccctatgcaaactttatcatatattcattgacatcatattatttcaatctattggcttttcttcatgattggatctttgtcttattaagttcaatgtttggtggccattttctgggattaggacataggcaatgggttcctagacattgggaggatgacaggacatccatttgtactagtggtttatgttttgtactgtttgaaacattcaattaagcaacaggcctacaatggcattgtaccgggtgatgccttcattcttagcaatggctgatgctggatttgtggtaactgacttgtttattgctggtatccctgcccgtttttagtggatgaccgcaatctgcgggtagctgattttgctcaattttgggcaagtgcgaaggtaaactctcagtctatgttgcgtcaactgtgagaatttacattgcttgttggagctttttg

SEQ ID NO: 54246 - DNA, 1194 bp, Oryza sativa
cgatcacgaaacgccctcagcaagtcgtcccgctcctgtaacgcctgttgaactgcgggcagacgacatgaacccggctagtaggcacgcagcgtcggcggctcgtgaccatagacgacgcggaacgacgatgttcgaagtgacgactgatacgacgtgttgtagcaatacatcgcgcatggtagccatcgaagccattgacacgaacgattcctagtgaaacatcgaagatacatcatgatgatcttgttagtcacctcggactggccattggatttaggtgaaaggctgatgaaagattcagctgcacacccgccaaccataaaatttcacgccaaaaagtgctggtgaagactggatctcggtcgctgacgatggagaccggaaaccatgcaagcggacgatctcagcgaagaaggcagctactaccgacgtcgccgtgtacggatgagaacgggatgaagtgggcaccggtacgatgaccgtcttgccatgtactcgcgggagcccctcgacgaagtccatagcgatgtcagcccacaccgccaaaggcaccggcaaggattgtagcaggttggccggttggaggtgctccgtcttgttccgttggcacgtgaggcacgcgcgcacgaaatcttgcaccgtcgctctgtcccgcgagatatggaaatccgcgcgaaggcgagatagggtcttttgcgttccctcaagtcccaagccatgcaccgactcgaggatggccggcaatgattcggatgatggcggcatgaagacgcagcccttgaacatgatgaggtcgtctgtgaacgcctatgctggcggtttggcacccttggtgatgtcttcacaaatggcggacagggcgggtgtggaggctacctcgcgggacaactcatcgaacagggagaattggtgggggggatgataaggcgaacgcctccgccaggtgttcgtcccatctagagagcgcgtccgccaccaagttcgccattcccaacttgtactacacgccaaagtcaaagccgaggagcttgcttgcccactgatgctgtggaacagtggagagacgctgatccaagaggaagcgcaagctgcagtggtcggtgcggatgaggaagcgacgcccccacaagtatggccgccaatggcggaccgcctggacgaggccaatcaactcgcgttcgtaggcagcga

SEQ ID NO: 54247 - DNA, 704 bp, Oryza sativa
atcacatcaaatgtttagacacacatatatagagtattgaatggtacactttatactcaaactgaaaatcaacagtactgaaatttcagacaggtatatatggctcttcctaccatgtgccttgtatttatagacatcaggctgcagtcataataagtaaagactacatgataagaacactactacaaatatagtactactctggaaaacctctatattaaataacaagaattgagcatttctgatagtgctacattctatgggggcgctttttaactagcagcctctgggtattgggacagcttacagatacaacagtgccacaaatctgcattccccgttaccttctgtttgtgaccaaaggggtacacatggacaaggcacaaggccggaacaagggctctccgtgaactgtgtgaatggggaaattgggaaaaaggagccaggcagcagcagtacattccgagccgcagaattgcaacgaagcaaaactgattccgaagcaaaactgatggccaaaccatgcctagagtatcctgaccatcgagagaggccattggaggcttcttgtcgaggatcactcgccatctccgttgccaaaaactccgacgcgctgcctcctcttatcgaaaactgccctgaaggattcaccttcgtcacgaagttgttcgctgaatcgcttctttgtatcggtgttgattacc

SEQ ID NO: 54248 - DNA, 3545 bp, Oryza sativa
catcacagggattggcattagttgactatgaaagttttgaggaagcacaaactgcaatcaaagcaatgatgggactcagctgttaacaaggactgtctatgttgactgggcattcagcagaggtcctatacagaaactcaccagtacaaggtgtgttattaaccatgcttttatcttttgcatttgctgggatagggatttgttgtgttacactggcatagggtttcatttactccacaatctcatcaccaaacaatgtcttgttcttttttctgtttgttctgaatctaaaattctaaatctaaatttcctggcaattgccctttcgtgaaatcttgcatgcaagatctgtaactgtaacatattgtttcatattcagtggctattttttccctatcctagtggcctgtttatttggtttggtttgatctgggatttgcataagcagttcatccagacttgtggaattttgacataattagactcgtgtaaacctgttaacctggaagacattacctatgtttcatactccctccgtcctaaattagatgtcgttttgactttttgcttgcaacgtttgaccattcgttttattttaaaaattattgtaaatataaaaaaggataagtcatatttaaagtacttttgataataaagcaagtcaaaaacaaaataaataataatttcataatcttttgaataagacgaatggccaaaagatacaaccaaaaactcaaaatgacaactattttgggacggaggtagtaagtttttttctgcagaaggtccagtgtttgtgaactcatactatcacatctgatctaggttgagtgttaactttattcgatctttggtgtgcaacttcaaccactatttttctattataatataatgataatatctaataaaattataatattgtaaaagtacttataaagtagtaaagtatacctatatgttttctacgctttcaaactatatatttttagagatgatggtcaaagtttcaaaagtttgaccgaataaagtcaacaatatcatatatttaaatacggagggagtactaaatagtccatcacctctagctctattgctgtatttccaaattccaactacttcgataaattgatggtggaaacaagtagtttatatttgtgggagcagaagtgtttttgttctcttagttccgtgattatgagtaaaccgcaaatgataattcactgtttcaataaccagtctgaggtaatgatatctgagaagaaacaaagtgagtccaaactctgacctatttcttgtgaactcctactacgtacagtattagacagtagcgttgaggaagcgttatctgagcctgatctaaactgcagctagtgcaatgccccattctctagacgtggaacttctgtcttaataatcctctggattaattgagtgcagatttgtattgtgtaacaggaattcagatatggtgctgaccacttctggctagaaattttatactcttactctgtttaacctgctgactagtttgtctccctgacaggccattacatcggcgatctcggactccacctcgcaggcttgctgccttgacatgttgactgggagctactatgtccgcaatcctgaatgttctcggtctgtgttttttgatagatggtacgaacgtagtcttaaccgatgtatggtgtgatatatcttccagatccagcccccctgagtcttgattctgctatccttatatatctgcactaagtttgatcaactttgtttgttgaactatgttctcggttgctggcctgtggtagaggctgttgtactgactgagtacgctagctagaaggtatattgtgtagtgatgacgttgagatggaagtgtctgccgacttaaaagcctactactacattttaaggaaaacaactttcgtagaaagaaaaaatgctctcttttgctattgtttgctattgtctagttcgtgcttgttcattttgacagtaataagttgtgcggtatgcaggcttcatttgcaaggtgcaaccacgtcagtttgcctggttataactgatgctattgttagattcaattgtgcaaaccattaccgtttccttgcagtatgcagacttgctgagattccaccgcgatcctattgttgccgtcttacgatgctgtcaatacttgcggccgtatctatctagttgtcatttgcaggttgcaactataaatacccaccacatttgtgctatctcctcatcactttggtggaatttgagcgttccaaaaagagggtatcatgattgttttaccacgggaagcggcgtggtggttgtccagccagtaatttttgctttctgggtctgtgtctgtctccatccatccatcctctcccctcggatatcggatatgagctactccctccgtctcaaaataagtgcagttttaaactattcacgttcaacgtttgattgttcgtcttatttaaaaatttttatgattagtatttttattgctattagatgataaaacataaatagcactttatgtgtgactaatttttttttatttttttcataattttttttaaataagacgaacggtcaaacattattttgagtaccaaacgtgcaactgtgcgagagtaatgtcctgtgatctgatggtttccactgcagctgcgagcctaaccatccgagtgcgccgtccatgcttccctgcggtattattgccgaccttgaccacggtgcaggtgcatgcccgtctctcagggaattaaatttgaaaatttattgttcattcaatttttttaaaaaatattcgggattcaaaatcttttgcacaaatataccatcggtctcgcacaaccattacgcacgtgaaaatgacgtcgcaaccggtatcgcacaagtgcgagatcacgcggtctcgctcaaacaatcagcgctatcgctcaagcaaacagcgaaaccgttccttcccaatttaattatcctgattaaggattttaataattaattaatccctaatcaggataactaattactaattattaattaattgttaatcaaataattaattactaatcaaaaggagcccattggacagtgtcgctgattgcttgaacggtctcgctctttcagtccgcgaaaccgcgcgggctcgcggtattgccgcgggagaccacccgcgacgtcattcctgcgtcattttcgcgcaatggttgtgcgacaccgacggtatatttctatacaagtttttgcatcccgaatattcttgagaaaaaattgaatgaacagtatattttcaaatttaattctctctcaagtgatctagctgatgcaacttaatatggcctagttagtacctcttccatcctcaaatatactagcaacttttagttacatgtctaaataactaaattgttaaaagttgttaatatcctggggaccgagggagtaggacaaattaaacgctcactttacttatatctcaatttcgagagcagtgttaagaataaacgtgaatcgttcattcctttttatcatattaa

SEQ ID NO: 54249 - DNA, 7487 bp, Oryza sativa
caagtatagagataaaagattgtgttgttttaacctcgaaatctcgtgttcaatctcttacatgtttataattttttcttaaaaatatttggaaggacttcaaatctctaggtagtctttcatttgagttgcttctctcctcccctcccctgcatgagccttctagctactactactatagtaccaccactaccactacggctatgaccactgtgcgttgatgcgtgtgtcctaagtgctttcactttactaatactcctactactactactactaattaaggtaggagtagtctttataagcgtacgtgcttgcctgattgggcagcttagttttgcatatcctcccaaattggggaatatatcgatcgactgtttctatacttgtttctaccaccaaatgtgcttagtgtgtgcttactacctgttggcgccaaccgtactacatggcggttttggcttcgaatgagggatatacgtagtacgatgtaaagtatacttatatatctatatgcctttttttcattagaagcaacccgtcgtcttcttccctgcagccaccggtttcatctcagctcggagattattccgatgaaccggaaagtgatcaagcgcccatgctggcctgccattttaatttgtatcttttctgttggttaatttagttaagaacattgttagtgggacggtgaaggacgtacgtctccctctctctgtcaacattggacgtacgtaattaagattgtcaacaacttagttgatttgttgaatgccatctcggttgatatgaccatgacatgtcaccttccgatctgcccggatatacacatctttatgtacggtacatcgagattttcattgccgaaagacgacgacgacgacaacaaaaagcatccacgcgcggctactaacttctcaatagtatatactttctttcgtcccatacagatatgacacacctgtataatattctctattagatttatttttttttgaaacggagagtatggtcgatggagagagtatggtcctatgtacatatgttatcgactatatacaaaaatcttccgctcatggctactagcttctcattaatatacactttcttcataaaaaaacataatacggaaatgtgacacagttgatatttatgtcacgtcccgtatttaagtttgttttttatgggatagagagagtatacatggtcctatgttgctgtcctctatttctcattcagagtcaaagatacgatctggcatgacatggtgattgttgcacactggcacacataaccgatgacacaaccttaattgagatgtggtaactgttaacatgtagtagtagtatatgccaaaagacctgtcgttgatctgttttctactccatgaaacgacttgactccttttctccagcatctatgaaagatcatgcatcagagaggtcaacgaaattattcctgttttatttgtacgtagcggcttggctgggtttgcataacacttatagctcgtactgactactgtagtacagtatctatttgagccaaaccgaacagttgaaagtgctactccctccatcctataatataagggattttaagtttttgtttacactgtttgaccactcgtcttattaaaaaaattgtgttaatataaaaaacgaaaaattatgcttaaagtactttggataataaagtaagtcaaaaaaataataattccattttttaaataagacgagtggtcaaacagtgaaaaaaaaaactcaaaatccgttgtagtacagtggcagcagtacgtcgtctgttgcctctggtcaactgtaccgttatatataaagtgtcactcactttgagagaaaaagaggcatcatgaacacgggcaccaccatttgtatggatacgtaactaccatccatatatatgcatatcagtgtcgaatgcaatcagctcatctcgatccagtctccaatttcaaaagagaagatgtttgaaattttaacattttggtttcttttttgaaaatttactacacaaatatacttcttaaaaaaactaattctatatacctcgcctcaaaaaaaatctctaaattgatttgtctgctcaagctagtctctttttaaaaaaagaataagacaactccattgttcagatagcccaacacagttgaattgctagctactccctccatcccataatataagagattttgagtttttacttgcaacgtttgatcactcgtcttattcaaatttttttgaaactattatttattttatttgtgacttactttattatctacagaactttaagcacaacttttcgtcttttatatttgcaaaaaaaaaattgaatgagacgagtagttaaacgttgcaatcaaaaactcaaaatctcttatattgtgggacggagggagtaccaaattacaaacaatgtctgggaatccttcaagccaaacaaagtgactttgtagacctagagatgcgtcaattttagcaagctcatgtgtaacacgattatgttctctaggacaattcataacttgatagacaaaaaaaaatcattgtaagcgcataaatttggcctatctaatgataacaacttttactcttgatcagacagcaagagttttttttattgacaaaatttaggcatattatctgaaaaccccaggtggccgcgtgtggccgcgcgcgtccgcggcgtgcttcttctgaatgctcacaatgacgccatcctcatcagccgctgcggagcactccaccaaggtcagcatcctcgacgcacaggcgcagcgtacgtctcatgcatgcatcctttatcgtacaagaactattactccatccggtttcatattcctaacattttaaacaaggttaaggacgttaaggtctcttttagaattttgcactatcaataactacaccagcggcatacatagattactcttaaaaagcactatcaataaagtaaatatttatttattcactgtatatatattataatagaaaactataactaaagaaatgttttggcaatcgtgcatgtggaaaatataatttgttgtattctgttgtattgtagtgactctctcacagatatatatagagtatatgtgagatagagatttagagtacaatacaaattttaaaacaaatttatttctagaactacatttatctataataatattctatctctagaattttatcttatctctataatttatatttaaactttcctccgaacatttattttaagaagaaattattagcgtattgggaattgaacgcgggatttttagggttgaaaccacatacctcttgtcactgcactatcaaatgcatatcagagcactgcagcatgatcactaaactccctctccccctaacgactgcaaggcgccgcgtcctccaacccacagtgtgggtgatcgcccttcacattccagagcgccctctccccccctataaataccccactgccagcctcatcttcctccacagcatccatcgcaaaatccacctcagctagctacccaagcgcacgcgccaccgcccgcgcgcgagctgagctagcgatcaacaccggtcgaacacctagcgagcatcaccaccatcatcaccatgcaggcgtacatggcggtcgccgccgctccggcgccaccggcctcgctgacgctgctgccgcgcaccaccaccgtcatcagggacagggagcgcttcgacgcggccgtcccggtggcgccgctcgtgctgaggcatggcgccggcgtcaagcacaaggccgtcgtggtgatgggcgccacgggcaccgggaagtcacgcctcgccgtcgacctcgccctgcggttcggcggcgaggtcatcaactccgataagatgcagatacattccgggttggatgtggtgacgaacaaggtgaccgaggaggagtgcgccggcgtgccgcaccacctgatcagcgtggcgcgccccgacgacgagttcacggccgccgacttccgccgcgaggcggcgcgcgccgcggcgggggcggttgagagggggaggttgcccatcatcgccggggggtccaactcctacgtcgaggagctcgtcgaaggcgacggccgcgcgttccgggagcggtacgagtgctgcttcctctgggtcgacgtagatctcgaggtgctccgcggtttcgtcgcccgccgcgtcgacgagatgtgccggcgaggcctcgtccgggaggtggccgcagcgttcgacccgcgccgcaccgactactccaggggcatctggcgcgccatcggcgtgccggagctcgacgcgtacctccgctcccgcggcgacggcgccgacgaggaggagcgggcgcgcatgctcgccgcggccgtcgcggagatcaagttgaacacgttccggctcgcgtgccgccagcaccgcaagatcgagaggctggaccgcatgtggcgcgcccgccgcgtcgacgccacggaggtgttcaggaggcgcggccacgccgccgacgacgcgtggcagcggctcgtcgccgcgccgtgcatcgacgccgtccggtcattcctcttcgaggaccaagaacgcagcagcatcgccgccggcaaacctcccctcttcgccgccggcaaggccacttcaggcaacatctccgtcttcgcctccgcggccgccgccatggcggcggccgctgcaatctgagaagcgcaggcgccaacctacttacatacacatacatgaccaaacacaaaaacgcagagcaccatgccactctcaagacattcaggctgctgccaatcgccattgccgatcaaattcagagctcgtcagtcggatcaaacgatgaaggctgctgcttctgcggtcaacatctcgactgacctgccaattgcaatgcaaagcaagattgttcatatactggtaactggttgactcctttttgtttttgctgtgtttctttgtgatatgaggagattgatgaattgcgcgcgagagtgtaacttatgagttttgagttttttttttctttttggtttctcctctgattttgggtgtgtaacagtaggagtaaaaactaaaaagtattgacttggatgttaattgggggattgatgtaatagcctctccttgtaacatagaaatcatgagctgaaataattaaatcgttgagaccttgcaaagaaaaagggggaaaaacaaaataaggaatcttgtgaaaggggaatatttggcagtctttatcataatatatcaactttttcaaggtcttcactgagctttgctattgagaatctcacttgccgcgcacttcaatagtctatgactatgctctacactgtccttgttcttaattcgagaccgcatactttgagtgacatgttgtgggtatgagtaaaactcggtggcgcgcaatactaatttttctttacatgaaaacttataattcgcgcaattttgtgtcaaaaaaaaaattcgcgcaatccttttgcgcattccctataaaaacttataaattgtctgtatttataatttttattttcttactttctctatttcattcagaaaactcctggccaatcaacatgacaggtgatacatgcaacatttggcctggaaaactagtggcagtcagccagtcattcctcttgtgcaatgtgtggctctatgctgtatctgtctgtggatacaagttggcatctgcatcagttctggttgcttctttgacatcatattcccaagtcttgtttcttggtcatggagacactctcgtgcatgattgggaactgggtattagttagggcagtgcttgcatgtcaaaggtcaagcccatcatcttcttgttcaaagtcaacttcacattctgaatgcatatgcacatttttacaaggataagcttgatttaacacatattttagagttcacttgaacattgtcaaactctttcgtagaatgcagtggtgatctctctggatagtatggagaccagaagactcagcaatcatcggttcagaatattatataagattcagaaggtcaacatgaacaaatatttatatgaaatagtaaaattggtcaggtaaatgataactttgacttaatcctactacagttagacagtcaaaatggcatttcttgatgctacattttttttctacatggattaacaaaaacgaatgaacgaatcagagttatttgaccaatttatcaaattatgtcaagtggatgatcagagaataagatctgaatatcgcgataggaatgaaatctttggtcaagggtcaatgtgcagttcctgcatttccttccccaaatcaaacctagaactggttgacacttgacagagaatgcaacgactctgtttttgttttcatttttttggaagattcttctatgaacactggctctttgaccaactgcctacatatctctactgatacatgagtgatcagtaataatttctgttgtacaatgttttctatagcattctgatttgccaataataattaacaaagtcaaaagcttttttttttctgaaggagaaagtcaaactgttcttctcaaatacagagtccaacttgcaacatggtgaacaaaacaaaaggaggaaaatacgaaaggaatcagcaaatagctaacaagctgatcattgagcaatgagaaaaatatcacatttaataaaggtttaaagtcaacatttagagcttgcaaaacttttaggggaatgggtttatttatttcatagtacaccaccaaattataattaagtttagaaaaaaaaaactgcatcaagtggcataagccgaataaccacttaacaattgggccctagcgtcttttgcaataaatattatattaataatattattagttagatggcactaatatttgtgattagagctccaaaatgactaatagcacacagatcaaccaaaaccagtcaacagttttatcatttgccaaacaacttatgttcagttacatcaatgcatttgggtgctttactttatctctttccttttgctttttttgttgaaaagagattatgatatttgttaatgacttgtataaatatggttaccacgaatttcatatatttcctttcatgcaacagtcagccaatcattagctcctccacatcttatctgtttatattatataattgttgagttgttgcccaaaagcttttacctcttcttttcaaagagaaaattcagaatgcctgcaagaaaaccagctgacgtcaactttcaaccctagtccactaatcatttgactgaaggcagtaacttactttagcaatccatggtaagcatatcttagttttgtcttttgtaactgtaataaaggtagttgttctgttcactgaacttatctttcaatggtgatattaaccatgcatgccattgttcatcttccaaggtttgatccttgcttacatctaaactacccaaggaaaattccaagtggaacaattgagtaagttaagct

SEQ ID NO: 54250 - DNA, 4337 bp, Oryza sativa
gagggggcctagctagctagaaatgctagagagagctggagtcctagcgcatcaagcaaggaattgtgcttgcaattattcaagtgaaagatacgcttaagggggctaatcatgatcggtcacgagaaagtcgtttataattgggaaaacatgctgatctttcggcggatttcgatggaaaattaaaaaaaacaattaaaggtaacaggaatttttcttgcgctagctttcgcatcatatccacagttgttttttgttttccttcgtacgtaggacggtcgatcgattatcatgagcgaaagaacttaatcatgattcgtcaaatgtctccttttcggccttctaaggacatgcatgcttaagaacataagtagtacttataaaggaccatgcatatgccatatatgattattgatgtgacatcatatatatcttgcatgttttatatatgcaagtgcaagtagtggcagtgtacaacaaaactacatatactgatgatgcatgcgaagaacatattcaaaggatggcttgacctatcgatcttccaaggtacaagtctagattattgtggcagcagtaaattaaaatgtgcgtaccttacatacttaagcacccttcttttgcaaaagaacaaaataataataataataataataatgtgccgtctttcgatttgcatggagactcctacgtctctcttttagtgtgtgttaagaggatgaggtgtgatagtgtatttcaacaaccttgtttgttataaaatgttgggttaattagattcatatcattatattttttatggttttgaaatatattattactattcagctatttagagagatgttattataatttcacaactattggatatgtgccactacttacatcttctagttattttctaaattttaccttatctcaatcttaataaaattagtccgggcttttctttctcaacgatccgacaaaaaaatataatcataaaataatttacctaatatattggcgtgcaattcttttacgcgttcatgaaaaaaaaagtaaaataatttacacactagtaagtacagcggtatagttgcatacatggattcctttgcgtttttcaatatatttcacttgcaaatttgtcatagtccaaacatggagaatggacagattgtaccaaaaaaaattaagaacaatggtacatgctgatgcagagaccattagcacacaaaggggtggtggcgcagttggctagcgcgtaggtctcatagctaaaataagcgagtgatcctgaggtcgagagttcgagcctctctcaccccaccaatttggagcagtgattaatatttgctacgtaatcggttgggtcagtcacatttgcctgatctcttgattagtccatagcacatgatgagctcttccttttcagccagtggatgatactgtactaatacctgatctgacaattgatgcatgacaaattaaaatcaaaagtacttcttttttcccctttcctcagctagcgcccttgtgtggatgctactaactgatatgacaattgatggatgacaaattaaatcagattctactctccaatttgtttttaagggtctcacaattgattacacttaatggcactgattaatagcaaagataaaacaataatggtcagtatgattaaggcgctggatgccaaatgtatagccaccgtggctcattcgagccaagaaataccttttgatttcaggtgtggtcaagttaatacatagcgtatgcagctccgtaatctggagcagtgacgtacaaaatgctcaccaggataaagtaattgagcttgataggtggtgagggaacaatagacacgagaattgacacttaaaagttgtgagaattcccgtcttcgatgagatatactacgctagatagcaatgaagggtcaaagaccacctactagtatcagaacaagtgtacattgtattattgcattctgcaaagttggagcctagggagagttaaaagaagataaacaaaaccagaactcctgtggatgccttctgcaactagagagagtcatagttggtgtcgccaccgccacctttgctccagttgtcatgccagtcagagaagccagtaagcaaagcctcttgcatccactgataccggcactgcgacgtggcttcaggaactgtcaaccaggtcctcctgcgggtgctctgctcaggccatgagtccagctcttccttcacatgcagcgcaaacaccgcggctctgcacataccctcggggcagcacgcatcttgatgcgtcttgcttttgaagtcgtagaaacccagaaattgctggtccagagaaacaatagcattataagctgaagcaaaataaatgccttttgtgatgtatgcatttcacaaccatgtattatcggcagaacaaaatacacaagtgaaacaatttataagcatgtattttcttaattatcaagcagtgataggacaaggaaaacattatctacgctgaagaaacatgttttagagatatttaataaccctcctagaaaagctataatcattctaatttcatagtgcaacaatgttattttgattttggtatccaacactataaaatgctgaacacgttagttgcaactgattcttgactaaaagagtaccaagtcagagaaatcaaagcacataccatattaaactcaaacgatggaaacaacataaccaactaaaccaatgaactagctgcgcatcacatcttatgacccaccaaagcactactaaaatttgcatcttatggtttttccactatgaaagtatgactagtttgcacatcttcataaaatctatgatgatactaattacacacaatgcaaaccaaacaagtatccttttaaccacaagatagtttgtttctcagttgcgccatgtctgtactccgcagtacatgtcacacagcattaacaattagcacctactacaatacttggtgcggatggtgtgtcttgtgagtacaacatatgtcaatgcagcagcaaactaaaaacaatattgtgagtgtggttgtgctctgactaataccgtgaatcacgtgaacaacaatattccaatgcaagtgatatgcaacccaagaaaaaatgatcaagaaaataaatttgatgggttctgaggataatgcataagaactgtagctgccagttcctaagtaattgaattccccccatccattgtttcaaattggatgttaataactaagatggtttgttgcagacagacatctcacgatagccatgaactcaatatttcaggaaaaagcaggttccaaaagagggaggctggttgatctacattagcagtttagaagaatcaagcttaggctcggcttactaagcatatattgaagaagataaatcaaacacagtgaatacgagtctgcatcacaatccaaaacatacggtaccagtttgacggttatgtaagagaaaaacacatgcaaatatgtttctgacacttggcaagcctgaagtagataaaatacatatgtaaaagtagtagaaatttaaaaacaccatctctgatgtatcttaccactatatctccacgaactccagcttcttctacagcctctcgagcagctgcctgctcaacagtttcatcattctcccatcctccctgaaacaagaagacacagataacaaaatttccacctagtactatggtaatgtaacatttatccaacaaacaaaatctgatgttatgcagaatctagaaaagtaggtgaaagaaatttctcagacatactttatgtatgcattgccagcttatcaagctaaatcagtaaaaagtacaaaacataatttgcaatggactttggtatttcttaatatgcaatgtttacacctgcatctcatttcattcaaacttcatatggattcatctgagaggcagaaagaacatgataaatgccaagagcgacactcttccacctatgggctaactgaaatatcaatatgttgctcatagtatagggtatatagtgcagtagcgcttcagtgtagcatgtcaaaacaggcaatttttgtaaatttatagcaattcatatcaagtaaaggccaatccaaatttagatcataaatcatcaaaatttatattcgattttttttcttgcaatttcatgtaaactaaccgcccataaagagtttggcaaacttatgcgtacacaatttataaacatttttttcatcatcatgtatttcttgattctaattcagatgggaacattacctttggaaacaggagacctggaccactttgagagtttatcatgagaacttcaacaattttctt

SEQ ID NO: 54251 - DNA, 1953 bp, Oryza sativa
aatatgttattagtaacttctacgcacggccacatgattcacaaaggttttttgtccaacataaacaagctaacaagatgtaaaagaaaaatactgaatacatgtgaattgatatagttctccaacatggtaaaatcgtatccagagaagaactaggtctgtcacagaaagagccgaaaccagtagtccttagagtgtgcatatatatattaaggcaacaaatattgcaacactaacctacaacacaataatgtatatacatgtaaaaggtgctacttgagctagttcctgccaataaatgctgtaggtgcacctcccaacctgcatctcaacaagcataagcagaatttttttgtactatgaaaaggaaagatctagggaaggtcaataactaaaatatcaagacatattatcgatgaaaatatggttagctttcattcccccactctatagttatatttcctttgtttagatctgattagctgccccatctgtcatctcctgattaacattttcaggttagctactataattccttaatatttacaaaaatctcatcctgagtactgatccaccagcctaagagaagtgcaacagataatagcaccacaaactcgttagcttgccatgccataatgcacagaaatgcttccctagcttagaaaaacagaagaacttaactaagagtaagcctaaaaacagaaattggtcacctatcaggaacaaacgctttgactaccaataatgattcatgaccttttcgtaaccagcaatatgcagcgacatcgacatacactgagaaatgtatctatcaaactaaactcacatccatcaatcttgacattggaggataaccccattcctaataggcttaacacatgctgctaaaaatcattctcatggatataccgcggaatgggccgcagaataatgatgtcgctatcatcaggtgttgcaactaagattcttagctaagtgctcacacacatcaagctatcttactagttggtgatagtgcttgtttcccagagagagaaaaaaaattaaagcatatgcaaatcgccgcgagaaacattccacacccagggatggcatccccaccgatcacaattcatagaacccaatccgaccaatgccatcgccctcgtacacgcgcattaggttaggtcaagaggcgcaatgaaccgcacgcgcgcgtagccatcgccgcaatccaatccaccccaaatcaaatcaaggagaaaaaaaaattaaaaaaaagcaacaataattcgatggagagggaggaagctgtacccacccggccaccagccgccggccatcctcgtaccgctgctgatgccgacccgttcgggccacaaggtcacacatgctacccacaccgcccgggttggccgccgccgccgctcccctcctcctctgcggccgccctcgccggcggtgagcccacggcggcaatgcgtgcggcgtgggggagcggaggaggagagagatttgtgcgtggagagagaagaggaggaggaggaggagagagataggaggtgggaattcctcgccgtgatgagggcgctctttttttttcgtgcggtttttttttctggattttttttgtgtgtgtgtgtattttggtgtcgttgggttgggcgctcgcttttatttggagggcgtggtgggcggtgactttcctttgctttcttttgttttttttttcatttctctttctgttttctgtttgttattttttggagttagttgccgtttttaaagatatcttttgttgtttgaaggatgtattatttgaagttagttgccgtttttttaagatatcctttgccattttaagatattctttgccgtttggaagctgctattgtttatacagtatcttagatttttcttttttagattatatacgccatattgaaatacttgtagtattgtatgagtgttgtt

SEQ ID NO: 54252 - DNA, 8620 bp, Oryza sativa
atagataactgtataatatggcataaatgttatcaagttgtatattaaaccgtctattaatctttgcaggaaaaatcatctgtttataaaaagtccaacaattaattaatcatctgtttaaccgtttattaatctctcatctttctctctcctcaaaaaagcccaacaaagcatcatggcattctttctcttgtcaggctggcatccctgcctattcaatctcatacttcaattccagtgcaataaaagggaaatgagtctctatccttaaattgctcgaatgtataataacaaggataagccaaatttgttagagttgatatattatactctttctgatatccaagttgagcaaaagcgaaagctaaagctctttcgaaatgaaggtttttcaaatcattcaacctcgatcgttttcagatgatggcaagtaatactccttccgtcccataatataacagattttgagtttttgtttgcactgtttgattactcgtcttattaaaaaaaattatgcaaatataaaaaccaaacaattatgcttaaagtactttgaataataaagtaagtaaaaataaataaataataattctaaaaaagttttgaataagacgagtggtcaaacagtgcaagtaaaaactcaaaatcccttatattataggacgaagggagtactagattaaacaatgcccagtcgtgacgataaagaagaacattaattccaagttgtcttttactaccttctctagaagaaatacagtaaccgcccgggccgtttgtatgatatcgccggccgttggagggagtcactggccggtcgcatgaaattctgataaggcagtactccatggtccgtactattaaatgaaatcgttttggacagcgacacggtctccaaaacataactttaacttcttgtttctataaaaatatttattaaaaagtgatatatgtatacttttataaaagtatttttcaagacaaatatattcatatattttttacatttttaaattcagcaacttgagagttattcatgatttatattcctaagatttgatttaaatattaccctaaataactttctttacgagtacggagggattactacctaccaataaaaattgaacgcagctatatataactaacggttttgacgacgaattgatgatgataatgatacactaccacgcgagcgagctgttgccctgttaccggcagtaggagctaggagtagtaaacggcacaaaaattctccactataccaacattgtttttataaaaaataatatcgttttcgatcgtttttatcccaatgatatgccaaatatcctcgttgatgttgttgctactcgtaaatgaggcgaaagagcaaaaccatggacggggttgggcgccggccggacgtacggccgttgttttgatgggccgtgcgtgcgtgcgtgcagcaaccaagggccgttttggattgaagccaaaacgtgaccctacaaaattttgataactttaatagtaaatatgctagtttagattgtagccaaacaattgatagtgcacacgttcaatttagctatattctagaatcttctttactctcatactaaattttgactttatatcggtattaaaccaaacatagactagctaactttgccttaccaaaaaaattggtagtgccaaaatttacctagattttagcactaccaattaattagtagggtagagaaccaaatagaccccaagtgccaaacttgttcttcccctgctacctaataagctacagttgtagagtacctgttacagagaaatcgattgcgaaatactgtgacgtcgtttataagaaaccgttagttttcaatttttttctttaaacttttaacttttttatcacatcgaaacttttctacacacataaacttttaatttttttatcgcatcgttttaattttaatcaaacttttaattttaaggtgaactgaacacaccctgtaatgtgacgtttcttgcgcaagatcgcatcctcatcgtcgtcgtcacctctgatgcaacagcaacggagaggttgatgggatccgcgaattaaccggtgatttcgtgggataagcccagtgaggcccacgtcaagcccaaactatccacgcggcctgcctgatttgaggggacttttcgcagtgaggcctcctgttttggagcgctacaaatacacaaataatcccttcgtattttaatatatgacgccgttgactttttgactaacatttgactattcgttttattcaaaatttttgtgaaaatgtgaaaatatttatgtcatgcttaaagaacatttaatgatgaatcaagtcacaataaaataaataataattgcataaattttttgaataagatgaatggcaaacgttggacaaaaattcaactacgtccctgtttaattcggaccgcttttgccggcaacagttagccaaggccaaaagattctatactactctctcattttgggtagctgatatttagattctgcagtttgcatgcctacataatcaccatcccacgtcagaggagcttcttcccatagccgtaataaatctaaattttgcttcagtaatataggcgattggtttaaagccattttttcccccaaactatacaatctacactatgttctttttttaaaaaaaaatagcacggttttactagttggagaaggctgggaaagcacccccttcttaattcttaattacgtggtggcttctcctcctccggtgagacggcctcttcttggtgctcgtcggtgacagccaaacacaaactagctctggctgatcaatctctggatatgtgtcatgtgcatttgcctgctctgaatcttcgcaaatcctcacatgttgctgcacggattgtatcacacacacgacatactgtcacaggcatggcgatagctaatgtttttctcttcttatttttttaatcaaacaatcaacgagcatactcctcctatgctgctaagctacttcattcacattgcgtggtgggcactaactgtgctaccgggtcataattccacaattaatgaagtatcatcatcatcatcatcatctcggatcacgccacacataatctcttcgtcttataagagcagatacaatagcatactattagccagctataaacatattttaataagataaaaaataagagagaagagaagcgggctataaatctgtagcccgctgcagcacggactccaagacacagtatgtatgactagtgagaccacatattaatagtatagtaagcaactattgtatgaattggctattagattggctataaataaattggagctagtagtaggctatactattaaacttgctctaaaaacctaaagtatatgataggatatgacataatctactatacaaatctagacaggtactccataaaaacctaatctaaaataggatatgtgctaattcagtacttatgtacatctcgtcctattcattactccatccatttcaaattgacctgtatatttcatagggacaccaagaccaagaaaaactaataactctctcatactatatttactctagcaacaaactctatgcatacactatccccactatttcctagccaatagcaaatcaagatattgcacgtggcatcactgtccatttactccaatgcacaaataacgaatagacttaataaatgaacacaaatatgtagattatttaggaataacctaaaaaaaactatatgtagatcaatttggaatggagggagtatattagattatattatattttatttgtaagttgtttttttaagacggagtgagtatatgtattcttgaatcttcctggggcaatcaattattaattgattaattccatgaatagcacaccatatacggtacatggatcaaacggggtagagaaagttgacaagtaattactcagctgcccctattaaaccccatcttattcaagcaataatattaatacagccggattgattgcgtagctgtgtgcaaggctgggcgatttagataaaatcaaagcctcgaaaggttgttgcttccggggctttgcaattatcagagattattctttttcttgttattgtttcgtatcggccattctcgtgaaaaagggagaaaggcgcgattatcgttttcgcccatttaatcccgtccccatccgagcgacagcagcaaccgccgtgatcttccccggatcacgccggccgcgcggatctcgtggcctacacaaccaccgttcttgctggtccatgcactgaatcgccggagttctcggcgacgacgaggagagaggcggcggcggcggcggcggtggcgggatgtcaatgccgtgggcgatggcggtgtcggtggtggacaaggtgtgggcggtgctggcggcgtgggtgtcgtcgtgcctgacggcggcgaccgccgtcgcgcgagcgctcagggcgggggacatcggagtcctccacgtcggctgatggcggggtccgtcgtcggagtcctccacgtcaggtcagagcttggagatggttaggtttcttgcgggggatgcaaagctttagttctgagcttttctttttttttttttttttgtgatgtgttatgcaactatccatgaagatttatgtgatgggaggtgcttggggttagtgtttcacctgtaattaacatttgttttaggtctctgtattctttggtcttatcagaaaaagatggtttgtgtataaagttttatggctctttctagaaaagaaattgttagctccctcgtcgaggaaggtaaagttggataagatgttcatcagttcataccattgctgaaggcccttcgatttcatttttccgttgcatactttatcctcatccgcaaaatgggtttgagatgaagttcgcggtatgctccatactccacatttgagagagaattgttatgtgctcaggacaagcagattggccacatttcagtttggtctaattagattctgttgagagggaaccttaccgcattttattagattacgtgaagcccgcaaatctattgaagagtttttgcttatgtttggatagaactacgtcctgcattttatttaatctgttcgtatcaagcgttattgcgtttacacagcatagaagctctggtcctatccatcctcaatgccagagccaaaagacaatttggcagattatccctttttttttcacgaacacaatttggcagattatcctcaatgcaaaaattcaaattcatgtttgttataatccaaaattcaagtaaaatttgagtaaaaagacaatctgacatatcattctcaatgccaaaagaatccagggccattaattaaaaaaagaaccgagacatgatatagtaacagcacatttgctaaaagaacaaaattgtacggcagtactaatgttttgccagagctagtttagtcatagcagtttatcagctacataattatagccgcaaaatgcgaaatccaatacgcagaacgattgattgctgaaaacacatctgtacataaaagggttctctggacaaagtttcacgttatgaagctcagaagtaaaaaattatctgaaaagatccggttgatgggcagtgaaaggaggaaagcactttatttcagcactgtccaggagagcttcaagacgatgtgttcttcctagctgcatagactcggtaagcagctattcccacaactgcaacggcagctccaactgcaaattattagtacagtatcagttgagttagaactcgaaggaaatttacactattttatagttttggaaataacttataaaatcatgatcgactgtgcacatgttgctagactgacaacaataaacctttacgtaaacctcttctttcatattgtcatgaactttctagtagccttgttgaacaggtatatctattgctatactaataccagacttcttgctattatagatttatagaatatatttgtacaatacaatgcagtataagagcgtaaatgcgacgagagtaaacacaacaggactgtcgagtgtggaactggctttacctgagacaaccataagggaacggttcagaagttgacggtattgtctgcgtgttttcccagcttcagtctctggaatgctcagatgaggctgctgcgcagcatggactattctacagaaaatattgttcaaatctctcaacctcacgctaataggaattggcatttcgattcccatgtcttggctcacctgaaagtacataattttgttgttaattaaccatagaaagacgactaaaagtaatccatagttgcacagagaacagtgagctaagcaaagttgagagaatcacttgcatatacatcacaaaaaaaaaagccagtaacaataaattaaaaaacaaagccagtaacaataaatatttctgaagaaacacccatttaaagttcttgcagcaggactagatatttgcacaataggaatctataagatcatattgcaattgatttgcataagaaataattgcagtaaggctaaaaacttctatcctagaagatttcctagctcttctccaaactgttgttccttgacttggaacaacaccactgttattgggagttactccctccatcgcaaaacaaataaacctagtataggatgtgacacatcctaacacgacgaatctggacagcgttctaggatgtgtcacatcccgtactactgtactaggtttgctttttgagatggagggagtatgctgcatggcagcagaatcaaacatgcattgttgcttgaatatagaactacagtgtatgaaaaaaatagtagaagcatagcggtaagtaatactatatctccggcattcataaaatagtgatcaaaatgtaaagggaaacagcttccaaaactacctgttatccaattcaaatgtctgggcaagaaaaatcaaatattttagtgccaactatgacacagaacagtggcaaatgattttcagagtaaaaatgacaaatcaataacgaacatgtagtaagcttactctcgttgattcctgcagagccaatggagattggtcaagatcatccttagcagcaacaatcagacaaggaacttcatagccagtattttctccatgtgtagccacttccacaagcaaatcccttgttctttgccaagaaaattcatcacagctgccatttaaacaggcataacatttagtgtacagaaaattatatacaatttgcataaaaagatatatccggaaacaagagcaacattgctgttgtgtgtagcttttgagattgcttcattccagaaaatataatagattgcctgtcatattatattttctatcacctttttaatattatttaaaaaaatcatcctgaattgtcaactgtctggagcaaagctaatagagctaacaaacatcggtccttacaactctccaaaaccatgatgtgtgtagaaatagttcattgtccagactaattcaacccatgtctataaaaaagttgagttgctacagctaataggtaaagaatccagttacttcagacaatgcactgaggatttcttggtcataaataaatagaacaatttggcagaattcatacctatcataaacgaatactgctacatcacagggtgccaaggattccctatcagccagtaatggtctgacatcatcttcaggaatctctcgaaatacaagtgtctttctggaccccttcagaaaaataaaattatttaatcagaccaaatgtttaaaaataacccataaatagcaaacaataaatagccaaactgcgaatatttaaatatgctaatattggaaatgacaatgtttgcgactgatgtactagtactgctaacattttttctgtcaaaaaactatcgttgaaagtaatttctgataggccattaagattcctgtctgttgccatcaaaatgcaatattttttttcacatggtatgttggccagtactatgtttcataaagaacgaagtgaatatatcatagaacatttttaaatttgcaagcaagcaaattttgcactcttataagagaatttatcagaatgtttcaatatgttggaagaactcataaccacttacagatagttcaacagtatttgctgcaaaccgttcaccattcataggcagagcatcagaaggttgcctggaacagggaccgcaagcaaatggtaagaaataaacatggtaataaagatataaagcacatagtgtaagatactaagaaatgcatagagcaccttccaaggaatgattgtagcaatgctgtctttccagcacccctgggaccaaaaacatagcactggaaaacattccgttgcgtttgctgctttttacgatcaactcgtcttttcctcatagtggtaaatgctgagccaaaatcacccgaatagccaacatatataaggttggcaaaactatttgctggatctagaagtgtcataagagcccactgcaattgcagaatagttcatcaacaaaggaagatagtataataagaaaatctaacaccaatgcagcatgcttagttctagatagtgctatcgctgcaattgacacagt

SEQ ID NO: 54253 - DNA, 4636 bp, Oryza sativa
  unsure (1)..(4636): unsure at all n locations
ccatgattttcagtaaaataaaactaccagaaaaaagaagttgactagcattcacattacagtaaaataactgtgcaccaatgcgttaaacttacattatctgtgtcaaacatattgaaaattcctctcaagaaatcaatggcttgacctgtcaactccagggtctgtaaggagaaaagttgatattgacactaaattttatataaaaagtaagtatgataaataccgcagataaatgcttgctgatgttaaacaacaaccaacatactattggaatcaacaattcaagaaactgccttagtggttcctaagagtagagctattctactacagtagtaacctagtaatgttagcaatgaagatatcaaacattgcaagaaacaaaagaacaaacagaacaccaaaagagcaatttctgcacttgctggaatagtaatgctatagagaacactatggttgaagaaacatctgacaggcagttttaatatatgaaggaacagcaactcgcatatcatgggtactaaacagcatacataacaaaaaagcacatataaaaataactagcttcaacatgaaataaaatttgaatagtaaaagcactgagcaacacattacttgatcgggcgctcgtttaattgttggaataaggtcatctctaagcttgatttcattatcataaccaaacttccttaggacagtccatgtagtttctagtcgtcctttctcaataaaaagagcatgaagaaaaaggaatccagtcaaggtaaggccattgtcattcacgccttcaggcatcttctcttgaaccactctcttcacgcctgcaatttcagtaggctggagaggagcattgaagcatttgacctataaagcaccagaagaggttctaatcaacaccataaataacagaatggcaataaaaagcactagagcagaaagcaaggtagactaagtgaatacaaacctgaaagtcattgagctccacatcactgagtgctccatccctgtcatggtcacatagaataaaaatccgcttcaaagccctcacacaccgtggctttagagattgcgcctcttgatcaaatagaggtgctgttgggtgaagcaccgccttctgggcatagtagaagacctcgggaacctgaaagcattcataaattatattctagttaacccaaacctagcacaatatctggaattctatcttagtagggcaccaattaagattatcaagtgcatagtacaatagatgcatgatcaactaagggcattttttatgggtttgggaaattgtatcccaccattcaaaggataattttcaatcttagccatcagtttttgccaccacatttcatcttaaccatccactcatttccatttcccaatctcatatctcataacccatcatataaacatgccctaaatttattttcagaataaaacaacataaggatctggttatggactatgtagtcaaccataaaaggatggcaattgggctagtattttgagcatgcccaattcagattgaccaacaagttgtaatcaacaaaaggatggcaattgggctagtattttgagcatgcccaattcagattgaccaacaagttgtaatcaacaaagaactattgagtgcacgcatttaacctggatctggcgaagcgcagagcactcaatgcaggtctcgatctctctgaatgtctgcatgatgggcgccatcacctgctcaaggctgacctgctgctcgtccctaaggtccagcttacaccccacgacaatcacaggtgcctttaactgtgataggcaaacagcaagcaacacgagatcacatcggaccgcccatgaaaccacccattacgaccgatccaaatcctacgccacgaacctggaggcggcggagctcggggagccagaatgtgctgagccgctccagcgtggcgggcctatcgcaggcgtacgtgagcaccaccgcgtccgccgcctggcactcggcgatcagcttcgccctgtgctccggctgcatccacacagaaatggaatcaaccacacagaaatggaatcaatcaccgagacgaacaaggccaaaatcgcaacggagtccatccacaaatctaccgactaagggaacacccccgattcatcgcgggccgcggcgcgatctagcgcgagggaggtgagcggacctggaggaggtgtcgacgatggtgattgggacgcggtcggggaagtagtcggcggggaggcgggtgggcggcatgacgcgggggacgttctccgggaaggcctcggtggcgacggagacgacgaggctggacttgccggtgccagggtcgccgatgacgacgacccgcacgccctgcttgccggccaagttcgccgctgtcgccgcagccgccatggcgcgcctnctctctctctccctccgctcgccgcgctagggttttgggggatttgggcgcggcgctgcggcgagtggtggcgtggcgtggcgtcgcgcgggggtggggggtggggaggaggcgtcagagagtggggccggctcgctctttatatggagtttggttgcaggttgcttcgccttggaagggaagaaagagagtgtgtctgattgaagactcgatccctgtgtgggttgggctttctcacataggccatgattgaggcccatacaaggaggccttacgtgttactgtgtgatgctgcgagccttttatgcacagtgcaaggccctcatctgcaaatcagcacaaccacatctggggagcgtttgttcggggaaatcactgagttacaaaacgagatttttcgatggtacaactgtcgtggtgcctacgtgacgtagctttcgctgaaatttcaagttgactttggtcaaccatcgtgtgacctcccccattgctggtcaccaagaagagaggaagagaggtggacagaggaggggaatagtcactaccatgtgggtcccgtgtgggtcccgcgttgattcagttgtcacgtcacgtgaaataggggacaaaaacaccgaaggatctagagtgacctaggtttttaagttgagggatgccatatatctggttttcggttcaaggataattttgtaactcggcgactaagataagggatctcaggtgtatattttccttcatttggagaagagatctttagtttttcacgcgtacgcttctcaaacttttgaactgtacctttaatataaaaaaaaactatacgaaaattgctttaaaaaatcgtattaatccattttacaaataataattaatattttaattaattatatgctaatggatcgtctcgttttgtctattctcggtcttctccaatcctctcctcacataaacttctttaaggccctgtttgatttagtttaggattattataatctggattattatgagtaagctaaaacaaacatatagcttattatgatagattattacaatctataagctagattactataatctggtaatccactctaaacgtgctttttttagattattgggtagctaacagctaataatatagagaaacaaacaacaaaccgcttattctatgtctgcttattataatctagtttatagtaatctggctcaataatctagattacaataatcttaagctgaaacaaacaaggcctaaaccacacaccaggacttattctatgtcggcttattataatctagtttataataatctggctcaataatctagattacaataatcttaagctgaaacaaacagggcctaaaccacacaccaggaaatctaaagccatgcgatgaaggcactctaacccacagtggtagttgcccaagcctaatagccacaatttaaccaaaaacgtgaacttttgatgctatataaccaattttgcctttatatttccacatatatgttggcctctagccgtgttgtctttctccgtcgatgctatcttgtcgatggtaataggcatttctttttgcctataaaatttgagagcttagactaaaatagagtgagctcaattttcatatatttttggcctagaaatatttaataactaggtacgtagattgtgaaataaaccgtgggctttgacccattaccacctcacaaagtgaattatgcggtgatctagtacgtgatctttggtgaaatgatttgtgctcctttacttgttactgccttaactgtgtgtcattcaggtagtactgatctctatagttacctatctaaattaataaaactacgctcctgattttactagtaagcagtagcaagagacatgtaaatgcagcaaactttgtgacaaccattttcaaccattcaagtagcattcaacagcgctgaattttaaccagtaccaacttcgcattagaaataccatcaatacaaatagtttctttagaagttgcaccgagatagagtttccccacctgaattatcattaagggagagaaagtacaaattgttttaactaaattacattggaatgtagaggaagaaataactactttccaagaatctattacaactctagctaagaaacctttccaacctttccgcccagagggtatagagacaatcttagcgagagagcaagatattccattgaagacaacatcaataccaataa

SEQ ID NO: 54254 - DNA, 4890 bp, Oryza sativa
aagtacttcatcaaaaagccatgaaccaattcgttatcataaccaaacttcctaagtacggcccatgtagtttcctctcatcctttcgcaataaaaacaacatgaaggtaaaggaatccaatgaaggtaataaggccattatcattcacgcatccaatcatatgttgttgaaccaccctcttcatatctgcaatttcagcaggttggagagagaccttgaagcatctaacctgtaaattagcaaaaataaaaaagaagtccaatgattattatctatataaatactcagtcttatttttaggatatataatttgaaaaaggacatcctaaagataattcggttgcaaaataaaatcatatgtgaggatgacatgtggggactagacacatgtcaatagcacatatgatggtattttttataactccacaattttacaataccaaacaaatcggtatatttttacatgaccataaaaacaactatataatttggtataagtgagtacaaaccagaaatgcattcatctccgcatcactaactgcaccatccttgtcacggtcataaagagaaaatatctgttgaaaagccatcatgcaccgtggctttatagatcgcgttgctttatcaaatagaggagttgttgggcgaagcactgccatttgggcacagtagaagacctcatccacctgcaaatattcaaatattcatttatcacgtgaaaacaacaattattacccaatatctagaatctatacatcagtaaattataagtccaaactacaatagatagacaatacggttatgaattgaatttactacgtggccaaccatgcataaaaaaattatggcaatttatgagctagtattataaacacgcctgaccaattcagattaattaattgatcacgaattaacgaacggcgactcgacactgaagtttgaaaatgcatcatcacatataattttaggtgtgtttagttcacgctaaaattaaaagtttggttgaaattggaacgatgtgtcggaaaagttaaaagtttgtgtgtgtaggaaagttttgatgtgatagaaaagttgaaaatttgaaaaaaaaaaagtttggaactaaactcagcctttaccacacattttacctttatccggtgaagcgccgagcactccagatagatctcaacctctctaaatgtacacatgatgaagtccagcacattttcaaggccggcctgctgctgcttgtcacttaggtcgaccttacaccccgcgagaatcaccggcaccttcgactgtgacaggaaaatcacaacagaaaacaccacgaaaccaacatcgatctcggttaattagcccagaaattaaaaccaacgaccaaccatgacggccggccgcgatccaattaatcgcacatatatacacgaagaacctgcaggaggcgccggatcttggggagccagaatgtggtgatccgctccaacgtgttcggcctgtcgcacgcgtaagtgagcaccaccgcgtccgccgtctggcactcggcgatcatcgatcacacgccgaatcgatcaacaccaccaccagcacaaatcaaatcgacacacgacgatgacacacgattaggggagagaagcgacgaagcggctcgatttggggagagaggcgacgacggcggcgaacgtacctggaggaggtgtcgacgatggtgacggggacgcgggcggggaagtagtcgacggggaggcgggcgggtggcaagacgcgggcgacgccgtcgtcctgatcggggaacctcccggtggcgatggtggcgacgaggctggacttgccggtgccatggtcgccgatgacggcgacccgcacgtccagcttggccgccgctcgcgacgaccacgcgacccccatggcgtctcctccctgacgtctcctcccctccgcccgcggtagggtttttttgtggggggtttgggcgcgtcgcgtggtgcggccgccatcgctggcgtcgactaaaatagagagagcgagagacgaatggtgggcatgtatggacttgaaaggcctgttgggctgggcttttcggtgttcctactccatatgcctaagcgaggcccacaggaatgagggctcacgtagtcgtgatgtcatcgttttttaaagataatggactcagttaaatactacaaaatgatacattctaagagtccaccccggtctctgtaaagaatgcacacagcaaaaaaaacaggatctaagaagaccttctcatcacaaaacagaaaccagtcgctatcaacctggctatcaaccaatagactagatcgcgactcatgcttatggataaaaaactcccacctagtccaaacgttgcgataccaccgtagtagtatcccgaagtcccggtttgtgaaggatggcccaagtgcgtagccaccggataactaaagtagtaatctgcaaatgagaagacacatcatacatcggtcagcgtcagccatcgcccaccgcagtgatcgccgtcgccgtcgtggagtcaatgttaaagagtttttttctaaatttttttaaaccttcttaattttaaaaacaaacaattccaaaatttatttttcagtcttactaacccgtctcgcagttagttaaggtgacgtggcaagacaacacccggaaaggtttgttatcaaaattagaaaatttcaaaaaaaagaaggaaaagctccagtaccagcctgagacgctgatggcatcgctgtgaacgaccccgcccccagcctgagattccgtattatcgctctcagatctcagttgttcgtttcttctgattgtttttcattaattgaagaagcttctttgctcatttggtcattttgatcgcgatccactcaagcacccgggctccactataataatgcaggctagtgtagcagcccagcacacacacactagtgcaagcagctcgagcttgagctccacctcgccatcgccggcgacttctcctgtcctgaccggccggagctccgatcttggcggtgaccaagagacctgacgagacgatgtccgccgccgccgccgccgccgcatcctcccccgctccccggtacgtacctggttctggtcgccgtaatccgatctcctctttttttttttcgcacggtcttcaccggcggcgctgtatgttagtttactcgatctcgaatccccgatgcgtcgccgccggtgaaggtcccgggctttcgccgtttgccatggcgaaatcgagggatctgactgactgactgactgtccctatccccttcccagtaagagtgggctgctcaactgataggttttggtgtgagagtgtttggggcttcttcagattgcccagaggaaaccccatatgttcttgaactgaaaagatgaatggggaatctcaatgttagtcaaagggggaattagtttctaattttcccttcaataacatgttagctggtgtgtcaagtcctgtaatttgtgaattgtgagagttcaggctagcaagattaagcttgtattttgttagaaataatgtggttaaaaatcatgtttgggtggttttatgagaaaaaaactgaaaacattgttcgcgaacaagcaagtaaacaactttgcaatggtgcttgcctggtctttcctcaactaggataatgttcttttcaagttaattagctgtcgcaactcactagtagaagtgcctatagaatttaatcaaaacggcggctcacttatccttcctctgccccttcgcaactgcattctggaatcagcttgaaatcccgcagactatcaccagcgcgagcgacctccatgctctgcgcccaaatggccgcctcccaacaaaacacttcaaggttttcttcttgctttgtctctggggattatggaatcatcgttatgatgttgtcttccgtggagaatccccctctctgcatagactagtttctagatgtattgaggatgcaaccttgtgggcagagagactagtttgtgctgacaggatcgttgtaatcctggaaacaaattctttcctccccccttcgcactatgtaatccaaagtcgtgtactcctatctttcaatgaaaattcaggtggggaagctctcccccccggtgaccagtctaaaaaaaataatttaatcaatggttcatgaaacactggtaattctgatactaaatacaatttgcatatttatcagttctttaaatttgatttgggttctttcctctggagaaaaggttggaaagcaaggttgcgctggttaccggtggtgcttcaggtattggtgaagcaattgttcgcctctttagagagcatggtgcaaaggtatgtattgcagatatccaagatgaagcaggtcagaagctccgggactcccttggaggtgaccaagatgtcttatttgtccactgcgatgtttcggtggaagaggatgtagcccgagcggtcgatgcaacagctgaaaagtttggtactcttgacatcatggtcaacaatgctggctttacaggccagaaaatcacagatatccgaaacatcgacttttctgaagtcaggaaggtaatcgacatcaatttagttggtgtattccacgggatgaaacacgcagcgcgcatcatgatccccaataagaaggggtccatcatctcattgggaagtgtttctagtgtcattggagggttgggacctcattcatacacagcaaccaagcatgctgtggtgggtctaaccaagaatgtagctggggaattggggaagcatgggatacgcgtgaactgcgtatctccctatgcagtgcccacggctctctccatgccgtatctgccccagggcgagcgcaaggatgatgccctgaaagacttttcgcctttgttggtggtgaagcaaa

SEQ ID NO: 54255 - DNA, 2410 bp, Oryza sativa
ggatggtggctttacctctgtgaatcacaatttgagagcatttgaagattaacagaagttgttaggcacaattggtactctagtttcagatgctatgtaccattctgattttagaactttgatcaattacctaaagtaagaatgtcaataaggaatgcaatcttgtatctgtggtattgtatagtactatgattgtattgcggtgcttaaggacaatcattgattattatcagcactattatgttacagttctgaaaactggtatgagttcatatagcatcaattattcaggtgtgttaagtaatgcttctatgtcagcatgcctacagtacagagttgcaaaccagtggattttacagttgaataaaattgatgcccattggtgtatataatcactgatgacatgcacaaaactgaattttcctgaattggcactactgtgctcactctaacagaatcattgacttatctgaagaaaaaaaaatctgcagataaaagggattcttctactgatgaaaattgtattggacgaactttcattgggcccgatccatgaaagaagaaactgacagcatgagattaaactggttgtgccacgtctaaatattcagcatacatgtaaagtgcgaaagaatggcagccaactgatttcactaatgcatgtgtgatgcaacaaacaataattttacagtacatgtatacaccaaacataaacatatcattagcataagacgtatatcatcagtcatcaccatctgcgctacagtttctctataaacggagatactatggctttcccgtacaacattgctgtaataaactatcaccggtaatctttcaaactctagcatctattcatcagctgaagaatgttgtgaagtcacagaatcagtatgagcagctgaaagatcgtttgagtcagctgcatctttgttatctccaggacagtcagaagtgtccaaatttgttgtgtccacatatgattcggtttcagcttcgctttcatgctcaccaaacacactctttcttttgacaacattaattagaattccgttagtactcctttctggttgcagcagttctccttcagaaacagcaatgcttgtagaggtagagggttgactagctatattgttgccagtattgcatgaaccagtttcagatgtgtctgtgcttctatctgtaccttgtgcagtaactccagaattattgtttgggcatgaatctttagaaacggtagatcctgatgaattacctgtattgaactcagactctatctcaagattctgaatgaaattgatgaacatgtcagctgatgaagtcctcattagaggtccaccactccgggtccaagaatttaagtcaatggtttctgattcactctcacttccatcattatgaataacgttcggtgtggcaacaacttgaattccttggtgagtagatgaactagtggttgcaaaacaatcttctgagagagatcctgtagaattctctcgactgatgcagctccacgatggtaccctccttggtgttctgattacagaactgcatgtatatccctgggaagcagaagctaccctttccatgcttctctttagtcttcttttatggtttagaacggcaatggactcatccaacgcaagttcaatagcacagtttgttctgatcgcagagatcttctcccatgtgcacctgcgcccctggttggcagccatttgcagctccgcatatgtagggttttgtataatcttcaagtactgaaaattgggaaaatacagcaaagaaaaagaattatgaccaaagaattagcactcgcccatataaccaaaaattaatttatcgacaaaaatacctgggctgctgttgccggcataaccatggtgacatcaccctcccaatcctgagcaaacaatttcgctagtcctcccagtgggaggccaatttctaggatttggttacatctgtacttaacctccatttcagccagacgagcaagctacacaaatgagattaaacacagcacttaggaatcaagattttaaagagaacttgtctgggaacatataacacggcatttgcagagtaggaatctaaattttaaagataattttttgtctagtgttaagggaacataaatcaggtgcatatgtatttataaattaactttatttgcatactgaataaaaccctcgatctaccagatattgcattatttccatgaataatcatgcatgcgcagcagcatgtggaaaattgacgaaataatgccgaagaacatgaaaacaattaactacctacaaggttacctacaggctgcatgctaggataagccatacaagccatgaagctaatgccattaaggtgcctattccatagggtagggttttagacaaacctttccagcgaa

SEQ ID NO: 54256 - DNA, 933 bp, Oryza sativa
aggcaaaagcttgtgctcaaccagtgttttcactacacctacatgaaaagatcccagtgaagcacccccacttaagagtaatgctgtcctcccaaaggcatgcctggtctcttgaacaaaggcaagtttctcttccaaaagcaaatcatcggtatcagattcacataccattttcagctgggcagaaacctcatcaatgtaatcttttataagcttaggaacctgcattacaacaaatcattttttttagacagaatggaaaggagtattttaacatttcatgatagggagtgcgaaaatcccagttgacagcaagcaatccttttatgtgtgcaataccgaaacaaatagtgagagctgtggaaacattttaggaacacatactacaagggaaaaaaaatgagctacatcaattatataatatttgatcaaataagatgcacaagcatattcaagataattatccctggtatgactgaatatgtacatgccatttgcgcgcaatttcagaacctgaccaaataagaagcacaaatgtctccagggcaatcatcatagaatgactaaatatgcatatctatgataaagagggatcagacatataaacctcgatgtaaaatattacactaatataatagcatgaactagtacaagagaaggtttgctaattacctcaagcctgcccttatgaagctcgggattgcacatgttccccaaattcctcacaagatcaccacgcatgcagaacaccacatcccggagcgacccttcctccctccgccttcggagctcctccagcctgttcctgatgagctcctcgtcgtacaaatcgctctcactgacctgctcagacattttgtcgagcaccttggcggcgcgcgcccactcctcgtagctcgccgcgtacctaatcgccttcttgcactgcaaccg

SEQ ID NO: 54257 - DNA, 835 bp, Oryza sativa
ccttgagatataaaaggaggaccttgcccacttaagaagggaggagctggggaaagaggggggagaagacctgagctcgtagaggagagaaagaggaagagggtttctagagtttgaactctcttgctctccagctctttgtaactccttcatacacagatccaccagaacacaggagtagggtattacacttctcagtggcccgaacctgtctacatcgcccgtgtcttgcgcatttgctctctcgcgaaacattccacagatcgagtgcttagaacctcacctagcgcccccggccgaaccggcaaaggggggcccgcgcggtctcccggtgaggagccccacgctccgtcaacacccatcgccgccgccctccggccgccgctagccgccgcaccgagcctcaccgtcgacgccgccgcgttcgccatccggcgagccgccgcgtccgctatccgcccggccaaacccgtcgccggagcccgcatctcctcgcactccggtgagcaccaccactactgccgccttcggccatggtttccgcccgccgtggaccacccctctccctctaatccctcccatcttgttccctaggaggtctcggagctcgtccgcccatcgtcgccgttctccggtcgctcgccgtcgtcttcccccacaccggccaactcgcggtgaggcactcctcccctcttttccccttcctctccctcctagcgctgagccgagccgagccgccgcttcggccgtgcgccgtcgccttcggctgccgccgcctcccgcgccgccgattgccctcgccggcgaccgcatgccgccgccgccagccatggcc

SEQ ID NO: 54258 - DNA, 5719 bp, Oryza sativa
  unsure (1)..(5719): unsure at all n locations
caccgatagagagagagagcgttgtctctctcttccttccctctctcgggcgttctctcgctctctcgttctctttctctctcgcgcgccgacgccgcttcccgccgtcgccgcccaaaacccgccaccgccttcactctctcccgcgctcgcgcgtggccgaccggccggtcgttgccgccgtcagccctgctgcgcctgcgccgcgcagccgcccggttgccgccgcgtcaagccctggcgtcgcctgcgtcgtgcgctgccgctccgccgctccacgccgcacccgtccaagagtgggagaagcagctgctctccctctcctccccctgtctcacacccctctccctcctccttttcccgtttcggcaagggtcaagccctcctttccctcttcctttttccttttgcccgaccaccatcggcgtcaccgcctgccaccgcctgggccacgggcgcgaccgccagctcgccgcccccaccttgaccgcgccagcctgcgctccagcggttcgattccagccgcccgatccaccgccttcgccgctccttgcatcctcggcatccgccgggcttgcatcgcccgtgaccgccggccgagcgctcgaccgctctatgtcggttccccctcccaaaccgacattcctccactataaaaccaagccaccccaaacccctcctctctcgttttcactcgcctcggtcctcacacccaccgcgccattgccgccgaaccaccgtcgccgccttgttgctgctcgtcccgctctcgccgttgccgtccgttgccgagcaccggaggagccggtgcgtgctggacgcgtgacgaggagctccgggcaccacctctccctcccttcttccccggccgcgccctctcggtgccgtgccgcctcggcgtcgcgaccacctcgccgcgacaccgaccgcgccgccaacgctgcctcctcttcgttggtgagctccctaccataatcctcctcctgccgcacgatgcgccgcgcccgccgccgcccgccataggcttgccaccgtcgccgctcgctcccggaggccgccgctcgtcgccagatctccacggcgtcgctctgccccatccgacgccggagatgaactccttgaaccccggagatactcccaccgccttgaattgatccctcgtcgaccgccgccgtttaacccctttgcttgccagcggcgcgcgtcgccgcaatccgccgcctccggcctctttccggcgaatccgagccgtcggctcgcttctctcgtcccttccctcccccggtgcgctttcttttccattgaggtagcgccttgctccggtgaactcggccgccgtccgccgtccattcggccgcgcccccttcttcctcctcccgccggcccgcgtggctgccacgtaggcgccacgtcggcgccacctcggctttgaccgagccgagccggtcagccgcctccttccttcccccctcctcgcgcgcacggtccacggtgcaccaaccggctgcgcgtgggcccgccacatccttggtccatccggtgctcgcgcgtgaaccgcgctcacccgaaacccttgcgccgcacctcgcgtgcgcccatccctccgtgaaccatgtcgcagacatgcgggccccacccgggacctcgcatggtgggttcggtccacccggaccgccccctctcccttccgcgcgtccctaatgggccgcctccttgcgcccgcgccggcccaatggctcggccgagcctccttcaacccattgggccgcgcctcacgctcggcctaaaagtccatatttcctccctccgtccaagtcagtgtccatctctcatgagctacaagtccaaatttgctccctctcaattttattctctctcaccttcttgttgaccccacttgtcaatgagtcaaagatattcttgagaatgtcttttccaatattccacaaatatttctcttttctataaattcaataaatcattttcccctctttcagaaatcaattccttattccaaaattccatgaatcattttccttggtcagtgactgtcaataatattcttgagaatattatttccataaattccgacaaaacatttccttgcccagaaaatccacttagacctccaaaattcatatccctcgattcgcaactccgattgaccccgttccacttccagaattcccgtaaaatcgagatctatttaatggcactattatttagtctaaataggatccttttcttggtcttttgtttaggttttcgattgtttgcgtatagttgcggttaccggattttcgtcgatcgcgggttttctcgaagattcgtgaagcttcgtgaagaccttgagcaaggcaagtcaccctttgaccaattgctcctataattggaaaatcattattattttgtttgcaacttgcattattagaatcacacacttaacttgcttggcctcggtttgcatgccaaaccgacggacctacccagtagtcgcactaatttccgtaggtcgtactactctgattccttgtcgctccacccttgtggtacctcgatattcgtgctctctgagcgcgtataccaaatatcccacatacaccgttgtttgtcgaagacttgggaaatgggtttgtgaagccttcaaaacccgacatgtggtgtcggtgtgtttgaaaaccaaatgaattgtgaaaactcgcgatgcgggggttgtgccgatgtggcactgtcccgtattcgcatataaggaccgattcctgtgggaaactcatcgaacataatcaaagtgcaaccacaaggtggaatgggacaccctggctaagtagtagtcggttcagggaaacctcgcatgccaatagttgggaacgccggggcggggtcggttggagccaaaccgggttcctggtaatgcaagaacgagaagcttgctgaattaccgatcgaggtggttggagtttgatttgtgaacgcctaaaatggcctatgtttatgtgaggatttgatccttctatatggcatgaggtaaccctgggtcggcttgggaaaggcttggtcgcgaacctctgacaccggccagtgtctggagtaagttcgtgtcttgtgggtanagtgtacccctctgcagaggttaactaactgttcgaacagccgtgcccacggttatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgtgggcatcatagactaggcttcccgagtggaggcggattgctttgctgctgggcagctggactctgggagtccgagaaaatgaaaaaggctctgggagccgattaatcaagtggaatggctctgggagccgagaagtaatgatctgacccgggaggtcggtacattaccaaaggagctgttgaaaaacatctcttaaagtcgaatcgagatgcaagtctcttttcggccccaaacttagaaagaaataaatcacatagtgatttcaaaatgtcttcaaataaaagatttgcaaaacaaccttgcctctcttccaagcttgcattaaacacctaagttcccgtgacttgctgagtacgaaagtactcacccttgctctatataaatatatatatatagttcctccgccctgaagagaagataaagtgaagtgaagattagggtttcgtcctggttcccagccgtcgcctgtggtgttgggtgttagttcgttggttccgctgctgctgctgttgttggtgtttcctcgtccgtgtcgtcggttgcattctcgggttgttctgagctgcaacctaagttaaggtaaataagtcctctatctattttaaggatttgcaatgattcatatttgtcaccgtgggtaccagcactatgtcctgggactggtaccgagatcgcggtttcgtaggaagcgattcgcgccgtttttcctacgacacgctcctatcaggtgccgttgtgcggcggtgccggattggggtgtgacatattctagcaacaaatttgtaaagacaaaaatatacttttttaatatagctatgtgctaaagacgtcttttttaatatatgacgttattactttttaataaacatttgattactcttcttattcaaaacttttatgtaaatataaaaaaattaagccatacttaaatgaacatttgacgataaatcaagtcacaatagaatttaaatgatactaccattatgttggagctataaacattatagttttgtgattaaattgacactaaacctatagttttgtgataaattgtcacctagggctggtttggttngnnnnctanntngnncttaccantttttgtnantgttaaattttgncaacttttggcatggctaattttggcaaaggaaaaattgtgtttggattgaagccgaaatagcctaaattaactgttgaaatggcctattttcttacgcatgccaaaatttggctccaaaccaaatagaaaataaacactattaaaattgccaaatattagtaaggccaatataggctcaaaccaaacccaacccctaatatctatttttgacattatgttttaaatttttagcctttgtaagaaatctcatgttaaatttatagttgtgtgataacacgataattccttaggtcctgtttgtttcagcttaacattattgtaatttagattattgagacagattactataagctggattataataagctgacatataataagttgttagttgtttgtttctctagattattagctggttgttaggtgttagcaacccaataatctaaaaaaaacacttttagagtggattactatattatactaatatgtcttatagattgtaataatctatcaaataagctatatgtatgtttcagtttactcctaaatatcccgattataataatcctaagctaaaacaaacaggggcttagttttgcgataatttgatcaaagcatatgtagttaaatttactcttacaatatattacaattatacttcactcgcattacaattatggtatagttacactaatattatgttatagtcacctaaaaactctgggacagtttttcttaaagcaattatcgtactccctccgtactcgtaaaggaagtcgtttaggacaatgtttaagtcaaaccttgggaatataaataatgggtaactctcaagttgtcgagtttgaaaatataaaaaaattatatgaatagatttgtcctgaaaaatactttcataaaaatatacatatatcacttttcaataaatatttttatataaacaaaaagtcaaagttgtgttttggagaccgtgtcgctgtccaaaacaacttccttttcgagtacggagggagtaatttaattcaattcccaatttcccatgttgacattgaattttgggcgtctttattactctttgacattgaggtttgggtagtactctttaacacaccaatcgggttagggcaagtgctatgatatatgtgactaccacatctaaatttatctattatattcactcatgaactcagaggtaacccatactatgtatcatctctagtacacaaataccaatatactcccttcgttttaaaatgtttgactacgttgacttttt

SEQ ID NO: 54259 - DNA, 1517 bp, Oryza sativa
taggggtggctcatcatctctctcctcacttctctcctccacctcataactcaatccaatggggtactcttagagcatctccagcagagaacataaacacacagctctcaaacaacttttattaggaggtaagaggaaaaatataggtccagtagaacccctactcaagcccctacaataggaaggccccccagatctcatcccacagtccttatttctaggggctccgggcacagcccccatcgacgtttcttcagcatgagaggaatttttgcttcgcgcgcgtgcatctcctcccccctcaggctgccctgatatccaaactctgatttgctcgcacatatactctgtatgtacgcattgcagatagaaaagtgcagcacatttgaacattgtttacttccaaatttatatatagttttgaacattctgcaagcgtccgtttatctgaatgcaattagaaaagaacgtggttgattttctgaacattttgtaagtaaagattttctgaatgcatgtgctctgatggaagttgtttgcattgctagctgatatactccctccgtctcaaaaaaaaaaacaaaccctgttttccgtgtccaacgtttgaccgtgcgttttatttgaaaaaattatgaaaaaaaattaaaaagacaagtcatgcataaaatattaatcatgttttatcatctaacaacaatgaaaatacgaattataaaaaatttttatataagttgccttttttttttggacggagggagtatgtgctctgctctgtactttgcttttggttggtacttggtagtaccttgtgtcaggcaggaacaaaacaaagggcattgctattgctgaacattgttcgtggaatgaattttgcatcattgggctgcatttttttcctgtggattctgatgatgataatgataatataaatatgacatctctactcagaattattgtgtttctgcattttctcaatgcttccccgtgtttgaaaatatgaatttgaatatggtatttctatgtgttaaaaatattcatgtttgtattaatgtgatactaaactaggtgtaaatataaatttgtacgttgacataaaagagaaaaataaatagggtctaagaaataagaattgttgctggagttgaaggcatttttaaagtcctaaggaaacgaagacagaccctatttagcttttaagggctttaaaatggggatgctctcggaggcatcatatgggacattagggtcccatcggtttattatccaactgccaaattatccactatcttacgaaatttcttttcaaggttacactgtttccgctcaaaattcaagtccagcctcaagagatacggaggatatcatgcttgcgccatcaaaatttctcttcctcgatctcacctcacctgtgcgtagagactagagggaggagaggagacggatggacttgcgctgcacataaccaactggttcttgcttccacgcttgctacactccccactcaccggggagtc

SEQ ID NO: 54260 - DNA, 742 bp, Oryza sativa
acatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaat

SEQ ID NO: 54261 - DNA, 2597 bp, Oryza sativa
tgcatcagaatgtcagtataaattgtcctatatgcatgcaaaatcaacttgaccccaactgcaaagcctgatcttcaccatcatcagcagttcagtacatgtacggatatcgtggtttgcagtaaacaatatactagtacatttctgaattttgcaaactggtcagtatattaattaatcattatacaccatgattagaagtcctttgggaggacagaaactcacaagaattgcaagaaaggctgcccctgtggctatgcacagtactacgttgtttgttccaatcttttttcagacgagcaacaggaggcacatgttcctacgtcgaggtaacaggggaaaaaaatcgacggtgctcccttcgtcccaaaataagtgtagccatgattttccgtgtctaactttgactgttcgtcttatttgaaaaaattttaaaaaaaataaaaacataagtcatgagtaaaatattatttatgttttatcatcttataacaacaaaaatgttaattataaaaaaattcaaataagacggatgattaaagttggacgcggaaacttgtggctgcacttattttagaacggaggtagtaatatgtgtgccgatctgtcagtggggctccgcatggctgaagttttggtgatttgatccgacctcgtatgcaatgcttcaaagcttttatatatatatatatatataaacctgattaaatttaaagaaaattttgattcagttcagaacaaactaaaatatctttacattttaaaacagagtaagtattggcttattggaggcagtgaatgtaagtaggagtatcgtataaatgcttatgacgagaggcggaaccagaaaatggccaatccttcgctgaattatattagtcaattttaattagacgttatatatttttaaaattttatgcactttgtaaaggatttaaatggagcttttgagccacgtatagggctccaatcaagccctaaatatgccatatgcctagctagctccgcacgatctgcatatatgggcagattcaaacaacatgaaatcaaaaaaaaaatcatgctcccatgtttttttctaattaagaaatctgacagattttcaaaaatcagtggagctctatcaaacaaaccattatatatattgtacatgcatatggagtataacaaaagataacatatcgaacaacaacatatatatataaagaatcatttcgtttaaactactcgattgcatccatgttggcctggttgctgtccaattcgatcggcgttaacagatgttgatgaccattttagatacgcaaagaccgaaagagatcaagatacactagtgttacagtactgttcgtatatactccatatcttactgatattaattaagacgtgtgtgctactgttcaatgcactttgaaaatatccaatctgtattgatgtgacatgcatatatatgaagcaacctagaatcgaatcctgctattgtgctgatcattttcagcgtatcgtgttctaagttgtagtcaccgtaaaagtccagtcatgtatacgtctgcatgttctcttggattattaatttagatctcttcgcaatcaaatattgtgcaaacgtatttatatagaagagaaagaagcaaattaaattccttgtgatcatgcccacaccacgcataaaacgacagtgattgttatcaatcaaaactagttcacccaaattaaagcaaaggggttttgcaccgacttcagttcagcgcggctaattaatgagtactccgtactctacagtattgcatactgtatatatcctcttgtgaatgagcagaagttaaacaagttagcaggtaattaactacagagttaaattatgccccttaattaatttcagcttcgttatttaattaacagttgccaggtttttttcttaactatcagttagctgtgcacgtacttttacaagctgtagactaaggccatgtttagatcctatctaaattttttcaccctgtaatatcaaatgtttgaacatctgtatgaaggattaaatataggctaaaaaaataattaacggcacagattgcgactaatttatgagacgaatcttttaagcctaattgctctatgatttgacaatgtggtgctacagtaaacatttgctaatgacggattaattaggcttaataaattcgtctcgcgttttactgacggattctgttattagtttttttattagtgtccgaacatcctatgtaacaccctatataatacctgatgtgacacgccaaaactttactcccgtggatctaaacacccctaaggctgtgttcttttcccctctttcgcaattcactcttctcgttttccgcgcgcatgcatttcaaactactaaatggtgtattttttttgcaaaagttttataaatgaaagttgcttaaaaaactatattcatccatttttcacgttttgctcgctaatacttaattaatctcactataatcgtgtgctttgttttccgtgtcgggagggcctcccgaacgcagcctaaattgacttaaacgcaagctgtacactgatcttacgtaatactataaaaaagatgaact

SEQ ID NO: 54262 - DNA, 1076 bp, Oryza sativa
gtactggcgaagaaattgacaaatagacaacccaaaatacaattaattggggctggatggtagtaggtgcatgcgttggctacacttggggtgggtcggtgtattggaggtggggatagtactgtgtgtaggaaggacaaaagaagcgtgcatgcgtggggatcaatgtattgaaacaagtatctagaatacagcaagtacatactacggggtgggtgtatgtatcatccctgcataccatcaccaccacaccacgttctacccggagccctgcctatctatcaaccttagccataggtatcgccatcgtctcgtctcctccggggaccatgcatgcaagtttgcaacctccatcgatggaggtatcgcttctctctctctctctctatctatctatctatctatctctctaagctataagcttaggagtatagtgtgtactatggctaatatacggggtatatatcatcgcaaaacatagcatgtattattgcatgattaattaagtaataactaatatttttaaaaaaatagattaatatgtttttaaacaactttcgtatattttttttataaattaaaaacacattgtttagtagattgaaaaacatgcgcgtggaaaatgatcgagagaggtgagttggaaaaactaagagaagaacactagtagagcaagtttaatagtatagcccactaatagctctaattcatctatagccaatctaatagcactggtggagaaactgtctttactcccggtttataacccccctatagtcccggtttcctaaccgagactacgaatccgggaccaaagatcgctatctttagtcccgggcgaaataaccgggagtaaagatctatctttagtcccggttgataacaccaaccgggactaaagagagggatctttagtcccggttggtaacaccaacctagactaaagagaggatagggacaatcccagatagtccttttttttgttacttttttattttctcccgaatcggatggcatgcacatcccaaatcaaaccccaaatctcaaataaagtaacatctcaaatccacatcaca

SEQ ID NO: 54263 - DNA, 6009 bp, Oryza sativa
attgcttggatcactgaaatccaggcatacctcgcagataagactctacccgaggaccgcgaatggagtgaacgcgtccagcgcatctccaagcgctacgtgctggtggaagggaccctctatcggcgcgcggctaacggagtccttctgaagtgcattcctcgggaacaaggtgtcgagcttcttgccgatatccatgaaggcgagtgcggagcccactccgcctcccactccttggttggcaaggcctttcgccagggtttctattggccgacggctctcaacgatgcggttgacctggtccggcggtgcagggcgtgccagttccacgccaagcaaacccatcagccggcccaggccctgcagaccatacctctttcgtggccgtttgctgtctgggggctcgatatcctgggtccattcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcgaaaatcctcaagggcctcaaaaccaaaaccttcaacatcctcaagaagcacggcgactcgtggatcgaggagttgccagcggtgctttgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagaacgaaggcggcgcgcggcccttcgagccgcgcgctaccagcagagcctgcggcgctaccatcagcgtcacgtccgggcccgtcactctgcgtcgacgacctcgtcctacgccgcgtctaaacgcgtgctggactgagcaagctctcaccaatgtgggagggtccgtatcgagtgatcggcgtcccccggccgggctccgttcggctggccacgggcgacggcacagagctgcctaatccgtggaacatcgaacaccttcgtcgcttctacccctagtgggggtcgggtgtcaggtctcgggctcgggccaaccccgcgcccccccgggcgtgcagggttggccgggggctaccacatgcatatccttatcttttttctcttccgtatttcagtaaaagcattttcgatttcctgaggattgtgtctgtgccatcgtttccttttgaagaatcttggcttgaattagcacgctcgtgcccgaccctgccctcggtggcccgggccggctaaaatcgccaaacggggcccagaaccgagccgtgccccggggcgtggtgaactccgggggggaatcggcataggcccacaatcgggtcatccataaccctcggtcaccacgctcccgcctggccagtctcgacacgcggatctccccaggcactagccccgacccgcgccacttgaggttgggacctgggcacgagccctcgtttaagccaagacacagaaggaccgcggcacggaccatcctcgtctcatacacacaacaaacttaactgacgcagaaatttcctctttacttgattacagattaaatcagtctatacaagaagggggcccgaaggcctcggaagaagaaggaaaagttattaagattggcgggggcctgggggctcactccgacgcccccgggccgtcggcctcgtcgtcgctgtcgtccgcgccgtcgtcaccgccctcctcgtcggagtcgagcgcgaacgcgagtcgaggggccgtaccctcgaagctgtggacgatgtggtcggcggcgtcccggaccctcgcacgtgcgccatcctcggttctgggagggaactcttccagcgctgcccacggggagaagtcagggtccctggcctggtagcttgccagtacgagctccgccgccccccgggcgaggtccctcgaggatgacttgatcgcctcctcaagctcctcggggagccgctggagggtcccggccatctctgagaggcgctgggcgaggcccccctggttggcggcgtatttcgcggaccgcccgccccagaggcccacctgccgcccggcacggtctagacgggagacggcgtcccgaagcatgccaggccctacctcgcccgccaagcggagggcttcgacctccccggcggacgagtccagcgcgccctgcagctcggtgatggtgtgttcggcggctgcaaggcgggcggctaggtcgccgtcgcccgcggtcgccccgccgctgcgcgctctcgcgtccagctccttcgcccgtgcctcgaattcagcggcccgctgatccagtgcggccctctcggcgcgggcgccttccagattgaggcgcgcctgctcctcccgccgctgcgccgcggcctcggcctcctcgagagctcgctcccgctcagtgagctcgtcctcgcggaggcggagtgcggactcctcttcggcgcaggcggcctcgtgcgccgccagcgttgcctcccggatggcgatggcggcctcgcgacccgccagttccctctccttcgtgtccaaggcgcgggcgcgctcctccagcaccgtggcgcgagcctcaagggcctcttcgcgctgccgggacgcgtcgagcttcttctctagctccgccgcccggctcccgtatgggaggcagaggtcgtcccgcgccgcgttgaacacggcggtggcgatgagggcagtctcccgctcctcctccacctccctggcgatctccgccaggtccctacgacgggcctcgagctctgaggcatgccggcggtgtgccttgcggcccgcctccaccatggcttccaccgagcgccgcccctcttcgacgcgcgcccacgccgcatcgacctccgcccgctctgcctgcaggacctccatctgggcgcttaacccgtccaacaccgtggtgttcgcagcggccaaggcctgcaggaggggttctgcgctcagtggggcagcggaaggcagaggggagagccgcctcggtgtgggcgccgcgcggctcggcccgccgatggacatgccggactcgggggcgttccccgaagctggctcgccccaagcattgcccgaggggtcgggcccgagcggcgcgcccgcggcctcgtcgtgggcggcctcagaagtcgtcgtcgcctcgggcggagtcgggtcgggggctcggcaggccgcccggcgtacacgcgccgcctccgtctcccggacggactcctcggcccggcggagtctggcctcctcccaagcggcttcctcagcctggcgagcccggacggcctcctgggcagcttcttcggcttcccggaggcggtctgcggcttctcgccggtcagctccccgcctccgggcctccgcggtcgccgtctcctcggcctcagaccggccagacttggaatggcgggaagggcgcgacgggatctcgctgaggcagaagaaaaaccagaagacgaaaaacgggtgagtgaaaacttgccttgggagatgggagaatgaatacggccgcagtgggcgcggggacgaacctgcgaggaggtcggctaaacgaccaccttgggggggagatgaggtttccccggcatggttcggtcccccccatcttgcggagccgcttcttttttcgctccccctcgggctgcgacgtcggcacagcaccctccgggcgcctgctgctggcacgcaccgccccgccccctcggggaggagatggggagggggtatcctcctgtttcctcttcccccgggcgtcggcagggcggctgccccccgggcccccgtcacggggcccagaagcacgaccccctcccggggtagattgttcccccctgcggctcccgcccgcgccatcgtggcctcgaggagcccgctcccctgacgccccgaccgcctgcatgatggtcaggatgttggcgcgctctggatcgctgcagagggggaggacaccttgggggatgagggatgcctccaaggagctgagattcagcacccgttggatcaccatcttgaagtcttcagggacccaatcccatttgaccccctggtggatcctcatgtagtcctcggacccggtgtactcccaggcgccccgggcgcgccgctggagcggcgcgatccggcgacgaaggtaatcgccgtacaccatggcccccgtgagcccctgggatcgcaaaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacgtcttgcgaaggacgcagggaatgtagcggttcagcaccggcccccgcggctggaagtagcagccaccgactaccgacggtggcgacaccggctgtacggtgaagaaccaccggacagccggagagatgggcgtaccccgatgaacatctcgcataggtgcgcgaagatggccaacgtcattaccgcgttaggggtgaggtgcgccatctggagattataaagctccagaacatccatgaagaaagaagagaatggcgggaccagccctgccattgcgaaggaaaggaagaatacggaccgccccgggtagtgtggtgccgggcgtccctcacccagcgcgaccacctcccggccagtggcagattccggcatgaatcggcgcggcagcccggcctgcctctcgctcacgatgcgagaaggcggcagcacgctaccatcgagcggtgcggagccccgtgccatgacgccggcggaggaggggcttgagagcgagtgagtgcggcgaaggtagggcacaggaaacgagaagttagaacgcaagcggcgaaggcaaggggaataatggcgagaggaaggaaacgaatctcttcctcggcgtctttatacccttaccaacgctatgcccggctcctcgcttccctcgcccactatctcgccccctcgtttctcgcgcccactcctccactaatcccgctcgcccgtttgcggcgcacgaggcggatgtgcggccgtggtagtcgagatggcacatatcgtgcgcgcgttaactacgctcgccgaccgatgcaccatcatcacatctccaggcgaaacgaaccggctcgtcccaattcgcgcgctactcaagtaatgtagcggtcttgaagaaagccgctcattattatcggtcggtttttcccttgccgatgcgcgcgatttgcgaccactggattcctgcccgcctgtagagaccggccccacctgtcaccaggcctaaggagtggcgtcacgcccgagcgctttcctcgaggagggcgatcgccctggcataacgccgggggctactgtcggtgacatgggaccgggggtatcttgactataggtttggggcagctgcagtcacccacgtggcctgaccccctcgggggggtcgggcccgagggtgatgtggccgcccctccctctgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcgccccacgccgcatttaatgcagcgcaacacactcgttcggtcgtgacaggtccagtgtgtgccggtcacagaccggtcagatcgcgggttaggtggcaacaggcggcctttcgcacgcctcgccccgtcccgtcggaatgatgagagcctctaggcactcgtccctagcc

SEQ ID NO: 54264 - DNA, 7374 bp, Oryza sativa
  unsure (1)..(7374): unsure at all n locations
acccgtgggtcccgcctatcggcgccgcccccattgctgacgtcagccctggggcaatattgcgcaataaatacattaaggcttttctttaatagtaaaaacacagagaatcttctaaaaatcataactaattcatccgagctccgattaagtccattcaagtctcagtaaattcataaaaatgcatagaatccattaaaaatggttttgtttcctgttttcagtagtcttatagcctattttgcttgtgtgctttgtttgtcgcgtagatttcggccgtttcgtcgatctgcggttcctcgaaggcgttgctgtggtctcatcagtgcgagagcaaggcaagtcatgcattacaattgatcatattgtacccaatttacaaatgtcccgcatttctattaaatattgcattattttacaatatcatgtgggatgggtcctattacttagctatatgttgtttcccttatgccattgataacttgggtattgaaatgactagatattggtttaggaaatgcttaaccatgcttagttcaactagtacacaaaaggggaatcacattaatgcatagactttgattattggcatagctttggtttagtgccaccgtaatgatgttggttaattaaaatacactacatggtgggctatgggtgcatggttttgttagtcgtgcccatggcgattaaggaccggttcgcgggaaaccctggaagaattcctcgtacttaccacaagccaacgtgagcaacggctgggcttgtagtgtagctttcctctagctgacgcatccaggcaagggtgggcgtgatggagcggggcgggccttgcgacgacctctgtcgcttccggattcacctaggcacgagaggggactgcccgctgccttgcgaggagtgggggtgaaacctgaggtgtggtgtgcttggttagagagggttatgcgaaaggtcctgtcacggcctctttccggtatgtcgtggtggcatgtcggcgcacagaaacgtgtcgtggggctgtgtcttgtgggtacagttgtacacttctgatcagagtaaaactattcgaatagtcgtgcccgcggttatgggcggtcgaccagattcaccgtgattagtctcacccctagttagctaatgaactagcgtagttcaggtggttggttgagcctgttgcaacatggtgtagcattggacagtgattggttaatactgattaattactacaactgttttactgctttcaactactgcttttaaatgctagctttatgcaaatgagccctttagcctcccttgggtatatcctgcatcatacctcctctttcggtatgacttgctgagtacaatgggtagtactcagtcttgctctcttttcccccacaccagagttgaagtccttctcagctgaagatgtctcaaagaagttggtttcgtcgttgccgtcaaggatgcctgtggaatggagtcgcccgctgcaggagtcaagtctttaggcttagctcgcttttatcttttccgctgcatttgtaatcttttatatttttgtaagacgtggatctgtatgtcaacaattgtcgtttgtgtaccctggctggtcctggacaagggtttaatacacattcagcttagaaattctggttcgggaatttctgggtgtatagggaaataatttattcaaatactaggttaattatcatgaataaatataatttttccagaatttatcttctctgtttaggtctcctaaaaatccaaactagtttccaaagagcccctcttcccctaatttttgagagtaatctatccataatttttaagtgcaaccaaagaaaatggaaactaggtaacttcatctacctctagaaaaatccacgagaatttatcacactcacaaatgaaactatagaactacagagtgagatggagagaaataatcctgaaaattcgtccaaaatcaattaacaccccatcttctacccacctctctcactccagccttgttcccttcgccctggacccacctggaagcctctctgagtcacttcttctctgtccatattctatttctcctccatccaacacagtgacagccgagagagagagactgagggcgccgaccggcactggacggcgtcgacgcgtggcctcgacgtggcagtgccgaaccaaagcttcacctccacccagctgcgtcgccactcttcacccaccatcccagtgccgatccaaccgagggaggaagctccagctctccctctccacctctctttcgtcgccggccgccaagaagagggacatcgccaaccgtcgtcgagccctctccatctctaactcatactcgttccattctcatctcaccatgccgaacaactttggtttttatcccattccatttcatcttctacagcagcgggaacgctgccatgtcatggtcgctctagagcgcgctctgtgcaccgccgcagcgacatcattgccgttcccgcttatctggaccaagccgggccaagctgtcgcgccagcgttttcgcctcgacctcctctccattttccttcaagaatctagaaggatggtactacgagtgcggagatcggctaccgtcttcttcacctccggtcgccgtcgccattgtcgatttcgcctcctccggtgaaccattgtccgattcttcgcgtatacaccatccctgggacctcactaaccccatgaaaacacatgcatgtcaattcgatgagtggatcgagccgttgccgtcttcccggagctctacaccgtcgccggaccatcttcttcaccgttgccgcagtccagactttcccgcgtctcgttcaaggttcggtgagcacccttgagcccataggattgcattcatgcatttcattcacttagaatcgagcaccaactcaacaagcaatagcagcctaagcacagccgccgctcggactcgccgccggcgttactccgatgtccactgaccgataaaagtagaggaatggaatcgcaatagcatgatcttcattttgtcttttggtcgcaccctcaaacgagccaccgtttgccgctggcaaacttgaaatcgagctcagccatggcttgatctgcttcagctcgaaccagggacctcctcacaagaatttaggttaatgtagggtcctttatgcaaaagctcatgacacacagaacaggcataggactgcggtttgatttcctgaaaccctaggggccttttgcatattggcatgagaccgacaggtggaccccataagtttaaaatctgaaaatgtaaaagataatactaaaagcctttactttttaacagcaaaacacctaaacttgtaaaatccatataaaatcaaatataacttattttgagatgattcaaatttctataggttaacaaaactatgaactttaatgtgataacaataagcttggcaccctcagcacagaccttgtctctaaaatgggtctaagataaatcatacataaagcatacacaaacttataaaatacatacaaagtacatctcaactcattttggagcaaactcagtttctacagatccaccaacttatgttctcctataaagcaaaatgaaatagtatacatactatacatcaaatgcctctaaaactattacctttaaatgactagttttagataagctgaattttagaagttcatataaaattcatcttagatcctttttgaataaacccaagttctgtagaatcaccaaaacatgtccttccaagttataaaataaaattacatacttattgtatgataaaagcctctaaatacttatgtaagtaataaccaatatagagcaaccttaaattgtaaaatttgtagaaaattcatctttagtctaaatgaagtgaaccaaatatctatagaaccagcaaacagtgggcttcaacatagtaaaataaaatatggaaccttctgtacaggttatagctctaaactttaaatttataggataggtgctaatcacatagtattgattgagcaatatgtatatatataaatgtatatagaaatacactctagctataaagaaacccaaataaaacttgttagaccagtgaatacatagatccatccccatccaccaaaacttaaggcacttagctcatataataatttctaggttgatataataaattgctagcatggactagagctcccctagtttataaaatatgaaccatgataataaagaccataagcctatgaactaaggttagattagttaactaaaatactcatttttatacatcactagctagatgaggcaagttctggacctaaacctctaaagccatgaacctatagaacactatacacctataacacgttataacttgtaaaatacataaagaattcatattaactctaaaaattatgaaaccaaatgtgttcatcttaaaaacacatatcttcaccccagcaaacataaacttaataagaatcacctacaacagcaattcacaataattcacaatagtacctaagtaaatcctacactataccgacgaaacttctaaaatttataactctcaaatgaaatgagataaaatagaaattctttcacataaattcattttagaccagtacctatccactgtgcacaaatcatgcattttagagcattttggatttttcacatatttcggtgttttaattgcataacgtgtacattgtatagatgattgcttaaacggtgaagaagtgatttaggtgctgactttttccagttacaaggcaagtcctacctccctctctttgatcactttgaacctatgttttggaggttattgaaaatgtttgtaaatcttgcatgtcgatttgtacactaatcaattaaaattttgttaaacttgttagacaaactcctattatttgcattatcaccttaaccccacatatatccatatccctcatacctaaccttaggaacaatatgactataccatttatatacgagttttggtgacactaggttactataatgcttagccatgcttagaatggtcttccttgtcattatgggctcattacaaacatgaaaattgatttttaaataatctgagcagaactttaatacttgtgattttgataaataaaatggtggaaaatatgaattttaggtttgggcctcaagtggtgcacatatggtgattagttatgtaccgatagggggagtgtgcgcccaaaccgacttaaggacttcactcaatgtcagttcattccgtatacagtacaaccacatatgctagtatgggatagcccaagcttagtaagttgtttatggtttagccttacattctggtaggccggtgtgtatgagttcatataattcagaggagcttcctatttaccccgacgtggtagtttaggtgactaagtgtgtccaatacaacggtattgtgccacgtggtgggttcccgttgtgtccgtcaccacggcgttaagtttaaggcgtgggcccaccacttaacggttctaggccatatatcgagtatggcttaggatggagtaacacgtatcgtgctggtgtaaggctaaatcatgaattttggaaaagctttgttgcgggtaataaatcgggtacttatgtatcgcgtgccatgcttttgcatgattattatttcgtatcatgtgggtaaagtgtacaaactctgcaaagttaaaactaatcgattagccgtgctcacggtcatgagcggcgtgtggatatgtattgagtatagacttgtgtttattctcctgaatgctgaaatttaccttcaaattgtgatgagatttgagaatgatctccttgctgccatggatggcaatgaggtggatatttatacatgattaatgcctactttgatgcccatatgttaagtactagcttgctgaaattttatttgaaagcaaatccgttttgaatgcgttttatgcaaataaaacttgctttatgctaaaaagaaccatactatgccttccttgattatatgccttgcaagtagggtgttaggcttgtcttgatgcttgccagtacattattgactcttgctgttgaattaacttttgcttgcaggttttagacttagcctttgagtgatgcgggtgatcgactgcttcttctaggacttgaacttaatggggtaaacccctagtcggtgtgcttgtggattggaaagacaagcttccgctgttctattatttatttggtcggtcggccaatgtaactaaagtagatgtagtttataatcactttcatcttatttgtgtttgctatgtataatcatgcttgagatgaaagtgtgaatctagtgcacatcctgggaattagattcacatgagtatgagttaagaatatttgagatgttgtagatcttaagccatttttgtcaagtctcctaaatgtgtaacatatctggtcaccgccttcgagtggtttaacgggcacatctcaggctgaagttgactggcaggctaaaggcccaacaatatctccaatattactctctcgaggcgtcggatatttcattatgcttgtttgatgacttgaattatttatttcatctcttnnttataatggaagattcggagagcctacgacagataaaaagaattattgcaattatatgcacgcataatcggataaaaagaattattgcaattatatgcacgcataatctctatccttcaacgctctcttcctctactcactcatttaattcctttatctcctaatttttaactaagtaaagaaatatcaataattagaaagctaaatgattataattcttaaattaaatcataattttaacttatttgaatttttgtttttttacaattaaataaaatatttaagatccatattacccatatttcactctataaaaaatgaaaatatgtcatttaagcatagacactgttcctttgcatggtaaccaaatagaaaaaacacggaccataatacaaaatgaaaataagtattatattaccgtaaatcactggacatcctctgagcacactcaaggcgtcatgtgttacgccttaaataaaaatataactttacaaattggaagaaaaaccatcttagcatcagtttccacttaaataggtagatccattattttcaaccaatagatattcttttaagaaaatcttaagcaaccatgtgttacgtcttaagaattagaaaaaaataacataaaatgtgagaaaaaaatatatcattggtttcacttaaatcatttagataaaatagaaaaaaaatacccctccacttcgccatcccccacacatacgcacaacacggcactattcgccccatcccttctcgtcttgagctctccactcta

SEQ ID NO: 54265 - DNA, 3004 bp, Oryza sativa
ttctgtttatatatattcaaacgcaatgtacaatatatgcccgcgcgaatacgcgggctaccttcctagttattctaatataaagttagttgtcgaacttttaaaaagctcaccaaattttatcataaatgatagatatttctgaagggagggagaagcaaatattttaggggagcactacattttttttttctcgatggtgcggtaacactgggaatacaccacaccaatacaggcgtttttttttcttacagggaaagggaattgtattactcagctaataattactcacggtccaatgtaacaaactaaagcattgtactatttctccattttaataaaattcaggtagggaaactgtcccaagtgatcagtctgaaaaaaagacccggtaaagattcggaccaggctttatttgctagggtgtgacttatactattgctgcttttgtgcatagcgattacggagtacatgtgtatccttatacagtatttatctctaaaatgattttcatcattaagatgatgtcaacaatacagggaaaaacaaaactcatgcgtctagcaagtctagggtaaattaccttaaaagaacaatatttgattacctaactatattgttatcgtagattttttgcaccatttttaaagaacatattttttttttcaaaattgtcttctatgaaactagttagagcactttttctaaaatattccttccgtttcacaatgcaagactttctagtattgcccacactcataaggccacactcatccttataagtgtgggcaatgctagaaagtcttgcattgtgaaacagatatttgtttagtttatttcttaaaatagttggtttatccgagataatcgatggtaataatttagcggacaatatgtttcaaacagggtaataggattacgacgagagtgtacggcagtgcaattgttgacaaaacaataatttgtgagtaatagataaaactaccactagcaaaacaaagatatttagtacatcccggttttggggataaagcctgaagataacaacaacttgtagaaactaaatgctttccaacacaaacctacaaaaataaatgcaatggtattattaataatcgataaaagggaaaatagtaaacgtgaatagtcacgtgtaacatgtataaacagagggaaaaaaaaaccacacaaactcgggaattcatagcacaaaaatagcgtcctccggagaggaaaaacaaacaaacaagtcaaaaaaaagggaaaaaaagagcgaaaagaaattaaaacaggagcccgtgtgcgtcgcgaagcattcgccattcggcaccccgcgaagcgaccatggccatccctcccctcgccgtcagcggggtcgccgtcgccaccctcgccgtcctcggcctcgccgtcttcgcctgccggcggtggcggcggggcgcgtcccccgcgcccccacctcccgcttcctcccaggtcggaccccccggaatccctcgattatttttttttcaccaatttatttgatcgccgtatgaaatggaaacattgtcgagtggtgatttgtactttcttgtggtggtggtggatcttggtgatgttcgttacgagggtactgtttcacgagcgatttgatttttgaggtccttggattcgtccatggcgttctctcgttagaatatactacaccaacacagaaccatgagcgaggggaataccgtggcctgctcccagccctagattgtagctgctgccttgcagtgaatgttgcattggtggagattcggcggtagcttttgttttctgttctgatatttaatccagcatgcatatttgattgatgaatttggtgcgtttgttaatttggtcatcgacaaggcaaattgcagcttgataggaggagggggggattattgtcgtattgcccaagctgcaatgttcttagatgcaactggattactggacataagattgttatctttgcttctttaagcttcatttccgactcttggtttgtcaaaagcataaacagtaaatacagcccgatgaaatggatgtgattttctttactttagtcaatgtttttccatttttgtacttcaatcatttttcatgatcttttacttatattatactttgctgttttgtgttaaatgatacattgtgtcccatagtactctcaatcttaaggaaatttggtcggcctaatctttggccggcccggcaagatacgttgcgtcccatatggttggatatgggtagcaaccacttttccttttcctctattaagcttcctggtccactggaacaactggcactaagccaatgaagcccccactgtcttacttttctgctaagagcacggaatgctatgtttaatctaagcgcacttaatttgtttttagaagatatacaagatttttctgtcgtaattcattcacatacgaatgttatcacaaactgtaattaataaaaccatttacagcaagtctgttttatctaatttatattacttgttgcttgcaggatgatgatattaacatgcctctcatatctgacaatttggatgactattcagtctcgagcaatagtagtactgtcgatgaatcaggaattcggattgataggattatcacttcacctaagactcatggcattgttggaaaaggggcaacctatcccactgaatctcatgttattgaaggtgcgtatacatttacacccaaactttcatcattatgttatacagcatcagtcttgttttcatttcctcttttagtaatattcatcttatttactaacaatcgtcataaaattacaaaaataatcaattctttggtttgtgtaggagaaactcatgtaattgatgttacaaacagtaaaacggaagagctctatttgggaaatacgcttaagcgtccagctgtggcaaatgggccaacacctgatgtgaagcacataagaagggattctggagagagtaatcacaatggcaccattcctg

SEQ ID NO: 54266 - DNA, 7081 bp, Oryza sativa
tccaagtcatttggtgttaaaggactcagaggtgtcaggaaagcatgcacagattgactggaatgcaaatgtaagttgtgaagatctaagctgatctaaaaaaaaaattcatatgacctatgtacatacctgcaaatatcttaagccttcttacattcccatccaataaaattattattactcttttattgcagaaactcaaatgggaaattgtggatatgggtagtctaaatggaacatttttgaattcccggtcagttaatcatcctgatgttggatctaggcgttggggtgagcctgctgaacttgcagatggtgatattataacacttgggagttcatcaaaagtatctgtaagttataaccgcttttgtttttcagtgtgtcctttcaagtgtactgaagatttttataactaatttatagtagaattggtcttttattgcttatggtccagcattattattcatctgatggttaatgcttttatgttcacatatcattctgcttgaaatgaaacccctatgcatttttttttcatataatccaactatacctaattcaaattggcaaacatgttaccacactcggcttttctgttttcttgctagctgttgacatttcagttcatatgctggcctatttggttccacatgtctgccatgccatagaaactggagcatatataaaaaagaaaaaaaaactcttcaacatatgtttgaaatttggttgtatctatctttgaagaaagcaattccctgatagcgctaccgtgctaggtccaaattgagctacaaaaccaacaacctgtaggagttggtatagcatctgatccaatgacagcccgtcgaactgggaagaaacttcacatggaggatgtcagctgctgccagtatcctcttatcggtgtggaaaaggtatgtgaatgattagtttttgtgcaaatacttgagtggtttctgatattgatttttacacagtttgggctatttggcatattcgatggccatggaggggatggtgctgcaatagctgccagcaggtaagctatttctgcctatttgtttgatcaagtgcaaatcataatgttatcctagaatttggacattcgtgtattaattactataaccgttcttgattttgagtttgatatgattatatacgtgttgaactgatgaccccctttgttgcctaggattcttccacagaacattgcaaacattttgtctcaacaggaaacaaaagaaagagttctttcatgccatagtgcttcagatgttcttagacatgcctttgcattgactgaagctgcactccatcatcagtatgaggttttccttttatctggatttctcgtgtactatattttttgaactatgttgcttaatttcttgtctggtagtttaataacttgattaaataaatatcatatgtttgttacaaggtttatctatacatttggttggtatagaatttgttggacgaatgttgctacattgtatgtttgttaacttttttgatcaaatgatgtgctactgcaatttcttgtcctttacttgcccctggatgtgtaaaattcatcacttgctgggtttctagatttaaaagtttagttctgattcttaatttggtttctgaaatgtatacatgaagcgaagtctcttgcaatttaaggttcccatgattgccaggaacatatttaccgaaattatgagttgagtctcccattaaaactcctagactccagatagtctttctaaggctatatgctgtacatgaagtgtagtgggtccttggaatcctctgcttcttgaattgccaccttttcagtaggctaaccatgtttttctatcttttacagggctgcacagcaactatccttctgatttggttcgaccagaacgaagattgcttcgcccaatgtgctaatcttggtgactcagcttgtattatgaggtaattagcatcttttctgttctcgaagacactgtactatttggttttctgtagcacttgcttcctcgcaaagaaaaaaaaacccactagcagtcacttgctagtataatgtgaaatacaccataattgaaatttaaatattgccaccctattgtatattaaactgctatacaatagcaataaaaaatgatttataaggtcctctttcatcaagctttgtaatacagcaataatttataaattgttgccagtgtcaacggggaaataattacaatgaccgaggatcatcgagtagtcagtacaacagaacgagcccggatggcaaattcaggacaacccctgaaagacggtgaaagccgtatatgtggtatatgctatattgctatcttacatcagctgcagacttgaacaataatgatgacacgatctcgctgtttatttccacaggactaaatcttggcaggatgcttggggacaagtttttaaaggaacaagattcacggttcagctctgaaccatatgtgagccaggcagttcgcatgacaaaagcatgcttagcctctgcccttattgctaggtatcaaaactccccatctatgatggtcatgcttgctaatgtaatgcattactcatacatttcataacgtgcgcttgtttgctcctttgcagcgacgggctatgggatgttattagcgctaacagggcagcgcagcttgtccttgaggtaactcatcgatcggcttcaacctcatggttattaagtcgtggtgtgctgatcttttatctcatttttcagggtaagcagaagtacagcgagcagaaaacttcagcagaaaagtagcacatcatgtgttaagtgaagctaggaaattgcgaaccaaggacaacacatcagtaatatttgtagacctggacactctgagaagtgatccctgatcctgaatccccaattgcttttgtcaggtccggagatcgtcctacctgctgctcgaacagttgaacaacactatttcttttgtttcactggtagttaatatcctttgtcaaagttgagccaggtgctccggtgttgcagaggatgaatgctacagttctccttgtctgcaaatacccagggagccccttgtgcggttatgcctgtaaattgtgagtgaattggttaaaagaaatgtttatgaactttaaattctggagttccatcacatggttggtcaggaaaagaatctcttttgagcttatcctgtgtaatatgcagaaataccaaatcgcatgcagccaaaaccagaatagcaagactgcatctcctatctatatataccattgtagattgtgctcagtttacaggttccgaatgagtggcaaaatttacagggaacatggacactgttttggcaaaacttgtacatcactatgatatatatccgttgcaaatctgcaatctgtcctcatcacctacacatacaacaattggtactcgagatacagagctcagcattacaatctgtgccatcacctacaggagatcactgatattgcttgacaatccaccatatctcgtcattgcaatctgtttcatcacctaataagtacaagtagtggtcctccagagaccgatcctgtggcagcacatcttgctctcttgacacatgcgaagtggactccttaagtctctgaacacgcagcctgctatatgcgtcaatgttcagatgtgagaccaagaagagctctacctcagcgacaaaccgctccgtttggccaaggaggaacggcctggcagcttccatgagcaagctcttgaattcttccctcctcttctctggtggagccatcttcgaggcatgccccttctcttgccttttcatgaaagactcgatcacaccatggatgtggtagataatagcgtcaacattttcatcctgcaaaacccagtattacaatacattgcagcaagcaacacgatagcagcacgacgattatataacatcgtagaataatcacaaattctcaactctctacgacacttgaaagaataatagaaaccatcatcatgctcccaagtcatgtgcacttgagtgcgtaaatcaaatccaatttgtactaaactataagagtaggtattattcccaagtgtgtgtttcagctatgatccatgagtaatgggtaaaatgagattgtcagataatgcagataagaagagaagccctaattacacacagataagaagataatgcaagtgcgacccttttaagctatggaataaccgtgtgacaatatgcagtactgtatgtatgtacccgtgtaagagcctgtatttcctgtcttagccaggtttgaagccaaatgttcttgcgaagatacttgcgttgcttccagaattgctgaacgctggaagtattgcctataatatctgttcagttgagcacacgtcagtcatataacactagattcatagatagatatctggaacaggttctaaaagtgtgagcacggacataactaaaaaccaacactatacctcgtatactatagaattgtgtaatcaagtcgtgtgcatctgaaagatgtctgcacgaggaggaaaatgagcttaatatacttattgaaacatgtaacaacaatatttaatttacaatgagaagagtggcatgcaaatggtctccatcgcagaaataaaagaaaaatgtctgctcgttaacattaactacaaaaagcgcagcactgcacaaccagatggagggaaggagataactggacctttttctggggtcctgatttatgtagtgccgctcaaatgattcaccattaaaaccatgtataatagacacattcacggtctgcaaatgtcacaagggacatataatcaggattcaggacctcagggcacagtctcaggtgaacaaaaaatttgccgggcggtgaacaaaaaaggggtcaaatttatagatatagttgactgcatcatcaatagataaatgtagcagcaccaaaaagtaatggctggtatggtgtgttctccacatttaagctttcctagaaaaacacccaaagctagcaaattaaacaatattcaatagtggcgtttcatcacgttcaaaagcgtttttttcaatcaacatatgaatggggcataggttcatatggtttctgtcagaattcacttgaagatgataatctatcaagctaagagaaatgtggtgagaatggtatcagacaaacagaatgtcctgttcctttttggaataactattggaaccagagaaaatgagttcaccttgcaaaggggacattgcactgatgataaaggttcggcatgcttggtcgatacaatctttacccactggcatatgcacttgtaacaaaaagaatctgcacaaacattatgactctaagaaaatgaacttgaacagatgaaaggcaagtggtgatttcaaaatacagtagatttctgtcctgattccagcaatgtttctcttgatgaacaaaactgaagcaaattagttagaggccatcaagcaatttcgcagaaacttcacatcttttgccctctacttaagagtcgttcaagattctatccaagataagaattcttacagaattgaagagcttacacataattaattattaaagaccctatgcggagcaatcttaagatccgaaataaaggataattagagagattctgagaggagagactaacggaagcaggtgtcgaggtacgcctcgtctaggaaggaatcgaggcagatggggcaagcacaagcagcgctcgccgccgccatctccccctccgccgtgttgccgccgctaccaccggaggaggatgcggcggagggagaggtcgccgccgccgccatctctgtccggagaagccccccgggtgcgaactagatgcgatctggaccgtcggttaccgatcagagatcagacggctgggctgatccgaccagtgggcccacatgtaagccagcagcttagcagtagttcgcttcgagttaattaacgaaatctcaagggatcattacgcaaatctccctccttaattacggactgtcggccctcgtaatcacgcgctaatccgtcgttaccgcctataaaaccaccacgtcggacgtcgccacttccgcggcgcaaacagtacacgctctcctcctcctcctcgctgtctcccactcccatcccaatggcggcggcggcggaggacgtggagttcgtcgactacgaccgcgacgaggaggaggaggaggacgccatggacgaggacgatcggggcggtggccgcggcgggcgcgcgctacccgtaccccacatcgtctcccagggcgtgatgcgctcgcgcggccgcctcctcggccgcagcacctccgtgctcgcctccaaccgcgaccgcttcgactccctcgccgatgccggcaaccccggccacggcccacagcgctgtgagatctccctttgtacttctattttttttttgggcgtgagctcgagtttgaacttctcggtagggttttgtgcgctatttttggtcggtttgcgtgtgatttaccagttagtgtcgcgcataatccgcgagggatttggtgagctaggatttgtttggtgatatttggctagggtttagggtttttggtacggctgcgcttgcggcttgccgattgccactcgattgcgtgcgcactcctgtttgtggtgcaggcttttgattttattcaggggaattggagccatgtgatgcttaagctaacgatccaaactaaatcgctgccggtggacagttatatgctgatatggttgtgggaaaaaaaaacaaatgtataattgcaattgatactgattttgtggtcctgaatgctgagaaccacatcaggttctacgctgattgagtgagtttccatgctgacaagtgacaactactaccatcagtagaatgattgtataattttgcacgctgtgatctttcgttcttctgtaggtttcgtagttgtgtgcctttggcaggcatgccttttctccccaatgtccttgatggcgttggaggaaattagaccattgtattgaaagttacttgggacaaaaaaaattcattgcagcgaatgcatgacatcaattagtttgagcagcaccatga

SEQ ID NO: 54267 - DNA, 2177 bp, Oryza sativa
  unsure (1)..(2177): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactagctcctactgtacaggccgaagcagtgaggaaaatcctgggtattgatattgagaagaaaaaagaggagaggaaacagaaagagcgggatgagaaggtactatgccataagtttttattgttgctacatttctgttcatggtacagtagactcattttacccttcctctcacctttttttccaggaaaagcaagaaaaaacagaagaatatagaaggaactgcatccaatgtgtcatggggccagaaggaactgttgtcacatttcctgataagatgggcctccctagcatatttgactccaagcctatcaggttacatatagtaccccatctgtgcatcttttaagtttttccaagtttacgtcaagcatagaatccatgtattgatccattttgaagttatgcatttacattcaactccatttgctttatccatcttcccagctatccacctccaagggagaaatgtgcaggcccttcatgcacaaatccatacaagtaccgggactcgaagacgaagcttccgctctgcagcctgcagtgctacaaggctgtccagggaagctctgaggctgcccagggaagctctgagacgctaacatgctgatctcagaaattaaaggatggtggtgaggcaatcgtgactgttttgtggaactggagaattgtgctagttccatttgccacctttgctgcttgttcttgtgttgccaatgttaccttttgccattcctaacaatcaaccaaccaacagagggggtgtcgcctgctgctggccatccttttgactcgttgtggatgcagctgcagtgttctcgattaaggattaatttaggtggtagtcagatgaatgagagtgatgtatacattagttgtacagtgatcatcctactcgtcatcgttggtcatgaaatcatcttgaaaattgtctctctgtttgcactttgcagcagttggctattacaaaccagttaacaagagtggcagcatcaggagttcagaggtcacctgttctgctctgctcttcagaagcaagttgccggcttgagactggtaacaattttgctgggccaaactgagaaatagaagatgggctgggccttgcacatgaacatgcttggttgctactaatttgaccatagcattaggacatacaagtacatgctgctactatagcaaaagaaacaaaaatgcatggatcaatgaactggtaacaggtcataccaatcgtacgataatgcactagttgcaggcactccgccaaagctgccaatgcaatcgtgttgaccagaaaaagataaacacgtcctgtacgttcgattcgtttggatatgatcgcactatgcgaacgtgttgacctctccaatccattccgtttcacttccatcatgtaatcacaagaggataaccaaaagtgatgggggttttgtatgcttgcttactactccaagtcaactagcttttgagtggcccaaaactctcaaaacgaattgacctctgcctttactgttactgcaactcactctctctcatcatcatcgtttgttctacgacggataagctgtgaaaaaaaataaacaaataacttaaaaatgatttaaatgtaaaacttttatctttatgtttttagctatttaaaagctgatgttgaaaataaactacgattagaaaaaacctcaaaatcaactttacaattatgttacaaaacttaaattttagctatggttgagaagccaacatacaatggagctgcttctgtagccactagtcctgaccnnnnnnnnnnnnnnnnnnnnnnntagctcgaaagtatatcaggagagagagagaagctactcgatctacctgtcttgcaaaagctggggcatatattttcagctgaaaag

SEQ ID NO: 54268 - DNA, 7421 bp, Oryza sativa
agttcaaacaatgagagccacgtcactagatttttcagttcatgcatgtagttatacgattctaaaaaaaaaaatacatgctactcaacaccatagtgagatatagatttatcaatggtttaggttttatctcttccaaaacgtaaaagtagtaggacggcatatatatatatgaacaatggcaccatgatggatatatacccattaaacctttttgaactgaagaaaggagtagtacttgtctaccacgctctgtttcgtgcatcgtgttatccagcaaaagtagctgtagatcagtacatcatcttgccgggaaaagtgactttttatttttatttttgcaacaagcgtgtttttttttaccactgacaacaatggtactctctcctacagtactagggagaatgtctgtctcttcttttgagcatggcgagatcgaatgaatgtgatcagtgatgagagccacatacacaaacacacatgctgctgatgaagtgatcgatgagcagctaagcacacacgatccaaggacagatcagcagctttatcataatggtagcagctctggacattcatactccaaaaatccctttcccttttcccctgtctttttgctgcaggccggccagcatatgaatgatcaggagaggcaaggagacatggcaaagcattggcagcagtagactctctggagatctctcctccttgctagtacttgtgtagtactccctctgtttcataatagttatcgttctagattgttaaggatagattaaaatttaatttaaaaattataatacctcttattgaataatgcatgatggaaagtggaatggttattgtggacaaagtgagaacttttggatagaaagtgattgatgtgataactagcattttacaatgacaagtattttgagatgaaatttgaatcctaaagagacgagtattttgggacgaatgcattggtagtactccctcggtccctccatcccataatataagggataatgggtggatatgatcacacattccagtacaattaatctgggcaaatgatctgtccaaatttatcacatccacctattatcttttatattatagaacggagggagtagcattctgcgaagacgacccatgcacatattgctcaccttttgcccaaacacacatgacacaaacacacatgccgtccatgagaaattgagaatgatcgtcgtcgtcttcctcggttgggtcgcagtggtaagtgctaatcatgggctctcgagcgcgcatgtcaaaagcgaacctctcccatcctcattgcctccagcatctcgatcacctcgcttttccctgtttcatctccaatgagtaattttgcagcactgcattctggctgccgccgccgacctagatgccattcttaatttactgttaatttcagttttctttcagagaatgtttttgtatcgaatgaaatgcgtcacattttttaattacctaattaaagccgcatttgagatagattaacaacctgattattaacgcagattatttactgcgttatagagataattaaatattttatgatgaatactccctccgtttcgaaatgtttgacaccgttgactttttagcacatgtttgaccgttcgtcttattcaaaaacttttatgaaatatgtaaaattatatatatacataaaagtatatttaacaataaatcaaatgataggaaaagaattaataattacttaaattttttgaataagatgaacggtcaaacatttttaaaaaagtcaacagcgtcaaacattttgtgatgagggagtaccagaaaccatgcaatagagaactgagatttattttttttaaaaaaaaacatactagtatacttatagggtagggtttgcgtgcgtgcgttcataggtgagtgtgtgttgtgagtgtctgcattgtactgtgtaatttttttaaaaaaatatatctcttgaacatatacatgcacatcttaattatacaagcaccctatgagaaactagacggacatatcttgatcgtttaacggaatagccaaattaagacaacacgatgttagcatgccacctaccactataactagcctaaataaaaacgtttatgctaaatcatagaatcaaatccgctgaatatgtttcatcgtaagaaacctaaccacatgagcttatcctagggaccgtgatttcaatctctcttggatagtggttagatataagagcacaaagctgtcacaaagatattttgggatcagctcatggatgtcaatttggtgagaaagatatcgaagtgctcacttggagattgcctacagcgacatgtaaagagttgccagtgctgctgcatttttggaaacggaggaatatatatgccggaagatgaaagagggcaattgggtgtcattatcatggaatcactattgcaatgccctagaattgtgagagacgtccatgagttgggtgcttggttgactacatgacctatcatctattcatgccgttttgggtaaataagtaacaaaaaccttatctgcatagtctctccgtaccataaaaaataaatctaaaatcggatgtaacatattctaataatacgaatctgggcatatatatgtctagattcatagtgctaagatgtgtcacatccgatattatgttggttttttatgggacgaagggagtatatggatatgattctataaattataattaaaaaaagtaacaaagacatgtacggtaaacgggtaatgagcactataattatactaacatgttgataggataatctataatttttatttaaaaaaagttggacatttttactggcaaccatgttactccattcatttcagaatgtaagatgttttgattttatcctaagtcaaatatcttccgatttgactaaatttattaaaaggaaacatgcaacatgtttaacaccaaataaatatgttataaaaaatatgtttaatggtgaatttaataaaattaatttggcattgtagatattactatatttttctataaattttgttaaacttaattgtagataaaactatatttttctataggacaaaaccatgttacattctaaaatggacggagtttttctttttttatatattttctgcttctttgaacaaactaaacctatgagtaagcacaataatactttacaatgaagcgtattaagaattccttagccaaattatttcaataatatataagttattccttctcactatgatgaggagaacaaaattaagtatatactccaaagaaaaagaagggtagaaaaaattagaagaaaacaacacataaaagaaaaaggagggtacaaatttctgccgaaatgaaacacagagcattcaaaaaatatttttatggcaagtttaatgtaaaaaaaagttcctgttgattatagttaatatcatgccctggggtgagaatgagtaatcatcattgtagcaggcacgatgcgctgctctacttggtggcctgtgcaattatgttcctcaatgagcttgcctcttcctttgctgcttccaccaagttgtcctgcaaacacaccagtttatattccacaatgtcatcatagatcagccaaatgctcaccattgatcagtagtgcatttcacatgagcacatgaccatgcttgtatatcactttttgttgttactcctagaaactcagataaaaagtttcagaaagaaaaggaattcagataagttcagtggaaccaaaagtttcagaaagaaaaggaattcagataagttcagtggaaccaaaaggactatcacaaggaattcatttcttgtcaattcattaggatgtgtatacagtctgtcaaggtagaatactctacatattcctcctttttgtgtgtgtttgttctctaactactagtccctgtttgtggaaggtacctatgggagttgaatatctgaattggttcgtgtgaaattcctacattttgaatgtggcctatctccatttcaattgatacaatacctgtgtagtgatcaggcgtagtactgctttcttgttcgattcttgaagctcaccggcaatcagaacctcatccaatataaagtatgcctgtaaatatagacagaagcacagaaaagacagcaggtttagcaatttgacaggcatggtcaatagatataagtaatcatttgaacaaacgaagtaggtaccttgtggaagttgaatatcaggtcaagctcgcagacctgcaacatggcaaacacagaagaatgtagaataagcaaagaagtttcagaatgcctggtagcacaacaaattgggagaatatcatgttaaaggtgtttctgtgtgagcttacattgccaaaatatcggtccaatatctcaacaaaatgatggatgatttgaagagtctccagttcattatcagcagcatcaatgcacatgcagaagtaaaggcttgcatacctgcagacggtgcgaaacagcttgatgcaatcagaaatatcaaaaatatttctttacagatgaactgacatttgcatgtgatttagcactttagctgctaacagtgctcgccaacaatcacataataacattgcaggtataatcacaactcgggagtaccttttgtatacaactctgtatccgtgccaatcgacaaaattgcacatctttggacctcttgtcaggacgagcgtacttacttctttgataaccttatcatcgaaaataaattatcttgctgatatttttacccagcggaaagaatgatggattaggattacagtaaacatgtactgatatgtgttaacctgtcatttcttaccttggatctttccttctgaggatatggattgtaccatttggtcagcctcaccttcccttgtctgctgatgaggagcacaaaatgtatctgacaacacaacaaatggcgatgtcatatggaatcctcttgtctgctctccagcatcaaaagaatcatcaaaaactaatgctgaaccaaagttcaattcgaggatcacaccactactaatgatgatatggtgcacatcaagacaagctaatggtatgataatgttatcaaggcaagctaatggtatggccacggatatatgatcccaagttcccagctgcatccaactgtacggcatttgtttatgtaatcccaaatcatgcaatctgacgcacatttgggcgaaattctagccctagcccaaatcaatctaactgtaataattcaggaatgggctacggatcatgaacgagtggacgaacttccctcacattaaattgccatcgaaaactgttgggaaaaaaatttcaggaacagaagaaggaaaaaaacagagagagaccattgatattcgagaatagagacgagaagaatcaaccaaatgtaggagggaagagaatcggatcacgaccggattaccatgacgagcgacggcggtggcgctggttagctccggtttcgaaggctcgccggcggtggagacgatctcggccgagaggagatttttttttcccctgagagagagagatgcgtagtagaggacagaggagttgaggtcggatgatactagtcatcgggcccccgattattcttttgcatgggttgccttttctttcttccgtgcatacgtgcatgccgtgtaaccaatccctctctctcggtttgttctctattctcttctcatacatgcaactattttcctgggttctctcttctctctctatctctagtactctcaagctttaaatatatattttttaaaataattatccaatctttaattacatcattatatttattatataattaaatgatatctcatataattatattttgataaaaaatatatacgattatatttctacttgaaacaattttatataacacatgaagcatgaacaacaccaaatattcgctaaaacatctaatgaacatgacgctaagtttgcaaagaactaatgaaatatcagaaaatatttattgaaaacatccagatgacaccatgcacaacattgaaaaaaaatacatattgcaatattaaaaactaaaaatgtacaacatagtttggttacggttgaaacattaaatttcaatggttgaaacatatatatttttattagaatataatcatacgatatgttgttgtaaaaatttaattgtaacaaatattacaatgtaaacgtaatataaattggataagtagtttagaaaaaaattgtttcaaacgttaaaaataaagtagataagaggagcgaaaatcttctctatgtagtggagcatgacgttggagggctccatataacgctgcatggtcgaccgtccgatcagaagtagatcaagtaaatctcggttggggtctccgcgaactgtttcgttttatttctctctgttttttcctttttctattttgggctcccgcatcttgggggcccacggcccacgaacgggatctgcatttcgtcccaatacttatacaattacaaaaataaaaaagttattttccgcacggattctactactgctttcacaattgggacccatatgcctgtcactacatgcaagtctgcaagactgcaactgcagtgcattatgcatgtacgtaaacagcatgaaacagatcactgttgacaagaaattaaaaacactataatcgatgccttccaattttgatggcatgatagatatgcgaatcactcgatattgcaagtgagaggtgtgttttctcaggtatccgtatttacaaattacaacagacaacaaacagaaacattctctaccctgaatatcatgatttttttttccgggccaagtgtacgaatgagaaaaactgttgcatttacaacaatatcatgatcttcacgtcttcagaaacgaacaacactccccagaataacatgatcttcagaaatgaacaacattccccagtgaaagagacagtatggatatatttcaagtgaaacatgacctggcatatttcaagttagcagtcaaccatatatttctcgagatgctttgacatcagtcgccttttggtatttggaaagagaaaaatggatatatggcactccacactccaaaggttgccagcgataagcatcagcatgagcgcaccacagatgagtcccattatcacacatgctcttgaaaactgttgcagaaagaggatactggatccctggtaagtatgtatcagtaagaattggtcagtttcttatgtgatggtagctaagcaacagatctgaatcatcaaatttcttggctcatgtcaaatgcttgcggttgttggaatgatggcatcttgattttgcggaatgaggcacatcgatctttcttcagaggaatcagtttaccagaatatagactgccaatgacccagctcgccggctgcaaagaaaattc

SEQ ID NO: 54269 - DNA, 1410 bp, Oryza sativa
acaatagcttatatggcgtgatgcgctcgcctcacttgctacgagaatgattccatgtgaagagcttctatccttcaagctttgaactaatccctgaagagatgcaaaaacttggccacctccatgctgtgaaacacatcgtggagataatgattcaggtaatggctaacaacatatcagttataattcacataagtaaatcatcaatcacagactagtttattattgtgtctgttgttgcaagttgcgacataccttgataacgttggaaaatttggaacagaagctgatttttccaaggattaagaatcctaccccatcaaataacaatgtattctttcttaggtgcagtgactggtcaaacattgaaataccctgcattgaatgcacttgtcgaataaaatacctagaaaaatgatatgacaagaaaagaagtgagcatcaagaatgaaaagcattaacatatttcacataagcaatacaacaagattgtttgacgaattattagtttttccaaagaaatatagcacagatgttcacaaaaagtgtgttgactatgtttgacaatatagccgaacgtttggactttgatgaaagagtatcgtatggacatactgtagctgatttaaaataatagtcttggctatgcatgtgtgtataattagtctcttacaatttgcatatgcttaatcatgtcagcattataaagccctttcaaaagatgaccttttaggtagtctatctcctcaaataaaaagttagatatacttctgacggttggcacaacaattgaggacataaacaagaaaatattttcaaccttctacaatatcttagtgacaaatttataaattataatagactgaatcatgcagtttcttaataattctagaatccatagatacttcagagaatcactgatacaatggcacatcatacagaaataccataaccgacaacttttccttgattacttcataatatatatgcaacattgaactttatcaagaaagacataaatgccaattcaaattacattttcagaggataggcatcatgaaacgtgtgaatataagcatatgataatatgagtggatgctagatcaccatactttccaggtggcaacatgacaccagcttgaatagaatcaaaaagccaactgggattcaaaatccaggagttgatagcacagccatataagaacttagccgttgatacctgtcacaacaaatacttgagacgtaagtgcaaaatattgtcaaaatatgaaatggtaatttttggaatacatgagagcatattatcatttgtaaccaataaactgtaccaaacacaaagaaaaaatgaaatggattagcaaacctttttaggagaaagaacaatgggaggcttgcacctagcaagctctg

SEQ ID NO: 54270 - DNA, 2557 bp, Oryza sativa
atgcttccttgtaccaacatttgtctgcacagcaactactccaccttcctggaaagaaaatttacattgtaatgtagcagataagtgaagtttatttgaaacaaaacattcgatgataaagcatttgattggcaacaaagataccttattgtgacttgctaaagaatcagatacatggtcattagtatcagcatcatggctgttccatctaatattttgcttctcaggagagctctctaatacgtgagcttctgcatcacaagggtgagaactagcgtgagagatttcctgtttcaggccacttatgttctgaccttgagatgcacaagcagtttgaacaagagataggccaacatcttgaaatgcatcgagcatttcagtctcatctaattctgaaagcctatcagtctcatccagatcactttcagaggatccacaagaatgttctagctcctcaagaaaacactgtttccgagcttctttcacatgtagagcagcttctaaggaagctgtagctagtttatcagactgagaatcaagaagtatcatttccgcaataaccatggcttcagaggcagcgattgatagttcaactgcatcattcacatccgcgctacggagtttccgaacatcaacctttcgtccagacagttgctgtcttctatgtccttttgaatcacatgttttattgatttcctcgctagacattttacaaatttctcgaaggtctttggcttccgattgattttgcggcactgtcttgatctcttgtgcttggtcatcaatacaaaagccacctaacacatctttgcatgtaacagagtttagaccattggcttgagttgaggatagttttgaagtactttctgaagaaagatgcagagagaaaggcactacctgtagagtgtagagagcaaatattcaatgtgttatgacttaatataagaataagaatatttgacaatgaatacaattacacaaaaggatgtctaacagcatgacacagttacaatattcaggagacattagcatagtacattgaatgcaaagatgtatatacagtatatatggctacatgcatcatttgaacaaattaggttaatgacaggaaacaatttgtaacttctgtccttgcaaaggaaacatgagttttactagtttcttagtagacaaccttgttgcttacaattaagctcttctagaacactttcatgtccatggtgatttgcatccagaatttaggcagtcccagtaaggaatatcattcctaaaacttacattgccattgctaggagtagttccagtaggcgtgccctcatcccccgacaagtgcaagctaaacccactgcaactagcagcattcaccatggtgttcagacaactatgttgctcttgtgcagggcctccgataaacgcgcaattctgcaactcaagaaagaacatcagtcattggatcatagccagctgcacaccaagaaacatgggtatatacatcagatattcagatcggattcagcacatctcgtttcctactaattattattggcttgtggtgcccaggcaagatggcattactaaaatagaaacaaagcatgaactaaaaccccaccagattgttgctactaaccaaagagaaaaaggacctcaccacacaagacggcgacgaaacggcggcgctgtccttcccgtgctcgccaaccgccagcggccgatgcggctgtagccattgagggagaaaggcaatgtcctgaacaaatcaacgcgactccactaggttattcgaagaggaggaggagaaggaagcatcccacccagttcgttccttatacagaccaacgcactcagccgctccgaccacaaatgcagcggcgcgcgcgcgagaccgggggagggagaatgggggagagctgggaggaggggcgcggttacctcggagaagcgcggggagtggtagccgcaggccgacatggcggcgggaagtcgccggctcgccgccgccgccgccgccacggggaggaggggatgggggcgcgacgctcttcctccccctctttcttttgtttttctttaatttatttaatccgaaaattaaggattcgcgccagaaatcacagcgaaggcgggcagccgggcatttcggggagggattccacagcgctggctgacaggtgggccccattgttgtaagttgtcgcatccgaacttcttacggtgcaggtgcaaatttatcgaccgtctgttctatttgaaattttgtgattggaattctttttttatttaataggcgataaaacataaatagtaatttatgcgtgacttattttttaaatttgttttataaatttttcaaataagacgaacgattaaattttgggcacataaacccgtaactgcgtttaaaatgggccagagagagcagtttactaggtctaccatttttaaccacacaaggaaatttggcaatttctttcttcacataaattatgaatgttagtattacttagaactgtacgcaataacaccatatttacatggccaattatttagacagaagagg

SEQ ID NO: 54271 - DNA, 841 bp, Oryza sativa
taatagtatttacctgtagagatcgagaaagagaggtttatatcaggagattgggcacaaacatttggcagtattttggtgcttagtgattgatgtacatggaagatatctctttgtgcgatggcaacattacaaggttgctagtcaaaaataggtggcaaattagacttatgatcttaactcataagtaatggtgtaataagatgcagaaaagaaagataatggtattcctacggcagatggtgtatatgcctctaattccaaatgtaggtcattttagttttttcaactcttttctaaatatatgttggtttgaaacttctgcgtgtttttttatttcttccatgtttgtcctcacaagatcgatagtacccctctgataaataaatagatccctttttttccaatgtagtataaacgaagggcaacaaagttattcaagctattttcttaattcatgtgtgcaaatctataacaacttatatttgaaacgaaggctactaattcaagagatatcacgccgagagtaccttgggcgacccttgcaatttccttggcaaatcctgtggatacaaacttgttctcggtatcaataacaagaagtgaaattccagccttgtatattttgccagccacctcaagtatctcatccttggaaaagataaatatatcgtatcagctttagagtgattgatacatgcttttaagaatgcaacttggaagtagtttacgtacatcatatcagcttcagagtgatggtcacaggtttccagtttaaataaatacttttcatatcattactaccatgtgatattagatacgagttgtacctttaattctt

SEQ ID NO: 54272 - DNA, 4130 bp, Oryza sativa
cttgtcttgtcacgatctttctctctcctcagtttctggtatggtgcagctgctcgaagtgtggcatcaacagctaacctccttattggaccctacaacacaattaactgttcaaattggagcctacttgtgataaaggtgccaagcaataggatgggaacggcagaatacaaggcaacacagcagtatatgactattgtttgatagtatatcagtaaatgacagaacacagcagaaagcatcagaggaaaataggcaaaatgattatgcacacatttctagataggagaaactctaaaacactacaggcattgaattgagaggaaacaaggatctggattcaggaatcttggtacaataaagtgattaagaagtttaccttgggaagcatagaacctatgtatcgtcccctatcagatgagaatatgagattctttgctcgtccagctttccctcgccgtctttgagcttgctgagcaaagaaaaggagcttctcatctactataccacttcagcatcaaaaatgaactcctcaggtatctgctggtcctgctgttcattttcttcatcatcgtcctgtccaagagtacagctaatgagctacgagaaaacaaaatgaataagttagtcaaatcgtatatgtattaacctcttggtcctcttcctcgtcttcatcttgatcttcttgagaatcttgatcttgtggagggggtggcggtgggggtggaggaggttgttggtcttgctgctcctgtgggttatcagataggattgatcgaggtagaataactagctctacctgcaagaaggtgcacacatgtcaaatgtcttaactttattcagaatatactgacatcattacattaatgcaaacagccagcatggcagaagaaaattgtgagccatgcgagggcaaaatttattttgctgtgacttttattacgtgcaagtttgcagctttctattttgttcttaacaacaaatcatgatgcatgtttccttcggtacatttcagtaaagagatgaaaaggaatagttgtaaacaggaaattacagggggtgtcttactgtattaaataatgaagaattcaaaggcataagtatacttaacagctttcttaaggtcatccacatatactttttcacgcccttccatagcagcaagacattttgccactcgagcagcatacagctcagcccggtgcccctgcaaatgagtgtcagttttatttacatgagaacacagccactttttgaattacattaaccacaaaaaagtagcatcagtgtctcaaaaaccatgattgcttcaggtattacattaaccacatggtgcacagcggacaggtataatatctagacaagcagaaaataatgcaaagccacatcgatttcagggcatgataaacacaactaaaatgaaatcaatggttacagcagacagtttttagccacctcgccacatgttatgaccagaatgcatgatcatggggtacagactacagaccattacaaggacagtgcaatattccaatcaagctccttactcagcttaagccaaacagagctaaaaaattctttcactgcaaaataaactaacctgacagccaccgcgtatagcttccatgacaagatatttgagctgctctgtgctgattgcaacatctttcagatattctcttgccaaaattatctgttagaccatgtattaccacctgtgagatgaacagtgcataatattgttttcaactaaacctccatcgttgctagttaaagtcgctcatgattttccatagtcttcaatgtgggactttggccacgttattttttcaatactacatactagtaaaataatagaagtcataaactgtgaaagtattgtccaacaaaaatagaatggcattattttgtgtgccatcatataccttttatacgtattaaagattgatgttttgaatgttggaccagataaaatatgttaagtggcagaacaacacagggaatataatgtaaatgtgggtacatgcagttaattcagcatgagtggatgacgttgggatctcaaaatacagaaccatgaatagcgtatatactttcgactatgaaggcaagggaaaaatcatatgtaaatggcacaagttgtaattaggtgagaaagatccaaaaatcaatgtatcaacttgtctgatgtgaccatttgtttatgaagcatattaatgaatccacatattttgtgatactgattgattagatatcgctgttctgaagaaagctatttgtgtgcaatacaaaaaaaaaagcaaaagctaaatagtttctacaccctattctagttcaataaaggaggtactctatcttacaggtttacatccctagtttaacagtatcggtggtacctgggtttttgcaacctcagtttcttcttccaccattttaaaaacctctttgctggactcttgaaattgtgttgcaatatccacagctgccacacgatcatcaaaactcattggcagatcagcgctgcaacaaaacaacaatatggaatgagcaatctgtggtatttcataaatgcattgagagttttcttatgttctccacaccaacagagggtgtataagataatacaacctgaacttggttaaaagaagtgagtaaatgagtgatccatagtctaaagtaccttaaattaattgcaatacgatcaagtaagtgttcacgtacagatccttcctctgggttgtaagtagcaattagaagtggtttgcatggatgacgaaagctaatgccctctctttccacaatattgactccctcagtcaagacattcagaagtagattgcttacgccctcatccaatagatttatctcatcaacataaagaacgcctctgtgagcttcagcaagaaggccaggttgaaacacagtagttcctgattgcacagatgcttcaacatcgactgatccgattaacctatcctcagtgataccaagcgggatctgtcaaggggaaacctgaaattgaactaacaatggtatgtcgaaattattttttaaacaaaaagtccatgcagcatacctgcacaaaaggtgttttgataatctcggtcttcaagttaccatcagcatcatattgaacttggttagccaaaccctcctcccatctgccataagaggagaacaatcaagtgagttacctgacaatcatttcagaaatgaaagtaaacatattcaaattgtagttggtatgtaaaactttgtgggggtgaaaagaagaatttggatgcttaaacagaagttctagaagcattattagacatgcatttggggacattactcttctgggtagttagggtcagcatttgcaatcgagcctacaaccacttcataggtggaagcatagcgtgcaagccacgagccatcactgtctttgctgtcccacgcttccctgagatggcgatgcctccaatttcacggtcaattgccccaagcagcagagcagttttaattgcatcctggacgcacaataaggtaagttaaaattgtaacatatacaaagttgagaccataaatcaatggtttgataacaagatggtgtcttctcctttgcaggttattacattagtcacccggtggctacgtacctaggctgtcctccacaaaccgggacttcgggatactattgcggtagtatcacgatagttggaccaggtgacacggagtttttttatccaggagcatgggtggcgatctagtctacggattgatagccactaatccctatgttttggttattcttttgtgcttgggaaggatgtttttggttcttttggctgtgtgcatcatatgcagaggccggggtgggcccgatgcggttgtattgtctttgtgtaattgactgagtatattaataaagcttccattatctaaaaataactcgatgcagggaacaatgggaggaaaactaaagcttgaaagtcattccagctcgtttgtttcatcttcagagagagtatgacagcaaaataactcatagcaaaggcattttttcagagatgtacattggcacattgtgtactgatcggtgatcactatttgtccactgattgattcgcttacaatagcattagcat

SEQ ID NO: 54273 - DNA, 1026 bp, Oryza sativa
tggcagttgagcactgtcgctgttgattttcgtatatgaaattttgagtatttttatgtctaaataaatttggcatggatacccgtgctttgctgcagaatatatgaatgaatatgtgttatatgttataggaataatatatgtatatctttaaataatgtgaaaatgatgtaaagataataatttgacattgtttgtatattgagttctaaaaatagaacaaaattgtaaatgatatgtcatatttgcgtgatacttaaaatactctagataataattgctagtgagtaatgatatggcttactcacatgttaagttttacaagttattaataagcatcaattttatagtaagatgggatacaggctccctctgttacataaagtcctaatcatatcttaatttttaccactcctatagtcctattctgtaacgctccgcttttcgtgagacgttaaaaactaattcggcaaaatcctaattgcgaaaatttcgttctttgagtgttgagtctaagctgtgccaaagatctcaatctaaatccctcccttgtctcgataccctgttgcaaagatcgtctcctcaaaatttccatcccaatatagtcccgaagctcgattccttctattcggaatcccctcctggaaccccatccgtgaactttgtcgaatgcccgaaacctaactccgtccaaggattcacccttcgcgtcataagctctctccttggttccttcaaaccgattctcaaattcgatttcaacctctcaggtgttgattcatctatcttctgcctgtataggtgcatcaatctacccttgtgatccttctcgaacttctgacccaagtctgaatatgcaaatcgagatcacttccacccttgaactcaaaatcccaagattcaatccctttcgccctgagtgctccccaaaatgagttccgttccgaattaatctcgaagtccgaacccttctatttgggcttctctccaaaatccttacccacatatctcgttgagtagtcaaac

SEQ ID NO: 54274 - DNA, 1955 bp, Oryza sativa
ctagccgtgatcaagataggtagtaccagagggcatgacgctattctgggtattgatatttgataaatatgcagcgtctcctcacaattcaagtttgagagcatttccctctatatgaactgaatgatcaagaaccgacatgaaaatgctcattagataaaacagtatcaaactactggttagcatggacaattaagaaacacgataattccataggagatctactcagcaaacagtagtttgaacaagcaatacttcgaaaatgctgctattctctagaggctgcctacagtgcaggggtacattgttcagtttctacatttctgcaaaaatcaatcaagtgtgctcctgaaagagtcttcgcacctgtgtacagcatgaatagggacaaattctcgagtttatcgtcatactgcaagagaaatttaagtaatgtatcttccttgctgctcctgaaggagacgagccgatgatttagcgtccaaatacagagcactgacttcctcaagatcggcctgattaaaaacaaggtcatgggttcagcatacataaaacttgcaagaacaatatcaggctaacaagtgaatgtagcagccagccatagcccatacggcaaaaaagacaacaagaggacgttacaatatcctgctggaatttcaacacataccttgctgatcttctctctcccattagcctttgcaactacactggcgggtgatagcaactgaatagcatgcctacatgagattcaacatgtgttacaatcgttcatcttcgctagctgcctcagtaagatgagcttggtggttataaaactaaaactacaaaatttaaaatgcttatagaacaccgaaagtgggaaataagatcagtccacttaacataactccctactgcataatttccatcttaactctctttctcaaacctgtcggtgtaacaaccaagaatcgtacctcaaagatgtctgttgtccaatctctcctaaaaatgcgagactttcttcatcaatgtcaatctcttccacctgcgctctaatagcaagtatctgtagaggacaatgagcaaagatcaaacacatttctaaacaggaaagcctaagtgatataagatccaaaatcaaacctggatcatctcagtgggaccatatgtttctgttcgaataatcaccaatctgtctagaagatcaactggtataccatgtggacttgtcatatcagttcctctggacacaagcataacaagactttgtaaactttaaggagcatatggtaataaacaaactgacaaacacatgattagtctggtattataatgtagcgcagagtgcttcgactggtaaatcaaactgtttaccttacgttacatattcctctgttcgtagcaagtatcacaattggtgataatgggctctccaaagcacgattaagataagagaagcattcaatgtctaacatgtggacctgcgattaaagttcctcacaagtaactaaatcaaaccacatcaagatttataccatatagtagagaaatagcatggcagtatggcactgccccacaaggacaacccactgtatgtttgacaacagacaaacacaccctcatttgtatttataccttctgactccaaaatgagccactgagaaaatttccaatcataattcgtaaggatgaaataataagatacctcgtcaatgaacagaacaccaggtacaagctcagcaattccttcatcaatatattgttaaccacctagcaacatacagtatagatgttaaagatcatatgccaatcctgacatgtttattaaatgtggtccacttttaaaagcagcagtgctgctacatgggaaatttgaataccttattgatttcttgtcgtagcttctcagtgatttcagttttccgtggcttcatcatctgtcccataagggacaaaatatcttggcctccttg

SEQ ID NO: 54275 - DNA, 2538 bp, Oryza sativa
caatgcaaaaaagacttgcctgtgcaaaaatcttttaggctaaaattcaccaaattacctgcactatttccttcttcttatggacctcccctttggggattggaacatactcctcagcttcaagatcgtattctgtagcaaaagcatcacatctaccaactcttttgaccgcaccactattagcttcaatgtatataacatcacccactgacacctgcatcccatgtatcactgatgtaatgaaacaactagtgcaaaaaatggaagtaacagaagtgaatctcagtatcaaggcatctaatcagcttcacgatgacaagttatgaatttccaatcatgcaattttttttttacaattaacattctccaaagtttactttatagattaaatattcacaacaagacattcttctgaataagaaatgaacaatcatccaactattactaaaatttcaaaaaatgcacttagtgtattctaaaatatccagcacaagataggagggcgaggagcaggataccttttcctttattaaagcatcataaattgtaggatctagcttcagttgcttagtcccttttacagtcttcagacctatgattacatggctaatgctttttccatatccacctgttgtactctcagcctcttctggggaaagttcagtaacctaaaaggcaatgaagcacaaatatatattattttagaaacagacagtgagaatatcatatcagttataaatgtgctaatatcaagagaaaatgaaataatgcacaaattcaagaacaatatcttagtgcaaacttaaaaattagcatatatggtgtgcttacctctccttcgtagacctctttattttcttttatacgcaaacctatagctctacggaaattctccattagcacctcagttttcttgacctctgaggaatacacttctgatcctaccataggacagaaagggacctgtatagtaaaataataagataacacataagatattctccatcaacatgaatgaaacattggaagttttaccaaaaatgaagcagatgtaagacattgaacgaaaaatcttatagttaacacaaagaatttctcatatagattgtgaggtataaagtaaaaaaatgtacaggtatctaataaattgacatcaaattccagtgatccaccattagcagaattattttcaaggaagggaaacaaatatattgaaccagcaagcaacagaatccaagcctaaaagaaatgttgaaagccaaaaacatagaaaaaaacatgctaagtcgaccatttctttagaatagcaatttagttaggtgaatctgaaatttaatccaaccatcctcccaacagttgaactaaaaaataataaggcataggttctcaaataccagaagctcaatatgaatgcctttctggagctagatgagcccttataaatgtagaattacttgtttacactagctaatgaacaaaaaggattcaaacttacaaagaaatggcttattatgaacaattgtccacggtgcccttattgcacttaaacacgattcatcagtttttattggccacatgctttaactccattcaatcttcagtaaagagaactatgaaatagaagtaagacctcttaaactaagtctatggtatgaaaggcaggaaacataacccctctatgtagaagtgaggcttgaacacacacatgtataatatgttgttgaaatgaggcttaaaaccaaggtattcacaaccttgtgcggccaccatttcaccacgctgagggccatcgcatcgacctcttgacgagcggaagagcaaaaatccccaaaaggcaaaacactttgtacaagcttacggtgagcatatgttgctaataacatggcttgttcattatgaagcctaaaatctaacctccaaatttatttacagcagagtgtacaaatcatctagagcagtgctcaaagggtgttcgagaggagaatgagggagtggaggcaccaaccaaccttactaccgagctcctgggagatgccgagagcgagagccgtcttgccggtggcgggcgggccggcgagaagcagcgcgcgcccggccatcttcttctggcgaatcatgtcgaccaccagcccggcagcctccctcgccgccccctgccccacgaaccccgccgccaaccctatcgccgccccattcgcctgctcgagaccaccaaaccaagccaagccatgagaaaattttctctaaaaccctaggagaaaaacctttccccactgcagcagcagcagcagcagcagcaaggtgggggagagagcggaggagcaggagaagcgcggggacgcacgtcgaggccgaggccctttatgtgggtgtgcgtcgcgatcctctgcttcttcgtcgtcgactgcacctcctcgatcctcatcgccgccgccgccgccgccgccgcttcctgtctctccgcctccctccctctcccccaccgcaacgacggtggccggccggtggcgcagcgacgcacgtgcggagctacgagcg

SEQ ID NO: 54276 - DNA, 1187 bp, Oryza sativa
ccgcccgtcgtcgcggaactcaccaagctccgccgcgtggcccccgagctggtcgccgaggtcctcagcgctcgcccgccgccgcccccgccgctcgcgctcccgttcttcctgtgggcgggacggcagaagggcttccgccactgcttcccggcgttccacgcgctcgcctcgctcctctccgccgctgggctccccgccgcggccgaccagcttcccgacctcatgcgagcccatggcaagccggtctcgcattcccagctcaacctcctcgtcaggctccacaccggcgcgcgtcgcccgctccgcgcgctccacgccctccgccgcttccgccacgagttctccgtgcagcctgaggtccacgcctgcaaccgcgtgctgggagcgctggctgcggctgggcatgttgatgataccctcaagctgttcgacgaaatgtcgcactgcagtgtgcggcctatgccggtgacattcgcgatcatggtgcgtgcgctggcgcgggcggggatgacggataaactcctggagatgattgggaggatgcgggctgaggtgtgcagaccggatgtgtttgtgtacaccgcactggtgaagacgatggttcgctgggggcatatggagggttgcatcagggtttgggaggagataagaagggatcatgtggatccagatacaatggcttacaccacaatgatagctgggctatgcaatgcgggaatggtggagaaggcagaagaattgtttggggagatgaggaggaagggtttgctggtggacaggatggtgtatgcgtctctcattgatgggtatgtctccacaggaagggtcagcgatggttgtagagtgttgaaagagatggtggatgctggttaccgtgcagacctggggatctataacacactgattggcgggctatgtgagatagagcgggaggataaagcacacaagatgtttcagattgtcgttcaggaggatctaataccaagctccgagactgtttcaccattgctggctcgttatgccgataagggcgagatggttaagttttttggattggttgataaactagtggagctaagcttgcctatagttgaaattttagtggacttcctgaagctctttgcatgcaagagtggcaatgaattgaaggctgtggaagtttttaatgctttcagaagaagggg

SEQ ID NO: 54277 - DNA, 1342 bp, Oryza sativa
aacaggagggaaccaagcctgagctctttgcttggctcctaaatcccattcaaatattcttaaaaaaatcacatatttcttttttttaaaaaaaatattatgatgattacgccgaatatgtcacttgagccttaagcgtggagaatttaatttggctctgtcaccaccatcaggaattgaagcagggaaatgagagctataaccgttgaataacctctcaaaaaatccctgaattttagctgcttgagcaccttaaatgtgggatcaatattcattaagatcaagttactaacttgaaaaatatacagcatgtgtgtgttgttttgaactctaaaaatacctagacggagttatgcattattgaaaacataacatatgaatgcaaacttatactagaaaaacccatgaattctaaccttagtggtttttcaccaatatttctaataaggggtcaacctttggaagatgagaactctaccatttgaacacatgaatagtgaaaaatcaaactattaaagcttgacgggctagggccataactgagcattgccacgtcagattattgtacaattatactactctagcagtacatacactcttggctgtgtactgttgtacgaaacggagagtccaaagtagtagactgtccatatagttcagtttgatggatttcacccggagatacaccgtacgatttaattgtaataatacatagaaccatttgttttttttttgaactgaagaaccatttgtttttcatttacttttactttaaaacatggacaatgaatttgtttttgaacagggcttgaaactcttaactccgagcaaatgaaaattcaaacagcagtggattcaatattcaactcgaaacccctcctttttttcaactaaaaagtccgcaaaacttcccaataattaaaccgtgaaatttcagcgagacctgtatttaaaaatatgggccaaattcaaaatccaaagcaataaacaactgggctacacacaacatgcgacggcccatctcatcaagcaacaaggcccagcccactcgacacccaccgaatccacgccgctcaatcgaaaccgacggtccagatctcgccgcgccaaccccatcacacaaaccctagcaaccccccacctatataacctctctccctcacgccccgcctccattcgcacgcccgcgccaccacaaaaccctagccgccgccgccgccgccgccgccgccgccatggccacccaaacccgccccctcgtctccgtcaaggccctggagggcgacatggccaccgacaacagcagcagcctcgccctcgccgaggtgttccgcgcgccgct

SEQ ID NO: 54278 - DNA, 6397 bp, Oryza sativa
gacgccgagaaggccaaggactcggtcggcatccgccccggcaagggtaagatgcgcagccgccgctacatcaaccgcaagggccccctcatcgtctacggcaccgagggatccaagatcgtcaaggccttccgcaacctccccggcgtggatgtcgccaacgtcgagcgcctcaacctgctcgacctcgcacccggtggtcacctcgggcgcttcgtgatctggaccgagagcgccttcaagaagcttgaggaggtgtatggcaccttcgaggcgccgtcgctgaagaagaaggggttcatcctgccgaggcccaagatggccaatgctgatcttggcaggatcatcaactctgatgaggtgcagtctgtggtggagccgctcaacaaggaggtcaagcgcagggagaagaggaagaacccgctcaagaatgtcgccgctgtgctcaagctcaacccctacttcggcactgcacgcaagatggccacccttgctgaggctgcccgcatcaaggccaggaaggagaagcttgactccaagaggaccaagcttagcccggtataacttactctcctctcaattttgttgattcagttattataaaatgatgactaggttgtagaataatccgattagctatgtagatctatagttgactctcatggtaacaagaacaaccatttggatgcttgtctaatgtgttagctggtactgctttggatgatctatttgtttagatgacattctagtttacttagttagcctgcacttgctgtttgtgctgctatgttgcttcatgggctgttaatttgttagtattgctcggaattgatactacctggtgttaattcttgctgttattaggtacattcgtttctatattcatgcttctaatgtgccattttctccatgtttagttgagtagtattttgttctatgatctctctggtaagccaaggttgtattacttgttataagttattgacctcattgttgtagctcagtgtctgtcttatttctacattgtgttcctagaagcctttgaatgtgttaattgattcatgataacatacagttgtgcaaggtcatttagttatttttcttaaattatgtctctatgcattcaagtttaggtttcatgtaatgttaatattctagattggctccttgtccttggtgaaatggtggctgagttcttggcattagaaggtcatttatttggctgtgttttatatttatcatagcatgtgtggtttgttgttgacttcgtcgtaactgtttatttacactgatcttaggttctactatcattttttgtctggtttattctgccattgatatttcatttgctgtattgcccttagtgtttttagtgggatacttgtttagtcctcaaccatttggagacttcaatctcttggtgccttttgttctaactgaaaattcctgttgattcattgtaggaggaggctgctaaggttaaggctgcaggaaaggcatggtacaagaccatgatctcagacagtgactatgctgagttcgacaacttctcgaagtggctcggagtgacgcgtgagcgttgtcttgttttaagttttgagtagcagcgttaccggatcttatctcaaggatttatcaatctgtttttacctgaacatctccataagaagttatctgtgggattttgagactagtttctctgttttgttaatgtgctgtcgtgagaacatagagtatgtggtttggaccagcctctaaattatgtatgcacttccatgttctctgtgatgtcctgtattttgatgctgtgatcttgtatcgctgtatcatattgttctagggctcatggcttactcggtcaccatggcgctgattccattcacagtgttcagcctacttaaacatatttgcaattttggttagatgagtttgttgtgaaatctggtcagtgggcatgcctagcaagcctaaatcaagttgagcgagcctcaatcttatcttgcttttggtgaggaaaatgttgtctgttttgtggttgtgttagttgaggaaaatatggtcgtgccattgctttaatcctggaatcactgtgatgactgactgaaacgagtttgctagttaaccaaactctgttaccgtcaatgattgaggaagaagtcttggctcgtgctgttgcagaattgcacgggattgaatcagtggcaacttgagttctggatgaattttcttccaaacaaaacctcgacagttcgactgtgctggcaaccactgttccttggtttgcattctgttttgcgggaccgcttagcgttacgacaaatttagggcctgttcactttgatgacattttcaaccttaccaaattttggtaaagttgccaaaaaagtggctacatttagtttgctaccaaattttggtaactaatgaaatcttgccaaaattttggcatagttgtcaaaatttcagcaataccaaaatttagtaaggattttttttaagtatcaaagtgaacatgcccttagcaaaacactgaaactttgtccgaaatttgatccaaaacgaacggtttgaggaagcttcggacggaattcgaactaacgccgtgtttagttccaaataattcttcaaactttcaacttttccatcacatgaaaactttcctacacacataaacttccaacttttcatcacatcgttctaattttaaccaaacttctaattttagtgtgaactaaacacaactaagactgtttagttcaacgcaaagtttagattttggttgaaattagagatgatgtgattaaaaagttgtgtgtgtatgacaggttgatgtgatgaaaaaggactgaagtttggatccaaaccttgcatctaaacagtaaacacagcccaaattcgtaaaccgtcgggttcattcacttcaccccgcgtcaaacacgcaacggaccggagcgcgccgcgaagccagctcactcggtcagtcgcgcacgtggccccactccaccggccacgtcaccctccacgtcatcaaaagcatcctctccctcctactctcccctcgtctactactacttcacctcgcaatctccgcccaaatccaacgcctcgtctgaacacaaaaccccgtaaaaatctccgcctccgccaccgccaccgccgccgacgccgccatggccgccaccgccgccgcggcccacaccctcctccacctcgcggccccgaggaagccctccgcggggcccccactcccgcccgccaccctccgcctccccagccgccgcctcgcccgtctcacggccagctgcagcagcggctccgggaacaacagcgccgccgacttccccaaccccaacgggatcctcgtcgcgcccccgtccgccgcggcggtggcggcggcgtcgtcgcatatcgatgttgacgtggcgacggaggccgacctgagggagaacgggttccggagcacgcggcgcaccaagctcgtctgcaccgtggggcccgccacctgcggcgccgacgagctggaggcgctcgccgtcggcgggatgaacgtcgcgcgcgtcaacatgtgccacggggaccgggagtggcaccggggcgtcatccgcgcggtgcggaggctcaacgaggagaaggggttcgccgtcgccgtcatgatggacaccgaggggagcgagatccacatgggggacctcggcggcgccgccgccgccaaggcggaggtgagcttagctgccgctggattctgcctttggcattgccgccttgctaatttgctttcatgcgttcgatggaattcggcgagtaccgcgtgcgtggtgctagcaagtacgtgaattcatactactagtgagtaggaatgcgtgctttattcgacttggaattcggataaagaagatgtcctgacaccgtgactcggtagatctagatttgagctcaggttcatgtttgcacagtgaaggggaacactagtattgttatggaatattcttccatgaaatgctactagcacccaacattccctggagtggggataccagtttggattttgcgcaactttatcgcaagttgggtgataacatgaatccagattctactgcagagaatataagagatgctcaggtagatgcaaaagagagagccacatcataatctcacttgagcaagtgctccagccccttctgggactaccatgttatagacctgtcaacaagctaaattaaccacctatttaagcgtgtaaccattccaagtgctggcctccttgttaactattgaatactctgcaacttttcatgctattgtccacgctggtagagaaacacagttagtttggcctaattgtcagctatgtatgtgttttgtacatggcccaacaggctcttgttcctgtaatgtcagcctatagtgtaaatcttgctttccagctgaaaaaggaacaccgcatctgaattttgtttattagattcagcagaagcatgcaggcatctgtagtttgagttttattgacttggtttggcagtcataagctctgttcttgctctagtaaagaattgaagtttcacattaaaaaaagggtaaagaaattgaagttaacaatatctgatgctccaaagtttctgtatcacctatgtcaatgaaccatgacataatcttagagattaatgaattctctcatatgactggctcaccactctcaaaaataagattcttgcataatttttttcatttgaaacatattacaagtggcttgaccgctatctagcactccctcctagtcatatccaatgataactactttactttttctagccatgccttttattggttctttttgggttttcctagtggcaatatgcccctctaatagttatttattttaatcctttttttttcttttgttggatttcacaggatggagaaatatggacatttagcgtaagatcctttgaggcacctcccccagaacgaactattcatgtgaactacgaaggcttcgctgaaggttattttcaagcagatctcttctgttggtcttatttatatttctattcccctctgtaatgtgttttttgaacactacacagatgtgagagttggtgatgagcttcttgttgatggtggcatggctcggtttgaggtggttgagaaattaggaccagatgtcaagtgccgttgcacagatcctggtttgttgctgccacgtgccaatcttacattttggcgggatggtagtattgtccgtgagaggaacgctatgctacctaccatttcatcaaaggtaaattcactagcatggcaaatttgttgctgcaagcctgtaatcaaaaagtaggctgaatggttatgtcattttgttgcacaaacagttcatgttttacatgttactactgaggtcagcccaaatgaattacctggtttactcaaaccattgtgttgtaatagtgaataatatctgcatatattcgaaaaagtccaccatccatttcttagaaagctttatgtggactgttaccaagagttattgttgttgagaaatgatgattcttatttctgtgcaacttctgcaggattggcttgacatagactttggaatttctgaaggcgtagattttatgcagtttcgtttgtcaaatctgcagaagtaattaaccatctgaaagctatatagctgcaaggagccgtggcaggtaagatgagtataaatactctcttcttgattgagctcatacctccatgaagctaagtacatggtttgatggttgaactgatggccccatatgtatgactaatactgtaactatccaactcttgtgcatttgctgcttttggttcttgtccaattctgtggtaccagttgggtaagcttttcagtcagctacccctcagatgatcagcttagtatgaacgcactgtttttaactagttattacttaaatgttgagttagccataacttgctatagtgtcaactcttttgcaccaacaatcttggtttttattaggacatggtctctttgttgttagtttctccaatcaattttttcgatttgtagtagagccaagtggactatggcagtaagttctgatgtgttgaagattgtcttggttgctccatacctgttcaaacaaaaaaactgatcaatatattattttgtactgtttctagtttagatttgcagtagtgtagtaattcacttttaggttgctttacgtgtattcttttatttctagaagagtgaacatgattaataaaatgcatgaatttagatggcttaagaaaatggaccatacaaatatatcggtatagtgtatagtgtttatatgtcccaaagaaccaagaaatattacatatatttctattaaaaaagctaggcattgcattcccgaaatattagttt

SEQ ID NO: 54279 - DNA, 1594 bp, Oryza sativa
ccatgaggaactggaacttaaagatgtttcatcttccttctctgacaaaatatcagaagaaatctgcatttcggccgctaaatgggtaaccactgccaactctacttctattgttggactgctgctgtatatatgaatcgttttttcgctgttacttctttttgttattgtgcattgccatggttattatcaactcagactactgaattttgccatttgcatatctgggcaaggcctaaccacagctaatttgagttgcagccaacaaattggaggtagatgccgttttcgtctacacaaacactggccacatggcctcactgctctcgcggtgccgtcctgactgcccgatcttcgccttcacgacctcgacatctgtgaggagacgattgaacctccaatggggcctcatccccttccgcctcagcttctcggacgacatggagagcaacctgaaccgtaccttctcgctgctcaaggccaggggcatgatccagtccggcgaccttgtcatcgcgctctccgacatgctgcagtccatccaggtcatgaacgtaccttgagaatcatcatgctcccctctcgtgtttgtttgttctgcccaaaacggaacacggctttagttgacatcatcttaagggcggttttctggtttgaaatttattcgtttgttctccattgtgttagacgacagaaccagagaatgttacaacaataatgctgcaacttccagcgcgttgtaaactctatgctatttagcctgatgtataaggccatgaactgttttgtcgcttactatgataggctatgtatttaccaataaacccttctatttaagctatgtaagaattttcctcatcagaaattactccttgctagagccagtaaagattctttaaaaactccttgcacatcaaattagaactgagtagttttactttcatatggactttggccaaactagtcactaaccttttgagtgaaatttttaccttttttttttggacatgtatgtatgcagggtattagttgacctgatgtagccatgaatagtttttgcattggtacgtttgtttgaatagtttttgcattggtacgtttgtttggcatctgtcacaacccacaagtaggacgctagcaacgacataaaaatattttattggggcgtgaaaaatgggagaattatgttcgcaagagggtttgaccaggtagtcatgacattcttatgctaatctcaagtctcagccatatatcaaacatcttaatgcacactgcaacgtgttacgtgagtctcctgctaccgctagtctcccaagtctaccaaatacttgacccgtttttaaatacactcagtttgaaaccctccgttctaaattaagatgtttttgtttttttccaagtcaagctttttttagtttgaccatatttatagaaaacataactgcgtttttagcacaaaaacaagtgtactataaatatagccagtaatggatttaatgaatttggtgtgttactacgtatttctatgagcttgctgaagaaatctgacttagaacaaaagactaaaacatcttacaacctagaaagtagaaaa

SEQ ID NO: 54280 - DNA, 2056 bp, Oryza sativa
atcggttgttttggcacagttactgcatggtttctagcgataaccacaatattcacatggttattgccggttgtatagcagaacacatcttaactagtgaaaactaaatcacacgatgcatcaaggaatgtgccacgccttcaaaatagtggctctgttcggttgcaatttttattactatactgcagtcaataggaacagtgtttgtactgcagtcaataggaacaatgttttgtattggcagctgcagcagtgcagccgctgcatataacagccgaacagactcaatattaattgtcagatatgctaatagtgaaacgacatatgtcgttggataaacatagattacaaaactacaggtgctggtaaatcttcatgaggcttccagagtctccaaatccaaactgagataaatcggtgaggagagagatgtgcaatactgtaagctgaggacatatgtcaatgcaattttgtaatttgatccttccataaaattcattatatatataagctcttaatttaatatatctttgatttcttgaaatggtcgcattgtactaccttctcaacatataagaagtttaggattcaatacggatatttaaaaaataggtaaaattcaatgatagtagattacgattgattgaaatgaggaaaactggtggaatgttgtaattggttatttactcaattttttatggattttttttacaatttttgaccatgtataataggcgggtttgagtcacgcgaatgcgtgacttcgtagcctagtgaaattgaaatttcactagaaaaaattcgaaaaaaacacttaaatgtgtgcataaattggggataattggaataatatatctacttttggggtgtaaaatacaaaaattcggcattaatttttctatatatggacttcaaagcaattcaacattttatagcataatagcattacttgcatattgctaccatatttcacacgagcaacaaatgacccattattattacaataaatatccatccctaaacatgagcatatctactcacccaacaaataacatatcacctctacaaaaccattttccgcatcactagcaaaccatttttcacctattcacaaaatttcaaatctcaacaaacatcaatctttcacaatgtatttgacctaaacccaatacatttttctttttctaatttctaaactatttttgattttgccctcaaatttcaatttatattactctatttccaaaaacttcttcaccatctgccactaaaaatcaagaactacatccatgaattcttttgattttttttggaattttcaatttgctcgaatttcattcaaaccatatcgcggaaaaccgttactgtgccccgacggtaaccgcaattattgcgcgataaggtaaactctgattgaacgatgtagtatgaaatctgatactccatccatcataaaaatataacacatatataaggtagagtctctctacctttttgcttaaaaaatataacacatatatctctataagtgaatggtgaatcccaagaattaactaggatgagccacataatcaacaaaataatagccactggatccacatgaagacaaaatagaaagaagaaatctgagccattggattcactttatctagaaacttccttaacctactaaaaaactagtaaggttatggatatgattttacaatgtacacttttatttaaaaaactattttgcaaatataccctattactctatctatgcaactttcctttgaggaaaaaaatacaaatagatcattgacctatatttagaaatattcaacaaatgttgtgcatataattttacaactctcacggtttacaaataaacctcattttttaataaagattaatatgatccaactaagctttatatcattcaaagttatatatattagtgatgagcatatatatgtgtgtgtgatatgctgatgtaactattagttatgcacccattaaagatgttatgattaatcatcattacaaatttaagcttattattgctaccacaatctat

SEQ ID NO: 54281 - DNA, 3869 bp, Oryza sativa
ttattctatctatgcaactttcctttgaggaaaaaaaatttaaaatagatcattgacctatatttagaaagatccaacaaatgctgtgtatataattttacaactcacacggtttacaaataaacctcatcttttaataaagattaatatgatccgactaagctttatatcattcaaagttatatatattagtgatgagcatatatatatgtgtgtgtgtgtgtgtgtgtgtgtgtgttgtgtgtgtgtgtgttgtgtgtgtgtgtgatatgctgatgtaactatcagctatgcacctattaaaaatgttatgattaatcatcattacaaatttaagcttattattgctaccacaatatatagacagtatttaaaagagaggtagcttatagttacgtgatgcacaacttaatatactagtatacttgagtagatacaacctaataaaagatttggtactatatttttttatagtactatatggtatatatcactatattttattttatgttggaggaagtattcataggaggatatttcatctcgaacctatattaatgaattgacctgcagccggtctgagtcgaaggaggtattcgtcatggactatgactccttctacgagtctcctgcaaatctcgagtctcagccgtctaaccaaacatattaatgcacactgcaattgacttctgttgctagtcccctctagtcgtctcgcccgtccaccatattagtgcacacgctcatcatgagtaatgacaattgatccattgaaccaggggttagctagacgtgtttttttttctcaaaacggattaggaatcatgcttctcatcttaatttgttcatcggcatttcttaaaaaaatattttctaaatcgacttttcaaaatttaaaatatatttcttttgtttgttccttcaaattaatttctacaacagaaaattataaaactttatagttattttgggttggtaatcatcctatataataaagaacgatccaacggctatggtattcttgatgatgtgtctacatgtaattgcagataaatgaggctaacttgtataggaatagtatatttggtcaagctaaaagaagtgacacgtgaaaatataaaatttagatatggaacaaaaggattggaagattattcagagctgagaaaaaactacaataacccgatggtgaaatttttaattaatattttaacatcttgaaaagtttgcttatagattcagatggtggtaactcgaagctaataaacacaggagtgagtgcaattcactggtttaacatataaaatgttacatacacgtggtttatttgcctattaaagaaagttgaaaaaatacctaaaagtttcaaagcaatttaaatttacagaagagttgagatttgctaaaaccacatacatgtagaattggaggaactattaactttgcatggaagtgcatgcatgtgggctggggatacattaatgcctacaccctctattttgcaagttataaacattcatggaaattttagcagaaattaagactaaagtgagaaataatgtgattgcttgaaatgagaatgtaaattaattaatttaacaagaaataattataattggatgagacaaacgagtagatggagaaatgtgaaatcctataacacttatatttaaaaatggaggaaataaatttatcaatggtgtacatgtcctttgtacgtggaagccagaacagaagtagagccacaagcagacaagctaacagcaatttgcaccagtccagaactgagaatgcgttgaataagccaagacttgggccgagtttagttccaaactttttcttcaaacttttaactttttcatcacattaaaacttttctacacacacaaactttcaactttttcatcacatcatttcaatttcaatcaaacttctaattttaacgtgaaataaacacacccttctcgagcgggttctaggtctttgggtcatagattaatttgagaatgtgtcggcttctaatttcgtccaaggcatgagtcaagtcgtctcctatcataatccatgaaaaatcagtatataattaagtgtcagtgtcaaacactggactaaatttaatttcaataggtgtcaatgtaatgagttgactaaatacgagataaatccaataacacataagtatatactaagtatatatgaaagatcaggaaaaaaaactaattatattgtaatcatttagctcttttctatatagcagacatgaacatatgtcgaactgaaacatgcatgtgccctaactgttgggtgtgtgtgtgtgctgctgggatcgccactgatcggtgttcaatgtttcttaattatgctttccattaatacattatgacaatataatgatcagaactccagaagagtacttggctagcttgccacttgaattgttgtaatgtgaaagatcatctgtgctatatttatcatcaccaggattcaaaatgttggcctgtaactatatagaaccagagacccattacgtaaatttaaattaattgttcaaattttgaatttatatttaaagcttatttttccacacccggttataggttggtaattaacctcctagttgctgataattttctttttcaaaatttcagtttgcaatttcgtcctgtaaatttccggtaaccagcactccagcagtaattaattagccagttaccggtctgtgttttcttttttgttaattaaagactgtcatggtcgggattacgtacaagcgatgaagccagagaatagtgacaatgatcgattccatttgttttgattcagtttgtcacttgtcagcttgttatccttgagaagaccagtagcagggccgtcccgtcaaattcggaggtcctgtgcaaagttgaaggataacaacttaattgatgatataatatgaaaataatttatactctgtaatatatttcatagcaatctagaatgacctaaaatgataatccaaaattagggattaccggattagaaattatcagaaagaattagataggggcgcggcaggcgtcaggtggcacgaccgcacgagagaaagaggtgaggcgtcgtttactcctctcgttcgttgtgattggcaattggcgaggttcacagtgggaggcgattcaagattgtgaaccggtgcaactgtgcgaaccggcaaaggcgtaatcgaagccgaaacgacgagaaaaataacagattttcggaactagctgggctaccaatttacttattgagttgtatatctagtgttgaagttttgggcctaggggccttaaaaattgggggccctctgcgggcgagctggccgcacacccctacggcttgtttggcaacttgaaggaaggggattgtgagtttacacgagggaattgatggttagattaagatgggaatttgatttttaatcccagtatcttatttggtagatgttgtggaaattgatagggagtttagttggagattaggtcattaatgaaaacggatggctgagatttgtttagacaaaataaatgaggaattccctcctaattaccatcccctacccaggtattgaaaaggagggagttcctccctcaattccccatctccatcccaccaaaaatcctatgtatcccattcaaacaaagcagttaatagcctaatccctctaaactcccaattccttctaaaaactccctccaaccaaacggacggggacggccctgaccagtagcaaaacaaatggaattggttgttgctaacaaatcctgtaattgaagtacaaatgcgaatacacctagatgtacccaccttttatatgaacacatacatatacattaccaatgaataca

SEQ ID NO: 54282 - DNA, 1732 bp, Oryza sativa
ccttgcgtttttgtcatgggaattattgtttttttctttttaaacatttccgatgtgtttgtaaagtatataaaaaattttatcactggtaattgtaatttctgaaaaagattgatctgatggtaccatggtaatgttcacgcttctgctaaattgattatatatattttttattttttttgtcttttgtttgggagacgagagcaagtgaatatagttttgtgtcactccttggtctctccccctgccttatttgattgttcatatctccttatttttattttatttttttgcataaaaaaagagaaaaaagctaagttccatgaagatataattatactttttgggtgaggaaacccgggcaaatatttatggatctattctcaaaagattatgagtaaccatttggctactcttttgtagctataaaaattgatacgaagatttgtggctgacctatcttcttgcaaggctcatatgttcatggaattctatattaagatttataataaaatagataaaaaatacatattgattgtcctaaactgctaatttcttatttgttctgtcataaaatatagcaacgtagaactggatgaaacacattctagtacagcgaatctggatatatactagtcactaatatcattattattatatatgtgtgcttagcagttatattaagaattagattaggattaggattgtgtcaatgttccataagagacttcgaatcctatacgaatctcaattttgcagttataccaatttataccctcccctccgtgggagaatgttcctctatagcaacctgtacacctgtgggtagacgtacgtttcttggcgaaagtagcgccgccgtcgttgcagccgccatcgccgcggagcagatcgatctactggcagcgttcggactgatggttgcagactcatttccattgacatcgtcgactaatgctgctgatccgtcgcatgtcacgccgccaccaagacccccgctgctactgagcagattgatttgtttctgaatctaggaaagatggctcctactacgctgccgcacctctatccacgatgaagttcatcgcctctccgacgtataccacgtcgccgccaccgcctccgtagtcggatagacccacgatttcctagtcatcggatatcaaccatcatcagggccaagagaaccgaggtgactccagcgagcaccttcgtctcggcgagggaggcaccatggtggccgccctgggccgggacacggctatatatggaagtggacaccgtggtgtctatggcttccataggcattatcgtgacggttggagaggtgatcaccatggtgggcatggacaggaacacatcatctctcacattggtttcctcccgccgctgccggcaccacattatcctttgtcggaatttctgccgccgccgtacttcggcgcataccatgaaccaactatcggatacgcaccccacagcgaatactatggatcaatggtcagccatgcacacccaggtatgtgagataacgaacacatcctctaccttaaaagataggtgactgagtcgcttacatgtgagaccactctactataggatcacatgtcagtgactcaaagtcatgtgacctaatagcagaggatccaatttggttagatatactaaaagttaagtttggtgaattgttatttaaaaaatatatattgatattcagttatacataccctat

SEQ ID NO: 54283 - DNA, 1076 bp, Oryza sativa
tatagttatgacaattgatatgaagacttgtggttgacctatcttagttcttgcgaggctcatatgttcaaggtattctatattaagatttgtaataaaatacataaaaaaatacacattacttgtgctagtctgctaatttcttacttcctccatcccaaatatagcaacgaaggactagatgtgatatattatagtacaacgaatctggatatatctgtccaaattcgaatatggatatatatatatatatatatatatatatatatatatatgtatgtatgtccaaattcattgtattaggatgagtcacacccagtcataggttgctatattttgaaccgagagtacaaattagtactttctccatcctaaaaattttagtactaattagtactaaatatatcctaattactacttccttcatattcttataagttatatcaaatatgatattatttgatactatgttgctatatttcaggacggatagagtatttgatttattggaaaagccaaaaacaaaattataccaaatggccatagattttatccctttgcaagccaaagcgagctgagtttatccatgtcatgataactttgctgagttggagatgatgtgttctatacggtcttctacggttgcacgtgcatacacacttatttgtcgtattttaggacatacactagagcaaagcatatctttcgaatgttcgtgtgttttatcagatttagcatcaacagttatctacaagattttttttatataaaattacgtcttttacaatattaatttaaagaaaaatacttacagtgcatgcgtaagactaatcgatccaatggggtcatgcgctcatttatattgatattattttattgtacctgttttggtattagagtttacttattccaaatctagccaaatgtggggcctccgttctgataaagtaaatgtaatgcacctgggtgtttcctaacatcctgatcattggtagtataaattttacaatattattttttttttcaaaagaagattcaactccaataataaaattttagggttaatatgttagtat

SEQ ID NO: 54284 - DNA, 2655 bp, Oryza sativa
gttatcaagtcgctagcagtcggattcttggaggattcggttaaggaaattaatatattaagggaagcttatccagaagtgactgaattcaaagaggatgcggcatgtcaaattatctattaattaggaagagtttgttagttctcttttatctttaggaaagtgtgtttagtgtcccataaagactttatgtcttccttctatctttagaaaatttctttcttatccaacaacgactagtatctacccatgggtataaatatgtacacccgaggtttttttttgtaaactatctccacgatcaatacaacttcggcgcatcgccacctttttacttttctaatttttcgacgagtttatacttgtcatggctatttgcatcggcggggctagggttcgacactctgatattgtcaatctaagcacctatctatcatacatcttagataatctagtttggtagctcgatttacttgtatcggctgacattcgctttagggtttatattggtatcggctaaatcgcttaccatattagattagctaaggtatctaccaccctgaaaatcagtcaaaggcttgattgtctaaatattatgcttcctttcatacttagtgcagcatcagttaagtttgatctactaagtcgtgcttagaatcataatctctagcccgcttcttgattgccaataagggtttcatcagagtttcagccaatgaggttatctgaacgttgcatcggcttacaaggattgcatacatgttggatttagccgatcacaacaaatgtttcattgtctaatcttgtggatttgatgacatcggatattcagccgatgtatgttttaaccttcggatcggtgattattctatcatatcattgttagccgattgatttctactggatattattatggtttaattacattaccattagtcgattgttcaaaccctatcgacatcggctggaattattccatcggcttgtcagccgatcggctcattgatatgctatttgtatatcttgtcagttgcaggatcaaactgattgacacgcccacatctcatcaacctttggaccttcactggagctaagctaatctcccagtctgttgtgttcgttgacttagttcgcgccaacacagttctggcaccatcgactgagcgcagatttttcgtcaataggtggtcgaggcccgcctcgccggattccttattgcctccttaggtcgatacccggagtccgcatcacctcccgaggtcgatctggggaaagagaggaagaggggtggcagtggatgccgcttgcctcgctggagccagcctcgcctgctgagatactggtaagagagggaagagaggaataggggcagcaacggtagcgccctcctcaccatgtctgcctgctagagttgagctggagaagagagaaatattggacagttgggaccacacaattttttaattattgttttgctgattggactgccatgtgtacgccatgttgtaaaaaaccgcttcagattgaatgagagggtaattcatccggttcaaagaatttggggtgttaaatatctagtattgagtttaaggaggtaattcgagcaactgtaatagtttggggtaattcaaacttcttttttcccttaagaaaagaaaaaaaaaccctcatctttgtaattttttaacacctataatgcttttacaatgatcctctccttccttatcctccaagagccatccctcatactgtgcgccaccgccatgctcctgctctcagccttgagccaacaactaactctattgtacgttaacaaaataaagttgttgaatggtctcaaataacataaaattaagaggatagctagaccgtaggatcccgtgggaacgggatacccttccgttccgcgtcgctagcccccccccccacctgcttcctctcacgtagcattctactgattactcatggctgtgtttctagctacatgcatacatgtgacgtggctgtgttgctagctgcatgcatgcatgtgacgtggcatgtgagttgatacctgatactaaaactagtatctgataccaggcccaataccaacaggtatcgttcaacatcaattcaggtacacctagtacccgatactcaggtggtatcaggtatatgatacctcatgtaccttgataccagcactaggtatggtacctataggtatcagaccgatctaggtaccaggtacttgatacccaaatacccgatacccagtactagatctggtacatatgggaatcatgttgatctaggtaccaagtatctcgatgtacctatgatatcagttggaacaatctgggttggtcgatacccagtatcgaagataatacatgtaggtaccggtgatgatacatgtaggtactggtgatgatacttgtgaggtatcggtgaagatacatataggtgccaattgatgatacatgttaggtatcggtgatgatacatgggtaccaatgacgatacctgtctggtactagtgataatacctatgaggtatcagtgatgatacgtaggtactagtgatgatacctatcaggtattggtgatgatacatgggtactagtgattatacttgtgagatatcagttacgatatatgtaggtattggat

SEQ ID NO: 54285 - DNA, 2609 bp, Oryza sativa
gtacttacgaaaccagtcccttcaattaatatcaggatcaatgggctaattatataggtaggttatgctaacactcagagtcgcgcaaaacgcgactaagtagctagtctataattgaaaactaaatctagaactcaaactttcaaacttaattagataaaattatttcaccattaaaaaaaaatctaaccttcgatttgtactacgtacgtacataatccggatcatgagacaaaggtggtgttcttttcttctaaagatgaagatgaagattaagttttttatgcaaaacgatttggtattaacgtatgattaattgagttttaattattacaaacttgaaaaatagattaatatgatattttagagcaactttcatatataaagttttcgcacgaaacacaccgtttagcagtttgaaaagcgtaccacagaaattttaatcttcatccaagtcttgttggagaaaagaacgaggccaaagcctgttttctaaacattaatcatcaaaccatgtttttttttttgctaaaaccagtttcaaaaaccttgatcatcacaccgtccaacatgcttttccaagtttccagcgtctagtcaactttccgggttacacaaatcaaacaagcttttattattattttttgtcaccagtttatacagctcagtaatttacacaaatcaaacaagctttgaaaggatcaaagctcacagttaagcatttacactcgtctaatttggtccatttcttcaatccccgccattaatacctttgacttttttttaaaaaaaaatagacttcatccttgatagtactttttaataaatcactggagggatgagattcctcacaataattttccattacaaaggattgaagagaaacaggattctttgaaacaatataatttttttaaacaccaccataattgattggccgcgttataataagaagagtgcttcattttagagaaaaaacaataccaaaccttacaataaatagttgataacaggaaaactgtgctaaaaccccagacacgacctagctttcctaaccaccaagaaggactagcaccatccaattggacgactccgacttccccagaaaaatcaagggaacaagatgtcaatagcccgaccgataccaacttctaactccctggacttaggaactgctccctccatccataaatatttgacgccgttgactttcttaaacatgtttaactgttcgtcttattcaaaaacttttgcgaaatatgcaaaactatgtgtatacatataagtatatttaaccataaattaaatgataggaaaataattaataattacttaaatttttttaaataagacgaccggtcaaacatattttaaaaagccaacagcgttaaatatttagaaatggagggagtagaaaatttcgcgcgcgagtatttaaccctgaacgtctggcgccgcgccgccagccaccgttgacgacacaccgacgccggcctttgctctgcagccaatcttcgcaccttcttggtctcttcgtcgtcatcgccgccggaggaaggcgagcagcagcgtcgtcgccccgacgaggccaacgtacagggtcgcggtttcttggcttttcttttttaaaacttacttttgaataacggggtttcgatcttggtttgattttgagcgctgatttggggctctacaactagacccatagatcttcacaggccacccaatttttggctgtgattacctgtctgcatagttgtgtgaggaggggtccggtttccgaccacatgcgagactgcaaagatccattttcgcggacgaacaacttaaaagggtcgtctgcgataatgtttttaattttgtaggcgaaccttaagccgtccacttgtaaaaaaactaatttttataggtgaaccgctaggagtgccacctgccaaaatcgccgatggaacaactccctaaaaaaatctatgtcgtccccgtgtaattcttatcccaatataataactctatcgactaccccaaccttagatatcctctccctctcaaagtgcgcagcggcggctcagtgctgagaggaggagcagcggcagtgaggtaggggtgccagcggcaggagctcggctcctccctcccctcttcttctcctccccgcttctcccctccaatcctggcaacagcggtggctcggtgatgagaggaggagcggcggcagcgatgacgatggcgaacgccactcttcccccactcccagcaacggtggccggtgggtgctactttcttggcctctctcctgtctctacctctccctttctctctcgatctctccagtctctactctgccactgaagcgcagcagccagcggggcgtgggagtagagcagctggctgggcacgggatccgccgtcgccgcgaaggagttgggggtggcgcggtggagggcaaccacgatgacggacgaccaaatccagcaaagacaggaggtggtggatccggccgtggcggatccagtggtggctgtggcatccgtgatgacgatgatgaccttgacggcgatggcatccatgaccacaacctgcttgctgcgacgatggctggcggcggtggg

SEQ ID NO: 54286 - DNA, 1661 bp, Oryza sativa
cacgatagcggcattagtagacggcataacgctattgaagattcaaacttgacaatactgagacaatttgttaacaagatttagccaaaatctacaacccgaactgataattataatatataaggaatcaacgagccttaggcctcccagtcgttctcttgtctagccatgcaatcatctcagatggtgcatctcttgtttaaaatagtctaaaataagagtttagctacaaatccaatcactaactgacaatgtaaacatatttaatacaaactctaccttggcgagtatgctacaccaatttgaattagttccgtgtacatttgaatctccgtgcacctgggcttaagctcattcattgctcatgcggagctatctgataagccttcaccaggtcgttcataattagacaaattattttgtggatttgctctaaattggttttttccaattttcctagcaaaactatagttaaaatttgtttgtgttcgtatattgtgaattgtccattttttctcatgtaattcaataaggtatgagagttagatgttttaagttcaagtcctaggtagcacaattaaataaaatcgtataactcatgtatattatattcgacgtttgagatataagggaccattgactaaggaagccttgagcgaggggaagttttccaatatagtgtggggggagtgttggaatataagtattcgctcgtcaatttaattaagcttttagattgaattgattggtgtccgcaactcaatattctcaatatatgccgcagatcacacctagacaatggaggttagcatcggcaagccagatgacgggcaatcgcttcttgctaatgttgaggcctccgatgaccatgccgcctttgatgccatggccacaagctcgcgccgtccacctagcttgcgccctctgcggcaccccaatgtgacatcccttgcaccagtaagtcacctcatactcaaacttattgatccattaattctgccatagcagacatgaacatgaaagggtgggtgagaccgtgtttagatgggactaatcttttaagtccctatcacatcggatgtttgacactaattataaatattaaacgtagactattaataaaacccatccataatcttggactaatttgcgagacgaatctattgagcctaattaatccatgattagcctatgtgatgttacagtaaacattctctaattatggattacttaggcttaaaaaatttgtctcgcgaatcagctttcatttatgtaattagttttgtaactagtctatatttaatactctaaattagtatctaaatacagaaactaaagttaaagtccctggatgcaaacaccacccgagtcattgtcgtttgtcttctttacagttgccaccactccatcgctgtgtaccacgacaaaccgaggtgatattcccgccacttgactcaccggactcctccgagctgaagaaggttatgtccatcagcctgccagcaacaccaaccggctttgccgcacctgttgccggtgccagcgactcgtcgggcatagatctccggaggcaagccatggcgtcgaacatgacacaaaggctacagcagcgcttgccaacgtcgcagagcaacaacggccggcggctcacagacgagaca

SEQ ID NO: 54287 - DNA, 2010 bp, Oryza sativa
acgcgctcatggcgccgatgctgtgcctggagctcaagatctatgggcagtggatgtcgagcgggcagaggcggctgtccatggtggcgaacccgtcgaaccacctgtccgtcgtgggcaacttcgtcggcgcgctgctgggcgcgtccatggggatcagggagggcgccgtgttcttcttcgccgtcggcgtggcgcactacgtcgtgctgttcgtgacgctgtaccagcggctgccgacgaacgaggcgctgccgcgggagctgcacccggtgttcttcctcttcgtggcgacgccgagcgtggcgtccgtggcgtgggcggccatcgccggcgagttcgcgctcggcgcgaggctcgcctacttcgtcgccatgttcctgtacgcgtcgctcgccgcgcgcgccgtcagcctcttcggcggggtcaggttctcgctggcgtggtgggcgtacacgttcccgatgaccagcgccgccgccgccaccatccgctacgcggcggaggtggaggacacccgcctcgccagggcgctctgcgtcgcgctcgccgccgccgccacgctcaccgtcggctgcctcttcgccaccaccgtcgtgcacgccgtcgtgctccgcagcctcttccccaacgacgtcgccattgccatcaccgaccaccgcaaggtgaagcccaagcccaagcccaagaccaccatggaggtgcactacaagatggatggcaatggcgacatcgagggcggtgctcctgccatgacgccatcgccatgcatgccgatggcgacggcagcttagaggatttcttttcttttctttttgacctgccaagccaacgcgtccacatgcacatgcatggttttagcggtttgaatttgataagatgaatatttgaaatacaaagtgcctatgaaaatttatattgttaatattttttgagtaagttgaactttatgtatctactagaagatggtatgtgctttactgttaaatactccatccgtttcaaaatatttgacgccgttaactttttctcacatgtttgaccgttcgtcttattcagaaaaaattatgaaatatgtaaaactatatgtgtacatgaaagtatatttaacaataaatcaaatgatatgaaaataataaataattacttaatttttttaataagacgaatggtcaaacatatactaaaaagttaacggtgtcaaacattttaaaacggagggagtatatggattagatgactatatattaaatgttatagaaatgataggtaaaatttagtttaatatatcgtgaaaataatgtaagtaatgatgatttagcatgtttttatgttgaactttaaaagataataaatcataaatataatattatagttttaggtgtttaatgggtaggaactttagagtaggtataagtttggttacatactttgagcctgtgacgccctagaataatcggggaaaaaaaaagatggagcaggcagcagcagctagctagctgtagctggcggcccattttgctggtggccttgggcccatttgcaataagcataaataaagcggaaaaagttcacttcagttccttcatctgtcatcaagcttcaaaccgttcctaaaccggaatactaaatataatacatccattatctttcaaaaccgagtcacactaaaggtgtgtttagttctaaagttttttttttccaaactttcaacttttcatcacatcaaaccttacttttcagtcacatcgtctccaacttcaaccaaattccaatctaaacacagcctaggtagtaaggcaatgttgcttccggttttaacagacgtagcactcttaaagcaaaaattaaaaaaaacataaaaaaccacgtgggatccgcatgtcagtgaagctttagacggttgacttaagtgaacgagctcctgctcgcgcatcggcctggcgcgcctctcctgctctgttggaccgccgcgcccagagcgctcgaccagtcggcgggcgatggtcg

SEQ ID NO: 54288 - DNA, 1541 bp, Oryza sativa
atagttggaaagcctatggggattcttggtgaaaatctatgcaagcttgtgtggtacgtcgcaggtggctcaacgtcgcctgagggggccacccggggcgcgtcctaccgagcacaccggtgcacgagtggttctcgcggagtcgctcgacggcgaggataaccagctgatggtgaacagctaccactgcaccaccagggagggcgtgcaggcggcggctggcggagcggttcgtgccgatggcgttcgatctgcgctccggatgcgattctgccgccgcggcgccggcctcccgccacctccgcgcccatcgccgcggcggtcgagcggctgctgccgtagtcctcagcggtgcgctaggccgatgcgtggccaggagtgagttcgttgaagccaaccggctaaagctccactggcatgtgggttctatgtagttttaattttttttaatttttgtttttagtgccacatcagttaaaaccaggagcttaaccacttaaccactcggatgctatactaagatgaaataattggcctcactctcctttttttttttactatggtttagctaaagggccatgcattgcaatggatactataagagataaaagaaagtaaaattacaagtttatagtattggtatatttttagagggttgtataggtagttaattagtcatataatgtcatatccaaaataaaattattcacgtgtgagaattttatgctgttagcttataatgtcagagacagatccgaacatcatcactaacattatttaagatagtatagctaccgagagtctgtgagtcttgactagcttgtgagtaatttttagagaaagtaaatcaatttactaggctgtgaaaaaaaaacgagcaagttaacagaaagtacacgcacgaggcgtcgacatacacggacgtatatacgtagacgtcgcggtcgtatggccgtacgtctctctgtattgcttctagaagcatcctcaagattggtcagctgctcgtctcaaccgctgctaaacgccgccaagctcttgactttcgaatagccgtactccctccgtccttaaaaaaagcaaaccctggttttcgtgtccaactttgactgtccgtcttatatgaaatttttttataattcgtattttcattgttgttagatgataaaacatgattaatattttatgcatgacttgtctttttaatttttttcataattttttcaaataagacggacggtcaaacgttggatacgaaaaccagggtttgtcttttttttgggacggaaggagtatagtatatgatcattggtcttttctatcaatcgattcagattttttttattgtacttaattattgtttttgtgattgtacgacgtcgtcctagccattattttaaacagttttttaatcctactgcctttacttaaaacaaactttcattcgtggctataaatctaaataagcacttgtccaaattctctatccatattcacgtaagtacaagaatcgatctaagtattgaagagaagagcggaaa

SEQ ID NO: 54289 - DNA, 3252 bp, Oryza sativa
ttggctactttctatattaaggatagactctgcaataaataggggcaaacaaggaaaaccatatataaattggtatgcatgctttatatttgaaacaagatgagaaaaactatatgccttatagaaagaaacagatggggtacatacatttgataatgttttttttatgacttggacgagtagtggctaagctattttgttatttagttgctaacctttcaataaagcatgcaaaaagggtagttgcttgagatagcgtaccatgattaatttatgtatatgttttttagcatatttaaaggcaaaaaattttcatgcatttgtgtacgtaaaaatcgcaatgttatccatgtcatttcacaatgtttatccctaggcaatgtcggaagtatagcaatattactaatactccctccgtttcatattataagactttctagcattgcccacatttatatagatgtcaatgaatctaaacacatatatatagctagattcattaacatctatatgaatataggtaatgctagaaagtcttataatatgaaacggatgaagtagttgtaatatgcatatgctgaggaaaactacaaattgtactgtgagatttatgttccttgatggcatatcaattaattaaacttagctatcctttgtttatttgcatatttgtggagtgattgatggctccatagtatatgttgtcaaattttccatgtttatttagatggcatgcatgcaagaaattaacaataatatatgatcaattttaaggtctaaaaagacttctccatagtgataatagagctgtaatgtgtgtgagtttttgtccaaatgcatatggaggcatgtagacattcatagaaaaagttgatgacacaaccaatttagcattttagccacaaaaccaaaattctcaagtcagaaccaaacagccgacctaggaaactaagcccacatctaatggcgccatgcatgaagataagatcagaaattaagccatatacatcaaacccacacacactgacacagacacatttgcaagaagacatgaattgcaacatacactttaacttgacacaaagctatccataatctctctcccccatctgtaattaatcaaaccaaaaacctctcattatatatccccgataagatatatcatcacctctatccctatcaagggcttagcgtgggagcagatggctttgtggcaatcaaacaaaggctccaaaaaggcattgctttcatgagggagaaggttaaaaaaatgaattttacattttgtggagtgaaagtggtgtgtggacatgtggctggtgaggccactgttctcccattcatctaaatgttgaattcccagcatcctatttatgttgaaaaatagataggtcgcaatcgcttatacgtgtatgcataatattatgtgtttgcaaaacctatgctccatcaagatcaacctcaaaaagaaatggagacattgttatcctctttcttttgtacactctctctggatttattgattatccacttgaaaattttgtaactggtagcatatatccaccattgtaaacatactttctactttgatagatcaaagttgtggcaccatacaagtttgcactccattattgacccactgaaatgtgcaataatgcaaattcatttatgtattcatggatacactactctattattgacttatgtgttcatacctgaggtaattgttatttgtgcaaaattataagacaattaattaaatggaaataaaggacaaaagaaaggtgacaaaggctggaagaaagtagaagcattctttagagctaaggctagcagtatcatctgcctgctggtggagctcacaatctatacatgatgcattcaataagccctttcttgtcctgcatgctacactgcatgtgggcccaggacatgttatggtcatagtgaccccactattaagtgcaaatgaaagtgacctttcatgacttttgtagtactgctatttcatttgagaaaaggctcttggggcaaatcatgcatgcatccttcatgatttccctaccaaatcactacactgcatttatttgagaggaaaatcactctacatgtctagtgttgcctttgtatatgtgtatggttagtgtaataatttatctgccaatcatcacaatgcacttacttgtactgtagttttctagggcttgaccatatgaaaggcattcttcaaccactcaagtattcaatatatacatcctgaataataattacttgggttaccaactggtacatactggattcatattaaccaaagtttaccttaattttctttgtttttttttgaacgaactggtacaaggtggtgcaaatgtaattaatagatatctaggaaaaaaactttctatgcaagtatgaaaaggaaaggtataaaaaggaaaaagttctatacttaatttttattaatgcaacattaccttctgaaactagatcatttatactactcactctgtcccaaaataagcgcaaccagtttatgtgtccaattttgatcatccgtttatttgatttttttataattagtagttttattgttattagattataaaacatgaatagtactttatacgtgacttatgtttttatttaaaaaaacaaataaaacggacgattaaagttggacacggaaacttatggctgcacttattttgggacggagggactatatatcaaattgaacaacaaaaaaaaatgttcattgttgtgatttttcatattaactaaactgatctaaatcttgcaaaatcttaatgagagcaacattgctgctgactgatgagagaggtagcagtatagcatgtcttctttttccttggaagtcagctgtagctgatgtgatcttcccttttcaagctgttcaatttgtagggcctgatcttccctttgattgctatgcacattgcaatgttctgaaaaacaaaattatggtttcagaatgtctatccatagatcctaatactgctaggccttagaacacttgaagaactacactcatgcttataaggctgtgtttagttcagctcaaagtttggattttggttgaaattggagatgatgtgactgaaaagttgtgtgtgtatgacaggttgatgtgatggaaaaggactgaagtcagcctaagttacaatgatctttacagtgatcgatctgcctttcttgctggtgcaacctatgatcctctacctactcactaca

SEQ ID NO: 54290 - DNA, 2007 bp, Oryza sativa
ggagcatcggtgcgtcagccgtggattcgcaggtggtgagcggcgggtgaaaacccagtctggccttggccggaccgacaacgatggttcattccccctcctgagggcgttgtcgtgctgtctcacccctcaagggtgattgccgggtgaaagcccagtcttggctcctttgagtcccgacggacggcggcggtagttttttcgtcgcttctcttcttgaagacgccgttttggcatcccctagggggcgatctcgtctgtgtccctttgttagtctagtggcagtcggtcatgcttagcggcggccggtccggtgttagtcttctcctggacttgtgtgttggcaatgtcggtgtgtgggtggtggcatatttttttcctggttacgaccctccaaggttgtaatcttgtattttttttctgctctatcaatagaactttgcaccatctcgtgcaagtcgttcaaaaaaaagactagtttacagtgatgggggatatatactctctacatgcagacttcctcaaactattttttaagataataaaaatgttttacatctacatctccaacctctgtagttgcgcacacaactgatgagtttgaatacttcaaaaaaaatgaaaaatatataagaaccaaattggtgggacaaacactcaacttcctcaaaactgaatagaatatatagtgaatattttgataggactatagttgggatttagattcaagtaaaaaaatatgtatatttttctagctttttattgttactagagattccctgttttcctctttgttttatgggggcaaacttggacagtgtcaatgacttacagctaaccagcagttgatgggagactacgacatttttttgcagttggtctgtcaaatcattttaggttgtgatcgcctaaccaatgcagcatatacccatcaaacaataattaagcacacatcatcaagggaaaagccagtagttacacaactaaatcattatcccttttgcttatccattaataatgatgagaaaaagaagtgtgagtggggtgttgtctctataatttgtgacttttagtgagtttagaatgcatactagtgtccttgctagtaaaaaagaaaaggacagattagtgtttaacatgtttgattatatatggttcaaattaaatcactcatactactgtggactgtggcgtgtgctttgtacgcttattttaaaaataaagtctatgaatctcaattaaagcaagccattgctgtgcatgttttgtgagtgcaaatctctgctttagctttaaaaataaatcaatatctatatataaccttcaatctaaaattttatcatatgcttcatccagatttgcgctcacctaatattaactaccttgacgcgaaagggcctgtagcctagtggttacaagagtctcagtagcacctgaggtcctgggttcgactccccatgggagcgaatttttcaggatttaacggcgttgtgctttcagtgataggcgacgtacccgtcgacagcgaggcgcctgtggtgacttcgtcaatctctccagaatttgccggccaagtcttcgaagatgctcataggggtaaggtttgcgtgcgtgtgttcataggggtgagtgcgcgtgcgttgtgagtgtctgcgttgtactgtgtaattctcaaaaaaaaaatattaactaccttgacatgaaattagtagacttttgaaaagaggtgtaccgaagcaacgccctacctgcacaaaataagcaatgtagtatatggagagatcatggcaggatgaacctagctaccagtcaagtatctttagggcatcaattaattcttgccttctattatgtactttactctttgagaaaatcataatatagttctgttttgactaaggatttttttaattagtttagttatgcaaaatttaacattgtgccaaaaacatcttctcaaccttataaacacaaaaagtccagatatgaaggccaaatggtgcaaaa

SEQ ID NO: 54291 - DNA, 3372 bp, Oryza sativa
ggtcttagcggtcatggaaacaaataagtcaagtaaaaaaatatcatctaagaaaacaaagactcggatatattcaagtatgtagtaatagtagtagaaaatggatgaaaacaactactacatgcttcaaattttcgtatgttggtaattgtatatgcaaaattaagggtgattgcttgcatatcatgatatcgttatagtaacaatgtagttgctttttagaaaaaaaagggataaaatatacaattgaaaaaaatagaactagaaatgattgtttggtgcaatttagatttaacctatcctttctcgaaagatgtattgtgcatgcaccagcacctacctgaagcagacaccttacagacagaacaatcaagtggaaagggacaaacaatattcacaaggtgaccataatgatgcgatggtttctcttgtagttccattggaaaaaaaaacataaaaatcaaaaccggccatattgtcaaagtatatataagcatccatggttcatgaaaactagcaaggggcattaagaaaatgaatttggacaaataggtttaaaccatactctttgcgatttttttagttaaccaatgattctttaatttagattccatgtgtaatgtataaatcatcaaacaaagttatttacgtcgaacaaaataggaaataactagggtaacaagccattatttacatcgaacaaaatagaaaacaactagggtaacaagccattacttgtatcaagtaatcacgggaacaactgtaattggtattaaaaggttgttgctattgatatttcacaagttctacaaaacactaaaatatatcatgctatccattcactcattcatgtcctgaaaaatcaaaatgtggtgttgtagctgataaatccaagcctagaccaccttgcaaccaatccaaccgctgtccatcccagcaaggaaaatgagatagtgttgctatcaaaagacaaaaaaaaatgtaccaaatgaaatcataaactacacagagaaaaccatacgatgtatctggacatgtacaccacacgcgagagtagaagatcccggaaagcacgtcatcaccgctctttggtgcgcgctgtgcttgtaggacggttcaccaaaatgttcttgatccaaaatgggagataacggttttcctaatgttataaaaaatgtttaaaaacagttgaatcccaacacaatatgatcaaattttaaatattagcttgtattttttttgaaacttaatcagaaaggagccaacgtcaaacttcgaattttaaaacttaattttagagttgatttgatgtttttttcggcgtagtttttttcggctttaacttttaagttgctatggatggatatacaaaaattttactcacaatttttttctcagtaataaactgttactaccttataatcagtcataaactaccgatgagcacggtcattccggggggatttgtttttggccttttggaaaaagaaaaaacgccgatccctactgagcacggaaggcatcatcccgcgcgcgatgcgcttgtggccgtgtctgtggcttcctgaggccgcgccacgtgtacttggtcgaatcggcccggtccaaccgaaagcgaggtgggcagtgtggagcccaccagctgggccgggatgaactgtatctttttgggagggtttgtttgtgtagaactgtagatcaatcagtgggtttggcttgtgtacgtaagcatcaaattatcactgtcaaatatatacgtcattgtccagtatttaattagttagtaaaattttaactagtctctcagtcccaaaatagttgagaccagatgtgacacatcatagtataataaatctagatataagtgtgtctagattcatcataatatgtcaaatccgataggaagttgagtttattttagaacagattgagcagttcttaaaaaaaaagtacactttgacgtgtgacagtcacttatactgccagtttaatagctccaacccacacaatttttttaatatgttgtatagagtttgtaggctaaatcagtggttattttactgattttgctagaaagctgctaatattttttcctctcaaaactaattttcagtttgtggccatccagttgtcgaacccggaatccttggtgggaagccacgttagccaaccaaccatgagtaatttttagctgaatttacactagttacatatcgtatatctacaatataagtacactttaattatattatagtatatttgatttaaaaaaaactgacgaatttgtatagctaattttttaaaagacaaatcagtggcttcgaaccactatttatgttcttccataataatcagatgatggctcaccaataactttgtctaacctaactctatctcaaaaacctagctttatttcaaagaatatttagagctaagataccaataaacccaatgaatactttgaggctggttgtacgatactaccatctccattctaaaataagtttatttttcacttatcccacacataccaatacaaaaccacaaatactataatatccctacttattaaatatctcaatgcaaatatttctcactttatctactcccaacataattattttcttttttataaactctaatgcaatgattattaaaaataaacttattttgggataaataacaggagctaatagtaaacttattatgagatggaggaacaggaagactaaattaaactgaaatgattgtgctttttttcgaggaatgattgtgcgatttttaaccattattctaactgttaatgtgattttcaaaggtacatttgaaatgaagtagttattaacttatttatatatcaaaataggcagcgatagcgttttcagaacacgacagttattacaatatcatagtatcacgtgaacaaccgtatggttgatatgaccactaacttctatatagcatcgatatatacattttttattattttgaataatttcatatggtttgtttttttttttcatgttggatgtttggttcttaccaattaggaactatcatcaaaattgaatatacttattttgattggtacaaaactgtcgatgttttatatataaaagtattgtactgtttttttctctgtgtagctaattttgatattcatattaagttatgctataaatgacataacagaggcttccagtttttatagcaacccctcagtggccacttttttttaccaggcctccaaagccatgattattaaggcgctatgaatctcgaaggaaattcataggaattttagagggtttcattcatatatgattttttactatatagccctttgaatcaaaggaatagatcctatggaat

SEQ ID NO: 54292 - DNA, 1471 bp, Oryza sativa
tttgactttttttaatgaaacacattacaaacgaaaacgctcataatatgtgcacactcacatctataaatgcacacacacatcctactcctatgagcaccttgagaagattgagtccaacatgatgaagtcaccacggatgtctcgctgttgatggatacgtcacttaccactgacagaataattagccgcaaatgtgagcacccatgtcaattttagaacttgaacccgactaggttggtttcagcaaaataaactaaccagttaaattatactcacttcaccttttgggtttgacttttgaccgcatatagcagaaaggcaaaagccttaatttaaaattacaattttcgttattatagaaaaatatattgaaaagtacaaccacagagtttataacttatttctatatatatagagagtaataataacatagttaaaatgtatacttgcatgtttaggcatggcggataataaaaataaaaaataaagcccaaaaccctatcgaaaagatcaaggcaaaatttactacagaatacttaaaaaacgtgtaattagttgtgggacaccgcaaatatgtgaattggctataggacatcccaaaagagtgataattagctactaaacaccggagacattattttatcatttctggtggaaacggagagaggaacaatggaaaaaggaccagatttccctatgtgagccaaggatgtcagcatctccactattttcatgtcctcttactcctgatgaggcacaccacacgcaatacggcgccgctgacaccgtccttctccatcacgccggcaggctcgtacgcaaacgtgggtagggcatcgatggcgtgataattagctactagacaccggagacattattttatcatttccggtggaaacggagagaggaacaatggaaaaaggaccagatttccctatgtgagccaaggatgtcagcatctccactattttcatgtcctcttactcctgatgaggcacaccacacgcaatgcggcgccgctgacaccgtccttctccatcacgctggcaggctcgtacgcaaacgtgggtagggcatcaatggcgtcgcggacactcacatcgtgcccactatgccacgtcacgctctccgcgcgcaccctcgccgccctcgccgccgcctgcgcacagcgatgcagccgcaaccggcgaggacggcgacgccaatgcaaggcggtaggtgctgcatcgacgagaagtggtgctattccatcggctccttgccgtggccgccagagccagtgcccgaggcagcggctgttgctcggcttgctcctctcgccttgcttgcgcctgggctagcatctgatgcacctgcaccgccacagccccagacggcggcttcttgatggcatgcgactctaacacaagcaaacgacacgggggtatgttggtacttccagcgctctttctctctctgtttccactag

SEQ ID NO: 54293 - DNA, 1276 bp, Oryza sativa
gtcgtctcacccaacgaacttttccggcgaactccccgacgagatcgatggccgccggcgaacggcaatcgaacaaggagtactaggacgcccttctttgttgtttcttctcggcaagatcagttggttggcaccacctgccattcttggtttggaagtgtgggagggaggggttcggttggtcgatgccgttgcggttgccgtgcgcgatggagacgaggccaccgcgggcggcggcgccggcgccggcgagggtgtcgaggttccggaggctgcttgtgcgggtgtccgcggagccggagcgggcgggcggcggcggcggcggggaggtgagggagaaggaggagaaggcagcggagatggaagtggggtcggtggggttggaccggatggtgctcagcttcatggaggattccgccgccgccgccgtggagcggcccccgcgtggccgctgcggcagctgttcaacggcggcggggacggcagcgacgacgaggagttcgacttcctcccctccgactcctccgccaccgccgccgcttcggccgccgccgccgccggcgacgccctggacgcgttaaaggtatagggcctttttccccggctcgattgtcgtttccaattgctcgccggagtgatcaacgctttgtgtcgtcgcagggcttggtgcagagcgcgagcatggcgaagaggaacctcctcgccgacgcgtcgaggatcgccgagaggtgccgcaagggcggcaagaagaaggccgacgtccgctgcgccgtcgccgacggcctcgccgccatcggctacgacgccgccgtgtgcaagtcgcgggtgggacaagaccccctcctaccccgcaggtaaactaaacctcgcccccaattcgatgctgctgaatcgccggcgctgaccggcggcgacggtgggcggcgcaaaccttgtgcaggcgagcacgagtacatcgacgcggtggtggcggcggagacgcggctggtggtggaggtggacttccggtcggagttcgaggtggcgaggtcgaccaaggcgtaccgcgcggcgctgcaagctctcccgccgctgttcgtcgggacgccggaccggctcgggcagatcgtcgccgtcgtggcggaggccgcgcggcagagcctgaggaagaagggcctccacgtcccgccatggcggaagccggagtacatgcgcgccaagtggctctccccgcaagtcctccgctgctcggacaagccgcggccgccgccgccgtcgcccccgcccacgccggtat

SEQ ID NO: 54294 - DNA, 1187 bp, Oryza sativa
taatttttataactcacatatactatttatcatgtagtttttttttaataacgcgtgtgatttctatctagtaccaataattcgctcattcgctgtgccctcgagaaaatataataataattcaatgtgcgacggtgacgacatgagtgataggactatttcatccccctcatttctctgaccaaataaaaacatgattcactccatccatctaaccaaacatcctatcacaaaatttagagaataatccaatccatctcagctcgatctcacaccaaacacgtactaagataagaagtgggtagatgctggcagaacaagttgacaaaagaagaggacaagatcgatttaggccatgttcagttctcaaaacaaaatttttcacgctgtcacattgaaatgtttggacacatgtaaagtattaaatgtaaaaaaaaataactacacagattgcatgtaaattacgggacgaaccttttaagcctaattacagcataatttgacaatattgtgctacagtaaacatttgctaatgacaaattaattaggcttaataaattcgcctcgcaattttctggcggaatctgtcatttgtttcgttattagactacgtttaataattcaaatgtgtgtccgtgtatccaaaacccaaaaattttccccaactggacgaggcctttacaccccataattctcgagtggcagagtgaagaacaagctagacaggatcgatcgatggccggcggcagcgagtttgatatccaggaagccgcggcgtcggcgtcggcgtcggcatcggcgtcggcgtcggcgtcggcgacggcggcggcggcgccgttgctggagaagaagatcacgtactgggaaggttgccctggctgcgccgtcgagcggaggaaggcggagaatcccggcgtcccctacctgcagttcttccacatctggatcatcatcctcgtctcctgtacgtaatttcatatgtactagctcagttagcttaattaggacactaatttaagtaattaggattgtttttttttgtcctggaaaagattcctcctcagaatttgttgattagcacgccttcttacttaattagcttaggtggaagttgcttaagagcaagtttaatagtatagccaactactagctccaattcatctatagccaatctaatagctcattca

SEQ ID NO: 54295 - DNA, 1165 bp, Oryza sativa
cctattgttgagaagaggatgaaaaatgaaagtatgaactagagatatgcaacattatctggttgcttaatcagatcttaatcactacttgtactagcgtgagtgtatcatatcacttggtatcatcagaggctcagagcaggcagtaggagcagtattaaaaaatatgcaagtatggagtactactagtagtgatgcatacttctaaaaaaacctgcagcgtaattatacttcactaaccactgctgcgaaaatatttggaattccaaattttcaaccactttgccacaaattagatagagcaagtaaaccaactataaacatacatatgtgaaaaagataacgagaagtgaaaaaaaaagagagctataaatttatagtcaaattatagacttctaataacaatagactttaacatgttgtttgtgtatgtgagagcttgtttgtgtatgtgagagcagactaaatattaatagtgtagtactacctctgttttttaatagataacgccgttgactttttctcatatcttttattcgtcttatttaaaaaatttaggaattataatttattttgttatgagttattttatcactcataatactttaagtgtgatttatatcttatacatttgcataaaatttttgaataagacgaatggccaaacatgtgagaaaaagttaacggcgtcatttattaaaaacggagggagtatatatttataggtaactaagggtattagcttactagattaattatagataatttgaagctaatagtagattgtattattaaacttgttcctagtccatatttgttctggagtactctattagtcctgaaaaaaacattctagaggatgaatctggataaaggtagtctaaattcatccttataaagggtcaggttggttttttttactagggagtaaagtttaatcttccactttgaccatgacagttacgcgcgggtgacggttacttttgcgagtggggcccaggtgtcatacaccgggggcagaggcagcggtggcccacgtgggccccaccggcgggcgtgcgggcagcagacgagccgtgcgggtgcactcgtgccgtctcgggagccgcgccggccgtcccatgacgatggcgtgcgtggctgcgcccccaccaactctttactc

SEQ ID NO: 54296 - DNA, 2855 bp, Oryza sativa
ttttaaaatatgtttatactggctattgtatatgctcttaggttgagaaaattttacggtggccgaagaagaggcaggcagtttgatcggcgaatccaaggtgtgtggggggtggtaaaaagttaacgcgaggaacggtgaaataaaaaccaactgtagtgctgttttgcattgcgttgcgcctcgaccatggaagacgagctagcgtgtgcatcgtgcttggtaaatttatgttagctttgaagcaacgatcacgcctttacggtttgcgaaacacacgcccggggtcctcgatctacctcacccgctcctcaaactgtttctagcaacaatcatccaaatcaactgtttcttaacaagccggagtatgtcaattcgagtgcgggcataaaaaaggggtaaattaaatagtattagaaagctggcttagaaattctgatgatgttcgtttttaatcgcatcatttaattataggtttgaaaaacatgcctgtgataatccggtggtcattaccagggttcaccgaaccgttttgggtggggttatcgccaccccacggtttggtggttattgtagtaaaccgcacgaaaactatgagggattgtagtccagtttcatttaaaatttgtgacataaatatattaattttagaagttatacaaccaatcagactaaggtatatgtatttattggaccctacgatgtagaaatggcaatattaatgaggggcgccatattcatttcttttcactactaatttatttaagaattggtagaaataaagtgtttgttagatgaagtgggtaaaatagaagcaacttttatatttgaattttgtgccaaatacaagcatttcattttgtacctatcccatcaatcatcgttcattcaatttgtttctcatattatccctaaccatacttccaacttcaaacgtctcttatttatgtttttttttccggaacacaatatggaacctaggtgttggataatgactcaaatatattattagtcctaggcactagtttaatatgtgcctatatataagggtcacccttatacatgtaatcctaaaccattatagttgattttgtcttccgtggtttttcctctttacattagaggggttttccgcgtaaaaattcgtctctttcgtatttttttcctaacactaatatttatatgtgtatacatactaccctctattagcatctccgaacatcatatgtgttccgttatcagtggatacgtctctattaaaaaataattaaccgctgatacgagcattcctgtccttatcttttgtaaccaaccttaattagaacttctacaggtgtttatgatttgccatgaagggagtagatacttggtcagtcagtacccgtgaaaccattaaactcgcttttctgctgcactatcggagtacccgtagtcctagtccagtaccagtaactgctcctgttttggacagatagctgttaatattctttaccccgcctgatgtgaatcagcttgtacttgctgtactggcagcaagtacgctgtcccattttcttaatgtgcatcaggggagtaaatataaataattaaggacgagtctggtcatgactacagtgcatactctctcagtaaaaaaagaaaaaaaaagtaagtctagaactcgatgtgacacattataatagagtgaatttacgatgtgtcatatttaatagtgctagattggtttttagggacggagggagtatatattaccatgcaaaacttttgcattactaagtttcgatagctttctttttcaacaaagcaaactcatcctaactctactttgtaacttgtaattgaaacaagccgagctcgaggcaactcgcaaacaactcatttggcttggtggcttgtgtggcctacgtgtatttgctcaacaattatggttttcgagattgctaggtgtgaattaatgataataggcaatatatgtactaatataccttttgaggcagaatataccttttgaagcagctgggcaagtgttctagtatttggaaatggtcggtttataccgttataaaaaaaattgcagatgtatgacatatatgcgtcaatcagtccttctgccataaagtttctgagacttattattgcttcatatttgactttttagcggctttatgttaaaaaaaatagtttataataagtggttatagtttctttaaaatactagtagatacgtcgagcccattttgtgaggcctatatgtcagtgggtggtaccaccacaagaaacattcaaatgagtaaagaaaatttatgtgttatttcattatcatttttttttaaaaaaatgcgtgagctgactcgagaaagagaattgagccaagacaacggccgagccggccagccagaacaacgcaacaaaggatctgtttatatctcatctcaaaattttacaccatatataaagtattaaatataggctaaaaaataactaattgcacagattgtgagtaatttgtgagacgaatcaatcttaaacctaattgctatatgatttaacaatatgatgctacagtaaacatttactaataacggattaattaggcttaataattcatctcgtggtttactgacggatttagtaattagtttttttaatagtgttcaaacaccctataaaatatccgatgtgacacgctaaaactttaccctagatctagacaccccccaagacagattctggtcctatactgggctttgaacatatccaaactatcaggcccacggcccatatatccttcaagcccacagcccattccacacacatgtctcgcccggctgacacgtggcatcaatcaggcttcc

SEQ ID NO: 54297 - DNA, 1180 bp, Oryza sativa
gttaaaattgaagaattttgactaaaagaaaaaaaatcaaataaattataatatgaaacggttggaatagtttagaaggttaagtgaactaatgtaatataaaacaatttaaggtgtaaaatggattttctttccaatactaaaaaaacaagaaaacctccatttgaaacgatggattgacgaaataacgagagaagccaagccaagccatctccttcctcttggcctccgaccacctcgctcgcctcgcctcgacgtctccttccctcccgcctccaagcaacccctctcgccggaggaggaaaccctcctccgcttccaatccccaaatccccatccgctatatcaacccgatcccctccccgatcgttcgatcgttcgatcgatctcgccctcgactccaagccgacgagaggagttgaggagttgaggccatttcggtgcgtgcgcggcgggcggaggtgatcggtggcgtttcgttccgttggcggcgggcggaggtgattgctcgcgcggcgtggagcggtggggggaggatccgagcgggagggagagcgcgcgcggatggggtggcggagtcgcgcttcggcggtggcggtgctgtggatgctcgccgctgtggtggcggcggctgcgctggatcctgatcaggacgagctcgaacgcgcgtaagtgcgattcaccagaggcagcttctgattgtttgttttttttttcaatcgtatagcatcagactctgcttttggttgcattctgttgttgcctagcttaatggggttgagatacatggagattccggtgtgcatttttcgtgttcatctgtcgcacgcgatgctgtcatgctgcgaaattcaagttagtacggccgaattgcggctgttttttttcctatctcttaacgccacattggaaatgggcacttgagatgattgtgtgggaagtgggatattggaggggagcaggtagctctgatgcatggttgaaatgagaaaccaagtggattattcatgtgagatgtggagtaggtagccggtgtgttgctacttgcatcaaccggactaattgagcgtggtgggtagatactttgttggttaatggatgtcaacttgctaagtttcacctacatatgtggataattaagaaagggaagacacatcttgaagatggaaaattttgaagt

SEQ ID NO: 54298 - DNA, 1248 bp, Oryza sativa
actccctaacatgcaataaaggtacaatgagttcctgccttacatacataccatgctccaggaaagaggatacttggaatgatggattgataaattggctctgcaggttttggagttggacatatgcgagataccaaaacaaaaggtttggtggtgccaatgacaactttgtaatgttatcctaaatgattccatatcctaattgaaggattctaacactctgctccacatattgaaggtatatgggtctggggtactcccattgagttagatgtgaatggctccaaagtttctgtcctttacctggacactgagggatttgagagcatcggaaaatcaaatgtatatgatgataggtttgttgcttatagatgaaatgcatattaagtttgaattggaattttaaatggtgaaaaatggactgttagttcttttgtttttgttgcaggatatttgctctggccactgttttaagttctatccttatctacaatcttccagagacggtgtgtttctctggctcatgacatgctcacctccattctctcatttgatagctattaacttgacttatcttgatcatagattcgtgaagctgatatatctagactctcatttgctgttgaaattgctgaagaattctatggaaggtttgctttctgccattcctatttggagcttacaatttactaagtgcctccttaatgttctaacaaaatttccacttttctgtcggcatttgttgactccagagtgaaggtaatacttaaccttaagtgttagaattatttaaactagaaccactatgtcaaagttacagtgcttgtctctgtaggggcaagatgttgcttttgagccagcaaaactactgtggcttatccagagggatttcctccgtaagtttctgtttgcgttacatatgaacaattttattttgataatcaagtattcctttcagcatgttctgaatactagatgagaattagattttcataacaagaatagacaataaatcacaagtcggaccataaaaagttctaattgccttgtattaatgtttgtacattgtgaggtcggacttatgttgcggtacagactacagagggactagttaataacttgatatgtgctgtatattagcaatagtggaaatatacaggtctcgtgctttattttggtcaaatgtctattgttttgcatttcaccgtttgttgttgctgttttgtttttaggatattaaacttcttt

SEQ ID NO: 54299 - DNA, 1012 bp, Oryza sativa
gtagaagtattcaataaggcaattcttgagcgctgcttaaagttgtataatgaaagaatggaaagagtgggtctaccagtatcagtggataaacttcagctgattcacaatttggcagaagatgaagctagaaagctctttgacaagcagcattttggtaaacatcatactacccgatccatcctcaagcttgatgaagagatgagaaagtttgcctgacaataaatattcatgcgtgtttaatgttgtcttccattttcagataataaaacgacgtcattgatgcaatttttatgttgtaatgaatatgaatatggattgaagtatatgttataaacattatatcgaactgagatgctatggtcttcagttcttcacataagaaacacttgattcttcatattctgtcataaaattctattattaattactaatagccataaatcaagtttgatagttcattgtgtagtggtagtacatcttttgtgtagcaacaagttggatttctttccatgccttttgtgcttggatgctttgttttgaacacgaacgaattttttctttcagattttatagggtatctctggtgagattcttacatttgaagcattccatttaggaataaaactcgtttgttgcttacaacctatgcaaaatggataatatatcttcaatgtgtttaactgggtattctttttaggtcttcggaaactttggttttgccaatgagtaccagtcatcgaagctgtgcaaagcaaagttttcagagtgtgaagataaaatggaacaccttcaatccttgaagcttccttcgatggcaaaatttaatgctggatttcttcgctgtaaccagagttttgaaatggagtgtgtggggcctgccaaggaaagctatgaacgtaggatgtcaaaggtccgtctcttttaacttgagacattttctatgatgggaaagaacaaatggattttgtacccacttaaaattcagatccatttagggataatgcagtaa

SEQ ID NO: 54300 - DNA, 1179 bp, Oryza sativa
tgtgagcatttttagaagtcaaatcgagtcaaggtttcatgtagtaggtaccatttcacccattatgaatagcaaaagggaaaagcagagatgattgtccatatgtagaattcgaaagtaaaacatctttattcaccttccttcctctttttttttcctggtaaatacaccagcacgttctgatatgttgtaagttttacctgaaactcattttttgtccaactatgttctttattacttgtgttgtgtattcctgcaccaatctttcttgaactgatatactccttgatgataaccttatctctgcatggtcacagatgctcgcaaggtctcgtgctcttttcatcaaggagtacaacaacaaactattcaattggctggtgacgttctccttgtcatgattgtgattgcgcgctttgtgatcaagttctttttactcgaagttgctgcatgggtgatattcatcttcttagagacatacacgagattattctggtcgtcagaattgttgtactacaatcccatctggcacatgatcgtctcttcatgggaaaccattgtgtataacccagttcttgatattgacaggcaagtttcttctctctgtgaagtgcacaacatgaatgtaatctctattttgccttccttactgttacgatgcttgtcttgtgcagatgggtgatcccaattgttgttgtgctatcatttttagctgtttactggcgttgcctcggtgtcaggaaacgaataggaagatcattgcttcctttgtacagaggttcttacggaagctccagtcgcccaagaacagattaatccaggtctagaaatggtgatgaatgatgcaaatcgctgggaaaatccatgaaaatatccttttgccgtgtgatggatagtggacggcaaaaggatgttggctctatgcacacgctgcaagaagcttctcttgcaatccaagaagggaatatttaggctcagctcacggctcttagtcttactgacccaccaagcaaagcaaacgctaacgtatgaatgataatcaatctttgttctatatcgaaatgcttatagtaacaaagaaatataaccatactttatttcaatgtaaagatcattctttgtatattatggcacactagataataacaaagaagatctggtagtgtacaggccagagca

SEQ ID NO: 54301 - DNA, 2721 bp, Oryza sativa
gacaaaaacagcgacaacaactactactacaaaacagcatttgcaggttgcaaatttgcacctccaaatgctctcatcatgttgttaggatatgctcctactactgaagctccatgttgacaagctcatttgcatccatcagagacgatccccatgctgtatattcattcgaacttgcgccgccaccacaagctctattctgaagatgctgcaagctcgccattgttgctgctgcagctgcactggatctgttgggtcaatcttctcgacagaatccacaatctggaacgctggagaaacctggtgcatgaagctgttaacaccggcattgttagcgttggagaagtagttcattgggttgttgttctggatcggcacagaagcatcagagttgacattgaggggagattgcatgtcaggaatggcctggtgaagttgtctagcccctgtaaccatcttcacactctcctctgccatcctcacctgcaatcatgtcaagatgttagctaacccacatcgcatggttcatgaattttcagttgtggtctagaagcatatggctataagatacgacaccgcagtagtgtagtgtagctcaggttctttgttaaaattgattgtgatccattgtgtgaattggttatcaccattcggcaagcgattatttacacctggtacgttgcaggaaaaagaaaagtagttacacccggttgtttcaagacaaaacaagtgagtctaattgttgcaggttataatagatggcaaacaacttaatccttcgaatggagcaagaggacaacatttgcaatatctcctgtaccaaattttaagaacaaatgctagaagttcgtttcattccaagaaaatttggtatatgtttgatatgtagaatattccggttttctacaccatgaaagatgcacaatactgaccagaatcaatgcacatggataattggatacctatttgaaagagaggttcagttcatacagaggactaaaaggcacttaaacagttgcatacctttgctcttagggcttcaatgtctgccattagtaccctattgtcaatagcagcagcactgtacttctgatttgcatcagcaagacgcctcaacagagaagagttttcaacccttaatagtgatacctgcaatgatttagcaacaattacacttgttacttacatattccaaaactttgttgtgcagtcaaatggaatagtgtaaaacacaaaacctgctcctccaggtcttttaggcgagctgcctttctgcttcttgagcgtctagctgactcccggttggattccttcctgaaattggacaagaacacaagctcaaatctcaaatatccggctgtatttattacacaaaaaaaggcgacatgaatgtctgactgctgcgaaaaaaaagaccacagtagataaactcaatttttcatatgtagaaaaagcaactagacacaacaggacatgatattcccagcatgttatgaaaagcaagaagcaaatgcctcctaaattgttctaatcatacacgttgcatttttccttttttgcatgaatagctgcttgcacggaaacaataattatccttaatgcaccagcttgtaacaagcattaccaaaattcagtcaggtatataaagcattgaaacacctagcaagcattagctcaagcatttctaagaaaaaagtgagaatgttgtatataatcaaatacatccagtacaaacatgaaacacctagaaagaaactaaggatccattatcttgataatctaaagcatattacttaaaagctatttctaagaaaaaaggaaatcaatagatgtaaaagtcccctaatttctaatgctaatgctcagtgtttactctttgtatgtgttgaattgaaaaataaaaatacacaagcaaaagaatacatattaccttttcttcactttatcttcttcatcaaggatcatatttcccattgcctctgcatctccttccatatcatcatcctctgatggtgatggctcccttgaggaaccactcgtagcttgcttggcatgagcatctgtattttgatttacatatgggcctgatcctccatttgggccaggacttaacttggtctgcactagtatcccgttacctgaatgtgtcgaaatagggggaaaatccaatcagatatatataatatgaaaactacattacgcaaaaattagatttgcttacaacattagagattactcataagtcataactcataggtactgagaagatttaactaagcacatatgcataatagaataccttcaatgcacttctgtgaactcaggatggaaccaactatactcagtgatgttttattgcctagaggactctcagaatgtattgcaccagaggcctgtggatggatggacatgccaaaaattgaagtcagaatgcaaagggacttaataactatcggagctaaacacacactctcatagttaattagttctaatggcattataatcttatatagggaaccgtttcacattgtaaactgaaatcaactagcaaaagctcagatcaacatgttctgtagtcatttgtaaactgaacccacataatgagttcaaagtatgatatccaattgcaaaaattatataccccacttagaaaactaacataaaaagaagatattttctccggtccaacaaaaagtacctcgaggtaccggtacctcccgg

SEQ ID NO: 54302 - DNA, 1707 bp, Oryza sativa
ccaccaccccaaatggtgaacccaccagtacaactgtacaagccatgaagcaagcaaagcaagcagcgatcgagatgagagagagtaccctccacatggcgacggtggcgaggtcctcgtccagcttccgcttcagcatcgcgttgtactccacggggtccatcgccgcgctcgccggcgccgccggaagcgcggccgcgggcatgggcatcacccccaccgcctcacgatcgccgtagcccctactccagcgcgccgccgcctccgccgccgccgccggcatcgggctagggtaaatcgccgcgccgtccgggctcgccgccggtgcagggacgccgtcgagctcctccagaaacctctcgaggttccaccccgacgggcaccgctccagcaacccgccgccgctcaccgcgccgacgtcatctactccggcggccgccgccggctgcaccggcggcggcggagcccacagcgggtcggggatctcgtcgacggcgaacacgtgctccattgcgctctcggacgagtttgaaatgaattcgcgaggggttttcgaaccgaaatcggggcgaaattgaaaacgctggaaaagtttgggagaaattcgatcaaatgctttggaatttggtttcgcgggaggaagcggagaggaggaggcttcggagagaaggaaatggtgggaaagctacggctacgcaacccatgggtttttttttcttctctttttttttcttttttttttcaattttgaactgagttgagagggtgctctcctctcctatttatataggtttgtcccctctttagaagcttcaagaaacgtaaaaagcaaaacaacccgcacgatcttgagtgataataccgatataaataatttggacgtgttaacagaggtttcaacggatataaagtgaaacccacacgatcaaagcgataacaacgatacggacgaatacgtttttattaggaaaaagggttaacagaaagcgtgcaagtaagctacgatggtatggtgttcctagcacaggtgtagcataattttgacaaggttctataaaggcatggatttatttgtttttatcttatcaaagtttttgagtgagggtgtagattacgcatccttaatttgacaatgataatataaggacaaatggctttctacagaaaaagaggaaaagtataacagaaagggtagcaaagacattcgtgaataagagtagtgatgctacttaagaaatgatccatctctatttactatgacaagtgtctatagtaatccaaactgattatatcaaactgacctaacaatgatatttcagtttgtaactttataccattgtcctaagaaacgtgccctacacttatggttatgctagcagcttattgacatgtatcatccatgttttctgctaactttttctccccctcctctttacttggttgctttcgagtttaatttcagaaatcacaagaatgcataggtataatgtggttgattccatgtgataatcaaaatggggacatgaaatttaaaagggggaataagatcagctgaaagtgcaatatgtgtcgcttaagcgcccattttgccacgtcaagtttttaagtttcttatgttctctagcatatttaatacatactacttagtcttttagatattattagtaacacaagcacatatgtattttatctttaaacgttaggacc

SEQ ID NO: 54303 - DNA, 3015 bp, Oryza sativa
atataagctcatctgatttcaccatgtaaaaggatctgagctaaagttggagcggcccagggcctgtctaaagtatgggtccgctcccaaccatataaattcttgttgaagaattcgaaatattcagcaagaaagaaaaatggaagtacaagacgatgaacataaaaattgcgtagttctaagcacgcatccaaaaactgtttctgaaagtggaaaccatgtgtttttttaaaaaaaaataatttaaattgatagtgttgacactaggaaactggtggaaagcctgccgccggctagtaacctaatggactttggacgatcacttatgattgtttttcttcttggtcattgatctcataaagtttgtttcaatcaatgagatcagaatagtttgtttcaatcaatgagatcagaatattaatttccaatcagatatttcctttaccaaatttgtccatagaatagtttgtcatgttcgcgtaattgtaaacacgcatcaatttcggtcagcaattttaaataggtcggttcaccaaagaggcttgtgcaattaggattgtatatatcataccattacatatagatgcttgaagatctgactttaaaggtatatactagaaaatagatgctttaaacccatacactcaatcaagcggctactctcggggcattgattccaggggtgccaaggtgcaagatcgacggatccggagatggctaccaaactccagcatctgccatggtaaaggtggaagcatggaggtctcggcatagccgtcacgtctgaccagcgagatggttgcggtggtgtgagcttggcaagcagggcgttccccgccattgaggagtccattgatcaacaagtcttcgatagcactccaatattcacggaagagccatttagtgcgagtgccatcgcttatacaatcaagtattgcagtcactgccaccaccattgctcctatttaatctcattgcgtagctcaattcttctttcgatggtcaactccttatttgatttaatcaggtaaatgattcccctataaatgttgtttgaaactttttttccttcattagtttgactacaatattgtcttgtttagtgctaaatcatttgaaatgagaccagaatggaaaatactggagtctaaaatggtgtggaaatagttctttctaattacttactctaggtctctgggggaaggaaagagagacacgtgtcaacatataattgtgcttcatcttaaccaatcagcgagcagcaaccttgccggcttgagatatataaagatattgctgaaactgcccgtgatatagtataactacctagaatatataaaaaatgtgacttttatcccaacacttcccaattctcatgctacctctatcatctactaacccttaaaccgcaccacaccatccattaatgagggcattgcagatcttttaccctaatcgttaatttctccaaaacatagaaagctatattttaggacagaccaagtatctaaagcatattgtgattttctctagtcaggagtgatgtacgtgtgcccttgaaggtactgctaggatcgttcaacagttcttcacaattcaggaataccaagaaaacatcacaacaggcagatatacgaggataattttcagaagcactttccagtttcctttgtacaatggccatatatcagtttaagacaaacgcaacacctcctgctacataagaaggcctattttggaacacgggaattccatggatccctacagggaaatatacagctaaagcaaaactccaactgaaattcccatgttccaaactaagactatcatccccaaagagcattcactaaactgtataatgtaccaatagtgatgccattagctttaagttttcagtcttctgccatggtttaactacggcttctcacgcagcgaatccacaaaaaccatcatctgtgttggaaaatattcgtcattatcatgtggtcaacctgctgtagtacatgaatcaacacaaagataagatgttgagatttaagtgtgctcaataccaatttgatatatggaagttacccttacattttttgccatgcctgcttcgataggactgcgctggttggcgagaacttgattgcctcacctgaacagagtgaaatacaaatggtcaagttatatgttggattgtaacaacaaaattaaatatcagaaatcaggaaacatttaacaagttagaggtgtatccacaggttcacccaggtttaagggtgggaggaagatctagagaatttgccataggaaatcatacctgactactgattggtgttcctgttagtccataataaaaagctgaaaatgcgtgatacattacatatattatagtccatatggaggagtcctttattaattgttagcaccagacacactgtataacatacctaggtgtggaggatatctattgctgtcatgataatgtggcagagaagattcagcagtagcagggggcagcgcaccatagctgacataagaggatgcaaaatgattaagtgagaaagaatccgctactctattctgataaataatatgacatatggggatagtttagaatttcagatcaccttgatgctgctgtagtataggtgctaccctcatgacgacgacaagaatgacctctcaatggataataaggatcaccctggattaaaatcaaaactacgagattaaaagatcagtatgcagtttttcaagacgatatggtttaacctaccagtgttgaaaagggacgcttctctccagaataaatgtgggtataatcttgaacagggtatcttactgtttagaggacgaaaactcagctgatagggattttaaagagaaaacaatatggcaaaacttcaaaaatatattgtattggacgacatgttaattgtaggaggggagcaaacacaatataataggagcgcacatagccagagtggcagcatgaaacagctagcagattttgcagcctagtgaaaa

SEQ ID NO: 54304 - DNA, 781 bp, Oryza sativa
ctttcattaaaatctgaagatttatgtgtcttgagctatcaatcttcagattataatgaagttggttgattaatgtagttaatatttacataggagaaagctggagccacagatgggtcaaacaattggaaatagacgacaagatggatggaattgggaatgactaacttttagaagtcttcattttgccttccccagtaatactagatttatggtcttccttggtctgcttgctctgttgggcaggtttagccaatgaaactttaatattcacctgggacacgccaaaagatgtaaaaatcctatcaattgtaaactaatactctgaattaatccaagtcgagaaaagacctttgagccgttcttactgaactcttccttgtcaaaagattcaagacacgagattgcagcctcacgagtaatgtaattaataaaggcaaagtccctccttttagctgacggcatatcgcgtgacagaaccacactttcaatcttcccatgtttcttgaagatttcttttagctgagcatgatcccaggacgttggtatcccatccacaaaaatcgatttaacctagatggaacaaacagtgcatcagagtacttagacttcccagggaagcgaaatcaaatatgttgttaagtgttcagaacttcagatatgattaaaggacttgaacggggatatgaataaagccaggtatgttaacaagtggaaacaaatggtcgttaacttatttatgtaataaggaggaccccgatgcacttcgaaccaagggcca

SEQ ID NO: 54305 - DNA, 797 bp, Oryza sativa
tataggtaaatctaccctttgtcgtctttttatgattggaagtttgtagtctcttgtcctattaaagcctgtcggtaactttgtttagatagtctcttgtcctattaaagtctgttggtaactttgtttagatatttgtattggcacgtttcttgttttcaacacgagtttttcctctgttgacaagaaaaaatgagctgtgaatctgttaactgttatattcatattcctgcattccagtcgagtccatgtttgtttttcagatcccttaaatattgcctcatttttatttttgacggttcataaaaccaacaagggaacaaatgaagcaagctagagaacaaagcatgccatcagcacccacaacacaacatgaacaccaacattagaccattggagtgttcagtgcctaacatgtaacagaagcttaacacaacacaactttccctgtcattttgtctgacattgcttggcaacttggcatcaggtaacagttaaatgggcttggtcctttgggacaatctgttctttgatccacatggagaccggtaccagcacaagtaagaagcacagatcatttcgttttgttggcattgcttggcatcaggaaacagttaaattggttggtccttggggacaatctgatctttcatccacatgtagataggtaccaggcgcataataagaagcggcaagtcgtccccatgaccaagcggaagatgaaggtgaaaaggattcactggtttctcaacatcttcagcctttggaccaagttgcaacaagaacaaaaggtgaaa

SEQ ID NO: 54306 - DNA, 2247 bp, Oryza sativa
tcatgggaaacacaattgagaaaataccgtaaactgcaatgcaaagaggacattagagaatcacctcccagcagagacatagcgatcaaatgtgtcagtcgggtaggggaggtcctcagcgtcaccctcaatgatgttcaccccattcagtgccaccttctgcctggccttctcaagctggtgtggagactggtctagcagtgtgacattctcattgtccacatgcttgacaatccccaatgtggtgaacccagtgccaccaccaacatcgacaaccttgagcccatggtggtagagttcagcaggctccaatgcatcatccctcatgtcctcggtccaatgccccgggtttatgacatggtcatacacaatggaaaggaacctatagaaccagaatgcttccttcttgtgttgtatgaacctaggttgtgatgctggcctagcagaggagaccgcgcactttggtgcgatatactttacccttgatctcacaccacttctatttctcaaaggaatcaaacctattttgaaggccccaagaatcctaatccaccgggagctctaaatgtagaggaagaaaccatttccttcattgttgtttgaaaacttggatcaaatcacgtatggcttagtgtatcgttgggcaagagaatactggttttatgtacgaaagaatcaacaaacaggaatggactaggtagctcctatgcttcatttgtgaggtttcttggtagatttacaatgcaaataaatagaagatcagtagatcacatatgagtcctgtacgatgcaggagagagggagctagttcttggccatggtaacctcagctgcaagccacaggaacttgagaacatgcaacagccatgtatgtaagcatgtgtgtgtgtgtagtcgtgtacagtatagaccttttttgtgatgcaacaaaaggcttaagcttctattccatcaggaattcaggatgctgatggctttatttgtcttcatctcctctagttgctccattgatggggcatgtgggttggggattgtaaacctatggatgacaattctggacaggaatgtatgggggacttgctacttggcatcttgcagtccttttagttctcatccaaacattacacctaatttgtttggtttatgctacataaacagctttttttttggaataacacaaattcaaaatgaaagttacaagagctgcccataacagtctaaaatacaagtatcatttaaagtacccataattttcagttctaaggaagattaacagcatatgtgtgattacacaattacttctgcaagtgaaaatattttattgtgtaaacttatggatttctttaagttcacaaactaaaatgggtgcaaatgttaccaacttaccatagacaaaacccatattttggtaatcctaatccacataatccaaattgataggtatacacctctcaactctaatgtggacaaataaaacatgtttatagatcttgctagttaagtaaaaagaaaaggctaacagtgacacctttctgcttttaatgatctgtaaatgactatatatctttagtgccataaaaaattctctatgagataaatatataggtctacgaccaaggagaactcatgatcaaccaaagtaaattgagcatacctggtcaatgtgaagaggaccatgaacaacactggagcagaaatcaagcaaagaattatatcgcatgagctctgatgaagatatacatcacatgggtacatcacagaaggggcagcaaattcatttataattgatttaccattactccaaagaacgtcaaggtgacttccttttttacattcacatggcaaaggtaggaaataaaaaaatgtgtaaaattggttagtgcggaagttcccaggagctaagattgaatttgtacaactatatcattcagagtgaagtaatacttttacagggccctggaagctgggacaagtttcaaacataattcctcaaaaaggtaactaaaataccactttcagattacttgttgagactatggaggatcattcaggatttagtagagtgaattgcagcttggactgtctcttgttaccatagtttcactttgaatccgctttaccttttgcttcactttgaaccccctttttcttcttctccagctctggaaatagcattatctcctaggtcacaccacttccgcggttctgcagccgctgccataatactggcagtggatatgtgcctga

SEQ ID NO: 54307 - DNA, 1094 bp, Oryza sativa
cagcatctctaggttaaatgaggaaaaacaaaaaggagaaaatttaaagtaagcacgaacaactctacattatttaagcatggcatatttcatacatttttaatatagttccctagctgtttgatgaatgaatttcaattttggtcagaacacatgcatgaagtaataaagggaaaaaaattacagagacttaatatcagataagagatgatcaaattgtccatacctgacaataatggcatccaacttatcatcaataatggatgggccataaggatcctcaataggctccacttgtactaccagttctggtttaacagactgcattttatacaaaaccaatcatgagctttcaacaaacatcataattgagcatcccagaagcagcagtttcacttttggcagctcctcctaagtatgaacatgcttaattgggtatgtacttatgtgaaactgataacccttacaagtttttttttcttttttttgcggggaataacccttacaagttaagaagcatgcaattccaaaattctatatttttctaaaatgtagacgactaggaacaggtcttcagtacaaggaagttatggaacaaatttcgcagcaagttggtcctaaattgccacataactcttcaccaaaccaattcactgtataacttcttattactcacctaaagtaatgtgccacatgagagaagctaattctcatgcgcgaaatctaaggtttactgaattgtctttgtacagaataaattatacaccgcctcccaaatcaactgaaaattacacctttgatttccttcatttttggaagagaaaagattcatcttgtcacaacgtctcacaaacagcaataaaaagcagctcagtaacttaattcatgcaaactgcttccactagtcatcacccaatgttccaatccttttaggagtatttactaacagaaactatatactacataataaagtaggcaagattatcccccaccttgatgtaatcctccacagccttcatgcgcttttcgacgggctcgatcaactcagcgtactgcaggcacacacacagagggtggaaatcaagaacacaacc

SEQ ID NO: 54308 - DNA, 1345 bp, Oryza sativa
catattgatttacagcaatacttgggccgatcaccttcgccacctccgcgtcgtcctcaccatcctgcgccagcatcgcctgttcgtgaagaagaccaagtgctcgttcggagtcaactccgtcgggtacctgggccacaccatctcggcgtcgggtgtggcattggaccccgctaaggtccagccatccacgagtggccacagccccgctccgcgcgtgccgtgcgcggcttcctcggcctggcgggctattaccggaagttcgtccacaacttcggctccatcgccgctcccctcaccgcgctcctgaagaaggacgggttcacatggactgccgacgccgcggcagccttcctcgccctcaaggaggccgtgacgaccgcgcctgtgctggcgctcccggacttcgccaagcccttcatcgtggaatgtgacgcgtccacgtatggcttcggggcggtcctcatccaggacggccacccgatcgcgttcttcagtcggccggtggcgccccgccatcgctccttggcagcctatgagcgcgagctcattggtctcgttctcgccgtccgccactggcggccatacttgtgggggcgccgcttctacgtcaagacggaccactacagcctaaaatacctcctcgaccagcgcctcgccacgattccccagcaccactgggtgggcaagctgctgggatttgatttcaccgtggagtacaagtccggcgcgacgaacacggtggctgacgccctgtcccgccgggacaccgaggaggcttccctgagcacgatcatggcggtctcgggaccccgcttcgacttcatcgaccgcctccgccaagctcaagccagggacccggctctggtggcgatccacgacgaaatcgtcgctggcacacgggcggcgccgtgggcgatcacggacggcctcatcacctacgacggccgcctctacataccgccaacatctccgctgttgccagagatcgtggcagcggtccacgacgatgggcatgaaggggtccagcgcacactacatcgcctccaccgcgatttccattttccaaacatgcgtcgatgtgtgcaggacttcgttcgggagtgcatcacgtgccagagatataagacggagcacctccaccccgccggactactgctgccgctgcccgttcccaccgtcgtctgggctgacatcgggctcgacttcgtggaggcgctgcccagggtaaacgggaagtcggtgatcctctccgtcgtcgaccgcttcagcaaatattgccacttcatcccgctggcgcacccgtacactgccgagaccgtggcgtaggcgttcttcaacgaca

SEQ ID NO: 54309 - DNA, 938 bp, Oryza sativa
tattgctagtgggtgatgatgtggtatggttgcatgttgagcgcttagtaggctataactttatagaaagtatagattagtcatagaagcccgaaatcaaaggtcatttatatttatattgtgtgactacatgagtctagaattgatgaggataggggcacatttataattttttatttagtggatcgaagaatgaaaaatatttaaggatgaaaatgcaatagtgcttgacaaatggtctggcagagccagggtttacgatttcgagatggccttctgtttcgggctctagcggaatgacggttttcacgaaatctggtggacaacctgtagattccgaacaaatttcacaaaccaaaatttgaatacaaattttctgagattaccaataagctcgcaaaaaccggtcagatttggcaaaattccgagcaaaatcatcgaaatttcaatcggtaactagaaaaagaggtaagtatttttttaatttcattattcttttctttcctactgtaaattaatacattattttttaaaaaaaaattatcccataggttctatgaagatcatactatttataagatttttttctcttttttatcaattcaaatttaaatttggatgaaactcattcaaatctcaaatggtttctacttttgagcctcgtcgaaacgtcgaaatttcgtgaaattcgactggttttcgtcggaattatgaacctgggcagagccgtccatctattctccatggagacgttttcagaacttttcccgtccttaattcaacatttatctgtgatgtgatgtacgccacgtggtccaatcagacccaatacaatccgccggcttgagaaggagggatgatgatatgtttagctgacccaaagctaaacaatgcaaaaaaaaattctaaaactatattttataagttaaaattgaccg

SEQ ID NO: 54310 - DNA, 2380 bp, Oryza sativa
ctgcatgctcgtgtatggtaattaatattgttatctaaagtagaatagtgggaaaaaagtctcactatgttcctttcaatggttctggcatgatttgttctgttataaagatacattattctttcaatgagcaattggcatttagtttggtcaggtttcttgtaagtcataggcttatcatttcagtactatgatagtttgtatttaaatgatgtattagcactgatttgcaacctgtgtgaccttttatatccacatgctcactttttggttgatatgtaggtgagagaggccttggagtatctacacaaaagccactttattttaagggaacaaacatgcatcgcattctgaaaggttttatggctcaggtactgaaaattaaaccaaatatccaagtcctctggccactgcatatttctttgtatcaactcacagtatgtttttgttcttttatgggatttcaaatgctgaactctacataattctagaatgtagatatgaatggcttgctagttatacagcataatcccagatttttttttgttccatttgcaggatatatctactctagattgcattctagcatccattttttccctaactatactcatcttatcaaaattttcaactgcagggtggtgatttttcaagaggagatggtattgattcattatcccaggcatcttctttcaactgacttcttgctgttgtacactttatagctcaacgttacatgctgtttccaggacgtggtggagagagcatatatggtgcaaaatttaaaggttaatgactaatgaaatttgtggctgccatagaatttttttaatccaattagtgtcaaatgcattagtatgctttcgctaaagtttttgtatgtactttctggtgttctacagataaaacttcaagttaaagcatgaccaacctggtgttctttccatggaaatgctggaccagacagtaatggatcccagttttttataacattcatgccaacaccacatcttgatgggtattgcttctttctgttagtcagttggcaattttctctgttaatctctcttctagttccttgtgcatattaagttatgcctttctttctttccttactgcacaaagatataggcttgatatctaccaataccaaaatttaacattctagagagatttagtctattaaaaaaccttgaatctaaaaattctgtacaaccatgaaagatcaattagcctcatgcatacacacataaaagttgccatttgttaaataatatcttataaacagcacatttatgtctatgtatatacaccatagaaaactctctggagtgggtgtgtgtgtagaacacatcattaagccctactcctttcttaaatgtgtctacaagttgtgtcaggtaatggttgagagtatgtggtggctccaacacagtgtatgttgcccacagaagtaatcaatttcctaatttctatggtgttttcctgtggataagaagtcatataacttccttttaccaatggctccaaaatctatcaacttcaaatgacttaaaattataatcgtgtaccaaacatgtggtctttgggaaggtggtcactggaatgcccttgctgaagaagcttgaagcggtaggttctgataccggaaagcctacttgtgaagtgaaaatcgtggactgtggtgaagtctctgattcccagaatcagctaaagggagagaaaggtaaaaagcaacataaacagataataccaaacagtccatgtgttgtctggttagctttctcactacttgttcttttgcagaaaagaagctcagaagaacagaagacaattctgctgctgaaaaaagggtcaaaacccaaaaaccacctactcatgataaacaaaagaaaaagagaaagcattattcttctgattcctatagctcagattattctgacacacagtcctcagatagtggctcggaatcagaatcatactcttcgtcatcattggatactagctcatccagcgaccacagacacaagagaagaaaaagttcgaagaaggataaacacaggtctgcaaaggggaaaagcaaacacaagaagactaagagaaagagtagaggaacaaaaaggaaatccaaacggtacgttgatgacctgtatgatcttggtagtgttattagcttataatgatgtatttgctgaaagatcccctgtctggagctttttacagaagctacaggagctcaagtgatgattcagatagctcaaagacaggcggcagcagttctgacagtgaaagtgaaggccgtcgtacgactcgtaccaagcattcctcgaagaaaggtaggacaatagaagagtcaattcacattcatttgctatgaaaa

SEQ ID NO: 54311 - DNA, 1077 bp, Oryza sativa
aaagctagtaaattaaggtttgattacttaaaacaaattacttactgtcaggttcctttcagtactactccctccagtcacaaatatgtgacttttggaatgcgtgcaccgtgcagtcaacatgtttaaactttgaccatcaatattgctttgaatattttgaattcaacttttaaaaatgttatgattatatttgtcttaaaaatagtatcaaaatattataccagtaattcctaataaaataattgtcttgatgactgtgtcattgtgcaaaacgtcacttttttgtgactggagggtatttagcagggataaaaatgtcctgttcaacattgagataaccttatcctttgagtacccaattgagatgtttgtttgtatttgcagggatgatcctggtgcgagagctaggagcagtcctattagggctgatgcaagtttaacaaaagtggatggcaacaatggtgctgatactgcagaggctggtatatctagagctgaacctgtgccaaccaatggtaaagatttagcaatgggctctacagacaacggacagcctcaacgtgtcaggaaggggcgtggttttactcaacaatatgcatttgcacgtcgatacaggacaccatctccagagcgttcccctgttcggtctcgctacaatgatggaagaaatgataggtggaatcattttaataggtactgcagttagattatttaccacatttttttaaaaaaaaatgatgattaatttaatgtttggatgccatcatgtgcaggtatggaagaaatggtccctacggtgcacgctcaccagtaagaagatatcgtggttccccaagagccagtagtccgtccaggttggtatcttctgattatccttggaatctcctagtggtcagtaccaattgattgggtagagtggatgaactattttgaatatagttgtgtactcttcatgagttcatgccttctttggggttaacagtgtagtttgttattatttagtaccataatacccggggttatgtgcaacgtgccgaaacatctgattttgttcaacatggcccatgatgagct

SEQ ID NO: 54312 - DNA, 1219 bp, Oryza sativa
caacaggtcttgaagagttcaagagctgcacgtggagacaactgcaacgtgcaagcgttcttctgcgcaggatatcctgcgcgcatcagttctctgaaaagagactgcttccttatccgatccagacgagacttgcgtggcgtggaatcaaccggtttccagaacgtccaagaacaaacaggcctgcggcgaagcagtgaagcacccgttctcgctgcctttgcctccgaagaggaaccacgcaggcagcgatgaggtagcgctgcagcattgcaaggcagagctagacctgacatgcaagaatatgtactgcactgcttccctagaaaaaaaatattgttccaatcagtccatattattcctgaaaaaaattcttgctccaatgaaattctgcattggtatagtagtacgtagtactccttgtatagctagcttaattagcaccatacattcatcatggctgatcacaccatttcattgcatgtgtctgtacgtacgtgccatgccgacgcatgggccgtactccgtacctcgcacattactcgcttggacaaattcaggcggtgcggcaggtgcatcgcaagaatcgatcgatcggcacacatgccgcagcagtggtcgcgacgacggccggcgcccacacggcgtgtacatgatacaccgtatctgcgtctgcactggcgcagttcaatggatctcggcggttgccgtacgtctcatcgatcccctactccccctgtgtattgtatgatatccatctatcactaataatctcctggttctacagcgagcgtacagtgcgtacgcgtgcgtgcgtgcatgcatattgtgtatgtgtgtcaagtgcgacgtctccatccatgattaatttgagcggccggtaagcggctacaggattcttccggtctaagcgattagctagccagggacccctgcatgtatacaaatcactcgactagctcggacgtactcgatccgtccatggacgtgaaggacacggtcgaaccgacctactagtagctgctgttccagcgacgacgatcgatcgatcgatgtggggagtaccggacggcttataaatgtgctgcacgatatcgatcgatatgattaatcgtacgcggacgtctggcccctgggcaccaacgaccgatcgagctacagccaagagccagcgtacgtacgatctactatagcattaactgtttccgatctctcctga

SEQ ID NO: 54313 - DNA, 16730 bp, Oryza sativa
ctctctctcctctatatctcacgcggtctgcacggtcacactcactctcggtctcactccctggagctggagcgtattaaaacccttctccgtccattcgatcctgccacttcctttctctcgccacgatctcctccatctctctctctcttcctcctcgccggccgagtcagctatctcgccgccgcctgagtacgtacgtccgtctcggtatggccatggccagtggcggcaccgtctgctccatgtgcggcgacgtggggttcccggacaagctcttccgctgcgcccgctgccgccgccgcttccagcactcgtacgcactcctccgtatttgcctcgttaatttctacctctctccctattgattcctggcgtctaggtaggtacatagtgatcagaactgacgcgtcgtggcaacggatgcatgcatgcagctactgcaccaactactacggcgacggggcaccggtggaggcgggcgccggcgtgtgcgactggtgcctcagcgacgccgccgtcgtcgccgggaagaaggggccatcgtcggaagggaacgaggagccgttctccagggagtaccgtggcaggagcaagcaggcggcgtcgaccggcggaggcgagcaggagggcggcggcggcggcggccggagggtctccaaggccggcgctgtccgtaggtacaagcttctcaaggacgtcttgtgctaaagagctatggtctaatacggaccatagctgatggatcaatccttcattttcactgcgtcaccccgtcatgtacaaaactagctctagctagctaggtgcccatcgctaggtaattagatcatccctgtgtaaattgtccccgtgttaattaaccgcgcgtgtgtgtatgaatgtatgatactactccatcctagctaattaaagctatatgtatgttttcatagacatgtcatgtttgacgagaagtatcaacttgacaactagtgaaaggaggagctagcctaggtcttgtatgcgtgacattcaccaactaattgtcgtcaaaccctacttgcaatacgtgcggtgcttcccgtcattcattatcgatcgtcatcggatcgaggaaacgagctagactgtcctcaactcgatcgatcggttgatgtttacgctccaaatcgcgatcagtctccatccacatcgatcgtcttcaaacgatcgcgaaacacgaaccatacacatcagtactagtacttaattaagacttcaataattaagcactattacacgtctgcttgattattagtttcatgcatgaaagacgacgatccatcatccatcccttcctctggcacttgcgatatgtacgtggtactcggtagttgatcggtacgtactaatccagaagaagactctagaaggcgatcgcgttgcatgctcggcaccctcgccttttttttcttctcctcggcggcgtgccgatgcagaggaatcaaatcaacaactcgtacaagtacggagtatgctgcaaaatattaaaggactccaaagtggccgacaaacaccatgttatattccccccacttgtgggttagcctcggatggcacgcagatctttgtgggcgcgtgaatccatctatccactcgatatccgtctcgccgtggccgtcagatggatatgtaagatcgagctttggcagacggacagcacagtgtacgtgctccggtcaatcagagctattcgattgatctgctccgtacgacgagataaacgaacacggttggtgtgcgtgtggcttgcgttgcggcacgtcgatcgccctatcaccccgcggccgagcggccggcccgtgcttgcccaaatgtaacagtggtgttggcattttggcagaccatgtttgaggggcacactgccactgtatatcattatattagatagatcggtctgtcgaaccaagtgttctagtgtaattttttttatgagaatttggaaaaagggtagttgatgagtgtgcacggactaacgtggcatatttccgataactgtttattcaacagtagtttatattttctagataatggattaaatattcttcaatgataatatctattatattattaagacagctcgaaaagaagacaccacgttcaccgtggaggctagaaattcccacgttaatcgaagaaaatatgaattatttacaccgttggattgtaagaggcatagatttcaatgtctgagatttaagacaaacttggcatgttaattaagagatacggagtaccgtacgcgtgtagaattagaatcaatctctagctaggacctttacatgcaaacggactcaaaagagttttgtccgatttcctaaaccaattaaccagagttagagatgaattaggctataatacacatatataaataaagcagcgggcaacgaaccactatagaacagtaatttggatgcgtttttgttgatatgaagatagatgctagcagcgagcgacggaaatccgaagcagcgggtcaagccgtgcggctgcacagtgagccgtatttgggtgatgcacacgtcagcaaccagaatagcatgatggcatgtgcacggatttttatttgattttgaaataacacaataaaaaatgaaagaagagttcatgtagaacacaattaaagattaattgaaatccataataaaaaataaaatagatttagaaactagaaaaatcaaatataagagttcaataagagttcaagtaaaaatacattttacgaacaactgaaattaggaataaaaaataagaaatattagaagaataattcatatagacatagtatgagattaataaaaaaatatgagattaataaggaatattaaaagaagagtgcatataagaactcaatatgagattaataaaaatttggaataaaaataaataaatccgaaattagcaaaagaaaataaaagaagaattcaagtaggaatatagtttaaaattagctgaaattcggaattaaaaataagcaatattgaaagaagaatccatataagaaccaatacgagattaattaaaatttagaataaaaaataaaataatatccaaaattagaaaatttaaaagagagttcaagtaggaatacaattttgaaacaactgaaattgaaaataaaaaataaaaacattaaaagaacacaatacggtaataactatttttttaaaaaaaattctgaaattagaaaaagaaaaataagatttcaattaggaatacaatttataaataactaaaatttttgataaaaataaagattattgaaataagagaccatctaaaacacatgatgagataaattaagtaacatgcctataaaaaagtagagtggtggcggttgatacgacgtataaaaattgttaataaaacaccaaatagaatcctaatgacgattaaaaggagggacatcaggcaggccgtgaagcaaacgagtaaggcggttaccgggacttctagaaagtaaaaaaaaaaaaataaaccccattgataatcatattcgatttttaaatctcaatgacaataaaaaggagaagcagcgggcggggtgcacaagagtatagttgcagagccgccgacggctgacgggacttatagaaaataaaaaatgaattccaacggtatttatgttcgatttttagaatcacaatgataataaacagtagacggcggacgggctgtagaggggcatagtggcatcgtttgatgggacttctaaaaaatataaaaaatggaactacaagtccaatttttaaatgttcgaaacttctaaaaagtaaaaaaaaacactaataatcatgttcgattttaaaatctcaatgacaataaagaaggaaagcagcgggcgagctatagaggagtacaatggtaaagccatagacggtttggcgggacttttagaaagtaaaattgaacctagacaataattatgttcgatttttaaaatctcaatgacaataaagagaagagacattagacgggccgtagatgagtataatggcaacgtttgacgggacatctaaaaattataaaaataaaacccaacatgacaataaactctagaaactataaaatctaatttttaaaggttccaagaagaataaaaagaaatagtggtatatcgagcaagcaaataaagaacgagatgacataaggggtagcaactggtgtgacttttaaaaactagaaatacgaggatgataagggttggtctttcaaagtcttaagacaataagatagctatctaataaattttaagtaaaatcatataaaaaatatgtgatttttttaggtgctagccgcgcaattgtgcaggccatccagctagttcgtttcattttacaagtcgctttggaaaaaatatagtaacattaatttttcaacacaaaacaaatatattattataatgtattcattattagttttaataaaactaatttgatgttatagatgttattatttttttataaatttgatcaaacttaaataagtttgtttagtaaaaaaatatcaaaacacgacttatatatgaaacgaagagagcattagttagtgggcgtgtacttcaagacttcaagtcaacccttgtcaatgctaaactgggatcaaactcaggaagttatggtctactagcatggttaacaattaccaggcgagcagatcggatgcataggtgtttgagcggtacggccactgtgtatcggtcaaggactgcctccgttctggaatagtgaccgagcacgtgtagggggtgcacagcaaagacaataattctcgaccctggctgcctgtcagcctgtgtgctaaaatgtgttggtggtgtactggtgttcctgttggtgtgaccgtgatactaggctgaattggtgggaagcttgccggagaaatgatcaaagagcatagaaagaattttgatggccttttcatctacacgacatggaggatttggctacaaagaaatgctagaaattttaacaatgactatggtacagcatagtcattgtcacatgtggttgactcaacatgtgcaaagccttcgatgaagcgcaaatcgtttagatgataaaacgccgacttttgctgttagtggctttgtactttctcaaagtgctataatctcctccagtgcataaatctgaagacacctcttggagatgtccctgtacgtgaaactgcttctttctcctttaatgaataggcagaactcgtgccattatcctctcgaaaaaagatactaggctggattcagactttcagagaagaggatcacagtatcctgtgggtctgcttgggctggtcgagtgggccacagtgacaaattgtcgtagacttgggttaagcttaagcctgatccggtaactttccgatcttcttgggccgctgaagaaatctcatgcaaatttgggccatggaagtccaacgagctaggcctattgattcttgcctacaagcccaagcccgtgtacaacgcatcccacaccgttcgttccgttgctgcaactgagctgccattgctggatgcgtctgtgacggaatccaaattacctgagctgacattacacaaaactggaagacaataaatacagaatagcaaagcaaggatcggatttccgattaatcacagttcatacatagataaggtgaagctggacggataacaatatttgagcaagaaacactaagcaaagaaggaacgtgcagcttgcacactgagggcaggcaggcagacagacaaacacaagagtggcactcatgtggaaaagattccgaattgcaggcgtgatttctcaatcatttctgcgcaaagcgataaggtaattaacaacaccattgcagcctcgcagcgtcattaaacgacagcaatgcacagaggaatgttgccgcttaataatgcagagagcaggacagcgcaactaatctctgaaaaattagtggctaggagccttggatcatagcaaaaaagtgctaacaactgcactataaaatgcgtgcctcgcgagtcacaaaattggctgttgtcagagaatatgaaattgcagaagattcttgcaattttcctgttaagtgcatttctgcatgatgtctgcatgacctacatgataggagcacaaagcttttacatctttggtaaggctttcacttacatggattaaaagaatgttaggtgctagcgaaatactagtggagtaattcacagcttctctgatgtaattttgtcggagctaaaaccctgcaagctatgataatcaaactagactactgatgttggatagaactgcatattgtcaacaactccaccgtccagatatcagccatgcatgcagtcaacgaccgccctcactacaaaaatttctcttctgttaccatcaccaacatgtataaatgattaaatgtactccgaacaaatgaaatctttcacctttgctcaactgcacttccattgggggaggaaatgtaggaagaataattttcaatggttacaggataaaagaaaccaatgtatcaagtcctaatcatcgtctgtccttgcctaatgacgtctttgccaccgatttagcactatcattttgctgtacctgacgcgaacttcgtatatctaatattatatttcatcgacttcaaaatttagagttcccatttgctcctctaccgatcggtgatccgaactatctagaaatgtagaaagtgcagtttgaagacatccagtataacctcactgtatctagcgaagatattctgagttgagaatgcttctacctgaccaactgttgaaaaatgcgagctttcaacaagagggcaataattatcagccaaatcacacagcagactttccctagttactcgtatttgtcatgcatatggaagtattccctccgtttttaaatatttgatgccgttgactttttaaaatatatttgaccatttcctatcatttaattcattgttatatatatatatatatagacacacacatacatatatatatacatatacatatatatatatatatatatacatatatatatatacacatatacatatatatatatatacatatatatatatatacatgtatatacatatatattacatattccacaaaagttcttgaataagacgaacgatcaaatatgtgctaaaaagtcaatggtgtcaaatatttagaaacggagggagttgaactagtttcaacagtcagacgaaaaacaaattgtgaaccattttcctgcacaagctaccttttcctttgaattgagaggaagagttttacgcaacttgtcaacagtggcttttcacggtggaacctaataaaattcaaaattttctaggcatgacgttatattttgtaaaaggaacaaaagcaccgggcagactttttgagtgtacactggcaagaaaaaagaacttcacttcgtttcgtcagaatcataagaaacaaaggcagcaccgcagcacatcaaacatttcctgccattcaaatgcacaacatatgatccatattattactgctagctaacatccagagtcttagtattctcatagccacacattagtcctactcctacttaaatttcataatagcaacaaaacatttggacaaagcaaagtgcggttgggcagaggctagtatcaatcatagaacaagctagcgtctaattaaaatgtttttggtgatcatccgcaccgcccgttctattctaaaccacaattgaagctgacgaattaagttgccagcacgacgccatgtgtataaaaggggcctaagctgaacgagcttcgccacatcagtaatcgccaagctctctttcaagcgtagagacctctccacacttatcagagtaataaggaaaaaaatatagattaaaaatggtgaagctcgcattcggaagcttgggtgactccttcagcgccacgtccgtgaaggcctacgtggcggagttcatcgccaccctcctcttcgtcttcgctggcgtcggatccgccattgcctatggtgagctcaacgcattttccggtttgatatgtacagtagtatgtttcatttctgacctaccgacggcttggtttgtgtagggcaattgaccaatggtggcgccctcgacccggccggccttgtggcgatcgcgatcgcccatgcactcgccctgttcgtgggcgtttccgtcgccgccaacatctccggcggccaccttaacccggccgtgacgttcggcctcgccgtcggcggccacatcaccatcctcaccggactcttctactggatcgcccagctgctaggcgcctccatcgcctgcctcctcctcaagtttgtcacccacggcaaggtcagcacgcacaccatcgccatagattaaaggcttagatttaaactgctgtgtatatatttcccgacaagaaggacagcgcgattaaccggtgaattcgatatccgaacgcgtgtaggccatcccgacgcacggcgtcgccggcatcagcgagctggagggcgtcgtgatggagatcgtcatcacgttcgcgctggtgtacacggtgtacgccacggcggcggacccgaagaagggatcgctcggcaccatcgcgcccatcgcgatcggcttcatcgtcggcgccaacatcctcgccgccggcccgttcagcggcggctccatgaacccagcgcgctccttcggccccgccgtcgccgccggcaacttcgctggcaactgggtctactgggtcggcccgctgatcggcggcggcctcgccgggctcgtgtacggcgacgtgttcatcggctcataccagcccgttgccgaccaggactacgcttaaaagtggatgaaccgaattaattgaagtatccgtgtcagtttgcatgcatcgtacgtttgcttgatttgatattcgtcgtgtgtgatacgttcacaggctttgtattttccggtttaccttctttttgtcaaacacggtacatgtaaaaggtcactttctgcgattgttgtctggaaggggaaatcaaaattgtaaaatttcatcgacacaattgataagatcaatttgcattagatttggtttgtaccaggaaatttggaagccatgtcccttttctggctaagataatctatctatctatctatctatctattatatctatctatctatctatctatctatctattatatctatctatctatctatctatctatctatctatctatctatctatctatctatctattatattattaaaacagctttgaaaggagacatcacgttcgctgtgggggttagaaatttccacattaatcggagaaaaagaaaaaaaaagagtccaagtagaagtacaatttaaaaatagctgaaattcggaattaaaaataaacgttcgctgtgggggttagaaattcccacattaatcggagaaaaagaaaaaaaaagagtccaagtagaagtacaatttaaaaatagctgaaattcggaattataaaaataaacaatattgaaagaagtttccatataagaacccaatacgagattaatcaaaattcgaaataaaaataaaataaaaatccaaaattagaaaaggaaaggagagtccaagtagaaatacaatttaaaaatagctgaaattcggaattaaaaataaggaatattgaaataaatttccatataagaacccaatacaagattaataaaaaattgaaataaaaataaaataaaatccaaaattagaaaaggaaatgagagtgcaagtaggaatacaatttaaaaatagctgaaatttgaaattaaaaataaggaatattaaaagaagagtccatataagaacccaatacgagattaattaaaattcggaataaaaataaataaatccgaaattggcaaaagaaaataaaaaataagagttcaagtaggaatacaattctaaattagctgaaattcagaagtaaaaataagcaatattgaaagaagaatccatataagaacccaatacgagattaattaaaatttagaataaaaataaaataatatctaaactagaaaaactaaaagagagttcaaacagaaatacaattttgaaacaactgaaattgaaaataaaaaataaaaacattataataacacaatacaatattaactaatttttttaaaaaatctgaaattagaaaaagaaaattaagatttcaattaggaatacaatttataaataactaaattttttgataaaaataaatattattgaaagaaaagaccatctaaaacacatgacgagataaattaagtaacatgcctataaaggagtagagtggtggtggttgatacgagatataaaaattgttaataaatcaccaaaatagaatcctaatgacaattaaaaggagggacgtcaggcaggccgtgaagcaaacgtggaaaacggttgccgggacttctataaagtaaaaaaaaaacctcattgataatcatattcaatttttaaaatcttaatgacaataaaaagtagaagcagcgagcggggtgtataagagtataattgcagagccgccgatgattgacgggacttctagaaaataagaaatgaattccaacgatagttatattcgatttttagaatcacaatgataataaagatttggcggcggacgggctgtagaggggcatagtggcatcgtttgatgagacttctaaaaattataaaaaagtaaactgcaagtctaatttttaaaggtttggaacttctaaaaagtaaaaaaaaagcaaatgataatcatattcgattttaaaatctcaataacaataaagaagaaggcagcgggcgagctgtagaggagtacaatggcaaagccgctgatagtttggcgggacttctagaaagtaaaaaatgaacccaaacgataattatgttcgatttttaaaatctcaatgacaacaaagagaagagacagtggacgggccgtagagaagtataatggcaacgtttgacgggacatctagaaattataaaaatgaaatccaacgtgataataaactctaaaaactataaaatacaatttttaaaggttccaagaagaatgaatagaaatagtgatagattgagcaagcaaataaagaagaagatgacataaggggtagcaactggtgtgacttttgaaaactatataattagaaacacgaggatgataaggtttggtctttaaaatcttaagacaatgagatagctaaatagctatttaataaattttaagtaaaatcatactaaaaaaatatatgattttatttaggtgctagccgcgtaattgcgcgaaattctcatattaatcggagaaaaataaaaatagagtccatatagaaatataatttagaaatttaaaattatattgtcattttaatatatttgaataatacattgagaaaacatatatgttattatatgagagaaaatataatgatgctagccgcgcaatctgcgcgggccactatgctagttattattaagacatctcgaaaaggaggcaccacgttcgctgtgggggctagaaattcccacattaattagagaaaaaaagaaatatctacaccgttagatcgtagtgggtccagattataatggtgcagattgatcaatgaatatatggaaagaatcatacagcaaattgatttttcgtatccgtgttgttgtactaattcgtatccgattaaccatcgaagaaaaaaaaaggacatgcactgccatatatatatatgcatgcctaaatagctagcctagcactcctggagaaaatatggatggcgtcccggagagaaagcacaccaaatgtcatgcatttttttcaatagattgatgactagcacggcaaattggaagggagtacctgtcgtcatatttttcatcaaataatagtaagcatgtatttacgttataagtccctaaaattatatatgtaattttaacgtatttagactataagtctcaaaattattacatatgtaaatcccaaacttatatatgcaagtgatgtaagtctcaaaattataaattattggcgactaagatatagggttttcgaagattaattggtaatcctaattagcaaataacgtaaaaagtatagaagaaattagaaaaaaaaaagagcggagtgatagacacgtcatgatgaatcccaaaatttgatctcaatacgaattcgtagaattcgacaaagttcaggtaggaatacaatttagaaattactgaaatttagaattaaaaataaagaatattagaagcagtgtccatctagaacacaacaaaatattttttaaaaattaaaatttaaaataaaatacaactccaaattggtttttaatatgaattcgaaagagttcaagtagtatctatttatcatattattgaattttaatattactaaaaaatatttgttagatgatatcatgttaaaattatagtggttaaatttaacacaaaaatcaaatagaatcccagtaatgattaagagaaggaatgatgggcaagctgttaagcagcacaatcacagtggttggcaagagttttagaaagtaaaaggtaaaccaaaatcataatcacgttcgatttttaaaatctcaatgataattaagagggaatgcaacgggtgggtcatagaggagtacaatggcgaagctgttgacggtttgccgggacttctaaaaagttaaaaataaacaccgatgataattatgttcaattttaaaatctcaatggcaacaaagaaaaggaggcggcggatggactatagacgagtagagtggccgcttttgacggagacttataaaaattataaaaaacaaaacccaacgagacaataaactgtctaattttaaaagttccaaggaggataaatagaaaccctaatagatcgagcaagaaaataaaagggtgacaaataagtaagaggtagcgataggtgtgattttcaaaaatataaaactagaaacatggagataataaggttaggttgatcaaattcctaagataataatatagctatttaacttttttttaaaaaaataattttgtatggaagctagccgcgcaattgcgcggtcacccagctagttatattattaaaagaatagaaaaaggagctcccacgttcgctctcatggcctaaaaattctcacattaatcagagaaaaaaaaagcagagtccatatagaaatacaatttagaaatagcagaaattggaaattaaaaaataaggaatattagaagagaagactagagtccatatatacatacaatatagaaatagctgaaattcggaattaaaaaataaggaatattagaagaggagactagagtcgatatagaaataaaattaggaaataactgaaattcgaaattaaaaataaggaatattagaagtaaagtatagagtccatatagaaatagaattaggaaataatagaaatttggaattaaaaaataaggaatattagaagtagagtaaagagtccatatagaaatacaattaagaaaaaaaatagaaattcggaattaaaaaataaggaatattagaagtagagtatagggtccatataagaatttaaactaactaaaattcaaaataaacataataaaattaaaagtatagtttagagtccgtataaaaatacaatttacaaataactaaaattcaaaattaagaaaaacatgggaagaagagtttaaagtcaatataggaatacaagttagaagtaactgaaatttgaaattaaaaattaaagaatattgaaagattagtttagagtccacatagtgtcggtgacatgggatcaggagtatcatgactagaggtttgaggcagacgcaatcgcccacgtggcctggcaccctcgggggacgtcgggcccgagggtgatgtgttcgccctcctcctagtccccccgagggggtcgggctgcacccccctcggccccgagggccgaggcgccccgacccctcgtgggttttttgctccgcgtgtatgggttaggtgagcacagtggggctcacctaccacatttattgcggtttgactgagcgtgtcacgccgcatgcaacgtagtgcagtgcactcgtttatccggtctgtgaccagtcacagaccggtcagatcgcgggttaggtggccacaggcgatctgacacacgcctcgccccatcccgtcaggacgagggcttctaggcgctcgtccccagctggagctagcgtgttacctcccagagatggcacgttagccctgatcagatatatgccaggcttcatcctaaccattacaagcaagatgttgtgtgaagaagggcggacatgtagattgctaagctgacacgtggtggacaagaatgaccgacgtgactggtctgactccggtcatgtcgtcagcaggcggccacgattccacgtcgcatctgctcccggcgaaagtgggggtagttgtgggccgtcccatcagaaggtgactcggatggcaactatacaaatctccgtccatttatgaaaaggtgggggaggtccccacaaaaaagagggaaatggtgcatgtggtatcctcttaagatataaaaggaggaccttgcccaccgagagagggggtttttctttttcttggactgaacctttccagattaggaacccagaacaagggagaggctggctcatactttgtagctctttcacacacgaatccaccaaaacacaggagtagggtattacgcttctaagcggcccgaacctgtatacatcgccggcgtcttctgtgcttcctgtctcgcgaaccttccacatacagattgggagcttagagtctcacccagggtccccggccgaaccggcaaaggggggcctgcgcggtctcccggtgaggagccccacgctccgtcatctggcgcgccaggtaggggactctgcgagtgatcttctgagctctcgcactccttcgtgtgcgccaagctttttctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggctgaaggatccgcgacttcgacatccacaggaggtggagaagggcggcgagatggggagcgtcgcctcctcgtctacggcgacggcagcacgccccagggcgcgctccaagctgcaggcgcgctcctacgtcacccgcccgtcgtccatgacccggagtctccagcccaacgttggctggacgatgtggccaaattggtcatgactgcacggcagcgcctaggtgctggtgggcggtcctccgccaccaaggcctctggtgctgctaccaccggctccgcgtcgtcaagacggagggcacgaagagcggcagccgctgttcgccattcggccgccactccttcgtcgactccttcgacccgggaagatctgcgtggggggccggacgcccgcaccagcatcgagcgccggcgtaatgaccgacgtgctgcccacgcaacggagggcgcttcctcgtccagagtgtcacctcaacacggacgcgggaatcagccctccgtgcccccggttggtggtgtcggctgtagagcctttgtggcgagtcttcggaatgtccgttggcccccaaggttccggcccaccatcgccgaaaaatatgacgggagcgtcaaccccgccgagtttctccaagtctacacgaccgggatcgaggccgccgggggtgacgacagggtcatggcgaatttctttcccatggccctgaaaggacaggcgcggggttggctaatgaacttgccacccgcgtctgtccactcttgggaggatttgtgccaacagttcaccatgaacttccaaggcacatatccgcgccccggtgaggaagcggacttgcacgcagtacagcgaagggatgatgagtcacttcgctcgtacattcagcggttctgtcaagtccgtaataccataccatgcatccctgcacacgcggtgatttacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgccgctcagacagggcggcgtgataggaggaggaagaagaggtcagcccataccgacgacgagggtcatgtcctcgccgtcgagggcgctccgcgggccacccgaaaggggaggcctgcgggtgacaaaaagaaagaggccggcgctcccagcagggagcgcccaaccggcaagtggtgcaccgtccacaacacttcccttcatgacctcgcggactgccgtgtagtcacagaccggtcagatcgcgggttaggtggccacaggcgatctgacacacgcctcaccccatcccgtcaggacgagggcttctaggcgctcgtccccagctggagctagcgtgttacctcccagagatggcacgttagccctgatcagatatatgccaggcttcatcctaaccattacaagcaagatgttgtgtgaagaagggcggacatgtagattgctaagctgacacgtggtggacaagaatgaccgacgtgactggtctgactc

SEQ ID NO: 54314 - DNA, 1364 bp, Oryza sativa
acaagggagaggctggctcatactttgtagctctttcacacacgaatccaccaaaacacaggagtagggtattacgcttctaagcggcccgaacctgtatacatcgccggcgtcttctgtgcttcctgtctcgcgaaccttccacatacagattgggagcttagagtctcacccagggtccccggccgaaccggcaaaggggggcctgcgcggtctcccggtgaggagccccacgctccgtcacatagaaatatatataatttacaaataactaaaatttgatattaaaaataattaataactaacacgtatataaaatacaatatgaatattacacattagtagtttcataaagttattacaaaatttaaaattatgatgtcattttaatatatttgaataatataatgagaaaacatatatgatattatataagagaaaatataatgatgctagctgtgcaatctgcgcgggccaccatgctagttttaacttgtttccgttaacatgttttcaaactactaaacgatatatttcgtatgaaacttatgtgtaaggtaactttcaaacatcagataaatctttcttaaaaatttaaaataattaaaactcaattaatcatgtgctaataacactctcgttttatatgtcgtgcttaatcttatctttagcggatgcaggctaacgggaccatatatagagacaccgacgtgcaatcccaaggcgcaacgggcacagattgtgactggatggatgacaattaagcgcaggaactgcctacaggaaccgtgcgcaaacatttggccatgagtaattttacggtttactattttttctgttataaatttaatagtaactcttagtatctacatactgtaatggtacctttaaaaaaccgtagaattgctctttggccattgcgcagccgtaaattcatttcatcagcgcggacttcaagaaataggccgtgtaccggccagactaattaatgctcagcgtgctgtggtgcagaggtccagagtttggtcttcggtgtgtgataaccgtcatgtaggcctcattttgatgggcctcaatttccaacccatctacgtgttcagactacagaggtagcaagcagcatacggtcgcatcaggttgaggacgccgacgccgtcgccgttgccttgttcaccagaggcgagggacgacggaggtcggatcgaaggaggggagcggtggtgacgactgccgagaaaaaaaaggctgtggcttcgcgcgattgtcgacggcaaggggattgtcgatcccgatctcctcgacgatggctgcagtatcctccactccactttggcaccattgtcccaccgattgctgaccaagtg

SEQ ID NO: 54315 - DNA, 3618 bp, Oryza sativa
tcgcctctccgggatgctcatgccggagacgctcgcgctcgccgccgcctccagcacaaacctgagcccccgcaaacgcgtaagatcatccgcgattggatggagagtgcgagaggtttttttgcgagatgatctgatccggagttcgtgtttctgcgtgcagtattccaggtgcaggagcgccatctccgcgcaccagcacacgatcgggaggtggttccaccacagggacgggagcagcagcagcagcagcagcagggtcgacaaggcccgcgccgagcgggcgcgcgtgcacgccgcggtcaccgtggcgagcgtggcggccgccgtcgcggccgtggcctccggcgcggcgaacgacccggacgacctcgacgacgccaagatggacgccgcgctggcgtccgccacacagctgctggcctcgcactgcatcgagatcgccgagctcgccggcgccgaccacgaccaggtcgcctccgcggtggaggccgccgtcgacgtgcggagccccggcgatctcatgaccctgaccgcctccgcagccacaggtgagcaaccatgcatcacgacaggccttctctagctcctgccacgcatgccaaccccgaagcaactaaatcatcttcgagttctctcgcaacatggcagctctgagaggagcgacggcgctgaggctgagagcgcagcgggaggcgaggagcaaggtggcggcggtggcgccctacgagaagaccggcagctgccgcggcgacatatggtgcaaggaagggacgctcctgaaacgcagccggaaaggtaaagctcaaaaaaagcctctccttgacacggacgcacgtcacaacgtcgtcacgtcgccgcgcgcccaaactgagctcgatcttgggatggtgattttttcaattttctcatcaggcgctttgcaccggaagcgcgtggccgtctacatcaacaagaagtcgcaggtgatcgtgaaactgaagagcaagcacatcggcggcgccttctccaagaagaagaagagcgtcgtgtacggcgtcgacgacgacgtgcaggcgtggccggcgccgcacgcgtgcggcggcggcgccgtgcctcctgctccggagacggcgtcgtcggagaagtgccagttcgggctgaggacggcgcagggcgtggtcgagttccagtgcgagagcagggcgcagaagcaggactgggtggagtcggtgaagaatctgctccggcaggcggccggcgggacggctcagctcgagcactccttcgaatctctccggcttagcgcctcgtaaaacgtaaaaacccagtgaattcgttttcgtttgctgtaaaatttacctgtcgagaccccgactgcccgttcattttatcgcaaagggagcagccgagacgtttcagtgttggagctgaagaataaatgtgcatacttgtaataacatgaataatttgtataaggatcagtagataaatgtcggtgttaagattttgatgtactgctctctttacacacgccactcattacctgtttaggtagcaattccgctcaaaaatgcaaacacgcagtgataagtagtactcatatgaattctgaaggcgttttttgacctttcagtcagggtctcgggggagagcccattagttattgaccctcttcatttacaggtatcgggggaaagcaacaatttttgcacgctaccaatcgtgcatctaactgatagcactatagcacagcgcacaaactttgttgaacgtctcgcacgagacggtgcaaagttctattgatatagcagaaaaaaaaaacgagattacgagggtcgtagccaggaaaaaaaattaaccatcacccacacaccaatatcgccaacacacaagcccaggagaaggctagcaccagaccagccgccgctaagcgtgactgaccgccactagatcaacaaagctccaccaccacactagctctgccgacatgtgggacccctgcaccggcgccccccgccggccaaccttcgtgcgccggagtccgctccacacccaccggcagctcctcctcgcacctaggtcgcctcctccaccgccggtcgcgcctctctgcaccaagccggcctcctccaccggatgcgcctcgcgccaatccggcctccctccatcggctgcgcctctcgcgccaagccggcctccatctccgccgcctgcgccaagccggcctccatctccaccgcccgcgcctctcgcgccgagccggcctccgctgccatcggctgcgcttctctgcgccaagctgatctccgacccctccacccaacgatgccgcgccggccagatgcaaccgtctcccacgccctcggcaagccgtctgaggccgccatgcctctgatgaccgccacggcaccaccaccgcagccgctgctgtcgaacactcagccacctcgccgtcgccatcctcgcctcgcacctgactccttccgcgccaccaacgttgccaccgcctccacagtcacggccgccgcgccgctgccaccgacgcgaaccaccgcctccgcaaaccgtcgttgcgccgtcgccctccaccaccaagcagccagcaaccgccgccgccaactgccgcgaccacaccgccgccgctgtcgccaacaggcgtcgccagccgaccaccaccgaccgcacccagatccggccgagagccgccgtggacgttgcagatcgcgggcgccgtcggcagccaccgccgccggcagcaccacctccagaagctcctgccgacggatgtcgccgccgctgccgccgcgacgggtgcccctgccacaagcttgccctgctgtcatcgccacgttgtcgcgagctccgctgcccccgccacgagctagctcgatccggccgccgggtggctagatctgccttcagcgtggccggatccagcgcctctgccgccgtcgccatccccgccgccgtcgacccagccgcgtctctgccgacaccatcgccttttggctgtcaaaccttacaattcgaatttaaaattccaccccctctctcgaactgagctattccgatgataaatcactaggacgacataagacagacacataacctacgtaccacaatttcttcccgccgccgtctccatccctgccgccagccgccaccccgccagatccggccgaggcggcgcggatctggcggtcaccgtcgccactgccctgggttgctcccccggccgcccggacgagatgaggttgacgagaaaatgaggagccccgccgccgccgtccttgcggccgcgcggctttgccggcggccgctcaggcggcggcgaggcggaggaggaagatgggggggaggggcggccggagattgacgcctcccgtgccacctctgggggagggcgacgcgagaggaagggtagaactcgcttcagaaatagtgaacttttgtagctgatggcataagatggtcattaacataaattactcattcgatctcaagtaacaatgttcatacaaagactatagatttcactcaagtatcaccttggtttccaggtacaaattgctcatcttactcctaactagatgcaattcgaagaaactaatatagaaaaggctggtaaggagttgt

SEQ ID NO: 54316 - DNA, 2428 bp, Oryza sativa
ccacggtagcttgctatcgggctctcgcgtgtcgccctagcgttgcactactgcttgggcccggcgcaccccaaccaatccacgtttcaaagatttgatctgctcatttagttttatagattttcatttgttataaatatttttttcaacttgcctaccgcagcgcaatgctgaattgctgcctgggctgaaaattagtatatcaaattagtatatcagtataatcaccggatggacgggggcatttttcctggtcgattagtccatttccgtttccgaaccttttggtcgattaatccgtttccgaaccttttctggtcgatcaatccagttccgaacctgcatggctgttattcgatgactcctgtttcttgactgtgttattctttactaatccctctcgctgcccgtccgttctatcgcaagggcgtggtgttggggctgaaggaataaaatgtgcatacttgtaacatgaataatctgtaaaaggatcagtagagatgtaggtgaatcactgaaacatgcaaacgtgcagtaatatctcatctgtattccgaagacgtttttgccctttccgtcagggcgtcggggaaagcccattaggcccagtttagttctcaaattttttttcccaaaaacatcatatcaaatatttggacatatatataaagtattaaatatagataaaaacaaattaattgcacagtttgtatggaaatcgcgagacgaatcttttgagcctaattagtccatgattagccataagtgtaacagtaacccacctgtgctaacgacggtttaataggctcaaaagattcgtctcacggtttacaggtgagttatgaaattagatttttcattcgtgtccgaaaaccccttccgacatccggtcaaacgtccgatgtgacaactaaatattttcttttcaccaactaaacaagcggcagttattgagccttttcatttacaggcagtggaaagcaacaatactagactaggcctatcaatcgtgtatcgaactgagacagttcacaagctcagctacgcaaacagagcaagagtcaacttttgtagcatggtcattaacataaactactcattcgaggtctcagtcattatttgacttatacttataatttaaaatttaaatgttacaacttggagtaagtttccatttgttttcttaatcatagtttattttacttcatttgcttttcttttacgggtcacgaggacgaaatgaagtgacacacttagtttttttctcgaacacgtaaaagtattacacgtcaatatattaaaagaatagaatgacacacttagtcttccgtgtcaatcttgttgggctaccttggaggcaacgcctcagcacttccgcaaccatccacacctactcgtcgcctaaaaacacatatataaaagttttacttataaataatctttatttgctaacaaacaattaagtgaaacaatgggttgctcgatctcaagctacaatgttcacacaaaaactatagatttcactcaagtatcaccttggttttcaggtacatagtacgtaccattgctcatcctacccctagctagctggacgcaattcgaagaaactgatgtagtgcacgctggtaaggagtccaaggactgataacctcagaaaatccaaacaaaaattcctaagcaaatcctaaaatccaaacaggtaggagtagtgtttaccatacaccattccacgcagctaactcaatctacgcgcccacagggccacagggaccgacgctactgtctcttacacccaaccccaacgaccaaagcgggggagggcggagctagtatatatagggaggtgttcaggaaccggtcaaaaaatttttttaagctatatatcatctattttcatcatgtatgcactcgtcttaatataaacttagacacccatatgagcttaaactcgatctaaaatagaataaattaagcaagtggcaacatcctcctttacgctttagcaccgcccctgaagacaccacgaaccgtccagtaacaaacataaaaaaacagctaacgacgaacaaaagctacagataaactaatcgcgagatcaggagagtccgtaccagctgacggaactggcgagcagatgagcggcagttgcggcggaagaacgaggatgaggacgacgagagaaggctcatggtggggctcatcggcggcgacctccccggtggccgtcgtgctacacggtatcagggccggattagtggggcgaaaaaaaaatccagcagctcagtcgtcgtcgattcgctcccggcgtcaatccgggccggacaagtcaacaagccccgttccacatctcccgagccagccacacccgtccgatctcgcgtcgcgattcgtgcaattccgaccggcaaaggccacgtgggcggccgat

SEQ ID NO: 54317 - DNA, 6031 bp, Oryza sativa
gtgccaggatatataccgtctcggcgaacgcgccgatggaaccttcgcgagcacccatccatgcatcgatcagacgttgttgttttacgcacgtacgctaccttcctcgtcgagccgccgcaccctctcttctcgatcgtcgcacgctatccaattgcctcgggcatggctggctgcggtttcggcgccgcacgtcccgctccccgcgcgtacgcgtacgtgtcagctggtcgcgttacggtttcgatacaggcgcggtgcatggtggcgtgaagacagcagccacgcgcgctaggccgctagctggcgtcgttctgagttcgtcacaagcaagaaccaagtctcgtatcgatcccgtgcgtaaatttgattggttttgcgcatgtttttgtaatgataaatcgactgagaaggttaaattagcgtggtgctagtttgagatttgcgcacgctgtagctgattagttggtgctttctgctcgtcgtggagacgcggagagtatctgatccgtgaaagcaatggcacgtgggtggggcctgaaaaggtccgtcgtttaggttcgctgtgtgcctgtgtctgacaaatcctgttttatgagtagtactccgggtgcacgtagcagtcaggtgcagcaagcctgcaaagcgacgtggatgaattctaccctatgaccaggaagcatcaagcatggtgcaacgaagagccaagggcatggaaaatggttgctccacgtaagctgaatgcgtggaaccaaacaagaagattttaattaatttcgagtaggtgatttttttttctgtttcgtattttcaatgacgagcacaatacaagattttttttcctcaccccaaaaacgagtggacgaataaaatatgctactgggatatactttttttataaatatcatttgagtttaccttttaaacactatgtggaaaaatgctcttgaataaaggagaaaatattggggagggtttctctgtatgcgtgatgagagagagaagagcattatgtgcagttctttttcttattacgctcaccgcatctatgtatcatctttaatccagtttagttatgcgatttacaataaaaccattatagcagctacaacaaccaagtattgaaattcatttgttgacgtcggtaattgtagttgtcgattgcaactgcattgcggacatggtaaaacataaccgagcaaactctttatgagattactatttgatgagagtttcctcatcaacaaaaatttttgatcaatggagaaagagaggagatttctctcgttctccgcgcacacgcttcccaaatgttaaaatatcatattaatttatttttaaatttaaataattaatacttaattgattatacaacaatgactcatctcgttttaggtatcttttcaatattctcctttctccttctctcaaataatctcttagttatcgacttgtaaatgaattgttttttcttaacaatgtcatactactcttccataagaaaataatgaaaatacttctaaaaagttatatatatttgtcacatgtttatcatataaaagtagtagaagagtagacaaataaagcaaccaataggcatgctccaattccacaagaaaccaaacgaggagctacaacaaggtaggaattgtgggtgaccccaagcaatactccacctccatccagatattgcaactacccttcctatcccagtcaaaagccttcaaaaatttattatctccaccacatcatcacaagccgcagcagtcagaaaaacaaggggaagaagagcagattggattagcgccgagccgaggcggcctcgacgataagcttcgcctcgccggccgccgccatgcggaacccgcccgggaggcacctcctccgcgtcgccacccgcgccgtgcgctcctcgtcggcgctcggcagcggcggcggcggagggggcgcctcgacctccgccacgtcccccgtcgccgcctcctcctcatccggtggccgcccgcgcacccgctccggcggccgcctcctgcgcgccacctcgccgcccccgccctccgccatcgccgcggccgcgtgctgggagtcccgcacgatgcgccgcgagggggaggaggagtgggaggaggtcgtcgccggggccgaggaggcggttcatggggcccccgtgcctgttgcggaggaggaggaggagtacagggtggtgttctggtcgccgcccaccggcgacgaggtccgcgcagccttcaccagcatcgaggagtaagattcgtttgcctctcgcttaaatcctcgcctaaatcaggttgctgtgaatgattatgtcagttagttttgatcgaattgattgatttagattggaaccgtattggtcatatgcgtttgatgcgagaaagtcagcgaaaatctgttgtttgtcgttagtagtgttcaaatccgtgctccagtggcaggttgtgatggtctttgtcgtgtgctgttcaatgtttgcaattggtgggtttggtttctcctccataattggatgtgagcctggggaagcatcgtgtacttccgtgatctgcacggacagatgccaacggaccttggaacacttgccgtgcagagttcatgaatgaacaatcatgagttcgttaaagggcatacgtttcttgaaaatttggactgttccatggcatgtgctgtagtactatacctcctccgtcccaaaatatggcaacacagttaacacaacctattagtacgaatcaggatagagggtaggttgtgtctaattcagtagctatattttgggacggagaaagtaggtgatttctgaatggaattttaaaggattaaaattggacaatacatggatccacctattgagggtatcaaaattcaagatatatacctgtagttacatacagaattatgactggaaaagtagtaacattcaagatttgcttgcagccttttccaatcccatggctgagtttcttatacactttgggtttcttctattattcagaagcgacctaacaaactgtgttcttgtcataaccgatgatattcatgggcttatggctacacaaaagatcaagtttgctatcttttgttgaaaatggatctaaactaataaactaatctccgtactgtactcatataatcttgaagacaagaagaacattgttttagatggagctgtcatacaatatactgtcaatcatctatgctgaacatgagccatttagatgtagtctgtgttgtttgctccatctgatcaggctaccatttgcattcagggtatttggtgatccttttcgtgcgcattcttatgaaactgaggagcaatcagcattgtccacctcagtacattcgtcatctggcaattcatcaggatcagatgactggattgaacctgctgcctatgctctcaactcaactgctcttctgacaagggaacatagaaatgttttggatgccttccgtttattgcaaaaagatcctaatgttcaggtgagaaagatataaccaattctgatgtgcgctgtaacaatttattatgttatatcagtttattgcaaaaagatcctaatgttcaggtgagaaagatataaccaattctgatgtgctctgtaacaatttattatgttatatcattatctattgggacatgtcatttacatagtcctttcaacttttgctccatctattgcaaaaaagatcctaatgttcacctgaatgagacctaacaatcttcaggtgctccagaatgtttattactttgtatcatttattctcaattggaacatgtcattttacatagtcctttcaacttttgatgtacttttgctggcttctgtccgaagttctgacatagaagttcatgaacaattcgtctctgcactgactctgctaaccttgtcttcaatgcagaaaatggtcatgtccttgtcatgcgacagggctgtatgggatgctgttatgaacaacgaggcagtgcaagaattcaggagatctttccaggatggtatgttacactaaaattttcatgtttagatttgctggtcataagcaatactatttggccttctcttttttccaaaaagactaacttgtcacagcaatacagcatcattttgatgatccttttcaccttagtactgcaaaacatgcaaatacttacaaattctactgatttatgcctttacttcctagctgttcattgtaatctacccatctttcagacaaagaagcagcaggtagaaagggaaaccctggtggtcctgctggagtgcttaagtggattctgggcaacacccaagcaaaaataatggaattcatgaataatataatgaagattgtgaacatgcttttccactctgatgatgatgaagcgaagcccgacctttacactgatgcagtgaaggtgtcattcatgctctcagttttcatcttcatcgtggtggccattgctcgtatcaagtgagcacaacaatccgtcgactttacatttcgttgttttgtggtctcttagctatgcgcaggagcacctctattcatcttagtttagccaacattgatgccaatcctagtttgtcaggctcagaagtttaattgcctgtgttggaatcatgattttatcatagtaaatctcaatatttaagcttcccttcagtcttatctcattaaatttcctggtgcttttgaacacagttttgagccgtgggatttcaaagtgtggtgatgcaagattctgcaagccgtgtgtgcatgttttgtaggacagctcatgatttccaagctatctaacttaaattcacacgaaattgtacatcgatgatttctgtatcatttgaccctgttagtctgttgtaaaggattggtttgtctgtgtcccattttcactgggagattaatatacttaagaatagataaatagttccgcttgcttggacgatgggttggaactcgcccgtcgcgttgccgccttgcagcagcaagttgaccgtggttgtcaagcccaatctctgaagctaccttccccgtccacgctaagaatgtcgagcaacaaatccacaagcacccaccaaccttaggtcaaatcgcaccaaacaaagcatatgcgcttatgtttggaagtttgaattgacactgtaacttttcatccgaataaatctgcaccaagattgattgtgcactcacaaaattgaattctgttttcccttttcatcgacgtttctcatagcaatgagattcaagatcacatttctgttacatccaaagggtgcaaaaccatctggttccaagatcaattccaagttcgaacaaccaatcccccaaaaaaagatgccaaaaacaacgaagaattgaattaaccatgcttattgcctgcccagaaattcagaaattcagccagtgatcatggtgccggtgccctcgtcggtgaggatctccagcagcagcgagtgcgggacgcggccgtcgatgatactcgcggtgtgcacgccctgcgccagcgcgcggacgcagcactccaccttggggatcatcccaccgcccaccttcccgtcggccaccatctgccgcaccccggcgatgtcgatctccttcacaaggctcccggggtcattgcggtcggcgagtatcccggacacgtcggtgagcagcagcagcttctccgcgcccaacgcggcggcgatctcgccggccgcggtgtcggcgttgatgttgtaggcctgcccggtctcgtcggcggccacggtcgcgatgaccgggatgtggccggactcgatgatggggtggaggacggacgggttgacgcgcgtcacctcgccaacgaagccgagtgcggcggcgtcgggggaagggcgcgcggtgaggaggcgcgcgtccttgccgcagaggccgacggcggtggcgccggcgacgctgatgagggagacgagctgcttgttgaccttgccgacgagcaccatctccacgacctccatggtgagcgcgtccgtgacgcggaggccgttccggaactgcggctcgacgccgacgc

SEQ ID NO: 54318 - DNA, 3471 bp, Oryza sativa
gtgcggcacagtgtttgggtacttgtagatggtggccggcgggcggagtaggtgatgaccgggctcccgagctggtgcggtgcgcgagagcggctgcggtttgacacgagcacgtgcttttccttttggtgttggctataacaagggttaattggatccatgccaacttttttttcccacctctcgcaggcgcagccaaaaccaccgcaaatagttaaatgcccccaaattctcccacctcctcggcttgctacctcaaatcgcaatccggggattaggctgggggttggtgcctttccccttcgcctcgccggaggagggattggtacggtggtttgggcgcattgggaggggtggttagggttcgtatcatggagggcactgatgatcctgacccggagcggcagcgctccagctctgttgcaccggcgccgcctcgccggctgcggtggcagccaccaatcggtccgtgcctcccccgcgctccgacgaaaagaaggtacaccctcgttcggaatttagtagttccttctcgcttgatttctgggtgaaacaagtaggatgaagtgcatatatgtgttgatgcgttcaaatgttcaagtttgtgacttcaattttgtttggattttgcatctggtattctggttagcttgagtcaattgccttgtgatagttcgtgaatccattggagcttcttagcatcagttattctactcatcacttcatagtttgaagggagagcttgcccttgttgtatattcctctagttggttttcagagaccgaatgctaaggccaatatggcaaggaaaaaatgggatgagaatccccacggtgatttatgcccagcacgagaaacaacagatagtatcattctaagatgtcaagcagctgcaagattatgggaataattaggactacttgatcttgcttaaaactcagaatcagtagagtaatatgcttcctagaggatattatcaacggcaatcaagaattcagggaaactgacgaatatggccaatctagcatgtcatcccaaaatataagtacatgccacaacgaatatacagagggagtgcatgctgtgagttagagaatttttttgagaattaatattatttttatggaaaatcgcaaaagtagtggtcaaccggggaaaatcgcgaaaataggtccctgtcgaacggatgcagttcgatagggcgcctatcgaacggccagagcgcgactggcgacgagatcggaaggctgccgttcgacaggacctgtcgaacagcccccgttcgacaggcagggctgtcgaacagcccccgttcgacaggctgggctgtcgaactgccgcagttcgacaggatgtccgtcgaactgccgcagttcgacagggtcgcgttctccatttatttgtaataagttatttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatacaaatagataagtcaaggacgatcagtgcccttcgcacgcttgctaggtcctcccttcttactacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcactccgtgatgcgtcgacgccgaaccgtactcatcgtctgtttgtacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgactgtgagatgtgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcacggaagttgcgaaggacactcgccacgtcgtcagacctggaggtctcgcctctagtctttgcagcagggtgtcggactccacgtgaacgtgctcaacaaattccgcctgttccacaaataatcaaggcaattaaaattatttaaccagttgcacatttattaagagtatttaacaagatgcacatttgttagaaataatgaaccagttgcacatcatttataaatactgaactagttccacatactaacatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctctccggcctgctatcccctcccctcgctccctccggcgctcacggcgacgatgtggcgactctcgacggcggctggcgatgtggtcctcaaataaatcgaacaagcatcgcgggctgggagacggggctttaaaccggcctgtcgaacgcccattgtttgacagggtcggtggagggacctgtcgaacgcccccggttcgacaggcctggcggcgcggggtggtgggccctgtcgaactccctccgttcgacaggcaagcgtgtcgaacgccagccgctcgacagggctctgtcgactgcccgtcgttcgataggtgccctatcgaattgcacccgttcgacagggacctactttcgcgattttccccggttggccactacttttgcgatttttcataaaaataatattaatcctcaaaaaaattctgagttagatgggagataattcgaaagacatgttcattatttctgctaaggaaaattatggtga

SEQ ID NO: 54319 - DNA, 5473 bp, Oryza sativa
gaacttgggagagaacaattgtgatatgccaaatgccatattgccgccatttactgaggttaccaggtcactcttgtttatgacacagaaaataaactgtacttttttcctagcaatcatgcagttttcggcttgtatgattgctgcactctttcaaatggagagttattttgttacttttcactagcctgccaaaggatgctcaaactacatcatagatttgcaaaagagatgcctgatcattaaatgcacttttattcttgctaaagggtattagtgaaatgtgtcaactgccaaagggcatattaatacccttgacaatactttgccatactgatattctagtgttctctgcacgcaataaacagtaagtctcctgctcatgcactgtttgcccttaattccagcagtatggtaaagttgcattaacgcgacactctctagagggcatctcgagccttttcgagttagaggtaggatcatacgcggactacctcgaaccagcgttttagagatggcccacaaggcctgcttctctccagagaaatgcacgagaacaccggttccgcgttgtatacttgaattttgctctcctttaaacaaatgaagtatctagcttcatagggctcatcttgatgtttcttttgtgccttttgtgtacttaagtcgcattacttcctttcaatatgctgttgaacttgtagatttcacactattcttttttgttgacggcttggttttgctatacttcaatgcagaaatcaaaaacttttggaatagctagaagtccataagttggagtactgttcccttgggagtaaattaatgatctaaaacagcagcagagtgctaataatgagacccttggtctggttaacaagccttgggagaaggctagctatacttctatgtttcctttactccaaaaaaccacaagtcttcaaacatttaccaagtgtttcatttgaacagcttgtgatagagttgtactatgttgtttctgttcacagaagcagtagtccttgctcagaattctgccagcggtaatcaacgtagaatatgaaggaataaggcaataagcctcccaaaaagcatattcctaagcatgtgactactacagctggtttttttatgatgctaccaagtttctggcgaattcccagtcatattatagtgtatctaggttcctcagtcagcctgagtaaaagttagcctgggcaaagaactggcaaaaaaaaaaaaactggttattggcacttgcagtttgtgaaacacactttctgttgaatgaacgaaaaccttgaaagcgcttgccccttttgttgcacttgaatctgcctatcacccaaatttatcttgttcgtttagcaaaaaataatatctacacagtagttcttcacattgttagcgtgataatatgtgctgaatttttagaaaatctaaagttagtaatgcacaatatacatgttgggttgcttagtaaaatatatacgagcaatcatcacctgtgtaagttctaaagagggacacacggtcatgtaagtcctgaagaggtcatgttagcttgatttataaattgtttggatcaaagaagaatatttcttaatgagttgtgttgcaatcttattgtttttaaatgttactgcagatctttatggaaggtgtcatagtgaaacaggttgaagatggtttgcatttagtggtatacaccttgcacaggagttgcagcaggcaaacagcatggtggatctctacaatgagacaaggtaatgcataaggatacaaaaaatatgatatgcttagttgcttacgggactgatgaagacacggtttctcctaagtcctaatccatttgcagttaaaagtttggttagatgtggtagggatctgtttcgttgggcaatgctcaaagaaagatggtggactttttttttcgggaatacgcaaggagcgcattttttccattaagagaaataaaagttatttacaaggataaaaggaaaacaagcaggggaccgatacaggacgctatggaaaactataggaatatctcgcactaaatttggctaccacgacctcgtaaaggccaaacagcggggatcccgtgattagccgacttccaaagcatggcctcctccgccattgctttcgccacttcggtccaagacctttgttgttgattgaagatttggttgttccgttctttccaaattgtccaagccatcagtgtcacgacggtgtcgaagcctcgacgatgccgctccccaatcttcattcggctctcacaaagccaattgtggaaggatggctcattgacaagtaagcagttcggactccttattgcctgaagcgtccaccaccataattgtctcgattcagggcatgctaccaagatgtgatcaatgctttcctcgtactgatcgcaaagaacacagcgatccgggtgtggcaaccctcgactgcgcagacggtcagcggtccagcatctgttaattgcgaccaaccacaagaagaagcagcatcgaggcggagcgagcgacttccaaattggggtggaaaggaaggtgacacgaccagaaaacaaggccttataggcggattttgagctgtattggcccgaactctcccatttccagatgattgaatcaggagtagtaggatcaagatccaccatttggacaagcgaccaaagctttagatattctagaataggctagatcccaagtgctcctcggatgtctttgatccattggcgacctgttagtgcctcaaccaccgttcgacgccagcgcacgcgtggtggaattttatcatagatgttcggagcaatggaccgaatgcaaccctcttgcaaccagctatcttcccagaagagaatagtttgtccgtctcttaattaacagacggtagaggctgcaacgaagttcgtttccttttgcgaccccggaatggctagcccctgccaaggtttgcttgaggaggaagatggtggacttacaggatgaggctaaaatattgaggtggtcaatggatcaaacaagccaagatcaaagaaagattgattggaataaatttctggtctgcttatagaattatataaggaaagataattctgtgagatgtcatctccaccctgtgacaccttccaggagatgaaggaatagtgaaatgtggtgtcggccacaaccgacagaaaaatgtgaataatcttgctccatttcttataaacttggtcatcatattgaatctaaaaacataccctttaggttgtgatcgaaaagtgttactaccttattttcggtgctgaatgtgtgcagaagtcattcagaaacagcaagaaggggtgcccttcctgtggatcaagcttttgggctagtgatgcagcctactcctatctgagatgctgcagatgcagttgcttgtaaagtgattcgaagtggacttattcctattttggcatgctgttgggttttgtagaggagaaagacccattgtatggcccaacttgttgggctttgtagatttgcaggccggctgtcgttggcatgtgggatgccaatgtggctagctgcatctttgtgaagtgttccttcatctcggaaccactagcagtcttagcttccttatacacattcaattgcttgaagatcctatgaaagagtgatgcatagtgagtccaaaacatgtcatgcatggtatactcctatagttctattgctcctaatggttgagatgatggaaaggtactggttctgtctggagtctagattttaccgggtacacggttccagttttttttggctgctagccaaatcacatcaaatgaatttctttagcaacagaatttgatttgtctggcacgggcaacttggttgataagcttggatgcatttgtataactcatgtcacgggcttaaatcagcgtattatggttatggctgatcacttgccagcagaattagcgatgattcgttgttccgggtggaccctgttctgtaatttctgactttgttacaattaaggtccatttcctgacgagagctcattgatggctttcttgtgcctttgtggagacaggttggtagaggttgctgagggcatcaaaacctttctccctgtttcctttttctagtactggtacgcttggtgttatcgagtttatgtccatgatgccctacattgattgctggactgaaggagccctgatacgctctactgccacgcctcgccaagataagatggcacttttgtttgtaagcttcctctgttgtttctcccgtggtgcgtgtcgtggttgggtttcgacggccagtcggccagagaagggtcgtgtcacgaaaagccttgcccgcactttgaactgtcgcggtagcatcattcctgctttgacccctgatgaagtcatgcaatccatgcatcgcagctagaggcgttcactgtgttccgccttattcgagctcgtgctcttacttggtccttgaaaaagattcgtgattctttttttcagttgtacctgagatgctcccattttcagagcttccggaattttcagccccccccccccctaaaaaaaaactaactttgcacttggattgtgtttggttcctgaaaaaagttaaaagtttgataaaagttggtagtttggaaaaaaattaaaagtttatgtgtgtagaaaagttttagatgttatgtgatggaaaattggaagttgagggtgatctaaacacggccttgatgggaaacaggcaggagtagaatggtgcaaggtaggtaggtgtgcaggtaggtaggcgtgcgcggcgtgatctgaccgcgaaattaccctcgcgcaggaaccgaaccaagctagttgtgctccgtattcgctgcaactgtgaaacacctggagcatttgactccatacgcacgaggaggaagtacgcgaggccggccggccggcctgccggctgccgacgctgtcgcggcggcaccgattgatcgatccgtgggcccgcgaactccactcctattccggctaacgctatagctcgatctaccaccagccaccgcaccggcgcaccgcaccccgtgtccccgtggcatccacattaaacgccaccgtccccgcaacagccgccggctcgggtgcacgcgcgggctgaaaacagtcggaaacaatactcgatcggtaatggaacatatttatcatttaaactactcagtatcgatattaatacgatgtaaaagaaattatgaaaaaccaaattttaaaaattaagaaaaagtacggtcagaaacagtacccatattacgaaaacgtcgttcggtcgatcgggaatttcagtatctgttttcaccccatcatcgcgcacagccggcaagcttgcattggctccctccgatccctctcctaccaatcgcgacgatttatcgaggttgattcagcgcgcgtcgtcataccgccgtcgcgatccgcggcacagcgagtagcatg

SEQ ID NO: 54320 - DNA, 11665 bp, Oryza sativa
ggtcacaaatcacacaattatttgtagtactactctcagtctcgtttatacgtgctgaaagagagtgggacgataaatttcacaggaactttattgtatactagtagcctgtcttttattgatcagtttactttcggcatgaagcatagaacagttccatgcgtagctgtaaaacgctcaattcgtcatgtactgaagcaaatgaatgttcaataaaatcaccctggtgtgtatcctgggaacagggatttttgccatatatgctctccaatgatcgttcttcaaaagacccggtacactgcacacacagcaaatttattgtgcctagctaccggctgtcctagcttcctccaaggctccaatccaaagtctcccccactgtttgcttgcgcatctgttgaccccaacacattggtgtgtttgaggaggaggagatagagaagattaaaaagatatgtaaaacgagttgaatcattagcgcataattaattaagtattaactattttaaactttaaaaatgaattaatatgattttttaaagcaatttttctatataatttttttaaaaaaaacgtaccatttagtagtttaaaaagcgtgcgtgcggaaaaggagtaacaatcttccctatctcccctgaaagaacaatctcccgttagtagtactgcatggcatttggcacgggatgcaacgacattttgatcgagctgccattctttcggatgggctctcttaatttgttcctcttttaccttttggttcgttcgtacgtgaagccgcgatcgatcgattgatccataggagtctggaccattaattcctttactgcctttgctgattaggatgatgtctgcacatacatcgcccttcttctaacaaaacaaagaaaaattcctcacccggcgcgtcttcatcttcttttctgtgcctaaccaagtagacatcggatccccatcgatcatccagcataatgagagagagatggactatatgcgtagttgtgtagattttcttgccgtgctcttattaccacccggccgtataatgcagcaagtaaagtagaagtatacacagtattgcagttaaaggagtggacgcggtgctgagctttcataccactcgagtacgtgctcaactattgaagtttcagtactcctcgcttcattccctccctctatctcatctgctcatttgctaggtgctctcttttgtgggccatttttgagccctaaccatcgtccgcacaatcacaaggaatctaatctttgaatgcctttgatcctcgtcattatgcatcatcctttattcaccttgtctctacgtgtagtatagtgtcgctcccatcagaaactagcagctgcctctcagtagactttaatactggtgcagtggtgggttgggtaacgcattcttttcttacagtactagtacctcatgcacacaaacgtgcaaaggattagtattaccctctatcatatggcgtgcgtgcgtgcttgctagctagtcatgtcagtctggtttagagatagaggcaggaggcgcctatggtgcaaaagaaaaggaggaaagttaagctgtgcgtggcgtgcatttgctcgtacgtgtatgtgcaccatcgatagggcgcttgcagcctttgcttattaggcggcttgtccgttggcaaatgctgtagtgcaccaattatccgttctttatttacatgctggtcgatatgcatgctatacgatccaatgagtataaggaatggacacgggttactcattagtgagtacttgttgacccaatattgcagctgaaattaaatcaactataccacacatttactccctccgtcttgaaataggttcatttttaactattttcatttgttccaaaataaattcaattttagagaaatcattgcactacaatttgtgaaaataaaaaaataattgtttcgagagtagataaaagtaggaagtagttgcattgagatttaataaaataaggtattctaatcttttaattttgtattggtatatttaagatggtgaaaaatatacttattttaggacgcaagaattatctaattttgctcattttgtttgggcatcgatcatctgcaaaccgtacctgtcactgacatgtgcgtcccatttctctaagcccacagatcagtagcagtaactgccactccatcctggtttagtatctgcttaattggccgagttggccgggtacatacctaacaagcagcagctagcgcgcggtgtggtacctagcttggacagcgaccaatggtactgtttggcgacccatgatgatcactggccgggccggcgcgcatgcatgatggtgcgccctggacgcattcggtgtctcgactgcgatcgccgcggacgtatgcgcgtggcgcgcgtaccgtgtaccgtaccgccgctggagagaccactcgtacgcttgcacgctgtgggcgtagtattgcagccggccggccgcgccagcgtacgttttgtccttccctaagaccatttccaacccataacactagatataatttccataaacttcacatcatcgagaaactagtactagacactactcttccaatgcaaacaccactatttcatgcttcaatttaatgttacttatctcacatgatgtcttggatgttgtgtagaaatcatgtctcgcatggtttccttctctttcctcatttattcacttgccacatcattttttatcctatgtagcagcttatttaatgttatggacaccatcctagtcattgggttgggaatggcctaatcatgtacccctcccatgattaccccaattaatatggagtatatacgcagtgagcgagcgtaccaccaaattgaatgaaggtccccggtccaggacgacgaacagcttaattaattcactgcgttaattaatttttgatgatctcgatcgatccgtttcgttggacacagcacagcggcgtgcctggtagaagaatgtactagtaattctttgattggtgttctaaaaaaaaaattctttgattggtctgatccgacgatggatgtgtgagattgtgagctgtgtgtggtgtgtgcgcgaatgcgaatcagcgtcagaaaaaaagaccgaagaaccttgaggggagaaagggaacatcatatcgacgtcgatctctccatcatcttctccatttccttatacgtactactagctttgatcacgtcgagacttttgcgccccgaaaacgaatcgacggcgccacggcggttgtattggtcgcgtggctagctaccctttgtttgtcgctgcccctgtggctttgcgctttggccgtacgacggcgacgacgtcccggccggacgacatgctgcgtgagtgattatttcattatttgtattttgggagtggtttggagatgaccatcaaagggtggcgaggtctatcgtactacatggaaaagctagcacggcgtacgtacgtggaattgtgggcgacaacggatttgttcaggtgatagcgagccccctgacgcggacataacaacaacagcaaggcaaattaatcaaggcttctattggaaatctacgttacggtaggaaacgtatccggcggggacatacgtatattaagaaggaaacgtgctgctccttctagtagtacatgttttctgttcaacttttcgatggcaaagcttagaaacaaaagttaaatccctttaactagtcctaggtagatacagacatactttgtacagtagtatatgtgctatgctccgtactgtcacagtagatggcagtcaatcgttgtagtactacacaggagggagttcatcacgccagattctcgcgccctggaggaggcgacaaaccaacagctggcacgcccagcagccggccggcgccaccgctacttgttgtggctccccgcagcgcgcggcagctctctcgatccatttccgatcgagccgagcgtgactacgccacgacagacggggatcaatcaggagaaaaatcaatcgattacccgtacatacgcgcaggcgcacgcaggcatcagcgcgcgggtcagcgtagcgaccccccgttttctctcccactactcgtgccgcgccgcgccgctcgccgctcccgcaacgcttggggccgcggggaggcaaggccgcgcccgcgcgctggcgcggcagcgttgcagctggccacccgcgcggccgcctgcgaaacactgtggacctctttcgtacggggcgcgcactgccacgcccccgtcgcgcgctgcccgcacgcggcatcacgttgcctttttctttcgcctcggcttcgggttcagtacggagttttctctgtattcaccgcaccgcaagcggacggctcggtggaccgtaccagtaccacaccggaccgcaaccgggccgtatctgaaggtgcacatgtgcagcgcagctagatttttacattgtgatccttctttaaaatttattttgcaaataaaccttaaaaaactttttttttttggaaatttactctttttcttggtgccaaggttatcggtgctgacgtttaatgtctccgcaccaatctcactaataccgacaccatgtgaagggggtcagcattgacgacctatttgtatttttttaaaaaaataattagcatggtagcccacgcagattgcgcggctagcatcattatattttctctcatataatagcatatatgttttctcattatattattcaaatatattaaaatgacatcataattttaaattttgcaataactttacgaaaataaaaatgtataatattcatattgtattttatatacgtgttagttattaattatttttaatatcaaattttagttatttgtaaattatatatattcctatatggactagacttgtctttcaatattttctttttttaattccgaattttctgtaaattgtatttctatatagactctaggatttctatatagactctaggctcttcttccaatattatttatttttatttctgaatttttattatttctaattgtatttctatatggactctaaactcttctttcaatattctttaatttttaatttcgaatttcagttacttctaaattgtattcctatattgactttaaactcttcttcccatgctttttttaattttgaattttagttatttgtaaattgtatttttatacgaactcaaaactctacttttaattttattatgtttattctaaattttagttagtttgaaatttctatatggactctatactctacttctaatattccttattttttaattccgaatttctattattttctacttgtatttctatatggactctatactctacttctaatattccttatttttaattccgaatttctattattttctacttgtatttctatatggactttagtttcctcttctaatattcctttttttattccgaatttctgctatttttaaattgtatttctatatggactctgccttttctttttctccgattaatgtgagaatttctagtccataagagtgaacgtggtggctcatttttctattcctttaatataataatagatattctaattttttttcttataaatagacaccatgtgatagtctctttgcctttgaggacttatttgtgataaaaaggttatatttcaacctttctttaaaaaatataaataggtcatcgacgttaacatctttgtctccaactcctttacatctcggcttctaggggtgagggtgttggcactaggacattgaacctcaatactagggtcattgacttcaagaaaatgatctcatcttataataagtttttatagggatctatttatataatatgtacttgcaggggactaacaccatcctttctgttcagccaaaacactaaagagaagaaggtcttgagattttcaagtgttcaaatggtaaaatactattttagcggtgagagcagtataatactactcgaacggtaaagtactattcgagtggaaagttctattcgagtggttttatgctattgaagcaactcgtcccgtttgagtgtgtttctaaccagtaaaaagtaaattccgagagccatataagtgagaaggagtgttcgaaatctcaagatggaaagacgacccaagatgaaaaaacgactcatgttgaaaaatatgaacaaagatggaaaagacgactcaacctaatgactcgagagaaaaagctactcaaccaagaaagatgccaaaagaagattccatagagaccagttttcaaacactcatgccagctagtgccaaaagaccataatgacctctacaatgtaccataatacatctagggttgctgacatggcaagagtataattttaaactcacaagggcccatgggggcaaagttgtaatctcacatgtacgattgtggggtatataagccgatcaaaagcatgtagcaagacaagacataatttaatactactagagaaacattagccatcaaagttctgtattttgtatttgagctcatttctttggataggcgagaaaagaaactttcctgtttatctccaaacttattcgtgacctaatgtcacgacataatataaataagttttttttaaaagaacgaaaacataaaaaaaatgtaatgttgcgcagctacttattgaaggtcacctactccgtctcatcataaaatggtgcgatacgatctgccacacattatatgacgagcacttttggccattccttggtctctcacccctcggctgcagctagcaaacggaggtacggctggtctgtctacccataccctactaggctggctgctgaaggatttaatcgtgatctcgtgaaaagaatgaaagaaatgaaagtgattctattcagactcagctcagcacctcaagccaccggctatgcttctcggaggcctaggagagatgtccagttgtacaccacgcatatgtttggccccggtgcaacgggtgcaaataacacctctagtctctagaaaaaattattgttctaaaaagagggtctctacaaaaaagacgtttgggcagacctttgttacttgtagcccatatatgagtcgtaccattgttcgccggccccatgaggcccacatggtaggtggagctacgtagaacaagcatcgtgttttcttgtagaagtactacacaacactagaaattctacaaaaccaggtgaagaaaaaatattctacaaaccagactaattgtgtaagtagataattcaacgcaattcaaattgttggagtttcaatttcgagatactgtaagctattttggcacttttacagttatctttcaaattgaccaacactcttcagtaccttctaccactaatggtagtagggtgcatgagtagaatttaaatcaaaccatagatttcttatgggcatttaaaatattttatccaaagctttgttaaggtagctttatcaatttatttattttaacacgatatatgaaacgcattggtaggttttttttaagtaaattgcatattgcactggatagagtgaaccttggtttgctttgcaccggatttaatacatatttttacattgaaataaattgtacctcacactaggtgttgtatcatataattgaagggaaaatattgtaaaatatgtgtaaaactttcaaaacccttttgaatttagacaatatttgaaagggatttattaaaataatgaaatatcatgaaagccctttcatatatatatatatatatatatatatatatatatatatatcttcattattgttcattgaattaaagatttggttttgttttctcattgaatttgaagatttcgttcagatttcggatttaataagttgaagatctttctgactcatctatataaagcggatgaaacaggctagcaaaagacacacaaaacacgatacctcttccctccccacttctaacatggagaacgtttttactcaatctgcactactctgtgtgttgtttcttagtagttcaatagttggaggttgctctcctacaatggaagaagaggtacttctcttgagctatatatattgttataattcaaattcgattttattcaactgaaacatagaagtgatagctagtctatattgatttgttccccttttcccaaacaattaaccaggtccaaaagaattggcgaacattgatggcccctctacttcatgtgaatttctcttcatcggatcatatatcaactcaagctgacccagtatattatgtgagtgtcatatactccttccgtccaaatataaaacatagttagaaatttgttccaaaataatgcaactcatatcttcttacctatcatcgatgaataaatcgataaatttctttcaatatcccatcaccgtacctactaatataactttcctattaatttggggcattttggttctttgtctcctttcttaactccaccataggaagctaaaatttgagtttttttggggagtatgttttttttccctagatctaaaagatgcacttgtactcatgatcatgattttcatgaccaaatacgtactttggcagtttgcagcatatggatcgattccttcagacgacgctatcaagtattacggattagaggccaccatggacatttatggctttaatctagagcatggacaacaaaccggaggtttcatttggatttacaatacggatgaagcatctgccgtgaataaagttatagctggatggaatgtaagttaaacttatctgcttgatttggaattgtaatttcaagcctacattagcttagctggttgatgctcaacaggttcatgagcttctcactgtcaatcgaagatgtgtcactaaacaagttactttgattaatcatttgctccatgtcttttagttttaacatttagttgtattgtacctcatacaggttgagcctgaatcgtacaatgattcacagacgcacttcagtacttggtttgtaagtttcttcataaacactgcagtttcctatccatcaatttttatttttattttttttgccataataaagattttgtatttattatgtcataactcattctccaattaatgccagattgaaggttctaatgtttgtcctgatatgcgttgtcctggattcgaaagtgtatttagctcagaaatcgttcctggaatggtgattagccctgtttccaccacctctggcaagaaacaatacattacagtcagagtatccaaggtttaattattgtctaattaataacagaacaatcttacattccttttttttatcccttcatatataaaatggaaatagtataatgaatctggacatacccatgtctagcacaacgaatctagatatacctatgtccggattcgttatactaggatatgtcacattccatgctggttgagatattttagcacggagggagtatgcgtcatgacactatattttgatgatttcaggatcaaaattccggtgattggcaaatctactatggctttaatggggatgccaagcttgcaggttactatccaagatctctgtttacaagcttgtcagataaaccagtgacaatattgtttggtggctatgccttgagaaaggatcaaaagccaagtcctccaatgggcagcgggaatgccccgtttaaaaacgccgcatcatttcgtagtatcaagttttttgatgccggtggcaacgcccatccaatcgattttcgtctcggatttatatcaaattgttacactatttctgttattgaaaatgatgggttcttttatgggggacctggcaatatttgctagtagtttgtaatcgagcttcaacttagtgtaatgaatatcctggggactgcacccacagagaaattgagcttcaatagagttcatcacaactgttgtgccactcttagttgataagtatttagcctcatcgtttgacgtattggaggaaaaaacgaaatggcatatttgcaaatgaaaaataatttgtgaataaaacttttatatacatgttctgacgatctaagagtaaagactgaaaaataaactatggaatgaaaaaaaaaactcaaaatcagctccaaattccaaatttaagattaaaaaattaaattttggctgataagcataagtggaaagatcaagatacaagattctaatatactccctccatttcgaaaatataagcagataaggagaggaaagggaaaaagaaaaagaagccgaagagaattacatatgcgtcatggttccttgcttttagtttcactttcacttttacccagggtatttacatactcactccgatttgataattcatgtcatatagacagcgacacattctccaaaacctatctttgaatataattttctattataatataaaaaccttaataagtactccctctattttatattataagttgtttaacttttttcttagtcaaacttcttagagtttgaccaagtttgtagaaaaatatactaatatttttaatataaaacaaatatattattaaaatatattcaatgttcaatttaatgaaactaatttggtgttatagatgttgctaatttttttataaatgtggtcaaacctaaagaactttaactaagaaaaattaacgacttataatataaaacggagggagtatctaatttaatttgattttttaagtctcatctacacatgttgtcccagtgccttaaaattaatatttcaaaagttgctaattgtcaaagttataaaagtttgacatcacccttataaaagaatgataggaattataaaaacaaaaggagtatgtgacattatctttcggatactttcatcgtaagtgatccctcggagtggatactttcatcagaagtgatctctcaaaaagagagaagaggaggtgtacacttggcatggttgcataaggtaaaattcatatcttgccttttgcttggtcgagctagctagcccatgtcaagccagctcgtatcacaccgtagaaaattaaaccctactgtcacatagattatgagaaaatatatatagagagctatagaaatatagaatctagaaaataaataaaaaccatatttttttttatagattctcacaagctatttctcataatccatagtttcctaaacaataccaaaacatctaggtacttcaacgcgcaatatatatgcaaaggaaactactccttcgtgatgattaaaaaaaaatagggtcatcgaggccaatgtcatgggctcacggcgacattaggatggagtgccgccgcaaccttcttccggccctacgcaaggaggcaggtgccactgtcgccgtcgtccgccttaacctcgagaagcaatttcctccttctgcctctaccccgggaggctgccgtcatcatcgacttggatgccgggaggccaccatcaccatccacctcaacttcgtgaggccgtagccgtcgtctgcccccaggaggcacccaccactgcccccatctactaactccaaagagaacaccgccgtcggctgcttctagcatttcaggtgcctactactcctacgtatctttttagttcatatattggttacttaaggacagtggcggatccaagatgatgaactacttgcag

SEQ ID NO: 54321 - DNA, 5614 bp, Oryza sativa
tgtgaagtgaaatatatgtgataaaaaggtaacaaggcacattacccggtataaagtgtaatttacccaatttacaaagctttaaatgaactgtcgtggggatgattaaatttattaaggccataggccgtgtttagatttaatattttttcttgccaaaaacgtcatatcgaatgtttggacccatatataaagtattaaacgtggacgaaaaaaaaccaattgcacagtttgcatgtaaattatgagatgaatcttttgagcctaattacgtcatgatttgacaatgtgatgctacaataagcatttactaatgatgaataaattaggcttaataaattcgcctctagtttacaggcggaatctataatttattttattattaatctatgtttaatactttaaatgtgtgtgcgtatactttaaaaaaaattggccaaggaagccatactccacatttcttgtgctatcgccagaagtgaagcaaattactcctaacacgttatgttggtagacaagttcattattgtgtctttcaagcttactgaaaagaaaagctttgtttaatggctgatagtgacctgaaccctctggtgctggcgaaggtgccaagggtacgggtgtacaactcacttcatctccgggtgtgatccacatgtggattgttggacgtccatcttactaacagtcctaattaattacccagaaaaaagacgcttttttcatctataatttggggtgtcctggtaatggggatcagacagctgcctattactggttgtgatttgtgtgaacagcagagccaattcaattaaaaatttgccaactttacgtacaaatggtcttgtcacgaagtgagattacggatgccgcttatgggtaggatggatttggcgaatggctatcacgtagggagtgggctgctttgggaaaaaaaaacaaacttgcttttttgctgaaaagataaacatgtgaagagagagaaataaatatagaacgataattggaaatcagtaacaaactaaaaatgaaagaaattgttgagagtaacaaaaaaaagtggaaatcaaacgggtggttttcatgattcctcacgaaaacatgtatttaaggccgtaccgatgtgtatgatgatgatggataagatgtgtattcaaggctttacttcaaatcaggaaaatcgtacctaatcagccatgacaatgaaaatcacgaattaaagcacgcggtttagaagcttcattctcaaggagaaacaaacaacgggctcaccggagttaacccctgaaacaaggatcccaacttcccactaccggtaacacggatgaccacaagcaacccatcttgactcccatccctccgttccccccagaagagtaggcacgcgcgcgcgtatagtacgtatcacatgaaaacgaggtccctttgatgaaaaataacgactcccatccctccgttcccccagaacagtagtagcagcatcaccgcatcacctccatgcccttgctcgtgcgcatgtatcaacacagtcacacagctactcaccacgagtccaagcttctgtttgaaagagtttaaaattctatgaacacacaaatatatctaaaaattcttttaattttgggaaaaaaaactcgagctggtataaagctgaagcatccctaaaaacaagcccaagacgaaatgacgaatgcgttacgacatgggcggagacggagggagatcagggtcgcgagtacaggggcgttggcttcaccgatcgatcgattgggcgatgggatctcgccttatccccccgcgcgcggcgtcgcccgtcgtctcactgtccgcgcggcccggccatatttatgcgcgcaaccaccccgctgtcctcgctgcgacgctgcctgcatgtccgtgtcccggccggtgcggggcgtggcgccacgcatggccgtccgcgtcaacgtacgcctcagcgtactacacccccatctttcgtgcgtttctcgcacacgccgcagatcgaattatccgttgtgtttttgtttccgtgcggctgcagagagaaaggaagtgactggctctctctgtctgtgccggaacaaggttaattacaactgccgtgattgttcgcgctttgggatgggacgaagtggaggggcccggatcgatcgaaccttgccgtaatttcaaaggtgcgggcaaatgcatgcagcatcgatctttatttagagactttctttcgtgtcacattaggtccaaatcccgggtagatcatcacctttagcactacccgctaaagatagaaaaaatataggatgacccccggaggaaaaggagatgcgctgataaattaattaaccggacacatattcttgccccacaatccaagcaaaggaaggagagactgaaggaaaagaaggatgattttttatacatggtctgcttcccaaatttggcgacgcaaacgcaggacaaaacgacgctgattttttggctcaagtttctgtgcgccgtaggccgtagctggcttgcatgcatgaattcttttggtcatgcgtggaaaattacgggttgtacatgcaggctgctcgattttagcactgacgagtgttttaccggcggcgctttggcttttagtactcccacagaagtggctcctccaggcggaacacgccggcggcggcggcaccggcgccggagattaagcccacttcgtcttcccaagacgacgcgcacgagaggcccgagctgggcgggccgtatctgaggtcgaggaggaggtcggggaggtcgaacagcgcgtcgtcagcggcgtccggcggcgggggcggcgaggcggaccggcgctcgcgtcgtccgatccgtcggggttattgctggcgcccgcattggcggaggaggccgggaagcggcggcggcggcgagcgcggctgcggcctggacgtccttgggcgccgcggtggccgggcgcggcagctcgtgggcgaggtccggaaagttgaggtgcgcggcccggcccttgatggcgagcgcggcaacgtcgtgcgcgcgcgcggccatctcggcggtggcgaaggtgcccagccagatgcgcgacttcttccgcggctccctgatctccgacacccacttgccccagctccgcatgcgcaccccgcggtacgtcgggtggtgcccgtccttgcgcggccgcttcttcttgccgccggcgccgtctgaggacgacgacgcggtggacggcggggaggccggcgcctccccgcccgaggaggacgtggtcggctcggaaccgaacgacgagtcgtccatggcgccgcgcgctgtggtggactggtggtggtggtggagttggttggaagaggagagcgagtgagcgagctgtgagctagctagagcgggcgagcgagcgactgtgcgaggcgaggcgagtggcgtggtgtgtggtgaggtgggagggaaagcagtgggagtggtgggtttttatgatgagcggatggggcgcagaggcctctcgcgacgtggaaagagggaaacaaggcggggaatagtgcggggagaatgcgaatgggtgagagcgactgggtgagaatcaccacgggttttgaggacctctgcagccgcgttgtttttttgcgattgaactgcctcgatgttagtggcaggtttcattgcaagtctgcgatgaactcttgggactcaattcatgggtgtgcgggtttgtcatcaatatgggacatctggaaaacgcacttgtttgtgaattgtttttcatcgaatctgttcattaaagccaatgcactaagctattgctaaatactactttctaaatattcgacgccgttgattattttaaatatgtttgaccgttcgtcttatttaaaaaatttaagtaattattaattcttttcctatcatttgatttattattaaatacttttatgtatacatatagtttttcatatttcacaaaagttttttcttataagatgaatggtcaaacatgtgctaaaaagtcaacggtatcaaatatttagaaacggagggagtataagagattttgaagggatataacacttcctagtactagcaaatactatcacatccatgtaaaatttcttttttgagacagatgaggtactatatttgttatactccgtctctcttggaatgactacatgtttaactctgatggctttcttggtgacgagttgcctttgagcgtctaggtgagaacacttccggtacattagtgatcgattgaaaaaatgatttataattcgttcaaaaaaaatgatttataggaaagcacaatgcacacctttagcaccttgatggaattattgatgcatgatttcattccactccgggagttgggattcgcaattttgatattggatcaaaacctctcacgagtggtatctttggattttgtaaaaacagttgataacaaaaagaaaatgaaatcaagataaatcatgtcaaaacttaaaattcagtttgaaaatttttgaactagaccgaaaaccaagcggtttgtgttttcaacaagccggaaaatattgaaatttggaccggtttccaccaagacaaatgcaacatactacatttaaaggattttgcatttcactccattactaaaattgcatttaggttcttgagagatattcaatcatcaatgcataataaacaagtataaaaaacgatcctcaaaagaaaatataaaatttgcggatcatgcataaaacaaataaagggaaagattatcttttcacccacctactaaccgtgggttgacataaccccaatggaaattacaaacaaaggataaaagctgcggaaatgcttgtcgccgggcgaccggcgcggggggagccggatcgggcgctccccccgcacgcgcccctcccccacgtgggtccactacttcttccccctttttccataaaaagatgtttcacctagtgtatttacaatgtttcactatttatagatctaatgttgcaataaattaaaatacttttttgcaacaaaaaaccacatattttggaaactctctattaaggaaatttggtttattttttgttccatcaaaaatgtttcacctagtgtactcacaatgtttcactatgtatagatctaatgttgcagtgagcgaaatattccattacaacaaaaaaacccacatattttagaaaccccctattaagggaatttggtttattttttgttccaccgaaaaatgtttcacctagtgtagtcataatgttttactatgtatagtcgttatttgctaaaacattgtttttatataaggtgaaacaacacccgatttaaacgagtgaaatattttcgatctacttagtgagacaattccgatatacttggtgaaacatcgagcaacatttaaaaaaaatcaataataagttaattttttttcgtcggaatatatccatatgtggtcttgttttgaagatttaattgcaacgaatttaatggtgcaatcggatcatgatttggataagtaatttaggagaaaaatcggtttaaattagttttgcacgtaaatcgggcgctgacgtcccaaattttcttgaaattgtcgggcgcccgagccttaggagccccgttt

SEQ ID NO: 54322 - DNA, 1162 bp, Oryza sativa
cacatccgcccccgccgccccgaggcagcgggtagtcacgtgcgatgaggtcccggtcaaggaggttgccttgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtacggccgggcgcgaggccggtccggcagaaagtgctgcgccaggccccggaacgtcaagcctttatccgcgaggaggtggcgcgacttctggaggccggattcatccgcgaggtcatccatccggagtggctggcgaacccggtggtcgtccccaaggcgaacggcaagcttcggatgtgcatcgactacaccgaccttaacaaggcatgtcctaaggatccttaccccctgcctcgcatagatcagattgtcgactccatagcggggtgcgaccttttgtgttttctagatgcatactctggttaccatcagattcgcatggctagggaggatgaggaaaaaactgcgttcattacccccatagaaacttattgttatacaacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatctagcggaaacttttgagagcctccgctccgcccgcataaaactgaaccccgataaatgcgtgttcggtgtacctgcgggcaagcttctcgggttcttggtctctgcccgaggcatcgaggccaaccccgagaagatacgagctatagagcggatgcgcccccccagcaagcttagggatgtgcaatgcgtcaccagttgcatggccgccctaagtcgcttcatatcaaggctgggagagaaggcgctacccttatttaagctcctcaaacactccgggccgtttacttggacggaggaagctgaacgtgccctcactcagttgaaggcgtatctcagctctcccccagttctggtcgccccggagccaaatgaacccttgctactctacttagcggcg

SEQ ID NO: 54323 - DNA, 5524 bp, Oryza sativa
ctttctgagtttgatttgcactttgaacgcacgccacgctatcaagagccaagccctcgccgattttgtggcagagtagaccccggctcccgagcccgtctcgatccccgaggccagctcggacccctcgcagttgcctcacaccgctcactgggtaatgcagttcgacggctccctgtctcttcaaggcgccggtgcgggggtcacgttgacctctccgagtggagacgtcctcagatacttggtccgcctcgactttcgagcgaccaataatatggcaaagtacgagggactccttgccgggctcagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcacgttcccagacgggataacatgatggccgacgagctctcacggctcgcgtcctcgcgagcccagaccccaccgggcgcctttgaagaaaggcttgcccagccgtcggcgcgacctaaccccttaggggagacggatgcgcctgaccggcccccgaggcccgtcggagtccaggcctcgggacccgaggggagtgctcccagctcccttagattgatcgcttggatcgctgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagctttccgccagggtttttattggccgacagctctcaatgatgcggtcgacctggtccggcgatgtaaagcgtgtcaattccacgccaagcaaatccatcagccggcccaggccctgcagaccataccactttcgtggccatttgctgtctggggactcaatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataatggcacccaattcactagtgaactcttcggcgactactgcgaagacatgggcatcaagctctgcttcgcctcacctgcccaccccaaaagcaatggccaagtggagcgcgccaatgcggaaatcctcaaaggccttaaaaccaagaccttcaacatactcaagaagcacggcgattcatggatcgaggagttgccagcagtgctctgggcaaaccgaactacaccaagccgagcaaccggggaaacgcctttcttcctcgtctacggcgcggaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcatcgtcgccttcaggcccgatcactctgcgtcgacgacctcgtcctacgccgcgtccaaacgcgtgctggattgagcaagctctcaccaatgtgggagggtccgtatcaagtggtaggcgtcccccggccgggctccatacggctggccacgggcgacggcactgagctgcctaacccgtggaacatcgaacaccttcgtcgcttctacccctgagggggggtcgggtgtcaggtttcgggctcgggccaaccccgcaccccctcgggcgtgcagggttggccgggggctgccacacatgcactttcttatttctcttatttcaatatttcaataaagacagtttcaatttcctaaaggctgtgtctgtgctgttttttccttttgaagaatcttgacttgaaataggtcactcgtgctcaatcctgccctcgggggctcgggtcggctaaaatcgccaaacggggcccagaaccgagccgtgccccggggcgtggtgaactccgggggggaatcggcaaaaacccacaatcgggttacccataaccctcggtcaccacgttcccggcctggccagtctcgacatgtggatctccccaggcactagccccgacccgcgccttttgaggactgggacctgggcacgaacccttaatcaagctaagacacaaaaggaccacggcacagatcatcctcatctcatactcacagcaagatgaaattaacacaaaaatttcttcatttttgattacagattaagttgatctatacaaaaaagaggcccgaaggccttagaaaaaagaaaagaagaaaaaactgaagaatggcgggggtctgggggctcaatccgatgcgcccggaccgccggcctcgacgtcactgtcgtctgcaccaccggcattgccctcctcgtcggagttgggggcaaacgcaagccgaggggccgagccctcgaagctgtcgacgatatggtcggcggcatcccggacctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttgtcggcgtactttacggtccgccctctccagaggcccacttgccgaccggcgcaatctaggcgggagacggcgtcccaaagcatgccgggcccaacctcgcctgccaagcggagggcttcgacctccccggcggacgagtccagcgcgccttgcagatcggcgatggtgtgttcggcagctgcgaggcgggcggctacgtcgctttcgcccgcggccgccccgccgctgcgcgcccttgcgtccagctccttcgcccgcgcctcgagctcagcggcccattggttcagtgcggccctctcggcgcgggcaccttccagatcacggcgcgcctgctcctcctgcgctgcctcgcggagggacaggctgtccgccagctgttgcgccgcggcctcggcccccgcgagagctcgctcccgctcggtgagcgcgtcctcgcggaggcggagcacgagctcttcttcggcgcaggcagcctcgtgcgccgccagcgttgcttcccggatggtgacggcggcctcgcggtccgccagatccctctccacgacgcaggcgcgctcttccagcgccatggcgcgcgcctcaagggcctcttcgcgctgccgggacgccgcttccgtctccgccgcccgctgttctcgggcagcggcagcgtcaagcaccccctgggcggcgtcgggcttcttccctagctccgcctcccaactcccgtattgaaggcggagggtgtcctgcgcctcgttcatcacggtggtggcgataagggcagcctcccgctcctcctccacctccttggcgatctccgccagcaccttcttacgggtttcaagctccgagacatgccggcggtgagccttacggcccacctccaccatggcctccaccgagcgtcgcccctcttcgacacgcgcccacgcggcgtcgagctccgcccgctctgcctgcagggcctccacctgggcacttaacccatccaacatcgtggtgtttgcggcggccaaggcctgcagaaggggctctgtgttcagtggggcgatagaaggcgtggggaagagccgccttggagaggatgccacgtggctcgggccgccgatggaagtgccggactcggggatgtctcccggacccggttggtcctaagcgtcgcccgagggagtgggcccaagcgacgcgcccgcagcctgtcgccagctgccccggaagttgtcgcctgagcgtcgcccgagggagtgggcccaagcgacgcgtcccggcctcgtcgcgagctgcctcggaagtcgccaacatctagtcctggcgggctcgggcggcctcctcccaaacggcttcctcggcctggcgggcccgggcggcctcctcccgagcgatttcctcggcctggcgagcccgggcagcctcctgggcggcctcctcggcttcccgtaggcgatccgcggcctctcgccggtcagattcccgcccgcgggcctctgcggccgccggatcctcagcctcccaccccccggacttggaatggcgggagggacgcgacgggatctcgctgaaacaaaagaaaagaccagaagacgaacgagatgggtgagtaaaaactcgcgttgagagaatgaatacaaccacgatgggcgagagacgaacctgcgagggggtcggttaaacgaccactttggaggggaaatgaggtttccccgagatggttctgtctcccccatcttgcggggccacttcttcttgcgctccccctcgggctgcgatgttggcgcggccccctccgggcgcctgctgctggcacgcgccgccccgccccctcggggaggagatgggggaggtgttcctccctgcttcctcttcccccgggcatcggcagggcggctgctccccgggcccctgtcgcgggacccagaagcacgaccccctctcgggatagattgttccccccggcggctcccgcctgtgccgtcgtggccctttggagctcgctcctctgaggccccgaccgccatcataatggtcaggatggaggcgcggtctggatcgctgcagagggggaggattccttgaggaatgagggccgcctccacggagttgagattcagcacccgttggaccaatatcttgaagtcctcaggagcccagtcccatctcactccctggtgagtcctcatgaagtcttcggacccggtgtactcccaggcgccccgagcgcgccgctggagcggcgcaatccgacgacggaggtagtcgccgtacaccatggctcttgtgagcccctgggatcgcaggcccgccaggcggtcgaggacggcgtcatagccatcccccagatctaccggcgcccgccagctggaggcctgagccgggggctggctcggaagtcggaggcgcacttcgtcggcaaggggggtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcg

SEQ ID NO: 54324 - DNA, 903 bp, Oryza sativa
gacgaagacaagggaaataatggcgaaaggagggaaacaaatcccttcatcagtgcctttatactcttgccaacgctgtcccggctcctcgcttctcgcgcccactgtttcgccccctcgtttctcgcgcccatgcttccactaatcccattcgcccgcttgcggcgcatgaggtggatatgcggttgtggcagtcgagatagatcatatcgtgcgcgcggtaattacgctcgccgaccaaagcgacgttaccatatctccaaacgaaacgaatcgccatgtccagattcgtgtgctactcgagtaatgtggcagtcttgaagagaccgctcattattgacagccgagttaccactgccgatgtgcgtgatttgtgaccgttgggtttctgcccaattgtggagaccggtcccacctgtcaccaggccttaggagtggcgtcacgcccgaccgcttcccttaaagagggcgatcgccctggcataacgccgggggctactgtcggtgacatgggatcaggagtatcatgactagaggtttgaggcagacgcaatcgcccacgtggcctggcaccctcgggggacgtcgggcccgagggtgatgtgttcgccctcctcctagtccccccgagggggtcgggctgcacccccctcggccccgagggccgaggcgccccgacccctcgtgggttttttgctccgcgtgtatgggttaggtgagcacagtggggctcacctaccacatttattgcggtttgactgagcgtgtcacgccgcatgcaacgtagtgcagtgcactcgtttatccggtctgtgaccagtcacagaccggtcagatcgcgggttaggtggccacaggcgatctgacacacgcctcgccccatcccgtcaggacgagggcttc

SEQ ID NO: 54325 - DNA, 18015 bp, Oryza sativa
ctttttttttttgatgaattgaggtcaattgagtaagacatctggtttctgcaggcacatgacttgctagttcttgaaagattttaccaggagcttgctgttttgcttcacaatcatcgagaatgagtgccttaacatgtcaaattgtaatcaagactagcgttatgttttttaagctagaatcttagctgcctatgttgaggggcaacatgatggaataaagtaacatcattttacatgttttgcgtaatagttggctgtttgcccaagtctatttgtctgtgagatatttaatacaatctacgtaattttcctatggcatttgcaattttttcctagacttttcctgtttgcatggatgcatgctcgtttgattttttctttcaacaaagaattttataacatggttgccattttagtttacaatatgatcattcttctcttctcagatgaaagtgatggtacgtgaaacatttacgcaatgtcttaaaggtggtgcttggctgttatggcaatgctgcacatgtattactgcgacatccgccttagtcatagaatttatggttttgacactccggattttgtaaaagttattttggtagtgtcagggataaacatcaatgctgtatgcttccacacttataaagttataatgaagcaattgagatattcaaagttctgatgtatgctttatttgtgtttatatagagatgggtcagtctgtcccaaggtgataaatgctggaagacctgctcatgtcgtgctatcagacaattgattttgtagagtgaactaaattggtttctgtgttgcctgattttacccctcctagaactgtggttctgttggacctttcaaagtttttgagataatgccccttgatatcatttgttaaaaacaatcaaggacataatgcaaaagcccgagctgtatttcttagttacaattctgggtgtctttcctgtgataataatgataaatgagatgcaatttacaagtactcaattgttgctatgttgtttcgatgtatttttctttttatactgttgtgaaatgtcaatgtgatgtgtgcaaagctgaaccttagtagttacgaggttcaggagtcaaggacactccagtggtgactgaaccatagtttggccgaatatgtcatctgtttgatgtttgaattatccttgactcacagtgtcttggatgttgtctcaattcagcatttgaattctcaatgcggcattatgcttggaaaattgaactgtaaaattatgggaggtgacgggagccatcagtcgtggcacttttgacagtttgtagcattgtattcctgatgaattttgtgtggtctgtcttgccgcattgcagttcgaaggtggtgcgacgtgaagtgctagtgtcagctaaagattgtaaaagtcctatacactagaaatagaagaaaagaaacgaaatgtgaaaatgctttgctttcaagtcaacctatgagaacagattaatcaaactcagttcgttaattctaacacaagaaatagcaatccttcagttttcccagtaaccctcctattctcctaggcatgaggagcagagaaaccctgcttggtcactcacggtctcacgccagtaaaggcagtaacctcttcgagcaagccatgctcacttactcatgggttcgcgcctgcttgccaccgttgtgtgtctgtttgcctttgctgccggctgctgccgctgctgttgttgttggcttgttgccgctctcccgcctgcagcgcctcgtgcgacgacgacgactgcggcggcggtcgctgctcctgcacataggacggcgtacccggcctgaactgaccctgcccctgcctctcgccgatgttgccaccgccttgctgcggtggaaatcgcgggagattttggtgttgagcaccaacctgagcctgatgtgcgtcccacccttgctctctccggttgccctgctgccgcgccaccggacgagaagagcatgccatggcggcggcgagagtcccagacgccgggtgaccgtgccccgcaggccagccgttgggcgccacgtgcggctgccccggcgtctccagcattcgaccggctgctgacaagccgacggcgccgcctctgctcgagccgggacggccgccgcagtttggctgctgcggccgcggcatcctcgcgaggttgcattgtgtgcgctgtgccatcgccgtcgcggggagaggcaccgcgagcggtgtcgacggcatcgcgcgtggcgtggcctctgcatgcggcaccggcactgcaaccgctcggtgtcggtgacctcctgaacacgatgagttgccgcaccggtggccgccggcggactcgttggcttgccgccacagcttacggcacagtgccaggtgatgattgacccggtcgatctgccttttcagcgacactttcaacatgaacagctcgaagaactcctcgttttgcgaacgtaactccttgtacactacaattcatagtttcatacatacatgtgcgcacggtcaggatgaactgaatttagtttatctcaactagctcgatcgattttgcagatgtgaacgttcatcctaccagcgtagtagattaccggatcgatcttgctcctgcgaaattgtcggaacatttgtcccttggacagccgtgcttccaggcacctcgcaatcacgtccttcacctgcattgatcgtcaatttatcacacatttgcgaggtcgatagcatcatcggcggctcggccaggggcgggtctacagtgtaacggccggtgtcaagcgacaccgacgaattttggcaaaacgtatagttaaattgcttatccatatattatagcactatgatttaagcataattagcatactatgacaccagtagatacgttatgacaccaacgaatcaattttctggatccaccactggctcggcgagccgtcagcgcaaacaacatatatttgtaaatgaaaaaaaaaaatatgtgaataaaacttgtatatacgtattcttaacaatctaaaaataaagactacgatgaaaagaaatcctaaaaattaaatttaatttttggctaataaacttaagcataagtgaaaagatatctcttattcttgccttgcttacatgttggagaatttcttccgtatcgtctacaggtgccgtggcatcatcttccgccggattttgatccgcgccgcttgcgcttggcatcgccgtcgccggttattcgctgcagcggtggacacaacgcagtgcattcgttaccccacgatgttacaccttctagcttaattagctagccgaagatggcgctccggtggaaggagggcggcttcgttcccagcgccggagaagagagagaggcctcgctcgcggcggagcttgttggagttgggattctggaacggagagaccgcgaggcgagatgagcgctatcgcgtcttctttaacatgtcaagagcgctcgtgcagagacgggtcatcacgcgcgcgggagtcggtagcacacgtctacggctgcaacacgagtggcctccccgaatattctggtactgtggtctgacggttactagtagaatatttcacaatctttaatagattataaacgcgtaatttatctctgaacggagtattctttttttcttctggacttgcaaacctgagcgcattggaatagttgataatgcactggaattgttctggttgcagttacttggacaaacaaatacttctagaaaccttgtaaaaaaaaagtcgcatcactgtaaacaaatcattaaatcaaacaacgaacaggaattaacagcatggaaaaggagagcatatagggattatcagatcataccaaaacaagaaacttgtcagtttgccactgtacatgtacatccaaatcctactggggaaataatgttgtgcctgagaacagtacttgaaaccacaacagaagggaaagtactataatttggccctgactgttcgtgtcatgtttaagaacagtgttcaaatgccaatcaggtatacagcctgaaacttctatcatctaaggacgacaaaccactgctattatatacaacaaattttctgatttcagtagttggcactgcttctgagtactgacagcatgtgcgctcattttagtctctccgtgctggcatctcggcaagaggtttcaaaacaatcggcttgcttggatctaccacaagtgaagaactcgtttacagaaaagccagtgaccaggggagctttcctgtcctagacatcttcaccattgctctctcaacactagctatctgattgtcggttgctgcatgctccttgattttcttcttatcagctttcttttgtgcatcttttattgccttttgcatcttctctgctgctctcgctctcttcttctccaacttgatctgtttccagttgaggcacaaaaccaacaaagtgtcaaacgacaactctgactatatcccaaattaaaataaaagataatcaatgcagtgggcatacgaagcatacctcaattcttttcatcttctcctttgcctgtgtaacctgattcatctgccattcatcgatatcggcctctttccttctcagcctaatcgaattaaataacatcataactcaatgagttcgaaatataaccttacgggcacaaacaaatctaaatgtcatataaacttaatcaatgacagcattttgtaggctatggattatgaagatcgaatattcaataaactagacaatcacaactcacaagcattcatgtttgcagtagtaattgataatggcttcaattctaatataaggctcaagagatataatgctacattttaatcagctaataagcaataattttctacaagtgtcagtccagaagttatgactgagagatcagaagatgtggattacttgtctatgagcttttcaatctccgcattcttccaggcaaccaacttggcgtggacaaaattttccttatgttttaccgcagaaccctggggccatctccccattctttgcactgcaactgggctattttcgccatctgaatggttaaacgcaccgccattatgatcacttccctcataggcaccaccagcctcaaagttccaatcacgagctgcagatgaaagaattgtcataaaaaatatttttcagaactgacgagactcatgagatttagatcagtacctgaggatatacgagaagacagagtatcagcctgccaatccgtttgatccactgcttcatcctcttcttcactgactttgggcaatctccattcattgatagcatccattgcccccaaacgcctacggtaattatgtgaggagcgagctcggcgcatcaatctagctggcgtggccttgtggatgaatcttggtggcactggattagttctctcaactgcatgttttcaagcgcattcaataaatgatgcgatgcaagaaaaagtcaagttaatctatggagggaggcagcagaagtaatcacatctcctatccagaagggaaggttgtctgggcgtttgcagtctgatgtgtcgtggtgtggtagacggatttatgaaatctcctctgtttggcagcctttcttggtcttcttcctgcagatgattggcttcttaacatttccaaatcacgtatgggaaatgaaaaaatcaaaccggcagatagtacaactaaatggatacaaccaaaagctacttgtaataattctatatggacccagacagagaattatccaaatttagtttgatcgtgtggaaaacatgtaataacataacaaacaaaatgactgagctaagaattctctagtttttggctatttcaagattcagaaagcagaaatgtaacagcaaaccaagattgtcaatacccttactgctttgatatttgaatcgatcaaaggtcacaaatcaaatccaggaacattgataaatcttgcattgaggcactagaccaatggttaaactggaggcgtttgttcctgtaaaccatgcaagaaactgaacaacctcatccaagaaaccaccttcctccaaagaactaacgcaagaagtcggcgaagttttccacaattcaatagttacaagctacgcaagaatgggaaattaagaccaaaggcagcaaaaaaatcaagaaccttcaggactgcgcctccccctggaaaaagaacacggaaactaaccagccgtggcgtgacgaacgaggaggcgtcatcaccgtcgcggcagccctcccctccattgctgctcacggggctgcagattggggacggcgaggcggggcggtggtcggtgagcgacccggcgctccacgcggcgcagctgccgtaggaagacgccgggcggcggccgtagggccccccgcggccgcccatggcggccatcgcgagcagcatctgcgtgctcctcccgacggacgcctccggctcggcctcggtgtcggcggcgtagaacgcggcgccctcggaggcgtcggagcgggcgggggacgagcccggcgagacgcggaacgccgcggtgggctccgcgacgcaggggatcgggatcgggatcgcggcggcgaccgccatcttctcgccgttcttcttgccctcttccggtggcggtgccctccccttgatttctagagaggaagcaaacgttagtcgcggagcgcgcgaggaagttgtgtatttagacttgagagttgagagagaggggatgccttctgactggtgggccaggttcttgtactaaccttcactgacatgcgggcccggttcgtagatagctgtgcaccggcatcagttcgctgcccttttcccttcatctcccgttctcttaactgaaccagcactaaaattagaagcaccacatgaacattcaagaagcaggatatcatctgacaatatgaatacatcatttgcgatggtatgtgcagcgaacacaaattttctgttggctctactgttagtcaggaactaacaagttctgccataacttatgaaacaatattccgtgccatgtgtggcttttagcttgctacaactccggcgcaaagacaaatttgcacctcaattgagttttcatactgtaaacttgtgggtataggggaattggcaaggcgccttttgccctaagttggaagaatttgtaacaacttctaagatcaagaatattccaggagcacgcagagcttctggacttgcaatcctactaagcagcaacacctgttgaatagttcagcatcgtccctttgactcgttgatggcctggtaagatctgctgcaagaaaagttcaatccatagacagatgaagcgcagctcaggggaatggagcaccaaggtgatcagacttcatacccttttgcaaagcaccctgcccttctttcccattccagtgccagcgaggcttgcagcgagacgtgacttgttgtcaggtctccacttaagctctttgaaagtggagaaaagctctgagagggcagggctgatttcctcatctttgattttatcacaagagacaacttttaggctctgcagatcactccatgaggttatcaccgattctagacctcgagttgtcagttgtgagcaaccttctaaggagaggaacttaactctcctgaaaaacaaagagaacgcagcagacataagtcaagatcctgaattaagccaagaaacactttccacgaaaaatgtaggttgtggaccatatctaggtatgtaaaatggctcaccatttccagaagaacaaaacattattacaatactattgccagtgaaaatatatagtaagtatttgctaaagcgttttgagaggaaactattgaaatatccagatgaaaatttgagatggtcgtcgtgctactgtggaagtgtggatgaaggtaaaacatggttttagcctgtaggtaatctgatgtcaactctaagaattccagttacacgaatgcatctgatttagagctttagaggttattcgttcattttattccactaattcattgcagtagattgctgccatattcacacaaaaaatgataatatgccacaatcgatggcatataagcaaataatgggtcagaagaaactgaaaattattccacgtatataaagaaactacctaccctagttagccctggcacttccaatgcaaatcttggcattgatcagtactagtaacagttataagactctagtccagggaaaaacaaatacagggaagtgtaggcggataacatttacgcatcataaataactacatttagtagcccaaagaactacatcaaaagactctaccgagacactgtcaatttgttggcccttttagaacaagtaatcctttactgcatagtttggcagaagatccatgagcaaaaatgcaaatatcctccaacgaatattccataacatcaatccacggtttgtgatggaagaatcggcatggcaataggtggtagtggtttatggtgaatctgacaccaccccaccactgcctattgtctgtgaagaaaaaaaacgtagagagcatggcatggggcaaaaggatatgtcaacaataatttatttctactacatacattgcaatttttttttttaattccataacaaagtatgggcactcagctagtctttactgaatccatttgctcaggtagtggtgcacggtttgtgttcgaagaattgaagcgacctacatctttatgaaatccatcgctcagacatctaagtcatggtttgcatttttaccagtcacaattatctggacacaaaaggagaaagtgcacgaggggctagataacgcacatcctaaaatggcaatatagtgaataacacaaacagcatgtgacttgctcaacacaagaggaagaataaaagtgattatgacaaacaatataacgcaaatacacaattatggaatactttcacttgaacacatctgtaataaataattgcatcttttccaagcaatcatatgctaaaacaaccaaaaatgacaatgttagccaaacatgcagtatactgaacagaggttgactagattatggagcttatcaaagctcacacagacataatcagtagacaaaaggaataatgatggaggctatctaagtgaggtttttacgacactaccgaataataaattttgcgccctcaagtcccatgataactgttatttaattaattaccacagaagcaatagtggcatactgactccaaacatggaggggtccatgcattgcaatttgcaagcattatatctcctgacactaaaccagggtcagaacaaccaatcatcagttacctacgactacttcaattggcagcaagtcactatcacagtctgacagatcaaatataaagcaggaataactaaacaatcaaagttcaaatacacaatctgcccacattgtgcgatcattgtaatatatcaacaacctagattgaaaaatgagattggtgattactatacctgcacagtcctgccatggcaaacatgtcatcttcaaggccccagcaattctggaccaataactcacgggcaccctcacaaaccaaaaggagagcatggagggcacgacggtcacgcagctggcactgctgaagctgcaggctctcaagcgtgaggcaggcaccaagatgctccgcaggcccaggatcgtcatcaatcctgcaacatccttgcaaccttagggttttgaggttgccgcagaaagcgagcgcagcaagccacccattgtccatcttgtggttggcgatggtgagctcctcaagcatcgcacagcaccgccccacagccgcgatgccgtcatagcttccctcgcaaccaacaagctccagcttcactaatctcttgcatccatgagcaaggatggtgaggccgatgtcggtgacaccaccatcttcactggtgccatataacgcagaggaggctgcgacaaggcggaggatctgaagatgcgcaaaggcggagactgggcggagggcgaggtcggtgcatcggtggagctcgagctcttgcaaagttgcgcagccgccagcgatatccatcagacccccggactccgaggcggctgtggctgagaggcggcggaggttggggaaactggcggcaacggcaacaaggcccctgtcgagcacgtcatctgcgaggaaacggcaggcgacgagcggcgggtccgcgccggtgtctagggttagcgacacctcggcgcaagtgaggagaggggaggtcggggacggcacggccggagcgacaatggacgccgggaacaggtcgaggtccgccagttcggggaagcggtggtgtaggcggtgggtcacaaaggcccagtccctgacgacgaggcggcggcgcaggcgccccgcgaggcgcatccacctcctgcagaccagcgacgcggcgcccgtgaggtggggctccgggaggcaggcgaagacgcggaggaggagcccgtccgagaactctagggtttggtccggcggcgccaccggcgcgggccgcgcctgctgctgctgcttctccaccggcggcggcggcggagtcgtcatcttcttcccggacagcgaccgcaggtcaggccaccccttgagaccgtcgcggtgcaggccccggccatcgaggacgcagacctcgggctcaggcattcaccgcgaacggcggcgcagggccccgcgtagccccggccgcgccgcgagaggagaagcccccgcagtgcggccgggcgcggcgtcggtccgattcgggagagattccggcgtggtagtgcggccgtgaggggatctgaggactttccttttttttttttcaaaatttttgggggggtttgggatttggaaatttgcctcgcccctcgctgctggaggagcgggataagagagagggtggagcggaggagccgtggggccgagcggtggtgggggcaaacgctttgaaatcctttccttgtctccgtgtgcaaggtagtatagcgttcgttttggctccttgcgccgttgcgcggccccgctgtgcacggtggaggattttctcgagagttttccttttttttgcttgtgtcttggcggagagttttgatggctcgtttgtttcttctgttcttgagcgacgtgatccgggttgttttactcggcacggtttcgtctctgcgtgagggatgaacagttccgttttaatggaggcacgtacggtacgtgaggtttgttgggtgtcccgtgtaccgcgtcattaggttgtgttctctttacgtagaaaagaggctcggatcatttacctaggctcttaagtgtttctgtaataatggatcgaaggacaattaacgccgtctgggcggatccgtccaaaaccaggctgttgcctttgcctgaactaattggcggatcccattgtgaacctccatcaaaatacagtaatgtaggatgaaattagatcacgttaatactataaatagataaaggtatattcatatttgtagtattacgatggatttctattgcatcttgtagttttcgctgtttcataacattttttttaagagcaatgctacacgtactaaatttttcttactaaatttttactaacaatcatctcaaccatttgatttaagtagatggaagttacaaaaaatctagatgcactcatagcatgacacatcagtgttagtaagaatttagtaagaaaaagttagtatgtatagccttttcctttttttaattatttgtacatcattgtaggataaagtttggtactactgtttgcaatatcgatggtcatttgtatatattttttgtgcgtctagaatgttacaaggtctactgctgtttatacatattaccattgccttgtaaccgataaagatctcatagcatttctaaaagtctcctcaaatcttgctcttcaaatatctatatatcaagatagccaaaacgatagatttctaaatttcatacgtactcaacagtttttccatattctactctccaaaattcataggtttcatatgttagtgtctcttgtcccctccttcactctcttttgttaggcatttgtaggcattctcatcctttggtaggtgtggagcccaccaagagccaaccactatgatttaccaagttcggccaacaagagaagacatttggcattttgacaagttaaatggtttatcaagcaatatgttttttttatttgctacaaatttagcaaagagagctaaatggtaaagctcttggagatgatcctagacatctatggtatgtgaaacatacacgaatgtaccatagctaaaattaatgctcaaggagacgggaaataatctctaaaaatgagaataaagtgataaacctaaatgaggttgaacgagtgggccggttaaaaattattccgttagataagccctttatctatccgcgcatactacttgggaataagtccacttactggctagcctcgagctcccgccgccatcgtcaaagctccacctcaaagctctaggaagtcctcccctccgcgtggtgacccatttgcttccccgttggtctcccctctttgcctcctggcgctccaccagcccttgtcgacgtatgacaccctacgaccctcatcgatgccatcggcccctctcaacgtcgtcacggcattggcatgccggctgccctcaccaagctccgactccaactccgttgtgggaggccatgtagaggagggagagagaaagggaagggggagtgaggatgccaccacgtggaggtcgcttttatttttgccacgcaaatgcctagtcaatacgagtagattgggttaacttgtcacgttagcaaaatcaaccatctatactattgtcacgccccggactagtaccgaccggaactagcccgtgacgctccaaataacctgttaatcgataccagtcccaggaaacagtgctggtatcacaggaagacagattatcacagcaacagaggtctctttattatagagtagaggtacagtcatgttgggctgtggacagatcccgagctcacaattgcattacaaaagggaaacggaagccaggacttggaccaaacaacacaggcgcgacttgggaactaggccgaaaccctaaaactcatcgtagccggcttgctcctggaagaactcctcatcagcaggatccgcttcatcttcttcagcaactggggggggattatttatatagagcaagggtgagtacgggagtactcagcaagccatgggaaataagtgtttaatgcaggcttcaaggaaaggctgttgtttttgcaattgattttatttgaactcttttctaaaaacaactaggtgagtgcttctcaaacgacacggatgagacagtgcgtctcgtccggtcggagtatgtgcaatgcatcagtctttagaattgattcaaggttggcacccggccaacagcttttcaaacggccacccgggccaacaactttcaaacggccacccgggcctagctgatcccgtcagctgcagatttttcaaacatcgaacccctttccacaacagcaatttcacaagcagtagtcaaacaaaactacgctaggaatcacctcacatccgcccatgaccatgggcacggctgttcgaacagtttgttaacctctgcagagggggtacactttacccacacgacattactaacccggatcacccagcccgtggggatcagccacgttgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaggtgcaagagcgggaaaccgtacacccggtacgttccccggtccgcggttttggaaattcatttagttcgcaagcaccgacccaggtgtcgggttttccaagtcttttgtaaaacccaagttttacccaagaggtttttcagattttaagtttgaaggcgcccgtcaatactcgcacagggtgcacgaatatcgagacgcgactagatggttacaaggggacacgatataacaattatcaaaggaaggatcaaatgcaacaaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctagagcttgatcctcgaaatcctcgcactgcggttcttcgggctccgaaactatacgcaaaacgggacaactcaacaaacggcgaaaataaagccctattaatgacctctaagcgtgccattagagagatctcgagatttgaggaattttggaagttgaacggagtcaaacggatttacggttgggaagatattgaatttctaagattactggatttttggtctaaaggaaaaggatttaattaaatcctttttgaaaaagaaaagaaaagaaaagaaaagaaaagaaaagagggagggaaattagacttttcctcgggcggctagggcgcggcctgagagaaaaggggcggctcggccgagctaaatgggccggccggcccaaggcggcccaaggcacgcgcgcgcgggaggggaggagagagagagccggtggaccgggctcaccacgcgcggtcccgggtgggacccgcttgtcggtgacacggttcaccgtgcggagcgagcacgcggcgcacgcgcgcgggcggggagggacgcggtgtacgcacgcggttcgcggtggacgcggatgcggcgggcccacgcgcagcctcacggctcgcggtggaacgcgcgcacggggagggactgaccggggtcggctcgacccggtcttggccgagctggcgccgacgtggcgcctacgtggctgccatgcgggccggcgggaggtagacgacgacgccggccggaacggacggcggacgacagcggcgagcggcggagcgaaccacggcgatacaggcggaagcgagcacaccgggtggttgcacgagacgaggggagacgagccaactgctcggattcaccggagggagcttgacggcggcgaattgcggtggcggcaaccggcggcgggagaagggggaaacggcgacgaggttactaggggccgattcccggcggcgagagcatctacgcggctacgggaattcgatgctagcgttggattaggaggaaacgcatcgagggaggccggcgacgagaggcgcttccgagctcgggcggcgacggcggcgagcacacggtgagtgacggcaacggtcagggcggcgccggctagctacgaggaggctactcaagctactacccgagtctaaggggaggagatggagcgaggagggagaacggggagatgcactaccgtgcgggacggggcgcagtgacgagaggccggcggcgcgggagtaatctctccggccttgggccggggaagaggaaggagagggcgcgcccggagtccccttccgcgtccttgctcgtgccggctcctccgaaacgcgcaacgacgaacgacgacggcaaacagagcacgggaggcggcggcaatggcgtggaggcgagtgggagaggaagggaaagggggagctcgggtttataggatggcaatgtcggtttgggaaccgacttagggcggtcaaaggagagggctggcgctcggtggtcgcggccaaagcggcgacagggaggagggaggaggatgacgccggtgggaggaaaaagggaaaagagggagagaaaagggggcttgcccccttgcctcttcgcgaaaaggaggagggagcgggagcgacgcggcagagggaggaggagctctgcctccgtcccttggaggctagcacgcggagtggcggggccgggcgatgacgacggcgatgacggcgggggcggtgtggagcggagcggcgacacgggcgacaggcgcgggcaggcgcggcagaggctgacggcggcagcgaccaggcggtcggccaacacggcacgcgcgcgcgggatgcaacgggaggcgcgtcggattgagcggcgcggctcgggcgcgcgcactggctcgcggggccgagcggctgcgcggcagggcagcggggccgggcggcgcaaacggcgcaggcgcggcacgggcgacgaccacgcgggcgcgcgcgcacgcgaacaatggcgcgcgggcagagcgagggagcggagagggagggctcgactcggcgcagctcacgcgctcgcgcgcgcggcgcgcgggcagagcggcgaagagggagagagagagagagagagcgccggggagggagggggagatgggccgagagagattcggcccattgaccccgggggaggcaaaatagacttttgcggagggatttgatttggaaggatttggattcggaaatgagctcgacgatagatcggggatttgagatctgaggtggcacggacactagactacaagaaaagaaacaaatttcgcaattagggtttttaagagataattttcccgctaggcgcgacgacggaacgggcgctacaactatattatgaggatctaatttaattcggttttacaagttggagcttaaaatttctggtattgtaatttaggaatgtcaattaaactcaatgtttagatgacaaacgacaagtagacttaagctgctcatttacgctgctgcaatgaaggcccgaatttcatcaaagggcctcatagactgatcttgggttcaatacaaaaggcccatgtggagactgaaacccaacgtagccggaggcgcacgcacgccgtggccggagctgcatgagacgactggtgatctgaatgaatgccggctatttaagtcaacaaatctgctattcaagtccacaaattaacaacctgtcatgcaaatgatcaccaaatccgtaattatgtccaaaaacacacctcgtatcacggaaatcaccaaatatatgctactagtactattcaagtcccagctgtagattttgaacagtaacttaaattccacattcgtctttgcctctcgcgggtaccgagcccgacaaataaaagcagaaggaatttaatctttcctttgtaccactgtgccgtcgacctgccagccacaggttgcagctgcctataaaatagacagacggcaagttgtacacacatatccaggggcgcgcacagtgaaggccgcggccgcgctgctgttcgatacacacaatcggcggcgacatggcattggcagccaagctcctcccgtccatcgtcgcgttcgtggctctcgcctgctgcgtcctccgctcatccgtcgcgtccgtcgaccaccaccggaagctctccggctggtccatcggcggcgcgacgtggtatggccctgccaacggctctggaaccgatggtacatctacctcacggactcgatcgatcatcaccagaggatggaccatatatgcgagcggcctgcaggcttaattagtactgacgaggcgtgctgcatgttgatgtaggtggcgcgtgtgggtaccagggagacgtcgggcagccgcctttcaactccatgatcgccgccggcagcccgtccatctatgagtccggcaagggctgcggctcttgttaccaggttcgatcgttcaattcgtctcgccagctgatatatcttttaatactcttttgttgctttccaagaataagacagtcaactctaacgtttactcgtttgtttgctactcctactgccaatttgggaattaaattctgcaggtgaagtgcagcggcaacccctcttgctccggcaagcctgtgaccgtcgtcctcaccgacctgtgccccggcggcgcg

SEQ ID NO: 54326 - DNA, 979 bp, Oryza sativa
aaatggcagggggtggacatcgcgttccgggtggacgccggctccaaccagtactacctcgccgtgctggtcgaggacgaggacggcgacggcgacctgtcggcggtggacctcatgcagagcggcggcagcgcggcggcggatcttgggcggcgatgcagcagtcgtggggcgcggtgtggaagtacaactccgggccggcgccgctgcaggcgccgatgtccatccgcctcacgtccggctccggccggacgctcgtcgccagcaacgtcatccccgccgggtggcagcccggcggcacgtaccggtccatcgtgaacttcaggagggaggattgatgagatgatatgtaggggatatgtagggtggtggtcgcacgcgcgcgcatgcacggtacaacggccggcggcgtacgtggcgctagcttagtttaattatgcttggagctatgtatatcagggcacaagtggtttgtgtgcgccattgttgcgcgtggagtgatggagctctctgtcagctcgatcgactgtggtagaagaataaacagatccttcagctaagctatttgccacagttgggcacttgggcgttggctccggtccatgtaccgatcagccagcgtggtccggggctccgggccgtcgcgggggataacgcgacttgtgctggcttccgcggttccacctacgcacttcgttcggtggaaaaagtcctttttatttttctcaactaaagttttagtttgattcgcatccatggacagcaaaatcagatagagaggctaccttaacaatcaaaattgactcattttatcttttcgagtgatttaggtaacggttttttcctacatgacacattgaactagagaaatttaaaatgatctatgaaggaaatcatgaccgccatggtggcagcgccacggcaatcgagctcgagataggagaaatgatgccacgggtggattgagtgtccaatggct

SEQ ID NO: 54327 - DNA, 12550 bp, Oryza sativa
ttcatagtcgcatcgaagtatcaagtatcgaacccaacttctagtttagtttgttgagcagatgacgaactccttttaatggtatcagtgaacaggtagtttcaggaatcaacagaggtagctgcagcgttagctctgtaccgtgttgtacagggcggcagttgctgcctgcatgtggtgttgaggtcatgaggaccttctgcttctcactgattgtgtttcatcaagagaaaaaaaggtatcagttcccaccttgattaattgagtgtgatgaaagtctctctttagaggaaaatggacagcacatttgaaggtgggcctctaggaaatggacagcacagtggtggccttggttggtgctttacaaatgctctgctgggcgcgcgcctgggccttgtgaggcttttgtggcttggcaatagtacacttgcctccctaaactgttttaccgaagcaatcaactgcaacgacctccaactactaaagcaggttcactttcacctctagaaatatttttgtttccctaaatactggttgcgatttcaccttgacttttttagggtaatatattgcaccatatacagtggagaacacaactttaaaatatagatggggcgaagaacggagatgttcactcgataagagcaatcgaacacaacagatgtggtagttatagttcaattgcataattacctcgatcattatttgtggcctgcatgtgttgtgaagagacaaactaattattagatgttcacaccttattatatctaattttgatggcctataactactataaggggtagtgggtcttggaggtgtggggtgatacgggtagtagctgggacggtcgacccactctgactaatgggtaaatccacccctgatcatatactaggtgtgtttggtaatttttgggaaggggagatagagtttagagaggggagttgatgatgtgattgatcatatgtgtttgctattttactctaagtctcttgtttgccgaaacaaactttggtcgttgatagttttttttatggaaattgtattttaagtgacgatggacgtcttaaaacttaactagcttcgctcatgagggaatctcctctcaattttcactcattataagtgagaatcacctataagcatttgatatccctaaagaaaaggtatgctccctctctttcaatataaatgcaacttagcatagacatgacatatctcagaaatacgaatctagacagtattgggacaaagggaggaggagggagtattgtctataagcatgcggacatgggctttgagcctttgaacaagggacaaatttctgatatcaaaatgcattatatgtacacaccaataaaggatggtgtttggaattttcctctatatccagagcaggtgccatattggaataagccaaatcccccttgcaaaaaaaaggactaacctaaaatccatgtatctcgtgcgtggaaaatagattcctagatgccaaaaccattctctattattaaaccccccacaacaatcaaaacaccaaacgggaatcatgatcaacttgcgaggtcaacacacccaatgatccatctcaggaaaataaagaatttagagcaaaaaaacaaagaaagcgtcggcagaggcagcagctttatcacaaatatgcatgtactacgtatatcagctatcttatcgccattcgccaataataatctcgttcgttattcccgtatttcccctcgttgttttctcggggaaacaggcgtcgtgcgcgcgtgggacgtgggcgccatctgcagcacccacccaccagcaggaagtcgtccaccggcgtggaacgctccaggtttcggctgggcgacgcacgccgcggagccaaaaaaaccaacgcgcgcgccgcgcgcctgctggggagtacggcggcaaggcgtgagaccacgcgcggggcgatgagaactttcggcccgggtttcggctgccgcgcgcggcgacgaacgggcgagtttagccggtagagcctgacccctgtcggtggacggtggtgaggcaccgggtacacgtgccggcgccagcgccaagatcggcggggagctactacccctgattattcctcgattcacggcttggacatgggctttgtcaaccgtcaacaagtgatgactcatgatcactggccttttttgagcttctagtaaattaaaaaggctcactgaggcgtgcgtaacagcgacagtgcaccgtgatttatagctttggctactgtggacgcgtgtgatttaaatagaccgacttgcggcgatgtttggatcccatgtgcaattggtccggcattcgtattaagaacttcagtacagtagtaagttcagtagcgtctaggaatgcgagcaccatagcgcttcactttctgccaaaaacacactactccagattttagggagaaacgatcagataatatatgccgatggacgtcggtggccgggttcgagtccggggccgattaaatcaactgcaactaacgtgcttccgagtcagagattacggacggaggagaagtactactaatcagcgtgctccgacacgatcgaactgaagaaaagaagagagaacgcagaggagccccatgtgccactgcttaaacaagcaggcgcccctacatacacgtgtctcggatcggacaccaactgacaaccccacggctagctccacgaggcacacgatcctgcccgtctactcgtcagagactagtaacgtgggccccacgccaacggtcaactaattaacggccggttcggttttctttactgtgtttgccacttgctcctgcgtgtgttcctcccttattttagcagaaagatcacctgctccagtaggataaaaagaagaggttcgattagaccctagacaggcatgattgatgattccaaccttgtttgccaataaaaaaactgcgtgattgcataaaagctagtagccaatttaatttcttggataaattgaacagtttagtttgtttaaaaccattgaaaaaaaatcaataattcctagtttcggtcactatgtgtttccaaatatcaaaagatagagatagccatttaggacgatgctagaaaaattgatagcctaagaacaaatcaatgtattttagttagacataattttctctctcacaaaatattcatataattttaaaggatttgaaggggatttttggagtcagcctaggactaagccctaatttccctagcttgtagctccacccttagagatcaccaaggaagatgtcgttgccttttcacatcctgcatttcagtgtcctcgctagtgttgaagtaaagaagacatggttttcatgttgctaagggctgatttagtttgaagacaaaacttgccataccaaaatattggcattttaaacgtaattttgttaatgtttagtttgctacgaatacttgtcaataccacacaaatgttgccaaaatattggcattggcaaaaaacttccacatgatttggcattgccaatagtttggtatggttgcaaactaaacaagccctaaatctctatcagtgtctaccgtattcttaaggtactcaatgaagacttacgaagtattttctatcaagttattcatgataattagcggtgatgaccgatcagtagtatttggtagttagtacaagtcactaatttgttgtgtgatattggtatacgtgatgaaaagttaagaggaacgatgatggtggcaatgctcgttttttattaatattataagtgcgggagttgattaatatcgtgtttacgctcgtctatttatatctcttatggtatggtgttttagaatatagagttcttttctatttcgatagatctttcatatttcttagttgtaggaatagagttgttattacttctcttgttgtatatataggccccgttcgtttcctctgaaaagaatggataaagttttggattttcgtggcacgtttttcaaactgctaaacggtgcgtttcgtgcgaaaattttctatatgaaagttgttctaaaatatcatattaatttattttcaagtttgtaataattaaaactcaattaatcacacgttattactacctcgttttgcgtgaaacacttgtttaggagattcaaacaccatcataatctatcatagtggaaaaagtaaaaaaaaataatcaaagtttgtaacgactaaatacgaacaggagcaattgaaacgagctactgcaactgccgccttttctgtaagaataccgcaactgctgtcgtcttccgtttagcaacaaccgttttaattcaaatttacctttttccgagaacagctcgaaagcacatagcgtatcggcggttgcttgatactcacaaagtcacaagtacagccacatttcggctacagaatctgatccaaaggcagatacagagcgtatgcacgtatgcgtgcatgtggctgtggggtcgcctcaactactaagaaatcgaaaggtgtggatgattagagctctctccattattacaggattagctatttcatccactaattaattgctcttatttgacgcgcacacgtagaagttcagaaggtcagaatacaattagtttctgaacatctcttgttcttctgaagtctgaactgtactgctcatgcgtgcacataatgcagcttcttcccccaaacacctcaaaagctctgtttaactatgcagcacgatatatatgattatgctctttgccacgaaaaggggtgcgtcgcatcgaccggtcacatggcacaggacgacagggatcaaattattcggcaaatggcggcagtgcaaagctcaaaacgcagcaatccgaaaaaacattctcctgtgcaggctggcacaggaatggatgaatgatcgatcgttgcattttgggggtcacatcgctcgtgcatgacaggtaaggtgtggtggtaaggccggccatcctgcatgatcagcagagagagagagagagagagagagagagagagagagagagagagagagagagagagagagagagagagagagagagagctaaagattgatgaacatttgggaaaggaatggattcgaagatgatgttcagtagacagtaaaccaattgttaaatcgtgtgcgtttgagaaaggtttgggccagagatgttcgccaattcttggtttttttttatgcgtgctatcctaaccgccgagggcaactacctcgtgagatttcgttttctttatcatgatttgggcgttggagaacgtgatcacctacattatcaaagaggatggcctctgactccttccattttgtgttatactactaaccggtagcaacaatatgatcatgcatatgggattatcctatcgcccaaaagaaaatcatgagaccgatcgaccgatcaatcctccccaaattcgtcctcaaatcgcgtgtgatttacttcattgttgttttgtttacttcgcttttttgtttttaaaactaaagcttgatctgacattgatgacattagtgatctccggggccgtaaataaataaactcggagattcaactcatgatacacctgaactattagcagttagcttcctgacttctagcacttccatcatttgagtttgtttacttaagtctttgtgtagaggtcttgcacaaattgccatcactctcactcttaactttttttatttttttagaaaagttttaaaataaataaagtcaacaaagtaattatataatctccaaatgcacccctgaaagattcttacataattcttacaaacaaactcttaattgttggatgtaattatatgggagttaaattaaatctagattttagtcgatgtatagagatcacatcattgtttgtaaggtttttgtaagaaaaaacattgtacatatagccttttccttacatataattttgttaatattatgtacgcattccttaattagaaattaacatatgtacataaaacaacaactttaggatactatccctaataccctataacaattttattttattcatttattcacatttgacaactagaattataccagtgggtaaagaccaatgatataatagctattaggagctccgataaattgaaacattaggatcgctatatacatcataattgaaaagttaatgaaaaattcttccttggttttgggccaaatactattcattccttcctttctagccccaacctagtacactaccacccttcgctcggtctgtctcttttcgatccagcaggcccaacttgcacaaccggctaataaatatatttaatgtaattgtgctgcgtgtgcgtgtggtggatcgaatcagaaaaaaaaaatcagaagcctaaaaaaactggacggacagaaaaaccccgaaaactttatgtatcttttaattagttatattatagatgtaagaaatggttatctttcatgcagcttgtgtaatgacttgtatctctttcatgagagatgactcctcatatttctcttacatctcgtcatttgaatcaacatggcagtcttggaactaatacttactcgccactccatcgtgggcacttaattagccaaaatgaccacttttaaaataagttttagatgcattttttttctaaaaaaagttttagaaatggaaatttgcctgcataccttgagatttgggatagcttaagtccctggcaaacgcaggaaatttaaccaaaaaacaatatcatgccaacttcgggagcaacgtactactgtacatagatcaattctttacttatgaatggtatatataaaattgaactaggcgagatgcatggtttcagatttgactgttcttgaaaccgatcagacttgactgttagttgtgaagttttccctgtgttccaattacaagtagacactagctaatctaatactaacagtagcatccctcttggttgttctgtagtgtactgaaaactaatacaacaatgctactagtgcctgataagttgatcttcgaacaatgtgcgcttatagcaggtacatactctgagattgaatttctcaacttgtgttatcccaattgtacttcaccaatccacttccttacaagaaattcagctcgccttattttgtaggtactggatactgatcgaaaatcaacaacagttcgtttagcctttttccctacaccaacttgtcacgttctcaccaataattctcgaccggcagaatccctaaatttcttgccacgtacgtctgcatccctccaaaaattccctataaataccccttctcggccactccctgcaactcacccaagaacacactcgagctgagcacgtctagctagctatatctctcaacatcttccgagctactactagtagctagctagctagaggaagcagcagcaatggcgaaatcttgcaccttggtactactacttgtcgcactggtcgggctctcacttcttgtgagccccattgcttgctcccgcaagctcagcaagccgaaacccaagccgaagccgagcatgagaagccggtggtccgggctcacaacaactacaccggtagcccgtcggtgacggtcaccaccggctgggccgccgccggcgccacgtactacggcgcccccaacggcgacggcagcgacggttagtgctcgcttgctttcgctttcgagcttacagtacttgcattgcacggcattggtcgagctggaactgaaattaaaatggaatcgggggaaaacttgcaggcggcgcttgcggctaccagaccgccgtcgggcagcggccgttctcgtcgatgatcgccgccgggagcccgtcgctgtacaagggaggcaaggggtgcggcgcgtgctatgaggtcagcacacacacacgacactgacacatgtacacacagcagtgtgtggtcacacgggcgagctagctattactgctgcgagagctttcgtgtagctccattaatggcggaaagtggtcggctgatcccaactcaatgcgttcatgtggccgtgtacgcaggttaaatgcacgaccaacgcagcttgctccggccagccagccaccgtcgtcatcaccgacgagtgccccgggggcatctgcctcgccggcgccgcgcacttcgacatgagcggcacttccatgggcgccatggccaagcccggcatggccgacaagctccgcgccgccggtatcctccaggtccagtacagaaggtatatgcacattcgcatcagtgcagaatcacgaatcaatggcgccggcaagctgtagtataattagctaaccttggtgcttaattccgttaatctctcgtagggtgccatgcaagtacagcggcgtgaacatcgcgttcagggttgaccagggggcaaacccgttctacttcgaggtgctcatcgagttcgaggacggcgacggcgacctcaacgccgtcgacctgatggaggccggctgcggctggacgccgatggtgcagaactggggcgcgctctggcggtacaactccaacaccggcaaggccctgaaggcgccattctcgctccgcctcacctccgactccggcaaggtgctcgtcgcaaacaacgtcatcccggcgagctggaagcccggcgtgacgtaccgctccctggtgaactactcctaaattaattacagctctctccacatctcctgcaagaagctgcagtgcagagttgcggtaaattggtaattacagatttataattagcctcgggttaattatatggcgggaaatgtgcgtccgggtgttgcgagaggcggtgtcagaagaggaggaaaggaggtttaagaatcgtgttcttccctccacggtctctgcattcccctagtgatgtgactgtgtcgtcgtcgatttgtctgtaaaattttatttttcttagttatatcttcctctgttattgtcatgttgagggagaagcttgagctgcaactaatgttgcatgccgatgtatcaagtttgtgtgtgtgtgttttttttgtaccacgcaaatctttcagataaatggattagtactgtcagaagatttctgtacttcactggaactcatgcattgttgtcgttctgtctcaagttcaattctcgcttttaggctgtgtttggttcctttcaaggttggaagtttggattgaaattggtacgatattactgaaaagttgtgtgtgtatgattggttgatgtgatgaaaaaagttgaaagtttgtatccaaagtttggatctaaacacagccttactgagcagggtctgtgatctctgaagtactgctccctccgtccaaaaaaaactcaatcctagatttgaaactgaacacattggtttttttttttaacggagggagtatgtcctagttgcagttcgaatccctgaacaatcaaccagtaatttgaactggagtagcacaagatagatgctgtacaaagaaaatactggacgtgcattttggtgtaaatcatcagcgcgctgtttctgtgtcctcctttttttcttttcgctgaaacctaatactcccaaacagcataaactccaatgctgcattatccgcccgcacattgcaaagtactactgtagtataagttgtgctataaattttgctctcctgttatgctgggttcctgccgacgaagacacatgcagttctcatcgaaagtagacaaaagtgcagagtcttgaatgttacacacactgattgtactcaattattagtagtttaagacacgaactggttttcaatggaattattaatgcatggagtacacttgtgctcctctacataccggagcttcgcttgtcctcggcattatgaactggaaactgagaaaagtcgtctagtttgtcatgtgggtctgacaaatgaagattatatataccaggagcgacgaccatggatttcgattcagaaagtttttttttctaaaaaaaactctgcctatttctgcacgagtgtgcagattaatattgtacagtacccgccgtcatatggatacagatttttattttaccacttagtttatgtcatttgatctacttaattccactagcattcaatttcttatttgaaacgtgccgctggttgcatggattaaaaataaatctcaaaattcaactagcaaccaattgcctgccccagatttaccggaaagggatacccacatgttagtgctcaactgcacatccagttttaccatgatctctacgtagtagaaattactttaaaccattatctttttttttctgatacaatgaaacgtatatttggtactagcatcttgactttttggttgtagaatatctttttccacaagcactgataatagaactaataaatcaataattgagtttgcttttaatcgtgacaatattagtagagaacaccgtaaaaataagtatgtaaaaaatagataaatttcgataacatacgtgtgtcgtggatatggattttcataccttgatgggatctccacccgttacttgtatgtcacctaaatatttatcaaaaaattgaaaaacattgataacatatgttaatatgaaatatatcagtgcacaaacatacaataccaaatttgacttctacaagttaaagcaaaaaaaaaaaggtttaaccaaaaatagttatcatacattcgcagctatatttgttatttttcttacatcttacagaaattgaattgtaatatatttaatattaatctatcttgtcaatttattttaaatctgtaatgactatttaaatagcatttacggaactagaggatatcacctatcctcttgaagaataaatacactttcccgtgtgttgttggtatatttctgctcgcagaatgcaaaccacatccgatgctaacaaccaatcacggcctaacaaactagtagtgcggagtacgtgccaacattttgatatggcatagtctcagccagcaagcaaaaaatctgcgcttgtctcctttttctcgttttaatgcatcacatggcagaaagtgaccgtgcgtaaatcattcataactaggagtaggctatttcaagaccttcaattgctcacagtacaacgatctagcggcggtgatacgaaagagaccaccatctatggcacatagctctctttcccaagaagaagaacatgctgcagacctgacctgcaacctgcattcaggtgcggctcgcgcgagtggtcgatgtcaaaagacgctacctagtcactgtcaggatccatcgcgatcctccatggctgcgctccatgtgcccgccaagcgcacacgacaacgatctggatgaaaataataatcgctctcgaaacggcacagtgtacgagcggaaaaccgatcgagagctcccccatgctctgaccgctcgcatgttccgctcccccgttctgtctcccttcccctcccccctgctaataatctcggcgtcgatggatcgatcggttggtctgtgcgtttcacagtccgtgtagccgcctccggccaccaccaccatcaccaaccaaccaaccaaacaaccgagcgagcgatcgtgcaggcggcgtagcgtgaggtgaggtgagcagcgcgcgcgcgcgcgcgcgcgttccccaccgtgtcagtcgcgggcgcatgtggagagattctccggtgacgggagggtgaaagactgaaagcaacgggcgcacatggcggtggtgctgtgcatgcatgcgacgcgcgcgcgaccccgcccgcggccacggttcggctgattttgttgggtattcgcccctattcgaccaggggtggtcaaaactcaaaaccccgcgaacatgttaattggcagcatcgaaatttctaatctgtcctgtccttccatacatctaccctggattcggatcaggccactttggcagtacccaatcatccagccatccagcacacgagagatggcccagatttaaccgtgtcatacatcattttagctatttgaacaagcatagaacagtttcagttcagattttgcctgcaatttctctccctttgatctgaattttcttgaactttaagacaacccaaatattgttaaagaaaagtagacacatacttcatttcattatattgaacttcataatatcttgcacgcataattgacaaaatgagctagagtttaagcccttgtttagtttccaaaatattttttccaaaaacgtcacatcgaatctttggaaacatgtatgacgtattaaatatagataaataaaaaaaagtaattgcacagtttacatagaaattgcgagacgaatcttttgagcttatctttgatcttatttttctattataatatataaaataaataaatgtatatttacttttattatggtgttttgaaagacaaatttatatatgttgtcctttaaactaaatatttttaaaattattgatggtcaaagttataaaagtttggcctcaaccttatctaaaacgtcaaataatatggaaccggatggagtacatgatagctataagtgatacagtaacccatatgtgctaatcacggattaattaggcttaataaat

SEQ ID NO: 54328 - DNA, 2305 bp, Oryza sativa
gataatatccaaattaattgcgtgtgatgtgcagcagtaggaggtaaagtatgcttcccatggtagaattggcgccaatttttacttccctctcagacttttccctccaaaacacatctgctcgagtcagagagtagttgaatagctgggggaaattaagcaacgaatctagaccatcccttgtatgctggatggttagatgatggatactgctaaagttacatgatccgaatccatctacccctggcttctcatttcacacggcaaatgaaaacagtatatattattgtcctgtgcgtgcagcgtgcgtacgtgtctcactcttgttggtgtttatttaccggcgtccgtcgccctggtcccgacgtagtacgtggtgttatgttaacaggcggccgaatgtcgggggtgattcgtcccctaacctgccactgacaaacaacatggcagtagaatcgcagcaggtacactggtactggttacagcaacagttttttttttaacaaggctttccagtttccacatgcgtgtgtaacttctttgtaacatccagtgtgagtgccggcgcgtctttacatacatatacatacattatacatgcacatacgtacatatacgtgtcgtgaatgggcaggatctcttagggtgtgtttgaggagaagggaattgaggagattggggagttacgcaaaatgatgtgagccattagctcatgattaattgagtattaactattttaaattttaaaaatggattaatataataaagcaattttcatataaaattttttttataaaaatgcaccgtttagtagtttaaaaatcgtgcacgcggaaaacgagaatcaatctcccctatctcccgagacgaacagagccttaatttactcatgctgctgctgctgcgtgtgctgctggtgtacttggcccaacgccgacggttgcaactgtgcgtaggagtggtgtggagtggaatgagtggcttggagtggattgatgcgatggcggggcacccgggggaccgtcgaatgcataactgtaacaacagttgagagcctatggctaccgaacttttttaatggatcggcgtcgctccttttgggtttattttggaccttggccggccggcctgggcctaccgttttgcggtgcccccatgtgaagcgagtaaattaaacaagcggacaagtggagagattttggttgcaggcgacgatgtgacgccttcgtttggccacctagctcactgcacgcgccatggaagacgaaggtctgtgtgctctgtgtgcgtggagggttcgggtggttctactggcggagaccacatcgagcactccagtccgactgactgtgtggcttcagtaattaattaccagtagaatccaatatgccatgtaggattgcttgcctttaaaagtcttggttgcaataagcttcacagatctacagtgccctgcatatatacacagcttgtttagtttgtactaacacttttaacctttggtatgacaataaccaacattgctatcctactaaaatttatgtagtttcggaagttttcactcttaaaacctcaaaaaaaattgatgatggtataaaccaaatccatctcatcacatataaaaaatttgacatcaccaatttttgctagggttagtttgaacaataaaacaaacatacttggtgacatttgaaattattaactcgattacaatgttttttttaagaaacattgtacaaacacaaagctttcacaacatgcgcaggtgcgcgcacattattccgagtatcttcgaaagactgaaccgatatatctagagattgataaagtcaacataagcacctcattatcaacggttacgacgcctaccactaaaaaaataatttaccataaatacgagtactcgtgccaagtctagaattttagcccaagtgggctagttacactacaagaatctactagtagagctacttgattacaatgttaggtcctttttggcatagctgtggatccaagatttttggagctggatatttctagattaacaaatctatggatttaatatagtttgttgataacatttatataaattattttgtgctcatttcaaataaattttaaattttaagcactataatttagcatataaacttcaaatgtactatggatatgagatctaaagccgtactaaatagagtgattggaaaaaaaaactttacaaataacaaacagtttggaatacgtggcataaactatgtagtaaaagattttttttctctttcataataactagctgggtggcccg

SEQ ID NO: 54329 - DNA, 918 bp, Oryza sativa
ctcctcaccctccaccaaacgaatctgatgatacccagctcgaaggtccaacttagaaaagaaacgggctcctgagagttcatcaagcaattcatcaatgacaggcataggaaacttccatttaactgtgatagcatttaattacctgtaatcgatgcacaaacgccatgtaccatcttttttcttaaccaatagtgcaggtgaagagaaaacactggaactaggctgaatcaccccagcaagcaacatctctttgacctgcctctctatttcatctttttgagcaggattatatctgtaaggccgaatgaaaactggtttagaattgggcaggagagggatctgatggtcacaagctcgtttaggacgcagtccctagggctcctcaaagatagactgaaattcctgcaaaagctggccaatatcaggaggaagaggcacttctgtgacagacaaaatttcctgcaattgtaagacatgcataacagaccccatcttcagcatgccttgaagttgttcaccaggaatacccaaacagtggttggtttgaacctgaatacccaacaattgcacttgacaaccagccctctagaaagacatccatttagcagtccaatccacactcattggacccagttgcatcagccaatccatacccaaaatgacatcataagtaccaaggggaagaaatttgaattcagtgtggaaaacataaccttgagtgcaccattcacaatgaggtataaactgagagcaagacaaaagaccaccatctgcaaccttcactgatacagtgttaggtagctgttgtaccccttgtactgctgagaaagagcactgtccacgaaggaatgagaactaccagagtcaattaacataaggacttccacaccctgaacccatcccctgatcctgaaa

SEQ ID NO: 54330 - DNA, 10131 bp, Oryza sativa
ccatctgaggactatctccattgaactgaggacagctcatcggcggaacatgaccactaattcccatggaacccccaagcgaaacagaattatcagtggttggagaagaaggggacgaggaggggggtgatttcataccatcaggcgacttaaccagcgcttgaattttatccacctgctcctgcagctccagaacagaatcttgaagcagatccacgcgcttctccatctctggaaaacgagattcaactacaaccttgagcaccaagaactccgcacgactcttctctgtagattgctcacgacgcttctcgctctcctcctgcttgcactctgcgtcctccatcttcttcaggagcaaatcaagtttgctgtcctgatccaagaccttggccgccattttagtcacgtagcggggtttctcgtattcagccatggctgaagctttcctcaagaacttgcgtacccgattgagggagccgaagcttttgcgggatcaggtcgccgaagcaacaatccccacctcgctcaggatttaccacaagaaccgagaggaaaaaattttgggtggtggctctgataccagattgttagctacctaacgccaatccaacaatcaaaaggaattcactcaagaacacaagaatttttccgccagatccaaccggatcggcgccgccgccgccttcaccgccaacttctttcctacttgtttctcaaataagaacagtattagtacatataggagtcaattccctcacgctaccgattcggacagctggagctggtgctcatttggcctagtccagtctgattacacgataattggtcttgcgcacacgaatgggccttgctagacgagtatgtacttcctcccttgcaacttcagtcttctgtagtaaatctgggacgctgacatactcccttctaattctattgccatccactaaatcaaaattttcatagatgacatcggtcaacaaagataaagatagcaatcgattgagtaacaaatggttcaaataccaagaagactaaagggggaggaggagacaccatggagatatacaaaagaaatctaagaacctattagtgattattgattcaatggattttgctaactgccattcgacagaaatttaggggaacaatcttactacttttgtgacttctgattaacttgaaaattcatgcaatggcttccttctcctcaagtttcagcgacccccaacaactccagtaaccctccaacaaggacacggctaccatcccactgggttaggtttttcatggtcagattaggaggagtaatgggttttgaggctagggcgtgatagcctggtagtgcgcgatggtgtcgggaaggcgttgaggcaatggggcactgctgaagctatgagaatggaggagcatgatggaggtggcacggaaatcaagaatatgttgataagtgacgattaatctactcgtgggagccaccgaaaacatagaaagatgatgtgggttggtgaggaatatgatgaaggagagggaacaatgatgtagagaggtggagggaggaagccggtggtggtgttgtggctggccaacgggtttggcctgcgttggaggcgacaccggagaggcagatggatagcgcctctgagccggggaaagaggtgggaggtggcggtggcagtaggcaagtcgagttcgagttaatggggattagggatgagtgcacttgagattataagagtgtgggtaatttgtgaggcattgaattttaatctagtgggtagaaaatcgtattattagtttggggaatttcttagacatgctgtatatggtagtccggttcaaacaaaaatataatttgttacaagcaattgtggttggaagagtactaatagtagatatgctttgttgtggtcttgttgtaatgtcgtggataaaagggacatcatgatcgtcttgcacggtataacatcggttctactaccgtacgtgctcgatcgaggtcctaaaccttcagcgaaaatgagcagacggccggcaaaactgacaataacgataaggagagtcgaaacgcacgatgaacttaagaagtggggggaaatcaattagacgcgtcgtcatttcgttcgtctgtactaatccagtacgaggcaaacttacacaactttgctatgaacctagctacagctcacgggtgctactccctccgtttatttttatttatccactgaattaagccgtgattaacatcaagaaaatgccatctgcgtcagacgtactgtcaccgtgcaagtacgtagacaaccgctcgcttttaattcggtgcgctctgaagctttctctagcttatctacctatatctcctcctgtttaattttgccacgtacttttcctggtcgtgggtcaccatatgacccgatcccagcggacaaactcacatgattacccccactaactatttactgcccgtttgtgtatggttcgcctcgccgtgcggcactggtgcgacgacggctgggccaggggcattagtacgttccgattggagcatttgcttctgccgatccgctgcgtcacctgcaaaaacggccaaagacgacatgcggctgcatctgcatgcacgtacaggaggcagccgtttcagttgcgctactgcgaggtgcgaccgatgagtagcatgttgatgcatgccggtcttattggactcccgaaggagtaaacttgaagagatttcggattacttattaggttttgattggtctgagttacgggttgataagtccttaaaaaattaacaaactaacaaaaataattcacaatttaaaagccagtatgaacaaagaaacttataaataactctaaaattaagttttaaaatttaaattttggattcggcaaataagagaagcatacaatgagaggcttaatttttctctactttttcataccatgccaacttttgtgattcatctattgatggaaaaaaaaaagaacaatctgttttatttctagtcaatgtcttccatcattttccctgcaaattgcccctactatatatactacctcagtgtagaaattggacgggaaaactgcataagggcattcacgatggaagctacttctaagaatggccttagggagaaagaatgtggaatgtagattgaagttatatcttataatacccttctcacaatgtatggtggctttgactagggcctgaaataattcagttcataaacttagctaatatatgttttacattaaataaatatgcagaacaacctttagaatcatcaacaaaagttacatcataaccattggcctacttgtcaaccactaattatattcgttttgcctatcaacacatcttcccactctaggcaccacagctcctcccactccagccaccacaacttcactattgtggatcgaaggcagccccacgactttccccctctccaactgacgtcaccaagacctatgcaaggtggatcgaaggtggtttagatcaacgggctactccactgtctagtcctggctgccgccatccttcttcacctcaaatccagccatgttgagggcagctctacccaacaagttcggcggcaaaaggcagtgacttggtcgatgacatctcctggtcgcggtgatggcaatggtgacagggtcctaatagtatgcagtgctactcttagccacgttcctcctctatctatatctgaccctctccactagttgcggacttgtcggtcgtatctctagccattgcctctttgctttccaaccgacattgtcagtactcgcaacattgaggtctgtgcaaccacgcggaaggagggggcatattgtggggcgatggccttaccgacgtggcttgcatgctttagctacacttgcaagtgtcccatcctaatgagacaattgtgccctctgcaaaggcacaagaagccttgtgaaggaactatctcattagatatatcaccacggctctgacatggtgagcccaagcactcaccctgatgaggcaaccgtgccctgacgacgcacgagaagcctcacgaggacacatctatggctgatatgccatcataactctgatgtagtgagcctgaatcactcgttaggtactcacactatgtatggcctaagtgtatgtgtaatgttgaccttttatctcttttagggtcaaatatctagttctcccaaccatgcatacagctgacggttctttcacggttcaactcaacccttttctaatattctaactcaaacatgtatataaattttaacccaacccttttatttattcctaaatctttagaatttataaagttatttatagactaaaggtttagatcccattctcggtcactctatatgaagagtgggtgacaattattgaattactagtacttgaatgaaaggatccaaacaaactcttggcgtgtggatggctgctcggcctcggattgtctaggctcgccgcattttacgccttggagagagttggtgattgactgtgtgcagtggagtactggatggccagaaaagattaattaggtcctggatttgctttttcatttacagaccttttactgttgcatcaaatccccgtgtatgtttggtcatgtgactgtggtgtgcagtgaatatcagttaggtcacacaccaacactaatatactactcccttcatcccataatataagggattttaagtttttcttacactctttgaccactcattttatttaaaaaaattatgcaaatataaaaaacgaaaagttgtgcttaaagtactttaaataataaattaagtcaaaaaaataataattctaaatttttttaataagatgagtggtcaaactgtgcaaataaaaactcaaaatcccttagagtaccaaacggctgggcttaaatcagctcatctcagcatgcttaatttacagttgacatcagccgtctgcatctatgcatggtttaggctggactattgagtttcctccctccggtgcctagagcgtttgatgttggccaagtgacactgacggtccataggtaggccgtaggcaagtactactcctagaattttgtcagtcaaaatatagctagtggcaatcggtcccttgacacagaattccgcagctaatgggtgttcattccttatagtaatccgtatactcaccagtggcatgcacaccgagaatccgagataggcggcagggagcggaaagccggaaagtgtactacatgcacgattagtcctaaagacatttcatcagcaactggtgagagtatgtggtggcgtagtggtggcaggctattcagctttgccttcacggttagtcctaaaaacggggcaaaatgaggtcaaaccgtgcaagtgaagtgggcactcggcactttgggtttagcaagacagccagcaaccgcatgcaaggctgcattttgcatggagtttttttttctccgaacacaccaagagattgcacgtcaatatatttaaaagaaaagagtgtttgatacacaccataatcagtcagaccgacttatgtcaagaaaagagagaaaaaataaaaacaaaaaccgagaaaaaggaagagactactacaacagctaaacacactccaaatagcgggaagaaggcagagtcacactaccctcccaagaaaaccccaaaagtagcaatgccaggtcgccagctaacgaccatagatggccttctgagaggatgactctagaacccctgagaccgaagagaccgcagagtcaaaaactctggagtttcgttccttccacagctgccaagagactagtaggaccagagagtcgaaaccggcatgaagatgctcaggtaagtatgccctagaaaatggccaccagtcctagagccaattaccacagggtggagagagggcagcccaaccagaagacgacagcacacggagccagacttgccaagcgaacacgcagtcgagcagaatgtggttcgtcatctcaagctcctgagcacaaaaggaacagaccgggtgactatcgatgccacgcttctggagaagatcagtcatccagtagcgctgctaaaatgcaaatcagaggaagaacttgcatttagcatgacccttcatgtgccagagaagatcagaacaggcaaaggaacgctagccatagaaaaacgcgcctggtatgccaaacacgccgagtagcgctggtcacttgtccaacgccaaacaagcaccgtgacagtctcctctcctgcgtgtcacaacatgtctggcgatgtgaacttctacgtatcgcaaccaaaaaaaatttttaagtgtgaatatttaatttgttttttattacaatattgtaggtttatgaagtgatatatcacatattaatatatatatcttcttaattttttttaaaaaaatcataacaattcgagtgacacatagattaaaatagtttccactttagaaactgtctaggaatgcagcccgtcgtcattggaattccatttcagtgattcttgcagcgagaagaagaacgaattaaaattcaatatattcattagagacatttcattttccatttactatatccgttgtagtctagctggttaggatacttggctctcacccaagagacccgggttcgagtcccggcaacggaaagtactttttgctggcagtatattttaaactgcaaataattgtctccattagcgtgtttaaactgcaattaattgtcttcattagcgtgttttgcctgcaattagcttgataactgcgaaaattctaattaggcgtttttcgataggatttttaagtcttcaattatcctcacaccgtgtatacattagcgtgttttgtcttgcaattagcttgatgactgcgaaaatcttaattagatttaatagtaatctaattaatacatggtcccatctgtcatacacacactgcgtcttggagtccgagctacagctggctacaaatctgtagcccgctgctcttctctctccttatttatctccttaaaatatgcctcccctatgtcgattaggcatgctcctcccctgcgcaacgcagccacgtggttcacacggagagggggtggcacagtttttttaattcgtacgtatataaacttcatatatatgtatatttttcataagtcaatatttttatacgtagaattttttatgtatacatacataaactttgtattgatataatacatatttacatatgtataaagtttatacgtgtatatacatatacatgctatatgtatcgggcgcccgcatgacctatttacatgcaccatcgaactggattggtaacgaacctcagcgagcttctccaccatggagatatgaattgaaaatttgacgtccctcatgtcccgcaggatagtaccacctccatctttaaatattttttacgtgaaatttgttaagtattatttattttattgtgatttaatttgttattaaatgtattttaagaataacttatatatttgcatatctgcagtgaaattaactatgtaagtacctttttttttacttattttatcattaaatttactttaaacattatttttttatctttactaatttatattattaaagatcctttacatctggctttttacaataatatgttcctagatgttgcctcaaacctttaggaacacatgaattgaccctacttgtaaaactactataaatacttacattggatgcatatacacaaacatatatcccgatcacataaagcaagtacacctacaatatgtatactagatggtaccccgcgcattgttgcgggatacatgaataaagtaaaaaatggcacgtttggcaggatccttaataaaaaaggattcagtaaccaacataagaatatttaaataataataaagtagctatgggtgattgcttcttggtgaacgaattatgttggatacagctgagtagacccacgctgtttatgaattacaatcgatcatcacgtcaatgaacttggatgaaacagttcaaatagaagaaaaaggtatagtttgcaaggtaacacacttgcaaattgcagaaattccccaagttaagtaagacaacaacagtgttaaaatgtaatgaaaaatcaaccatgctgatactgatgtgctccaccatgctgaaactgatgcacttgccccccgagctaatattgttgttcctccattaaattctccaccgtgaccatgatcttggcattgacttcttcttcagacatgtggatataaaattcgtggtcccactaggcgtgccaatctgtgttgacgaaaaaaatcgaacacaccggcctaggagatctgcttagctcctgtgcaggaccaaagattgatgagatgcgggcgtgccagtcagtttgctcctgcaactgacaagatatgcaaatagtagatctaaacagccgatcggctgacaagccgatggagtagttccagccgatagctgataatagccgataccgataccagccgatagcgatagggtttaagcaatcggctataagtccaatgtggataatgatataaaggcaatcggctgatgataatataatatagcaatataatccagtagaaaccaatcggctaacaatatgaaatagtagaacaaatattgatccgaaggttaaagcacacatcagctggaggtccgatgtcataagatccacaagattagattaaacattgaaacctttgttgccatcggctaaatctaacttatatgttgtgcaatccctacaagccgatgcaacgtccagataacttatcggctagcaccccgataaaacattagcatgaacctatcgacttaacaagacttatattatcaacaacaatctagtagatcgaacctaaccgatgcagcacgagattgtatatgataatctaatactcgatgagccgatagatctgtctaatgtgatggatataacaaatctatttagaacattataattgtagagatatatcggctaagacaggagatcagacctaaccgagacagtcccaactaaaccgatgcatctctaaacacaatgcaattagagatagaattgagatatcaggtaggcaaatatatcaaccaaaccagagcgatccaagagatcgaatcgatgcagccttgaacaacaccaacgtagtcgacagattcaccagggcccgacagaacataggacttaccccttcgctggagatcgaaagccgatgcagccctgcgtcaggtgccaaagttccgccggaagataagtaaaaaccttagggaagagggtggcgatgcgccgagagtattattgatcgatagattgatagattacaatgaccccgggtgtacatatttatacccatagggagatactagtccttgtcggacaagaaagaaactaaaaaggaaaagataaagtccttatcggacactaaacacactttcctaaagataaaagaaaactaataaactatgcctaattaatagataactgtcatgtcgcatccttcttgaactcgaactcttctagataagcttcctttgattgatccaactccaccaagaacacgacatcgtggcgacttgactcccatcggctgattctcgaactttgaagccgatactgactctaaaccgatggtaactttgggattaccaaatttcactgttaacacatgcccccaaattttggagtatgaggacttatgcttcaaaattatcttctgtctcgccttgataactccaaaaccgatcttcatttgcttcttgcaatcggctttcatgagctgatactgatgtgctccaccatgctaaaactgatgcacttgccccccgagccaatattgttgttcctccattaaattctccaccgtgactatgatcttagcattgacttcttcttcagacatgtggatataaaatttgtggtcccaccaggcgtgctaatatgtgttgacgaaaaaaatcgaacacaccggcctacgagatctgcttagctcctgtgcaggtacaaagattgatgagatgcgggcgtgccagtcagtttgatcctgcaactgacaagatatgcaaatagtagatctaaacagccgatcggctgacaagccgatggag

SEQ ID NO: 54331 - DNA, 5833 bp, Oryza sativa
acaagtatacatatacatatacaaagtttttatacgaatatatatttttatacataaaaaatacatatacataaaatttatattatacatatacgttgtctatacgtatatatacactttatatacatattataagtatcgggcgcctgcccgacctatttacatgcaccatcgaactggactggtaacgaacatcagcaagcttctccaccgtggcgatatgaataaaaaaattgacgttcctcacctcccgcagaatagtaccacctccatttttgaatatatctttttgacatgaaatttgttaagtattatttattttattgtgatttgatttgttaagaatggcttatacatttgcatatctgcagtaaaattagctatgaagtaagtttcatttattttgctttaacttattttatcattcagtttactttaaacattatttttttatctttactaatttgcattattaaagatcctttatatctggcgtgatttttttatgtttacaataaatttaaataaaacgtatagctaaatattatgtttaaaagttaagaacgtcgtatatttagagtaatatatagtgtagaaatgcaagaaaaaaacatatataggcacacatatagcttgtctaattgcagtgaacacaaggacaaaatcaacttgcatatatacattttggaagcagcaaattaaataatcggttagttacaaaatagaaaaaataaaaggaaaaaaataaaaataaaaagcaaggctcctcaaagaatcgtacagtaaggaaaccttttagaatcaagcttgctagcctattaatttacagtcccccaagcaatacgtccctagatgttgcctcaaacctttaggaacacatgaattgaccctacttgtaaatacttacattggatgtatatacacatacatatatcccgatcacataaagcattgatatagtacgtacacctacaatatgtatatatatatatggattagattagcactaattaattaattaattaatttcttagttcattagtcggcatgacctccttgtcatgaccaggtcactcttgagtgttcttttctttgctctctgatgaaattccgatgccaacctgcagccagggcaacgactcccctgccactttcatgtccttgaggtcgccgatcttggctctcttggcgctcgtgctgtccgcttcatcgtcctccgtggtcacgccgccggccgcgtcgttgatgcggctgctcgtcgcggtggtcttgttcacgtggctcccgttgctgtgccctgtccaggactgcaggtacaccgacgccgccgcgttgaggcagagtgcgccgtcgttgagagcggcgacctgctgctgctgctgctgcctggccgcgaccgcttctgccagtgggttcgtcggcacgttaaggtctagtatccgctggtcggtagggtcgaatattgggcgcccgagcgtgagctggtggcacatggcggccatcatggcgtggtcttgggcgacgggctggagcttcgtgagcgggtccgttgcgcccgacgtcagccagtggcatcgcttgtggccgccgagcgcttgccccgacgtgaacacccggtggcagatggagcactcgtgcaccttccccttcttcttgaacggtgagacggcggatggcgccaacggtgtcggcgcgaagtcctcgaccgacatcatcatggccatatccgtcgacgaagctccggcgaggacaatttcacctgcgccaacgccgcttgccgctgccttgccgtcagcatcagcactggcaccgatcgtgtttgcatccatgctgatatcgctggtgatgacatgagaggtggtggccctggtattgtcatgaggagcggctgagacgtgttgctgctgagtctgagtctgactagtctcgttgcggctgctctcgagcttcgcggcgaagcatcctttcaccttcttgtggctggcacggtgcccgccaagagcctggtgcgatgtaaacaccttcttgcatgccttgcactcgaacatgccacgtggcacggtcgagatgtgctgtggcaccacttgcggagcgatcactgtcatctgagccatcatgggggctgccatcgagattggctgcggcacaagaacctgttcctctcctcgtccttgctacctgatgcgcaggactcttggtccgcgtcgtcgacgacgatggctggctgtgcaacacgcgacgatgatgacgaagaagaagagagcatcacgagaaagttggcgaggtcttcctcttcggtagacggagccggcagctgtagctcggacacggagccggtcccgacggccatcactttagcacggcgcgagcgcttccctttcgaccacccgcccgcagccagtgtgaggtcgtccccctcctcctcctcctcgccgtcgttttcgtcgccaccgtcgtgaagcggcggcgaacggagcgagacgtcgaggcgaccgtcctcctcgtcaaggccgcacctgccatgatccagcaacgtcttccacgacgtgaactccttcccgcagttctcgcatgtcctgcagttccttggccgcccgggattggtccgcagcgcgtacatacgtttcgtcgtcgtcgtcgtcgggctcccggctgcctccgacggctcgccaccaccatcgcacggtgacagcgaatgatcatcatcgcggccgtcgtcgtcgtccatcgtgtcgttgtcgtcgccgatgccgtgcgccctcatgtggccgccgagcgcgcgaccgcacatgaaccccttcttgcacaccttgcagtggtgcctgtacgtcagaggaggaggaggaggctgcggcggcggtggcgggaccagccgcagcgactgcggcggcggcggcggccgatggctccccgcgacgaccatcgccatgatcgcgcgcggtcgatcgacgacgctttatttgggcagtgggcaggcatgcggggccggtgcggtcgagatcgatcgctgaaatccaaatggagacggcgagggacgttatatatgggagcccgacacggcgctactaaagatagtggcagtggagcactagaataggcatgcgtccgtggagctaaaccagctacttgaacgggatgccgtggtttcgatcagttgttaccactgcatgcggggccaccactctaatctgtttgctttcttgcgaacgcatcttttgaacccgacagttgcggctggcccgtgaccccgtgtcactcctctccacatgcagataacatggtcaaactttttagatttttaacggcaaagttattccctccgtaccattttaaatgtaatcttgagtctccgtattcaactttaatcatttgtcttatttaattttttaaaaaaattgaaaaacatgggtcacttataaagtactattcatgtgttattatactagtagctgtggacagaagtactatttaaatgtaatctggagtttccgtgttcaactttaattatccgtcttatttaatttttttagaaaaattaaaaaacataagccacttataaagtactattcatgtgttattatactggctgggatgttatattccattatctaaaaaaaatgtgttattatactagtagctgtggacaaaagtactacttctcccccctaatataagtgattttaacatttttcttgcactgtttgaccattcgtcttattaaaaaaattagaattattatttgttttatttgtgacttactttattatccaaattactttaattacaactcttcgtttttttatatttgcataaattttttaataagacaagtgaccaaactattgatgtaaaatgtcaaaatctattattttagactacggagggagtaccataccagtacgataaagtacggtaaagtactactaccagctgtggacagaagaaaataagatgaccaaaatgcggtatgcagaaacacacagagggtagttctgggccaaaattgagggtagttttggcccagataaacctcctccaagaaaaccaagtccagcagcccatatttctcatatcggcccatgaagctagatccagacgcttagtcgagccttcgatcctctcgggtgggtctacggcgcgttcgttctctctccatccattcacgcgattgacgcgagcgagggacgacgactccgacgatcttactccggcgaggcgagacgacggcgactgccgaccggcgagttcgctccatcttccccagagaaccccctcattctccctccggcgagctttcttcgacggagaagacgagacgcggacgagcgacctccctccggcgacgacaacagcctactccggcgagccccctcctccctacggtgagtccccttctcctccctccggtgagccgctaccgcctcgccgcgcgcccttgtccgccgcccaccgccggtccgccgcctcccagaccatccctctaagccccgatcccccacttccccctcccaagcgccaccctccccccacccccacatccccttcgcactcacgcgcagcgcccgttgaccgcgccgctgtcaattcgccgccctcggctgtcgcggggtcgcgcggtcgcgggatcgcgccaccgcccttggccgtcgcggggtcgagccgctgccgtcggccgtcgagctaccccgagaggccgagaaaccctaaggtaattgttgtttgcttcagtggtgctgtgatttaggattattgggaacatcttttccatttgaagccatggatggttgattgattgattgccagtgaatccagttgtagtaaatgtagatcgaaagggcatcactagggaacaatagaaattataaccatatgtttcaccaattgaactttgatttttgaaccttgtgaagctttgtacaattgttcttttgtataattatagtgcatatgtttttaagaaagtatgaaatgactagtactgaatttagatcctccactatatattatccaactagtagtttagaactacatgaaattaaacatattaggctttgggttataaaaaaaaaatcaccccttcccatttcgaatacccaacctcaaaatcctgggtatgccccacctctaacccacaagccacaggcgtagggtgccggccggtggccaccacacgcacgcccagccccagccctgtgatcgaatcaactatggttgtgatttgtgcatgtgaacaacttggtagtttaatgttaaatgttgttgccattgtagaattggtaggacttgatgaatcatttggctttatttttagggcacacttgatgttgatgatttgtcattggatgtacaaatgatctgtctctcagtctttgcaaagcagaccacatgttatttcatggttcatatatggttcatggtcccaatgaaatgattggtgagcttgtcaaagtaaatgtaagaccatcgagagtattgactgatagtttgatgctatgcttcttttttttttttttgctactgtaccagtcacttattttgctatcttttgtgaaagggtacaagcacaactagaatagcttatctgttgatttttttttcctatttgcactataatctagcccatttcttcgtatttttggtaacaaatcttgtcttagtcagtgaatgtctgtgatggtccattcagatattaggatggataaggtgactcaagctgttgagaacctaaaggaggaatggaatcaagctgttgcacagcttgaagggtgcattgctgcaattgaatcatgtgggaagatgggaaaggggacagaggaagcaagttcacttccta

SEQ ID NO: 54332 - DNA, 1353 bp, Oryza sativa
ctctgcgtgttgcatgatatgttcagtttacatggttgttcattgtgagtatagcatgtggagaagacacagtcacttgttattttaattaaatatttctttttataatctatactaaaaaaacgttttgtttactgcttctattatatgggcaggagtcttgtactgtcaaaatcgaacaaacatttgattttgaagcttgcagaatagtaaatactaactcacctaatgatttaggacaaaggctgggatgacatcggctgcagaaagtataaccgagagcctccgccgatctcgccagttgatggtccaggttagtgcacctgttttcaattgatattttatatgctaatgaatttttgctcttaaattttaatctaactactatacatgtttacaggaagtggaaagaagtgcaaataccttggcaacatttggtatgtttcttgtgttcctaactaaatctgtgtacaagagccaagaggcgcagttgtaattttattctaactattaaggcgaagttgtaagcgaactttaaaattatgcagatgaatcaacaagtgttcttcgtaaggctgaaggtgaatatcaaggacaccgctctttgctgatgcgtactcgtggtttgctatctacaatgcaacggcaagatgttcttgataggtaagtatcttccaccaatctttcgtatggattggagatgtatgatgtgggccatgtggccatgcggtaaaaattatgttttccgatcaataaagatcatacaaaccacatcttcacataatgcatgtgtcaactgccattcaccttttttccacctctggatgaactcctcaccttgttgcagatcatctttcattagatggcaattaaccgttgtaatctagcctactactgcagaaaatacatatcttataagactttattaggatcgcccagttggccagttctctcttatcagactgatactgcaaaatgcattgacccagaaaatgcatttggtgtggccagggtgcattctcttaattatctttgttcgaaggagtacacaagacagtccaataagatcctgtgcatagatattgcattactcattcttaatactttcatttggaaacactagtaaaatacttgtgcgatgcgatgatttatttaacataaaacatgattatgagttctcttggtaaaaaaaaatcctgcctcatgtgtgaaaaagcaatgctcttcatcttaaaaggcaaaagtaaaagagtgaagcttcttgtcttgctcaaatttcaaatggatggtacactgaagagagcaatcaaattgctcatgtggggtcaaccaatcccatgggcccacatgttg

SEQ ID NO: 54333 - DNA, 2416 bp, Oryza sativa
cattattttctgtatacatctcttaaaaagttagggagttggtggtggttcagattcaccactcaccaccaccactattcctttttaaaggagtatagatagaaatgctcttctcttttaaaaaaaggtggaaccaaatgcgcatttgatttaccaattacgttacttgatgattccaattttcttatctgccaaacaagtttctgccggtgcaatacttagtattaatactattttctgggttgtaccaattgctaattggctttctttaccaggatcatccttaccattggttttctcattttctccttggcggtgctatatgttgtctcgagacgtattggcctgttgacactgcaaaggaagctggccgatgccatcagatcaggctcaatatcagctgaagacgttgtagcaaaagtcaagaatgtgcctgtcccagcacctgctgctcctgctcctgctcctcctatttatgatgaactatgatttacttttgtgtattgtttgtacatgtagattcagaagaaaatattcaccatcattgtcagttttatatagtaaactttaaaaattctgattaaggtctctattaactttttttaccgaggaaatgcaggagctgtgtcatgtgtttcaagtaatatttgcaaatggaggatatgattggggacggatgttgttctcagccttcttcggttaaaaaatgtgttgattgcacagttttccaatctcttgaaggaactaattttgactcaaacggtatttactggtattgcgcatccatctgttcgacatgtaataccagcgaatgtaaggctagtttctattgccaaaatgtatttccttctataaccttagcgtgatcagtaaactggagtgaagttttgacaaaagccaaaataaacacggtgtttttcagaacttgtttgactttctattgttgtaggagagtatatatcctgctagcttggtaggtgcagatctcatactgaaattcaggattcaggtcttgcaaaaaattgctgggaataggatgaagcggcagaagtcgtgcaatggatgttgcaacacttagtcagactgctgttgatcaactgatttgattatttcaagcatgaaagctataaaaaaaattctgaaaaagagcaccagttcaagttctgaaataggagtaagagctaattgaatttgagctaaatgctaaaaagttcctagagcattcccgccaccgttccaccaagcagggcctgacaaattaagcaccgatgcatctctgagcctctgaaaacacaacaactactgctgcaaagagcaaattttgctcttccatggcatttgagaattgtttccgatgcatgtcttccatgacacttgagacctgtttcagctgcaagcaccacagaaaactaattttggtaaatcaacacatgagctccactgtctctgatgagatcgtatcgtattcagggattaagagagagtattatatgcatgccagaccatgaccatccatctctgcagttcaccgactcaaaaatactcagggagaccagctactccgaaatggccctgtggcctgggagcaaatgagctactgagttcaattggaactgggacaaatatgacgaatttctagttctctacagttctacttcagcgagacattgagtgaagatgaagattaagtggttgcacgtaaaatgagaaagtattaacacatgattaatttacttcaattattataaacttgataaatagatatattcgatattttaaattaacttatatttagataatttttgcacagaatatatcgcttagcaatttaaaaggcgtgtgctaccgaaaactgagttaaaatcaaaatcttaatcagaaaagaacagggcctgagcgaacgggggaagctagctggcgtgtgcggcacgcacttccgcgttaacgctaatgacagtaatttgaaaaaattgtgaagattttttttcggagatttttttttactaatagattaaaaaattaagttagatttgaaaactttcgacttaatatttaaattttaaagtcaaattttgaaaactttcaactcagattcgaaaactttcaactcgagattcaaaaactttcaagtccagatttgaaaatttgaaaactttcaacttgatgtttgaaaatttttaactcgagatttgaaaactttcaactcaagattcgaaaactttcaatcccaggtttgaaaattttcaactcgagatttgaaaactttcaagtccaaaattaaaaattttacattcagatttaaaatttactagtaaactaatcacttgtaaaaaataggaaactaatggctattaaactaattacgggttttttctcctacccatatggcatcaaaactgcaaaggaatgaaaaaaa

SEQ ID NO: 54334 - DNA, 1299 bp, Oryza sativa
caactccactccagacccaactcctagagctaaatttaggagttggagctgtaccaagcaggccctcaatccatgaggagatagatatgtgcttgttatgttatagggcagttcgggctgtactggtccggcccaataggatggcgaataaaccgggcccatatacggcgcacgcatcgcggaaccgggtgctccgcaggttcgctgcctttcgtcgtcacgcacatgacgacatctgggcctcttgcttgacgtatcggaacgccaaaaatccgagaaaattttgagccaaaaaaacaacaggctgatccgctgatgaccctcactgtgaataatcccggttccaatctgggtcaggacttaggactctcaggagagcgaggaacaacacacgccacaccagcggtcgttcagtccagttatacgctcctccttttaagcttagccatcggattgttgtaacggattggattatttactccactcttcgattaatacgatttatctattatattattaatacagctcgaaaaaaagacaccacgttcaccgtggaggctagaaattcccacgttaatcgaagaaaatatgaattatttataccgttggattgtaagaggcatagatttcaatgtctgagatttaagataaacttggcatgttaattaagagatacggagtacagtacgcgtgtagaattagaatcaatctctagctaggacctttatatgcaaacggactcaaaagagttttgtccgatttcctaaaccaattaaccaaagttagagatgaattaggctataatatacatatataaataaagcagcgggcaacgaaccactgtagaaccgtaatttggatgcgtttttgttaatatgaagatagatgctaacggcgagcgatggaaatccgaagcagcgggtcaagccgtgcggctgcacagtgagccgtatttgggtgatgcacacgtcagcaaccagaaaagcatgatggcatgtgcacggatttttatttgattttgaaataacacaataaaaaatgaaagaagagttcatatagaacacaattaaagattaattgaaatccgtaataaaaaataaaatagatttagaaactagaaaaatcaaatataagagttcaagtaaaaataaattttacaaacaactgaaattaggaataaaaaataagaaatattagaagaataattcatatagacacagtatgagattaataaaaaaaatatgagattaataaggaatattaaaagaagagtgcatataagaactcaatatgagatta

SEQ ID NO: 54335 - DNA, 2134 bp, Oryza sativa
tcacggcttgcctgacatccctccttttaatcgtcattaggattctatttcatgttttattaacaatttttatatgtcgtatcaaccgccaccactctactcctttataggcatgttacttaatttatctcgtcatgtgttttagatggttttttctttcaatagtctttatttttatcacaaattttagttatttataaattgtattcctaattgaaatcttatttttctttttctaatttcagaatttatttttttaaaaaaatagttaataccgtattgtgttcttttaatgtttttattttttattttcaatttcagttgtttcaaaattgtatttctacctgaactctcttttattttttttttctaatttttgatattattttatttttattctaaattttaattaatctcgtattgggttcttatatggattcttctttcaatattgtttatttttaattccgaattttagctaattttaaattgtatttctacttgaactcttattttattttctttttataattttggatttatttttatttcaaattttgattaatctcgtattgggttcttatatggaaacttctctaaatattccttattttaaattccgaatttcaactatttttaaattgtacttctacttggactctccttttcctttttttctttttctccgattaatatgggaatttttagcctccacagcgaacgtggtgcctcctttcaaaactgttttaataatataactagctggatggcccgcgcaattgcgcggctagcacctaaacaaaatcatatattttttatatgattttacttaaaatttattagatagctatcttattgtcttaagactttgaaagaccaacccttattatcctcgtgtttctaattatatagtttttaaaagtcacaccagttgctaccccttatgtcatctcgttctttatttgcttgctcaatataccactatttctttttattcttcttggaacctttaaaaattggattttatagtttctagggtttattgtcatgttgggtttcatttttataatttctagatgtcccgtcaaacgttgccattatactcctctacggcccgtctaatgcctcttctctttattgtcattgagattttaaaaatcgaacataattattgtctgggttcaattttactttctagaagttccgccaaaccgtctatggctttgccattgtactcctctatagctcgcctgctgcctgctgccttccttctttattttcattgagattttaaaatcgaacatgattattagtggtttttttttttactttttagaagtttcgaacctttaaaaattggacttgtagttccattttttataatttttagaagtcccatcaaacgatgccactatgcccctctatagcccgtttgccgtctactgtttattgtcattgtgattctaaaaatcgaacatcaatatcgttggaattcattttttattttctagaagtcctgtcagccgtcggcggctctgcaactatactcttatgtaccccgcccgctgcttctcctttttattgtctttgagatttaaaaatcgaatatgattatcaatggggtttgtttttttttactttctagaagtcccggtaaccgccttactcgtttgcttcatggcctgcctgacgtccctccttttaattgtcattaggattctatttggtgttttattaataatttttatatgtcgtatcaaccgccaccactctactcttttatatgcatgttacttaatttatctcgtcatgtgttttagatggtcttttatttcaataatatttatttttatcaaaaattttagttatttataaattgtattcctaattgaaatcttatttttctttttctaatttcagaatttttttttaaaaaaattagttattaccgtattgtgttcttttaatgtttttattttttattttcaatttcagttgtttcaaaattgtattcctacttgaactctcttttaaattttctaattttggatattattttattttttatcctaaattttaattaatctcgtattgggttcttatatggattcttctttaaatattgcttattttt

SEQ ID NO: 54336 - DNA, 722 bp, Oryza sativa
atatccgcgccccggtgagggagcggacttgcacgcagtacagcgaagggatgatgagtcacttcgctagtacattcagcggttctgtcaagtccgtaataccataccatgcatccctgcacacgcggtgatttacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgccgctcagacagggcggcgtgataggaggaggaagaagaggtcagcccataccgacgacgagggtcatgtcctcgccgtcgagggcgctccgcgggccacccgaaaggggaggcctgcgggtgacaaaaagaaagaggccggcgctcccagcagggagcgcccaaccggcaagtggtgcaccgtccacaacacttcccttcatgacctcgcggactgccgtgtagtcaaaagtttggctgagcggacgaggaagtgggaggaggagaggaggcaggagcgccgagagggaaagtccccggcggttccttccggcaatcggcgaagtgaggccaagcagaaggcccccgccgaggacatcgatgatggcgatgatgacctaggtttccaagagcctggggctgatgagctactgt

SEQ ID NO: 54337 - DNA, 702 bp, Oryza sativa
caaacaggttatggggatccttttgaatttccttttcgattccatctgaaaattctcacaacaatcaactctatcaacacatcaactccagacctcagcagttcagcaaatgcaacagatggagtctgagaagctcagatgacacagaagcaccactactgcacactgcaacagcgaaaggagattacgccctcacgagtcacaggaccccgcgacttgtagtggtatgtcaggactatggggcatgggccattgcctgcctagctttcctccgatcccagtagtggttcacaatctgtgatctgtgcagcttcttcaactcgcaaactgtctgttcagtgatcccctgataccagatatctggcatgtagaccatatattcaacggtacgcagacagagcaccgcattgcagctgaactgctgaagatttatactcactctcaaggcacattgcattaccggtttctcccgcacattaactgatcacaccatcatcgcatcaaagatgcaaataggagtacaacacaaacagtgcttgcaactatatttgcattggttttggaagactaggatgcgttatacccggtttttggttttggaagactagcgatgcgttatacccgcttttgcggttcagtgatatgatttaaactcgacccttagacgagagacttcaagtgaactttcttccctgatatatc

SEQ ID NO: 54338 - DNA, 741 bp, Oryza sativa
cacccgagaagtgtaacgtcccgccttcccccaggccgggcccgcttacatctgatagctttcataggtcatacactcgtgtgcacccgagaagaatttcccggtcggtcacccatcccaaattgctccaggccaagcacgcttaaccctggagaaaagaagttgcaacttgccctaggtcgggatgttacaccttcacccccttaagagagatcgacgcccccgtcgatcaaccctaggccaggtcccacctaccttcactacttaaccaatcataactgtaacgtcccgccttcccccaggccgggcccgcttacatctgatagctttcataggtcatacactcgtgtgcacccgagaagaatttcccggtcggtcacccatcccaaattgctccaggccaagcacgcttaaccctggagaaaagaagttgcaacttgccctaggtcgggatgttacaccttcacccccttaagagagatcgacgcccccgtcgatcaaccctaggccaggaacgtcctctcttggccacgtccatgtgtccagtgccagcgcatgcgccatgctgtgtaaccactcccggtctacaccagccatgcgcaccatgccatgtcttttctgcacactttgtcctcactcgtgtgcacccgggaagaatttcccggtcggtcacctatcccaaattgctccaggccaagcacgcttaaccctggagttgttggagattggcttccggaaaag

SEQ ID NO: 54339 - DNA, 4204 bp, Oryza sativa
  unsure (1)..(4204): unsure at all n locations
cttacattgcatttctgatcaataagcgagaaaacagatttggctgcgcacacatgagttgaaatttgcaactaattcgctacttttgcttggacgtgtgcaggggtatggttcatgcattgccacttggaggtgcacgtcagctggggcctgaagatggcatgggtggtgcaggacgggagcctacccaaccagaagatcctccctccgccgtccgatctccccaaatgctaaccgatcgacaccggccgaccagagacagagattgcgtcttgctcatcagcttccctgtaggatactcggatactcctctgcttttgctagcttgcttctgttgattgctcgcggttggtgctatggaatgcttttcttgtagtggtgtgcctttccgaagttgtgtcgtcatctggttagctgatgtacgaatgatcatgggcaagtttcttgatcagacgcaaggcctttaattttgggcttctcattattatttgtcaccttttgtaacatatgagggagctggatcataaatccacgttcatcccaatatttgtaccatcatttgatgtacggcaaaaggatttttttatgtactatttcatattaatcaatgtttgttatattgttttggagtaactcatttacctcggtgattttggtgtaactagtattgactaggggattagcttgctatgacaggaatagattgtggttgcttgagaatgttttttttaatcaaagtttcacttttttttaaagaaaataccgcaataaaattgccaattcactttactgataaggaatatattgtggttgtgtggcaagtctgtttttggcagctccagcaacacaggagtgaaatcaaatcaaaggtttaaataataaaaggcctacaaagtgtatccaagtccccaagtctaccttgttaaattttctaagaaaaaataataacactcgttaactgttatgcaggacccaataaaaagcagccaatcaaaatatttaggtagtaacctgacccacacaatgcttaggttacaaaacatttcatatcaatgaaaataacgggcggtatcgttatcacctttttccaagaaaaaaaatatttgatttgggacagagacttgaaaaattaggaggcgacttctttctcacattttttttttgaagagattacaacgagactcctatgcagtcaccaacgcaaaccaccaaacacacgtgtgtgcggcttccaccgtatgctaggaatttttcagtcatcaaatatctcctggagtgtggcagaatctttactcaacccactaaacatgcacatccatatactgttaaaattaaagtacactggttccaagccttgaacataacccgtttagagttaatcattgaggttaattactgcttgattatagaataaattgtactgtcatgaaatttgngaataataaattaatgacaatctagctgctctttacactttgacatcaatctgcacctctgtttgatcttattgacatgtggatacataactcacattgtcgatgtttgatgtcgcgattccggtatttgcatagtatggggatcgttggtactaggatagatctcagactaaggtaaaaaagatagatacaaggatttttatacaggttcgggcccctgaattgtcagataataaccttacatcctgttggccgaagccggtttggttttattttatcaaccttattcgacccattccatttttgggggtaacctatctaactgttatcgacttggcggtctgaaggtctgactcgtattcaacaacagggtagccttcctcctcaagttcgtgcccggcgagatcaaagacaacgttaaatccttacagccggtctctataggtaccggatagggttgatccaggcatatctctgatgtcaatatccggcagcttgtcttggcatatgtgggcttgtatgtagatcttttgtcttgatctattgttctgtgacacgccccgaactagtcccgagcggaactagcccgtgacgctccaaattaacctgttagtcgataccagtcccaaaacacagtgctggtatcacaggaaggcagaatatcacagcaacagaggtctctttattatagagtaggagtacagtcatgttgggctgcggacagatcccgagctcacaactgcattacaaaagggaagcggaagccaagacttcgaccaaacatcacaggcgcgacttgggaactaggccgaaaccctaaaactcatcgtagccggcttgctcctggaagaactcctcgtcagcgggatccgtttcatcttcttcagcaactggggggattatttatgtagagcaagggtgagtatgggagtactcagcaagccatgggaaataagtgtttaatgcaggcttcaaggaaaggctgttgtttttgcaattgattttatttaaactcttttctgaaacaactaagtgagtgcttctcaaacgacacggatgagacagtgcgtctcgtccggtcggagtatgtgcaatgtatcagtcttttgaattgatcaagattggcacccggccaacagctttcaaacggccacccgggcctggctgatcccatcagccgcagattttccaaacatcaatcccaaaccacatcagcaaatttcacaaagcagtagtaaaacaaaactacgctaggaatcacctcacatccgcccatgaccgtgggcacggctgttcgaacagtttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagatcaggtcccataccatattgtgccaggaaacccgggggtcctccccgacaccaccccgttgaatccacatgtctcttggcatcatggctcccccgattagctagttactcagccaggggtgtcccattccacccatgtggtcgtacttgtcttatgttcggatgaaattccaaggaaacggtccttaagtgcaagagcgggaaactgtacacccggtacattccccgggtccgcaatttggaaattcatttagttcgcaagcaccgacccaggtgtcgggtttttccgagtcttttgtaaaacccaagttttacccaggatgtttcttagaatttaagtttgaggcgaccgtcgatactcgtacagagtgcacgattaccgaggcgcaactaaggggttaagggggacatggtataacaattaacaatggaaggatcagatgcaacaagttaggtacgtccgccaatctgccttgcagacgggacaagcagattaagtgcaatcctatcaatacataatatttttcaagcaacataattaagttcaaatataggctcaagatgttcaaaggtggcttgccttgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaaattttggaagttgaacggagtcaaacggacttacggttgggaagatattgaatttctaagattattggatttttagtctaaaggaaaaggatttatttaaatcctttttgaaaaagaaaagaaaggaaaggaaggagggagggaaattagactttcctcgggcggctagggcgcggcccgagagaaaggggcggctcgaccgagcttaatgggccggccggcccaagaaggcggcccaaagcgcgcgcgggggcggggaggggagagagagagagccggtgggccgggtccatcccgcgtggtctcgggtgggacccgcttgtcggcgactcggctcaccgtgagcgaggtgcacgcggggcgtgctagggtttagggagggagccgcgacgcatgcgcgcggttcgcggaggacgcggtgcggcgggcccacgcgcagcctcatggctcaccgcggaccatgcgcacggggggggggaacggagggagcggctggccgggtcagccgatccggtcgtgccgaggtggctccgacgtggcgcctacgtggctg

SEQ ID NO: 54340 - DNA, 1258 bp, Oryza sativa
agggatttgatttgggaaggatttggattcgggattgaacttgacgatagatcggggatttgagatctgagatggcacagacactagacaacaagcaaagaacagatttcgcaattaggtttttttttaagagatagttttcccgctaggcgccacgatggaacgggcgctacattccgtctcccctctcctcctagagggtcttgtatttatacccataggtgtccccttgtccaagctagtagaactaaggaaaccatatggatacaatccgagtagtccttgtcgtttccatgtagaactctattcatccttccttatgcggaactcctcctatatccgaaggttgtttccgtagaagacatggtatgtggtgggtcctgccgagatttagtcaactactattaggtatatggtatccataactctgacacacatgttgaagaaagatgatactcgaatggaaaatcttgattgcctttttccctatatctcactacttttatgcaattcatattcaaaagtaatgggtatggatttccacgatgctactaacaaaataacaaataatatatcacattttgcttctgaataaagcatgtcgtttcagatgagctattatatattcgtattctttggttaagaactatataacttatttttattctacatatattaactagtagaatttcccgggcaattttttatgtagctatagattttatattcaaaatacaactggatttgacatgcaaatattgcttatattttcacaaatacagtagtagtatccaactatattgattagccgttataatctagatctatcattatcaaatagtgcatatttttcttcttttccttctactaagcgttaatttctggacctagagtaaaagtgtggtggttacttttcttcctatcttaataatatacgatagatacaacaatatagcgttgtcatgtgataaacattagagccgtaactagggcttgaaattagttgaatgggttataccataaggaacctaccaaccaatgactggtttttgttcaatttgttttactagtagtatttaattttataagtaacgaaaaaaatcaaattaaaccgtagctagttaacgtatatttagagttaaatttgttaatttcgttgcaagatatagaagttgaatttttacttgcatgtttgtggagtgatatatcacatgttaatacatcatctcaaattttttcaaatttttcataaccattt

SEQ ID NO: 54341 - DNA, 1033 bp, Oryza sativa
gccgccagcatgtagaacgtcgcaccggggtacgacggcttggtggtgaggagcacgttggtggtctggcccggggtgatgaggagggtgtccacggtgaatggcttgacgtagaccgcgtcgacgtcgaccacggtgagcgtgtgcccggcgatggagaagaagagctcgtcattgagcgcagcgttgatgagccgcagcatgtacgtcttcccggcctccaccttcagcttgaacgtatctgcatgccacacaatgcgtatgcgtataatcaaaatgtactagctagctagcttatagctgcaagtgtacagcacagtgcaccacctttggcagagcagttgtagagcggcccagggaggccattgatggtgaacgcgtcggagacgttcgggcctccgccggtctgcgtcgcctggcttatcaccgcctccgtgtccgccttccaccactcgcctaccacccaaacaaaacaaacgcaatttaacccctgatcactgatcagtcgccatgtttgttacgcttacgtacagacccacgccacgcgacagtacgtctgtcgtcgatcattacataccgaagacgacggggacctccttgtccggcgccgggaacgggtaggggacgccggccttggggaggatgatgatggggccgtacacggtggcgcggagccaggagatgtgcgcgtgccaccacagcgtgccgcgctgcccggtgatggtgtacttgtacacgtagctgccgcccggctggatcgggcactgcgtgatgtacgccggcccgtccgcccacccgctccgcagctgccggatgccgtgcctgcatcatcgatcgatcgatcgatcgtcacaatgcgcagtgatgagctcgatcggtaaaattttgcaccggaaaactgatcgatcaaacggtgaagcgtgcgtgcgcgcgggtgtgtgcgtaccagtggatgctcatgttgtagggggagtggttgatgacccggatgacgacgaggtcgcctcctcgcgaacacagtcggccccgggaa

SEQ ID NO: 54342 - DNA, 1372 bp, Oryza sativa
tatagttgtgtatagcttcggagtgtggctaaagtcaactactcttctgtttgcatgtcaccttgaccacctattatctttttctcatgtcttaattacacgcagaatgccgaatatgcaatataataattagatcatgctgcaatgcgaatatgcacttgttaatttgtgtgttttggttatctttgtcacgttttcttgttgacttgggtgcacgaatcaatttagctcagctctactttgaaaataggggattttatagccagctgaagtgcgatttactcagaaataaagaacttgtgtggatggtaagaactttcacatttaatttctagtacttgtgtacttatgttgaacttctttccataatctaaagaaccgctgtcaaggttgtcattattttaaggcgtgaagattggtggttcggctgagattaatttttggcggcacccgaaatgatataatacattagcgcatgtatcaagcgttaactattactccctccgtttctaaacatttcatgtcgtcgacttttttaaatatgtttgactgtttattttattaaaaaaatttaagtaattattaatttttttcctatcatttgattcattgttaaatatacttatatgtatacatatagttttacatatttcacaaaagtttttgaataagacgaacggtcaaatatgtgctaaaaaatcaacggtgtcaaacatttagaaacagagggagtataaatttaaaaatagctttatttgatttcttaaaaaaaacttttacatacaaaatttttacacaaaacacttggagaataaggaagtagccattcggaacagttaattgttacaatacatagtaatagtctgctaatatattgttctatgagtgattttccaggtgttgattaggtaccagaagttaaccatatttcttgtacaatataataatgtcttacttccttaatgaccgtaaaatttcttttgtcatgtactttagccttttttttatgatacataaaagttttgcgcatctttatattgagcattgggagaataccaattcaaaatataagagcaatattgatatggtctccgaattatcctttttaatagagggagtatggtctccctattccgtttgcttgtaatgtaaactcaagaattcctttaaccggtcgatcgggagagatcatcgaggttagttcgagttttctgcacctactattagaaatgtgttaaatcaggggtagttgaattttcgctttaaaactaaaggtcagaggcggcaccaagtggatcagttgcaaatcacatacttttttcgtcaaggcccctaccatattatccttacatgccaagggatgagatcacga

SEQ ID NO: 54343 - DNA, 703 bp, Oryza sativa
ttgttcatgccccatataatactttacatccaatgcaacagcacttaattatgcaatgatttctgctgtaacaagtaacaaagagaacactgaaatcacttttaaaattgtacaaaccaacctaggctctcaaagcaaatgtgaaggtttcaaagtgcgcctcagtcacatcaagaataaaatatagcaattatttgcaatttaagaaaaaacagttataagcagttctcatatagaattgacaacattgaccaagccgatattgtttaacatatatataataaaatttgctacctcctgaattgataaaacaaaaagtatggcagcccaacaacaaagtatttgcaacaattttgtttatttatgtactcgtagcctagcagcattgtggatactggatagtttggcagccaggttgcaaaattcttatgtaaaatttgataaatcaactagtagaggcaaatgaaaattggcaccgtaaaaaataccttgtttttcttttccaagcctccgataaccctatcaattgcagattcaaaatgttgcattgtaagagtgtgccctcacttcttgcagcaattaaagctgcctcattacaaacattggcaatgtcagctccagcaaatccaggtgtcaaagcagctaatctttgtgaataaaatgatggttccttgtccagtttcagctttttaaggtagatgcg

SEQ ID NO: 54344 - DNA, 1231 bp, Oryza sativa
tctttaggagttaaaaccatcgtttactctttaacttatcagctgtagccaaactttaaattttacaactcaatttttgagttgatttttccatcatagtttatttgttttattgacttctctgagaatacatatataaaaactttacgaccaaatcattttttattggtaataagtgttacgcttataaataattaactgtaggtgaaatgatggaagtaatatattttctcttgattttagatagtttgaattcaagttgtgggaaacaaatccacagatttgtttaattgggaaagaaaatggatactcatgaaagaaaaatataggcaaaaaggacaacgtacaaggagtgttctggaacagtttcatgcaattaatgcccatttttttattcaaagaagcatcaaaacagtgtcattgtatagttgtacacaaataaaagaaaaaagaacaaaataatgtcacaaaagttagctaagaacgggctaacacactaaaatctccttcaggagaaagcaatcgcaaattggcgaacaaatgaaatgaggaaagaagaatcaacggcatctgtggtaaggtcccgactagcatttgggcagatcggacggcggaggaagcagcttctggttcggatggctcccatccaacactagccatgccatcctcaggccccacgtcgtgtgcgcctccaaatgacagtgcatgaaccatacacctgcacgcacataattgcacaacaaaaattattagcagggtagtactatatctaagacgaatttcacgtacactaattgcagagataactaactaactaactcacctgggttgtcagcgaggaaacggatggccacccatccgcggccggcacgccgacggtgttgcgctcgacggggtcgacgaggttgaacttggccgggtcgttcacggcgtcgtagttgccgaacccttggccgatcacgaagaagttgaagccgtgcaggtgcagcgggtggctctcgatgcccaggatgctggtgtcctgcatcaccagctccaccgacgtgttgtaccgcagcaccagcagcttggtcccggtcttcacgttggtgttgttcggcggcgtccccgtgtagttgaacggcgacagcggcgcgacggggaagtccggcgcgtacacgccgctggagagtccggtgaagtgggactgcagcagcgccctcgccgggagcacgaaggagacgttgttcat

SEQ ID NO: 54345 - DNA, 1269 bp, Oryza sativa
  unsure (1)..(1269): unsure at all n locations
aattggttacaatgcaagaatcgaccttttgagattcaaaacatagcactgatatcgggatgtagattttaaaggatgtactcttgttttagcgccatatcgtctagaaaatcatcaaaaacatttagagagaatgacaaaatatataaatatgtggtatattatgtattccactaacatatgtaagtttaaatatgacttgcataaatataatacaaacacatcgttaattttttttacatgtacaagttaaatttaaatttggatgtttctgaagtgatatatcttcattgatctatactgttaatttgtactacctccatcccaaaatagctaaaaatacgtatattttgagatagatggagtatattgttaaaaggactttttaatgactttttcgatgacatgtaaaaaacgaggggacgttctcgagtgccaaatagactttccacttgtccaagtaatgaaccagtgaattaagtcttgcactaaacatgttggaaatgaaattcttngggggcatacattgtcagttgtcaaaactgttgaatcaatgtgatggttacttattcagaaanaaaacgaacggttccacatgaatgtactctttgtactttctagctgatttggttccacataaatccattcgatcaagtgccaataagtcaaacctgatctaatatgcaaataacttcgagcatgtattaggtgtactccatacatataaaatcatgacaacttaaaccaaaattcatataggagctgacatgtcagaagttattggccctatattttgataaggtacttcgttctctattcttctagataccatactatcttatgggtacattcaaggttaggttgtgcagcttaatcgaattaaacatcacacgacacacgtaccatacacgcagtgcagggagtacttcccctgttacatcgagattagctccttttgaaaagcacttcgatcgacggacaattattttgtcaatcaccatcagcaacctacatatatagtggtagtagtatagcaagctaggcatgcagtttaatttcgtcaatgtccattctgatataccttcaaagttcaccataatcatatcgctaagcggtaacatcacttcctgatatgctcgtcccttgttttcacctacagtacaatgaacctaggctttttattttttatgtatatataatatatgctcaacaatggctaagttgcgatgatcacttgacatggatcccaagatatatatctatccagta

SEQ ID NO: 54346 - DNA, 842 bp, Oryza sativa
ccgttgactccgaatgcagtgacgacagctagctgacatgtggtgcatgtgtgtggcaggggtgtggctcatgcactgtcacttcgacgtgcacttgagctggggcctgtccatggcgtggctggtcaacgacggccctctgccgagtcagaagatgtgccgccgccgtcggatcttcccaagtgctgatggctgatccaatggccgggccgggacagattgtttgcgaacgttttgctgtgtgcgccttcgcgttccgttgtgtttgacgtacaaaactctttgatttggaccgacttaattttaactggtgtgtgccgattttgtggcaagtgtttgggggttttgcccccgtgcttaattcctctttcaaaacagaataagatgtaagcaactcggttctgttggtattttttttcgtgggcatttgttattggtgtgtacacagtcgaatccataatgtaccagataacttctatatttaattgttttggtttttgatcatttcaatataaaaaatggcttaagctcgagagtaagaaaagcgatcacattatcttactatctgttataaaaccagccccgaaatcgacgtcggtagctaaacgcggaagaaaacgccataggagatccaaaacgacaacgtcaccgagatacgatatttggtaacggagttcagccgtagcctacatctccagggcactgattacgggcgctcctctccgatctagcatattacagcgtatcagagttacaacgactcacggtcggttgacgcaggcaaccgctccctctcgctatgctaagtcaccatgcggttacaacaagcacgcccctctatt

SEQ ID NO: 54347 - DNA, 1812 bp, Oryza sativa
actataatctcaacgtgctgaccacatagttaggcaaatgaaaacaagcagaaaactttatataccttttgaacatcctgcacaaatctgaatcttgatttttgttgtaatgcaggatcaacgtgactgacctgatcagcttaggcatggagcacggcacatgggagatgagcgaatccaagcaccgggtcgtcctcgcggacaaaacataccacggcgagatcagagtcagctcacgttcacggcttctgcaaaggtaaacaaatcaccagacgcacgactgaattattgattattcatgttacgccccgttgacctccattggtctctcctgattggctgggatctgaatgtgattcgatgttgatgtccaatgacaggctcaagaccacgcagacaggttggaggatgggcgcacagctttcgtcagtagaaagattgtgaacttcaagtctataatcagttggggcctgtgggaggtttagataagtatactatagtactagcaaggtaggattttgtgagtaacaacggcatctaatgcccaagattgatgtggttcgaagtgtatgtatgctgccttttttttttctatactagatgtatattcagaacattgtagagtcatgaacctgttaatggatgtgaattatgatactacttcaacctctttttcgcctttgtgtagcgatacatacggtcagactttaccatctctaacctccaatatattaattagaatgtatgtataattcaagtgtgatgataacgagttgatttttcatcaaaaccacttatgtatcgttatattctttacaattttttattaccacattattaggacgtctgtgtgtataagaaatcatctatttagaaacctagggagcaggcttacaccgggaagtatctactgagaagtaccaattaggtcaaaccgtgaaaaccatcacatatcagagtatcgagaggaatgtctgcatttatccactccataattcatgagaacaaatgcaatcaagtttcttgtgtccttggaaaatccattcttagtgatgtcctccgaaaagaagactagttcagaaataaatcaaaggaaccactattctttcatcgtgtcatcatatacaacgaccaaatataaacataagcaaaaaatctattatattattaaaggaatagaaaaaaggagtctccacgttcgctctcatggcctaaaaattctcacattaatcggagaaaaagaaaaatcagagtccatatagaaatacaatttagaaatagctgaaattcggaattaaaaaataagaaatattagaagaggagactagagtccatatagaaatacaatttagaaatagttaaaattcgaaattaaaaaataaggaatattagaagaggagattagagtccatatagaaatacaattaggaaataactgaaatttggaattaaaaataaggaatattagaagtagagtatagagtccatatagaaatacaattaggaaataatagaaattcggaattaaaaataaggaatattagaagtagagtatagagtccatatagaattataattaaggaaataatagaaattcggaattaaaaataaggaatattagaagtagagtatagagtccatataggaatttaaaactaactaaaattcggaataaacataataaattaaaggtagagttttgagtctgtataaaaatacaatttacaaataactaaaattcgaaattaagaaaaacacgtgaagaagagtttaaagtcaacatagaaatacaatttagaagtaactgaaatt

SEQ ID NO: 54348 - DNA, 939 bp, Oryza sativa
ttatattatagtacatgataaattataagccaaccgtaccaagtttgaccatgccttatattaggatgaagggattaggcttgccgatcaatgagtgaaaagcaatagttagatcaacttgggtttactagactaatctttgtgtcatgcaagccaataccgctgccacgtaatcattttcatggcaaaaccacctaaaaaactactctggggggttatttgaaccctttttcatactttaaggggtagaatatccggtttcgtactttagggggtgaagtaggcttattccttctggtaatggagcatgggaaataccctataagggaaaaatgatgggctataacatatcactgatatctacaacttacaagaaaggctcaggtcattttgtagctcatgctaactatgacaaattagtaattatgtgcacaaaatggtttatgtgattttttatattaacattttggctatcggagtttttcggtactaaaaggctgaaaattggttatgtttcattttctcattttattttgtgtgttttctctacataggtgctagggcctaatgcgttgtgctggctctgcccaatatcaaggaatacaggcaatggtattcgtttccgtacatcatatgatataccactatctacaccaccaatttgacatcaggtagcattacattcatgttagatttctggtaatttgctaaaaaaacttggttgcctatccaagtgtgaaatgtgctattctcgcaatagcatttgataacccttcataaaggaatagcgtttgtcaatgtcttgaaactcttgcatcaagagtttgtacttgatgtgatcaaatgtgtaaatgacactcccgtgtaagatacaggaagaggagctggatattcctccaggctccaaggatctatatggattttggagctagaaatgtt

SEQ ID NO: 54349 - DNA, 1690 bp, Oryza sativa
actaatataatttttagaacaactttcctatagaaaatatttgcaaaacacatatcatttaaccgttcgagaaatgtgtctgtgaaaaacgagtgagtagaagatcccaacctacagagccaaatagtctaacagatgattggtagggtaagaattgttaacctttttaagtctatacaaggatgatgagtgtataaggagaaaaaaaagagcatcttacgaatgggaaaatatacatgcggtgtttaattgaatggaggacatgcatgcagcatttaatttcgtcgtgtcgttaataatagcgagagcaacccacgtacatgtatgcaaccaagtagcttacggtcgaagttttatttctccttggttttagtaataaaatatctaattattctaggagagagtaagtgggtcgctaaaatgctagactttgtaactctattcatacccttatcttttttagcggggaaatgtaaaatggatagcctcactgaatttgatgaaatatgcacgccattaacacccactagcttgcgtgttcaatctatgttctttctgacacgttcaggttgaagtatataggtcatgcgcatatttattttacacatcgaaaggccaattctagacgaacttggtttttttttttttttgaaacttagttgtctgcactataaactcgggagacgagcgtagacgaagagtacaagtgtagacgtacgttgtgatcaagtattgagtgtatttgagtagctagcaaataaccaagtatttggtcgatgatcaattcgctgttcccttggcaagagatatttaattaatcagctaactccacacaaaatgtcttaagcaactaagcaataagactgagtgactgactaactactactccgtactacttaatttaccaattggcatatagaataccgatgactcgacatggattgctccatattataacctgtacatgtgaccatccttacgtactgtacatacattagcatccgtatgtgatcatagtcgcagagatataaatcgtgacgtcgatagaaaacaaggcatcggtccatccatggccatcccctaactgtggcagacagctcatatagtgcctgcatgcacgagctacatctacatcaagtatagtagtattcttaactcatggtggtaatttgattttctttattaatatgaacatttttttatttggggagtttctaaatttcagttgttttaattttatttctggaatacgcaaatagcgtgtatatatctttatactagggttgataatttgttttttttattaacgtgaacattttaaatttggggagtttctaaatttcaactgttttaattcttttctataatttgtaaagcgcatacctttgtactagggttgagtacttgagtatatcgctttacacacttggctgtattcttttggaacccctccccaccacacggaaaacagagcgataaattaacacgtgcttaattaagtattagctataaaaatttgaaaaatggattgatatgatttttaaagcaactttcttatataaactttttcaaaacatgtgccgtttagcagtttgaaaagcgtgcatatgaaaaaatgatagagataggttgggaagccataagaaataacacagctcaagagcattagatatgtacagacagaacacaa

SEQ ID NO: 54350 - DNA, 767 bp, Oryza sativa
caaattaagaagcgattatatcccataaccaaataaacctggttgttcattagttttctcaaaatctcggtatatggcgatgattagttttcttgagactcgttagtttactcctatatactccatgcgagctgcgtcacatgcatgcagatgcaagtggagcgagcccccataatccttctagaaggtcttggtcattggacctgagccaaagaccaacaacactgacaggtgggaatcttttcggatcaacatgaggatgttagtactatattttggaggggcttcaggcttttcttttgtttttaaggtttttttaattcatggggcaatcttcttttggtgtttatatatagcaagttgatctttttatgtgtgatcatggacaatcggacataaacaatcgtgtcattcatcatcacgtacagtatgcattaatcgtacgtatagtactagtacagtagcagttacgattgcttcatctgtaaacaaaggtgtgctaggtgcattatggctgaagaaagcttgttacaactactaataacgaaatgacagcatggacatgctcaattagcaacctactacacgtacgttacacgacgtagcatcaagcaccactcatatatgtactaatacacccatgcgtgtcgtttcatcgtgacaccacactctctggcagtgtaaatccgcgagaagctcacaaaattctcacgcactgaatttaattaaatacataaacatcagcatggaaacgttctattttaaat

SEQ ID NO: 54351 - DNA, 702 bp, Oryza sativa
atgatggagaacgagagggagcgagccaacggcttggattcgccggagggagtccgtcgggggcggattgcggcggcggcaaccggcggagagaaaagggggaaacggcgacgaggtcacgaggggccgattcccagcggtgagagcatctacacggctacgggaacccattgctagcgtcggattgggcggagctatgccaagcgaggccggcgacgagcaggcgctacggagcacgggcggcgacggcggcgagcatacagcgagcggcggcaacggtcggggcggcgccagctagctacggggaggctactcgtgctactacccgagtctaaggggaggagatggaacgaggagggagaacggagggaggcactaccgggacgaggcggggcgctgagacgagaggccgacggcacgggagtgatctctccggcctcgggccagggaagaggaagaagagggcgcgcccggagtccccttccgcgtcctcgctcgtgccggctcctccgacacgcgcgacgatgaacggagcacgggaggcggcgataatggagtagaggcgatgggacaaaacaagaggagaagggagagagggcgcctgggctttatagggtggcaacgtcgatttgggaaccgacctagggcggtcaagggagggagctagcgctcggcggtcgcggccaaagcggcgacgggggg

SEQ ID NO: 54352 - DNA, 1722 bp, Oryza sativa
atctgaggtatgcatcttcagatgggaaacatctatgttttcttgtgataggtgtcataattgggagatactatgtgtgattttatccaagagcattgcttcagaagttgtttaattatattttacagtgttgctgtgctcttcttatttcctagtcctctgcatgacacttgttttagaactctgatccaacagaactatgtgtgtgctgttttatgctatgcactttgttttttccctgaggaaaactatgtacttttcttgatatatgtgttgcaatgttctcttgttaaatttgacaatgctatgttatcactaaatcctaacttcacatactactataaatttatttttgcttgtcaatcttcttgctccactctacatgtatgatcttttgattaatgttctccttgcataaatcatggctcttcatctcaacatatttagatgccaatgataacttaatctgagggatgcttcatcctctagcatatcttgactttgttagcattttacttttgttacaaactgaggaactgagaggtcttcttatagaggattccgacttcctatgctacctgacaatgatgccaaagcacaatatgctgatctgtacatatattagtagaagctcccacttaataaacgtcatagggttcatttgttttaaggaaacaaatcctataatattattggccccatgacgtggttaatggcatgtgagacccattccccatgggcccacttatcagctaccacgtccctactactttatgttatattttgcattactcactcctaagttgtcttttttttggacggagggagtatatttttatgtttgactagaatatcatcgttacattttttttattacatactccctcgttccagaatataacaactttgagcactcaacatttgtcccaaaatataacaacttctccccagcaatctcgttccaaccaatcataaccctctaccattcacttttcccacctaccttcactacttaaccaatcataactgtaacgtcccgccttcccccaggccgggcccgcttacatctgatagctttcataggtcatacactcgtgtgcacccgagaagaatttcccggtcggtcacccatcccaaattgctccaggccaagcacgcttaaccctggagaaaagaagttgcaacttgccctaggtcgggatgttacaccttcacccccttaagagagatcgacgcccccgtcgatcaaccctaggccaggtcccacctaccttcactacttaaccaatcataactgtaacgtcccgccttcccccaggccgggcccgcttacatctgatagctttcataggtcatacactcgtgtgcacccgagaagtgtaacgtcccgccttcccccaggccgggcccgcttacatctgatagctttcataggtcatacactcgtgtgcacccgagaagaatttcccggtcggtcacccatcccaaattgctccaggccaagcacgcttaaccctggagaaaagaagttgcaacttgccctaggtcgggatgttacaccttcacccccttaagagagatcgacgcccccgtcgatcaaccctaggccaggtcccacctaccttcactacttaaccaatcataactgtaacgtcccgccttcccccaggcccggcccgcttacatctgatagctttcataggtcatacactcgtgtgcacc

SEQ ID NO: 54353 - DNA, 1123 bp, Oryza sativa
ggaggcaacggcccgacagtgggaggtagacacgagttggaggtgaggcatcggcggccacatcgaagccacggagatggaggaggatgatgggttggccttgatgacgggggcaaaccagagcttatggttaggagacgatgattagtggtgacggatccaacggcgaggagctgccgaagacggggaagacaacgagacagggacacttgcgccgccgacttgggaagagaggtgggagggggagaaggcccgggatgaagggggagttgccggcacagttgacttcattcggccaaccggcaaggccgggctgcggcacatggggctgaggcagaggcatcgcatgcatgcaagcttgcgagtggcagcggttgcgctgggaatgacaatagaagaaatgaggggttagggttagaaatatggtgcacgattcttaatatgatccaatggtttaggatttgcatgatttgtaaggtgtttttccgtcaaatagcatataaacattctcaaaacaaaaggatgatatactatttttatttatactttatccatttttaaataacgacattttcctccaattcgtttgtttcaaaatatttttatcaccaccacacttttattagcagaattttaattttgaccctactctccgtagctatacttgtgaacataaatcaatcttcaccatagagcaaacttctaggtgcttctattttggatccatttcttgccctccacctccactttatccattctttaaaatcatctccaaataactaccaatgacaatttggttataaattttgttaccatgatctacgtgttttggtgaaaatttctacagtatgttattcgaaaacagagggagtactcaataattactactacctttatttgtaaatataaatatttctaggttattggacagatattaaggtagacaagaaaagatagaaatcccacaataaataaatgatggataggtagggtgtatgggtaggtgggagtgagagatgtgaagaaatttgaacgggaaataataatttataggacaagtagtatgtactccctagaatagtgtgctagatattcttatattttgaaaccagattcaaacgtt

SEQ ID NO: 54354 - DNA, 708 bp, Oryza sativa
cacgtacgaggggtcgcaccatcacggcccgcaggcgctcttcccgccgcacatcgcccagccaccgccgccgacgtcggtagtgggcttctccgccgcctccggcgctggcccgccgccgtcgtcgcccgcggcggcggcaaggaagaggaagaactatgtcagggcggccttctcgccgacgacgtccgaggacgacggcgacggcgccggccggctacggccagagtggccacaagacgatgggacgtcgtgtgacgtcgccgagttacgacgacgtggcgacgcggagcacgccgcgccgcgtcgtgtcgcgacggatcgctcgtgcgacgatggcggcggcggcggctcgacctcggcctcgtcgtccgtggcgcgcgctgacgccgctacggcgctgtcctctgactcgccgccgaccatatggtcgtgcctggactggccgtggtcccaggaaacactgtttctgtagctgaagtgagtggggagttgacttgggaagatgactcgatagtacagtactggatatctacttgcaaggtgtaattagttactgatggatacgtataagtagtggacaggtcaaaggatctgaacgtagctacgaaaaaagaatacaacttgtggggttcgcccgacgctggaaagaccaccgagctagctataaacaggttgcacaactaacgaacttaattgctaatacct

SEQ ID NO: 54355 - DNA, 1794 bp, Oryza sativa
ctaatttcataactcgcatggaaaccacgagacgaatcttttgagcctaattaatacgtcattagcacgtctgtgttattgtagcacttatggctaatcatggactaattaggctcaaaagattcgtctcgagattttcgtgccaactgtgcaattagtttttttatctatatttaatgttccatttgagtgtccaaagattcgatatgatgtttttgggaaaaaaattttggaaactaaaccaggctatctctcaccaaacaaccaaccttgcagaaagtgagacgacgatcgagcgaacagaatatgaattccctttccactcatcgctttctcaggggcggatccaatgtgggtgtagagcggactcaaatcccccctacacctatcggacccatggatacccccctgagtccccccttcaattttttcgtcctgattgataagataggaggtgctaaatgtattttaatagtattttagcatagtttaatactgagattatatgtttatattgatgtactcggtatgttgaggggctgtttggtttggtgccacacaatgttatggatccgcccctgcgctttctccttataatttcttgacgacgcgttgagcttcggttgatcccgacgcctgcaacagtgccacggccgcacggcgtcgtcgtcgtcaagcgcgagtatgatcttgtccggcacagcgctacagccacgatcgaatttactttcgaatttcgaaagatctcgttgtgtatacctatggcaccaatcgatcttgctcgctgccactgccacttgctgcacgcactgaaagggagacgtagagctgttcctctgaaaatgaccgataaatccacgaaacgattcggtttcacccgtaacttgacatgatatttgggcgaagcaactgttaaactgtcatttgctcattttttttcaggcagtttggtcgagcctatactcggggcctatttagttcccaaatttttttttcaaaaacatcacattgaatctttggacacatgcatgaagcattaaatatagataaaaagaaaaactaattgcacagttatgggaaaaatcgcgagacgaatcttttaagcctaattagtccgtgattagccataagtgctacagtaatccacatgtgctaatgacggcttaattagtctcaaaagattcatctcgcggtttccaagcgagttctgaaattagttttttcattcgtgtctgagaatcccttccgacatccggtcaaacgttcgttgtgacacctaaaaattttcttttccccaactaaacacatcctcatttactctgttacagttgaagttgaaccacattgctcccctcgccacaagggtgtcaatccaaacgtcatctcggtcaattctgggatagcagcatggtcgaggacacgaggtagtataggaaatactactccactatgcactgaaaaagtcgtcctgcaatttctcgtaaaaaaaaaagttgtcatgcaattggggtagacccagccggggcaggacatggtctctttcgctaataaaaactccgccatcggctcatccatcacacagcgatggacacataaatatatactctctcggttcctaattaaatacttcatacaattttgactagttaaaaacatactctctttatattttattgtataacgccattgactttttaaccaacgtttagtcattcgtgttattcaaaatttttgtgcaaatataaaaatatttatgttatacttaaagaacatttgatgataaatcaagtcaaa

SEQ ID NO: 54356 - DNA, 70872 bp, Oryza sativa
  unsure (1)..(70872): unsure at all n locations
atactatgagataccaatttttatattgtaaatttggtatcacttagtatctaggtactatgaggtaccaaatagtacaatttggtacttcatagtaccttctcaaagatcgtaaaattgctcaaatttttggtacctccttaaggacggtaaaatttctcatacggtaaagttttcaagctttgaccataatgaaaaaataatttatatttatcgattttacggttctagagaggtatcaaaaggtaacacatttgacactttgattttacactagtaaatgtggcactttcaagtacctatgttcaataaaatttctcttgattaaatcatccatttacaagatattgcctcgttaattctacctatcatacccttaactattgatgattcataggtcaacaatgcaggaattttgggggttacatttgattttggcaacttagatcttaataaagcggtgagtatatcacgagacgacctatattgtggatcaagagtactgtgtgctgcgaagttaagtatgtttcgtgcaacagattgagggcaagagtgcaaacgagacgctggaatggttgatgcaacacaccgtggagactgccgagaatgcagaagaatgcttgaaaataaactatcacggcaacaaaaaaaccatacaagcactccttcctctcctccaatcatcacctgatggaagaattgtaactgtttcctctgtttttggacaactatcggtatgtacatatgcacacattttagttataaatattcgatgtgtagaaaatgattcagtgagttaaaatttcaacatcgaatttaactagaattagcttataaaatccaataaatttatgatattatgatgtagtttttgagacaaatctacatgtactatttttttaaaaaaaactaagcatttgagaaattattgacagttaaaatttaaaaaagataagaaaatcttattctaaacaatggtggactgaacacatcaaagcagcttgctgttctcttaaaactaatctagtttcgatctgctccagtttttcagtggggagaaactcaaagaggagctcaacgatttcagcaagctaagcgaggagaggatagacgagctggcagagctgttcgtcagggacttcaaggacggagagctggagtcccggggatggccagccagagccgacgcgttcgcggcctacaagacgtccaaggcgctgcagcacgcttacacgagggtcctcgcgaggaagcacgcctcctcctcctcctcgccgttgcgcgtcaactgcgtgcatcctgggtacgtcaagacggacatgaccctcggcaccggggagctgacggtggaggaaggcgcggctggccctgtcgcactggccctgtcgccgccgggaggcgccacgggcgtgttcttcatccaaaccgaaccagcgtccttcgtctgagcgtgattcctccggaaaatcagacgcagcttgtttctcatatctaggggtgggcattcggtctaatcgagaaattcggttcggttcctcggtcttctgaaaaattcggtcttcccaaccacaagaccgatcggtcttaaaaaaactcaagaccgagcatttcgatcttcggttagttcggttcggtctcggtcatagaccgaactagccatagcagcagtttaaacagcaaaaagaattaataaaaaaaaactccatacaagatcaatgaatcgaagcaactcggatgaagaactacaatatgatgccactagagcatgattcagaaaaaacaagaagcaaatcaaagcaaatcgatctccacaattccacctcaagctccagatcccgtcgatctcccaccatcgctttcatccccgaccgacctcctcagccatctaggtctccagcgcaggtgaaagggcggcgccgaggcggaggcgtcctggctggaggcggcaccgaggcagaggcggcggccgcggcgagatgggtcggagggcggaggcggcgccgacgcagtgggtggaggctggaggcggagggcggaggcgacaccggcgcctgcgcggtggaggctggaggccgagggcggaagtggcgcggtggagacggagccgcggaggccgagcggaggtgagcgcgaacgtgcgatgaatggggaggaatgcggtgctgactcatgaggagggagggtggggcgtgacgcgtgggggcaggcagtgagagagagggtggaattagggtttatgttactaggcttattgggcctcctaagtttattgggccacaattcggttatctcggttaattcggttaaccgagcccaatgaccgaaatacccgaaataaattcggtcttttgatggctgaaaccgaactactaaccgaatttctcggtctccgtcttttcggttcggtctaaatatgcccacccctactcatatcaataagacaatgagcacctttacggtggtcttcaactctccgtaataacggtattattatcgattataagtggtcccaccgtcccaagggttaatttataagttctacttcaagtagaaaaatggtttttctactgtcaatagttaagtagtactataaagaagattgtaaattctatcaaactataaagctaagctaacgtccattaacttctaaaactcaatatgcaaatatgtgacatcattacctcttagcaataattattatttagagtattttaaatatcatgcaaatatgatatattatttacaattttattatatttttagaatttaatatgcaagcaatgtccaatcattatctccacatcatttcacattatttaaatatatacatctatcatttctattataatacgcgttaatccatatataccgcaatgaagcgcatggtatcaactagtactataaatagttactataaatcattgcaaaatacctctaattaagacaactagcatggtggcccccgcagattgcgcggctagtatcattatattttctctcatataatacatatatgttttctcaatatattattcaaatatattaaaatgacaacataattttaaattttgcaataactttatgaaactactaatgtataatattcatgttgcattttatatacgtattagttattaattatttttaatatcaaattttagttatttgtaaattatatatattcctatatagactctagactcatcttttaatatttcttttttttaattccgaattttctgtaaattgtatttctatatagactctaggctcttcttccaatattatttatttttatttctgattttttattatttcaaattgtatttctatgcggactctaaactcatctttcaatattctttaatttttaatttcgaattttagttacttctaaattgtatttctatattgactttaaactcttcttcccatgtttttcttaatctcgaattttagttatttgtaaattgaatttttatatgaattctaaactctacttttaattttattatgtttattccgaactatagttagttttaaattcctatatgaactctatactctacttctaatattcattattttttaatttcgaatttctatttttttcttaattgtatttctatattgactctatattctacttctaatattccttatttttaattctgaatttctattatttcctaattgtatttctatatggatatggactctataatctacttctaatattcctttttttaattccgaatgtcaactatttctaaattgtatttctatatggactctagtctcctcttctaatatttcttattttttaattccgaatttcagttatttctaaattgtatttctatatggactctgccttttctttttcttcgattaatgtgagaatttttagaccatgagagcgaacgtggagacttctttttatatttattccgaactatagttagttttaaattcctatatggactctatactctacttctaatattacttattttttaatttcgaatttctatttttttttcttaattatatttctatatggactctgtactctacttctaatattccttatttttaattccgaatttctattatttcctaattgtatttttatatggatatggactctataatctacttctaatattcctttttttttttaattccgaatgtcaactatttctaaattgtatttctatatggactctagtctcctcttctaatatcccttattttttaattctgaatttcagctatttctaaattgtatttctatatggactctgtcttttctttttcttcgattaatgtgagaatttctagaccatgaaagcgaacatggagacttttttttctattcctttaataatataatagataattgaacaatgtgttggggcaaacaaaagaagattgcaatgaacagattcttgccaatgtgccaatgtcatggctccatagcctcatacagaaataagtacaacagttgcagtttgtcaaagaaatgataagcaagttttcggtctttaagaggtggaacaaaaagaaagaaagaggaagcaagggaggataatacatcaaattactagctgataattgaggatttttcttatgtctatatatatatatatatatatatatatatatatatatatatatatatatatatatatccggttctgttttccccctaatctttgctctatgtcgcgtcttgtgggggcacttcctgttctttctcgctggcctctgtggccgccaccggtgcagcctcctcggactctttctgcttcgattgtgcggtctggatcaagtggttgtagctgcccttctccttgaacagctgcgagaaatggatcttgcagtagaggatcccgttgagcgccgcgtaggaagacgtcgtcaggatgcagcccccatgcgagcacttgaagcaactcttgtggtaagactcaccctccagagttagctgaacaaaaaaatagattccatcaaatcagattggtttagagcaggtacaatagcagactataagccagctataaacatattttaaagagataaaaaatgagagataagagtagcgggctacaaatttgttgccagttgtagcacatacgtaagaatacatgtgtgtatgacaggtagaaccagacattaattatgtagtacatgtttatgggtaactattgtatgaattagctattaaattgactatagatgatttgtagccaatagttagctatactattaaacttgctcttatactcgttcaatttcaatgctatcatctttttaaattttctttaacggttttgacagattgaaatttgtgtgacgctactttgcggtcgtaactaggcagcattctgtaccttctccaatgggtacacagttttttggcaggctgcacatttatcttgagttccagagaatgctgaagatagcttgctaggagctcttccctggaaaaagtttttgcagagtgaatagtttgcggattatcaaatttggtgatatataactaataaatgcataatgtgtgaattgggctataaacaggtctgtggggtttgtacctggtcgctcttctctgaagatttaccacctgagtaccgggacagagagagaattcagaacacaataacttctcaataatgtccaaacatctcgacagccactgtgtcttagcattaccttgcgagaatttctttgagaagctccccgtctctttgaagagctgctcaaagtgcgtcttgcagtacaggacaccatccatcgaagagtagttacacatctgcagatgcgtaaatgttttgaacgaaaaatgtgatagttgatttaattacctaataaaaactgaacatgttgcagggccgatcgatgccatatatacataccgagagggtccccttgcagtggctgcacttgaagcatgtcttgtggtaggagacgccgtcggcggtgaggaggtcgatgaaatggacggtcttgtcgcacgccttgcacttgtcctgcgtgccggtgaacgacatggcggccggggtacgtatactagcaccgggtgattcaccgatcggtcgatggaaaaccttcaggcctcggtctggtccagctcgaggaatcaccgtagctatagcttcccaactcccaactcttccgatcgatcgacggaggagatcgattcagggcgagacgagaggaacgtgggcgtggcgtctccagagaagggagggaggagagatgggcagacagcaacgggcgatggtttaaagggcggggcggcgtgagcacgggagcaaagataggagacgggatgggctccgggccacacagatgacagacggacgaacccggtcgtgcaaaccgggagagaggcttgtttaattttgggaggggcgagcggacaagaattttctatgcctattctatgcctaggtgtcatggcatccatcatttgcatgtgatttaaatagttatagaaaaaattaaaacaatcaattatgatgatacaagtctatacacaatcatacaagaactgaactagagaaacaaaaataataatatcagacagtgaatagtacccgtacaacgcagataaaatttgttatttttatttcttcatatgtagattgattttagacttacatgtttgtatagtatcttatattatcgcagtctatcttatctaattttataatatttttataaaattatttaaactacatgcatacacctagacgccatgatatttgggtatagaaaatattttcccaggccttcacacgggggcgcgcgctcatgtcgcgcgcgctcaactccggctgtggtccttcttcaggtcgtgcgagccgcgaaatcacaacgtggctccatggatctctgcgagacactgtcgtgcggggcagttcgttcttgattatgcagatctctttctggttgggtttgtgtactgggcttcgatccgctctgctcacgacagtctgggtggacaagcgtacatatctgtcacagataggcccgtataggcccatgaccgaataaaggaataagtccattatacctctctcaattattcccctttgtcgaattacatccctcaaccacaaaaccaggtatattacctcctctaagtgttaaaaccagtacaaaacaactcccttaatggtttctgacggtggttttgctgacgtggcatcctagtcatcgaaaaaaaaaattaaaaaaatacgtgagggcccacatgtaagtggcatttctactcttcctctcctccaccactctcctctctcctcccccttctctctccctggacaggggaggcgccggaggcgcggaagatgtggggaccgccggaggatgcgagcgcacgccgcgagggagaggatccactatcagcagcagcagatgcaggtggtggcggcggtgacggggaataggaggatgcaggggctagggccgaagcggagctcgaacaaggaccggcacaccaaggtggatggccggggacgacgattcggatgccggcgttgtgcgccgcctggatcttccagctaacgcgggagctcgaccacaagtccaacagcgagaccgtccagtggctgctccagcaggtggagccggcaatcgtcaccgcatggggacgggtgtcggcactgacatacaggggccctccctcccttccccaaactgcgccctctncaggtcgcaccaccaccaccaccacatgtgggctgccgccgcggcaccgcccgccgcgtccgcggcgttcgccggtgccacatcgggttcgcgaccatgtttgccggctacgtggcggcggccatgccggggctagaactaggactctcacaggacggccacatcggcgtgctctccgcccggtcgctcagccagttctaccaccaggtcggcgacgctagtgccccggtcaactgtcgcacccacaccaccatcaccaacaccatcagcaatagcaggaggacggggaggatgaccgcgatgacggcgagtccgatgaggagtccgggcagtagtaggcgcaccgccaattgttcatctatgcgtctcacgttgtctctttggagaagaaaaagagaattccaggaaggggcatgcagctaatggagggggtatgcttttgttactgttgggttgttcttcatggggatttttatgtctgatttttcctcgtgtggtgtcgaagctggaagaggctactacttgctccagcgacttgttgggatggatcatgatcatcttcagttgttactcctgctgctccatggatggtcgccggtttatccccctccaagtgtttaggtgaaagctcaatctttttcactccacagtcagcacatgacatgctctttgaaaggtagcttgatgagcttatgtattttgccggaggttggcggcgcgaatagacagcgggaggatgcgttgccggcgagcagatcgacgctgtggcaggtgaaccctccccgtgcgggcgccgcggccggcgatcctctccctcgcggcgtgcacccgcatccttcggcggttcccacacctcccgcgcctccggcgcctctccttgccgtgctctgttcgaggagagagaaggggaagaagagaggagagtggtggagagaaatgccacttacatgtgggccctcacgtatttttttaatttttttcgatgactaggatgctacgtcagcaaaaccacagtcaaaaaccaccaagggagctgttctgtactggttttaacatttaggggaggtaatatacccggttttgtggttgagggatgtaattcgacaaagggcaagaattgagggaggcaaaatggacttattccccaaataaatatcaggccagatacactttaattgctttgtataagcgcaatgggctagagatatacacgggccataaaatgcacaatcacgtgctttgcttgcttatgcgaagaagaaaaggcacgtcaaccttttctttttctagatctttcatgaacatgtttttgaccgtgatacggattggtagatttgtctagagctattgtcttctttaaaagaaaaaaaacagcacagaccagtggcggaggacgagaaaaaaataaggtgtggcagcatcaacacagcgaaaacaacataatagggcgaacgctatggatttgtaatgtgctcccatgcaccgctaaaagttactgcaaaaattgttttgatgcaacaaatcattttttttgaccgagaaaactaccagggcttttcctagtagtgtattttcattaaaacaaaacgtatgtacaaagatatagggaaaaaggagcttttaaagagttacaaagtttgtatccaatcaagaactatttgttttcaaggctccttcattctacaaatatgcagaagaacttcgtttctgaataggcgtttccacgactgaaaggatggcacaacattctaaaatattagcccatttctctgtttccaaatatgccaagaagcgatgaaaaagatttcgagaaaaccttttcgagcaaaattcaatcttcctaagattatcatttgaaagaatcctatatgatgattccagttaattcccaagtgttgccaacacctaacactgaaaggacaagtgaagaagagatgaagtctggtttctctctggcctgcattgcataggacgcaagttaaatcatcattctcttttgcacaatgcctcctgtccggcatatcctagtgtttagcttgtcactgaaaagtagccatgcaaagaccttgattttcatgacacattttgtcttccatagctagacaagaggtctggggggctgcagtggcacaaagttgagcttgtataactttttttgcagtgtatgaagatgaattccaaataaagctccaactatcaccttgccctggctgcaagtgcaaaaggttaagttcttcttccagcagcaggaattcctcatagaccagggcagataaaggtagcaagaaagaatcctctaggggtcttgtactcatggccaacacagattcctctttatgaatcaccagacagtagagtgttggatacttgctgctcataagaccatcactccataaatcttcccaaaataagctgaggttccagttataagagtgcatttaccaattcccctgaaaatatcagtgagggctaaaatgtccttcagccagaaagaacccttgttaagacacatgtgggggactcttgcaagatagtaaattttccatactaagtcaacccaaggcaaatcaactccattgtaaagtttaactaggtgtttcataagaagagcacaattctgaagcttcaggtttaccactctcaaaccccccttttcttttggcctgcaaactaagtcccatgaagccaaggatcttcttgtggagtttgggttatttccccctccaaagatagtttttccttgcattatcaatcgatttgatcactgtgacaggtagttgcaaggaacacatgaagtaagttgggatggctgacgggactgaatttatcaaagtgagacgccctccttgggggagaaacattgaacttgttgttaatcttctttccactctatccaccaaaggggcaaagtccacaatcttaggccttgttgtccccatgggcaaacccaaatatgtgaaaggcaaagatccaattgtgcagccaagtaaaccagccagatgattagctttttcagaagagacatttagggggtataagctagactttctgaaattgactttgagacctatggactaagcaaagttattcaaaagagctttgagatagaagatctctctttgtgaggcttttagcagaataagggtatcatcagcatattggattattggaaagcccttaccatcattttcattgttgggtttagagagaagaactaatgagaaagctttattaacaattctctacagcaattcagcacccaagacaaagagcaatggggacaaaggatcaccctgtctaacccctcttttgcagccaaaactattaccaggcactccattaagcagaacaacagagttggctgtggataaaatcatttggacccaattgattcactgtgctgggaaacccatattttgcataacggatattatggctgaatgctcaattgtgtcaaaggccttctcaaagtccaatttaagaattatgatttctctcttagattgctgacattgatgaatgtattcaaaggcccaggccaggcaatcctgaatggtccttcccttaaggaaaccatactgattctcactgatcacctttaaaataaccccttgtaatctgtcagccattagtttggtgagaaattttaagctaactcccatgagagagataggcctgaagtcattaacagtttcaggggaattcttcttaggcactaaagtgatgaaagagttgtttaaagactgtagatcagtacatcctaagtggaaatgtgcagccaatctataaaagtcttgggcaataatgtgccaacatcttttgaggaaaacaccattaaagccatctgggcctggggctttatctgcaggaataattctaatgagagtatccatttcctgagtgaagaaaggatccacagggttgtccagacaaacatgatcagggaaaagctcattcaaatcaaaccccattgtgggcgaattagagacacccattctttctctaaaacttttatagaacaaagctgctttctgctcatgcagggtgaccacctaaccatcatggtcctggatttgggagattgagttagctctatatatttatgtagcaatggactgaaagaactttgtgttttcttcacccagcaacatccatctattggtgcatctttttttccagtacattttcctgaactctaagagcttaattatgtggcactacacaatctccctgaaactcctctcttgtcagagacctggcctcctcaacaaggtctagaaaatcaactgctcgattgcaatttgcaagcagaacatttagtttagataaatttttgctccagcttaacaaccttttcctaagcattttaagcttaaaagagatgcattttgcagggtcctcaaagtcaggatccaaggcccaagcagaattgactatatcaaaaaagccctccacctctacccaatagttctcaaacctgaaaattggggaccttggaattttagtatcaatcttgaccacatagggcacatggtctaaaatgtttctagtcatgggtagcacagatgtattggggaagttcagtgtccaggaggcagaagtgaaaacccaatccagtctttcaaggagagggttttgttgcatgttactccaagtgtacctcctgcctttaagagggatttcaagaagacctaaggagctgataatatcattgaaaatgaagatgtcattcatatcaactccagccttattcgtgtcctccactgacctgtaaaagttaaaatctcccaagaaaagccaattctgctgactttctatgtgaacattctgcaaccaggcaacaaaatctgctcttgcagggccagtacaagaaccataaacacaggtgagagaccaaggctgtgaggattgtctggaggtgaagtcaacagtaaccgaaaattgattgacctcttttgccacccccatgaacaccttaggcaacaaatcatattgatatgtgttaggattcaaaattcccgaatgaaattttcaaaaaacatttttgtgaatttagcaaaatatatccaaatttgatcacattttgttcaaattttaaattatttttggaagatagaaattgccaaaccgatagattaaacctttatctcggttgtgttatataactactagcgcttatataggtagctaattacaagaagtaaaaacaagataatcggtataggttggtttgctttgtgtaactaactaacgacaaagtcagaccagctaatcacgcatgcatgcactttacctccagtgaagaagttaatccagctaatcacgcatggatgcactttttacaacgagtgaaaacaaggcaatcagtgaagaagtttatcatgcatgcatgctatttaccaccagctaacggaattgaggtatggcgagtgccatatctcgtcataccggaagctccgccactggcacaggccatgcacatcttatatagtgaaagcagcaagctttcttacacgagaatgtgccacatcatcaaaaacatattagccgtcggataaatagttcggataaataatagtcattggatcgaaagagtgcatgtattaaaaaaatcacaaatgggctaaacatatggaaatttccagaggtttcgagtatctattgtcctagcaagtatagatactttgtaaacaaattaacttatatcaaaaccttattaagagctaaggtaaactaatagaccatatataaaagttcttaaacaggaccaaaagttgcgcaaagcgtgactatatggctagttttattgaatatagtggaagaaaattgcattccctaaacaccaagggttaaagaaatccacaagtttgccatgtacagatatagctacgatcaagaagatgttttaccgctgcaagcgtccacatccttgtcttctcctttatatttgcaaaaggccaggtgttgaggtctttttgtgctcgaaggtttttggttccttactttctatatctcccacacgaccaacaggatgagcgtgcacatttctctcttgggcatgccttggtgacttgcgagcattttccaacactcaaacattgatctcggactccattggcttggtgtgacttgttgataaactacaattttgtaactagttcccaaattctcctaatgtatttgtattgaagaacaggtgagaggatgattcatttgcattgtgatagagatgaagtgagtgttgttcggtcaaacactgactaccagctgatctgatgtccacgctctattttgtatcaccagctaagtgaagagcttgcattttgttggcgcctaaggcttccaaatgagggcattgaagtttgtggtaactcagccaagacattgtgctttgtaaacggataaggacgtacattcaccgtggttggttagcttctacggctatgttcttatgtcaaggttcccaacctctactcattcgtttcccgcgcacacacttcccaaactactaaatggtatatttttattttaaaaaaaatctatagaaagatgctgtaaaaatcatactaatacatttttcaagtttttgttaactaatacttaattaagcatgtgctaataagtcgttctgtcttcctagattggttcccatccactggtgacgaacacaaccttatgcatgttggatcacattccataaggctactaggtccaggatggtttgcagatgaggtcttgtatccaggtcttattcttcaagtcttggtgcattgtcctttttttttctttagatgttacattcattggtcgcttatgttgattttggaggctacaacaaagagggttttgtttgtctcgtcacaaggcgtttccatgcccacccatggcttccaagattctacccatttgtgccacaaccatttaagccttagggatttgtaaatttctcgagatcgagcgtcctcaacccttcatttgccataggtaagtgtgttctctttcagtcgatcttgcatttggctccaatgaagtttccggagccaacccatatgaatcgctagcattgcttgccaatcttctccaacgacttcttgttgactgtaagagcagtgattacatctgaggtggtggcatttacatgcacaaatatagttttagacgatatttgtaacggaactctggctacaaggtacaaatgctcacttccctattaagtacttgggcatgccgcttgcgtcgagaaagttgtgcaagccacctttgaatggatggcggggcatctaggaggatggtaaggaaggaacatcgggttagcaggatgcacaacccacgtcaaatcaaagctttccttttttctttgcaaagaaaatgatatcttcaaagaacaagcccacaagagacttgtagtctactaagtctcgtcatgactaatttttttcctaaaaggcgacaattaatcttaaaaaaatgtgttatatatgccaacatcatgtcatatcatgatattcatgaggatgacaacgcaaacggctagctacatgagcgccacgccgtcacgtcaacctaatttagattttcatttttttttttgaattgatcgttgttaaactttgtaaagttatgcatgataaaaacgtcctaccattcggtaagaaaaattacgttgtgaagacaatacttacgtatttgtctttctagcagaccgacagattaatttcctgccaaagtaatagccctcgtgctaatagaagtatagaacttctgtaacttttggggaacttttgggtggtcaaaaaaaatgtgaaagaaagtcgttccaaagaattttagttactgttataactgaactttctaatactgccacttggccagtgactcggcgagaggtacataacacccagtttttttgtaagtattccatgttaatttggacgtcgacagatgcaaaaattattttgatatgacgtagaggaagcaagaccacagagaaattagatttatgtattacaacaaatcaccggcctcgacacaaattatttttcgccgtacttttaagtcgtgctcaacgactggctgcattatatgcacagttactttgggcccattaaattattaaaatgctttaatgtaaaattttgctgctaaaaatgcttagtctattcgttgcatcggtggaaaatgccctcaaaaccagaagataggacggtgatagataatattgatgtcttttctgtgtttgttaccctccatttgtagttctcgatgtcgttttattgagttgtgggacatttgtgtcttgtgccttacgtggaactgcatatgttcctgatgattgcatctgatgatctaataagtcctttggttttggtataagcagagtttcgctgtaaataattactcccttcgtcccactcactatgtcatgtacgtattttaaaatttaatttatatttgatcaatgaatattttattataagttaaatattatttgatgaaaataatatcattgattatcatttaaatttacttttatatgattatgattttgttgctacaaacattgtagtatagtaataaatttaaatttaaagattagttagaagattgtgccaaatttaaatgtatcttagtgagtgggacagagcgagcattgttttacaaatgttaaaaactacttaattctattcaaagagatttgctccggtccagcacaaagtatctcaaagtaccggtaactcacggtaccaaatcgttttcgatcattggatctagctgggcaggatgggcattgttagatccaatgatcagaaacgatttggtacggtgaggtattgatacctcgagatactttttattggaccggagcaaatatcttagagtggcattttccttttcaagcttcagactagtagtatttcacgaaattcctccttttcacataaagttagcgtttcttttataccgaaagcaaacttgaatttctcgggactattcggtggagtagtaccaaaatctccaggatgccctgagagcattacctattccaatctgcaaacagttgtacttcgttccaatctcaaattaaagtccattagtccaagcaattcatcagtacagaatacgagtataacagctctgttgacttccaagttcaacatgctcctcctccatcttgatctggtcctcctatcctgcattgtattgatacctgatcaagaatctatgggctttgctaaattgattgcctctatcccggctgtaccgccgtaccaactaggcaactatgtacaattcaaaaaggaaaaaagaaaagctatatatgcaaccatagaaattggagcatgatattattagtacttaggagtgtatatgaattcagttgttagtgactctaaatgggcagagtttctcccatttttcaaaaaatatcacttctggcattattgtccttgtaaataagtaagctattgtgctcgtgagtaaacgccaattggggggtgtttaggtaggctctgcatgagaaagtcttgaatgtcacgtagtagcggtcagtgtcatagttgttagtagttactgaccaacccagtactaggtacaaaatatgaacataacagatcagcacatgacgcgtctggatcatggagtttatgcacgtctgtctgtcttgagcccctgacttacaagaagagattgcctactggctactgcgataaccctgatttgtctacctttttgtatagtgagcaaaaataatctgatgagtcatgagtttctttcttcaaaaaatatctgatggacttaacattagcacttcttgcccacctttcacgaacactgacgtttcctgaagttgtgcagtggcttcggtttcgttctctcgtatggcccttgatcatagttactctgtcaaagcaagccggatgcgttacaacttgcaacactctgaacacaagaacaagaagtcagatcaaagaagaagaatctgctagtaccatgcatggaccaagctaaaggcatagagaaatgccatgtatgtttagtgtcctagacgattaaggcatcccatcgccacagataacgtagggtcgtcacacaggaagactgtcgccaataattgcatctgtcaatataaaattgctgggatatcatcggaacaagttgtgttaagccgccaaggctcgtgtatcgatcggtttcggagaagatcggaagaatgcatgtctgatttgagttgttgcacttctttcagtataatgcatgtggctcaattgtgtgattgcagtgatgatgtaagatacaagcacgtaactcttgaagtttggcggcttcctactctttgcgaactgcggctatcgatgacaatatgggctggtggtcaggcttgtacctgctgctgcaattagatgcagtaggccggagtaatcaatctgcagttcagtaacagtttgttactgtttacagaagcacgggggaattggaggttcaaatcaaacttgagcagcatcttagttttcgtcccatagggaacttgattaaaccataaaggctgcacaagggcacaattatctttttttaaaaaaacgatccggcactatacatgctaattttattgaatagagcaggactaaaaagttttgtacaaatataaaagaaaaatataaaaaaaaaagtaaaactaagtgataagctccgagagacgttctgctaaagttcaggtcttggtttcctcctccattttttgccacgagcactattgatggattttatgaatgttaaaatccattggtggagaactttttgatgaactgcattggcttattggtcagtacattaaaatcatcggatcaaatttcacactacaaagtggtagctactcaatcaccgtaaaattactcatgattcaacatgaatgtatcttgatcaattttatggtctgagaaggtaaaaaagatgccacatttgtagtacaaaatttgttaacaaaacttacactaaaaatttaatgtatctccctgtacctcccaaagtccataaattttttctatattttggttccgttttgaacttatttcatttacattatttgatggattattaccgtggattatctacttcattgtaggttatattaaatattttagaaaataaacacacaaatagcttaaaacaacctaaataatataatagcagaatttttttaagaaaaatatttttcgaagcgtggagaaaaatccgtttcaataatctaatgaataatcgaaaaaaagggccaccagaacactctgtccttgaattaggacatctaaaacgcaagagtgagaaaaggtcacagaaattgacactacctactaatgcaactgcataccataagttaatgatcacagtcaggaaacgactttagggagaccacatacgtatattttcttagcactagctagcataagcatatctttctgcagagtccaaaacccagtttgctaccctaacaaaatcccctcttgggggaaggattgtatttttaagaagcatggatctgtcttgtgcaatattaattggggtactagtactaaataaactccgtagagaaatgtcaaagaaaaaaaagtattgtgcaatactaaactccatagagaaatgcaacagaaagaaaaaaaaaaggaaatgattgtcaagcaatatgcattcacctactccacgaggtgattaagtttaagaaacagtcagcaaagccagcagcttagcctttcgtcgtttcccctgccctattcagccaaaatgcaaaagaaaatgctcccggctctcaaacttgagagttgagacaatatcaatcaatcaacaactacgcacatttttgcatggtgcattttgcgtccattttatcttgacgtggtcgtgatctcactacgactctagaaggagtacaaaaatacttgctcgttgtttgcatgcgtacacagcgaaagtcccctcctctctttgtagccgacagaagccagccgacattttgttccgtcaggctataccacttgtagtcagtagagtgatgttcagattgtgacagtgaataccaaatactgcacatgtctgtacaagtggcttgcgtgcttgatcgtataagggatttataattatataaatggagaggctaattcaagaaactagcccgtgaaaggacaaaacattacttcatgtattcccaataaaatactccatccgttcaaaaaaaaaaagcaaaccctggatttctgtgtccaactttgactgtccgtcttatatgaaatttttttataattcgtatttttattgttattagatgataaaacatgattaatactttgtgtgtgacttgtctttttaatttttttcataattttttcaaataagatggacggttaaacgtttggcacgaaaccagggtttatcttttttttttttgacggatggagtatgtgttcagtacaacaaaattctctgaacgtcactaaataggtttattttagttcatcccagttcataggctaaatatttgtacgtttcgtagctgtccgtgagcttttaattatgagaccaacatatatgtggtcgtcatgaagtatatctgtgtatacgaagtgttattataccactttgatacagacactctaccgtgcgccagtagttctctgtcaacgccaagcaggggatacatgcaaaacaaacatctggagttcatgtgtccgcttcaaatgctgttgcggtcaaattttattgaactatcaaccttatgtaagatttgattgagttcttgtaaatattttttcaagttttaatgaatagttgagctctctgctttactttaaagaaaaggaccgagttcgggaaagagaaagacctcgcttcactagaagacatatgtccacataaagactaactgaaatgcacaacattaacgctttgacaatattattatacgctaggtccaatcttcaggcatactggtcgcaaatttgtttatttcttgagataagatacgctctgattaatgaagattgcatttttcactggagacagacgagaggtatacttgagtagtggttcttttgttgagagacaaatcatataaaaataatgagcttggttaactagaaatgatatcgtaaaacacagcagtctccaaaagctagtttttttaacgaaaaaaaaagctagttttgtgtactctcgctattggtggatcgcagaagtccacaaccaacccacatttatgtatgtgaactggcaatttcaaaatcagatgataagggaggattcttgcttaattggctgcaggtatcattcttctgaagtcgtttgtaccaaccacaaaattaacaaaaggggttccatcatctcctgattgcaggtgttgctgaaccgagcaaacgaattctctactgcacagttgtacttcgcctcgtcagaaaagattagccacagtacgtccttaaaagccactttgccattataaactagtactaatcatgagctctgtacaatgcgataagatttgttcccatgagcaatcatgcattttgtggcggccactgtatatatgtcccccacaggttaacaggatgggatggaagtggtgccataaagttacgtataacctaattaggacccattcttgaaatcgacaaaagcaagaaataattctaagcattttttcagagaaaagattggtgtgtgtcatgcagatatgcagttcgctggcccggcgaaaaaagatatgcaggtcgctagttcagatagatttgagggcactagtcggtctactttactgtatcaatagctctaaaattcaaagttagtgattacaaaattcaatatatataatcaaccattccaacatactacttttgatttctgttttcttaaatttaatattcgaaaaatttataaaataatagatacaaagttattatactcctacttgtcatatggccttcattttagtttttcttaattaaataatataattctgaacttggaattaatcattacaaagttgtcctcggtacggactatatcagtttatagtatttgactattgccagatttatttgctactcctattagcatgagatttttctccaagtatcaatttagtgtgcgtgtgtgtgtataatgggaaaagaagtgcacttgaactatttgctcaatcctgtatgtaccttttgttacaaatttctcttttgtagcagttaatgtttgaagaatggtcaactgtagtccttcattggtacatgagaaaaaagaaatactttaccgtgtaaagtccactgaagaaattttcgatgaaaaccgactttttcttaatcctttatgtctccgactacttgaaaatgtggataaacattatagttgtattaatgttcatacgagtaggatacgtagatacctgtctacacttctactgtgtttttttttaaaaaaataagtttacagtctttatgccttggactacttagaaatatgaatgaatattatagttgtattgttcatacgagtaggatatgcctgtacatgtttataatggtatgtgcgtatgtacgagcgtgtgttaatctgtaccgtgctttaaaaggagaaaaaaaaaacataagctgtcctacgagtcctcctgaccatgacaatttgtcactagcatccgaggaggaaaatctcctcaccgttgctagagacttgggacgatgcggggaatcttccttggaaagaggtgcgagagaactagagaagggcgttatcaagatgcagggaaatcctccattcctcccatcaaatgcaaagaacaaatgaagtggcgggaccgcgctcccctgctgacagtgcactcggcagcctacaacagcagcagcatggcatccccttttttctctcgtagcgccatgcatgcacgatcagcacctacgcccccgcaatattattatatggctgtcacgatcccacccctttgatgagaggcccatgcatatgcacggttacatcacggtgcacacgaacgacgcacccctctcgtcctcactgtccctagctcttttaaatttctttatggttccttctcttctagtactcgtgaccttctcgcagctctccacacggatgcatatgcttcacccctctctgtacattcacaccttctgtcggtgtgtcgattttaacctgaatcatctgggcactatcacactactagtagtttattcagctgttagtatgttactgcacgacgtgcacatctgtacttgttcaggctcctgttgcaaacgcacaagtcccactcacatcgaacagtccatacagttttctttgtgtgggggagagcatgaaggggaggatcccccacgatttcaccggggcctagtgctcctcttcccgattcggccaactgggcagctcccatccctgcaggtggccacgtacaccgtatccctgatttcctatgcgtgtccgctggccaccgaaacagataagcttatttcctactcctagctagcttagctatctcctggcaggctggcaccaccaccagctcccggctcctgacaaaccgaaccatccaacacgtacacgtacacgcgcgtgcgtcgtcgctgcaggcgacaccgggcgagtgatggcaacgtccggacgtcgggtcgtaacctgtgcatgccatgccaaccatcctggggatggaccggatccactgctcacgtcgacgcgacgtagcgtttccaattgaccgcggcggcgtcggtggggcgacgacgagaacgtaccagcgcgcgcgcgcgcgtcgcgcgggaggaaacgagacgagaggtcgatcgctagcgcccgcacgcggcacggggtgaaacgctggggaggccacgttttttttttcttttttggccccgttctcgtgcggttttgcgccgtcgggtaagcggttaaaatccccacacctaatcaaacgcgggctcgatccgtagccgggggagatgtggtgctcctcctgctcatcatcatatggcaatcttggcggattgattagcaggggggagggggcagcacaaaagcgtggcgttggttccgggtccaacggccccgaatctgaaactctgaaactttcaacaacggcgatcgatgatgagtatcatcggccagtatggctgattgattacagggtctgcgtggctgcaattcgatttcgtttccatcttttggactttctgtactcgcgcggcgttgaatggatagaggggacgggacagggtgtgagcccctgtgttggttcctgctgtgcctgtgctctgctacatcattcttcgcttctgccacaagtcacaaggcctcctttttctcctatatatggagaaaaaagcgcaaataaatattttccgctttttagactctgctgcgctttgggataaaaacaagtgaggaaaatatgcaaaagaaggaagagttaattaattaatcaacgctacgtatatgcgcgccgtgttacgtatctcttgctgactttataggtaggagtactgatttttcctttttaccgctgatgatagtatatacaaacgatgttacttaccaagtgacaagacgtggacgtgttgctcacaatagtttgaaaaataagtaaagaaactaataatgcgtttttagacgggccgcgagaggccagcaaggcgaagagaaaaacggtgccgtttggtagtctttaagctggctacgtcatcgcacaatttgatcgttttgcccccaccacggggactcggggagaagagccaagccatctctgcagctggcttcgatgattttatgaagtgcgtagtacgaagtttacatgcacggcttgactttctttacgacctctctctcacatctcacctcgtgaccaagctggatatagcaggaacagtgccatgcgcccatgcttgcccgtgagaaaaaaaaggggagaagttaagtaaggtgagaaaaaaaaaagtttaaccaggattcgactggatacgcctttgcgtatttatttgcgaaaaaagagaagaagagagtgagaggaaaaccaaacacttcttttattaatcaccaccgttcacgtcgcctataaaactcgtacctacctgtctcctccctgttgaaacggcacaaagctccatccgttctgaaggctttgtggccgagttctcctcccccacctcctcctcctcctcctcctctgtagccgagctgaggccaacgcgagtagtgacattctcctgcaatggggtgcaagtcgtgcgagaagcccaggccgaactaccggaagggcctgtggtcaccggaggaggaccagaagctccgcgactacattctccgccatggccacggctgctggagcgcgctccctgcgaatgccggtaagaccaatcgccgcccgccgatgccgccgacgcgtaattcactacccctgccggccgccgcatgcagcatttgcgctccccaagcataattcgcgagctctaggcgcattgcaccgacaattatgcaccgaggcacacacacaaaatcggtgaattcgcgtagcctggttgcatgcggttctctttgctgaatttctcttgccgacccgtctgaattatgaaccaaaccgttctctgaacaaacaagactctgtttcttagccaattcgtgattaaatgtgcattgtgtgttgctgcttgagagctggtctcacaagaatttgtccggcgatcggtgcagggctccagaggaacgggaagagctgccggctgcggtggatcaactacctgcggccggggctgaagcacggcgtgttctcgccggaggaggaggagacggtgatgagcctccacgccgcgctcggcaacaagtaagcttttctaactagcaactcccccgacgagtctcgtcccagtcgggtccgtgcccagtccccacacacctcaccggcagcgcgcactcgatcgttcgcctttacacgcaaaatgattgagcccggagacaattctccacgttgtgcttgctagctgctgctgctgatgctgccttttcctttttcagtttagtactaatctctctctccacacttaattaagctacctagtgtagtactagtactactactactagactagactattagtaccaacgcaacagcggcactaatctttttcgtgagaaagctagttactctagctgatttgtcccagtccgggcgcgctagtgccgagctggcaattcgggttctagaacgcgctgattgacagattgtgagtgacagagtgagtgaaaggagaggaggagcggagcggaggagcggagaaatcaaaatatgaaatggtggaaagggagaattaaccggggtgatgctggctggccgccaccgcgaccttttccgtagtggagctgatgctgacgcgcacacgctccaagaacgctcctgcgcattcgaaaaccgcgagatttttcggtgcacgttgcgatgatggctagagaaaccgttgtgtgttttttttttcccctttcttcctttcgcgctagtacatttgtttattgtaaagtgcgggccactctggctgagcatgagcaacaaggacaagttgaggggggacggctaggataatgtggacttgcaacgctaaatgccacacagtacagttgcgtgcgtcccagaacaagttagctcgaattaattttttttttggggggggtctatttcttcgatttttctatcttttttgtacaggaaaaacggacactattcattttagttgtacagcgacgacgataacatgtcgtcgactggttggaccaatccgttctcagttgcgagttaatgaaaacagctgccttcacaatgcgaaactgtcacgtaggagtactagtctcgcgagaagattagattctttattgggcgtcgcaattatgtgcttccttacaaaaataaaatatcaaaggattagtggtccacatgaatagactacgtacacgcttgtccctttcaccccacaagtgacacattacatttctttaagctggtgacagaggaaaaggaaacgagaaattggaaagaaacctcaacttgtcaatgcaaaagctttgggttttccactaacccccaccgacagaaaccaagattagtgaattttaagctgtggcatactactaaccgtaaggcagagagagactgatcgatagatcattccaaaaggataaaaataacctgacttaatcactgacagcaatttttctactgcaggtggtctaggatagcacggcatctacctgggagaacagacaacgaggtgaagaactactggaattcttacctgaagaagcgagtggagagcggcggcggcaagacgagccaagggccaccaaccacgcctgcgtcagccgcgagctctcccgccgattcagacgactcgcacagcctgcagcagaagccgcacgagccggccaactccgactcgtcggagccggcgcacgagtcgtcgtcggcgtcggccgactcgagctgcctgacggtgaccacggaccacccgcccgtctcgaggccccacgcggcagtgacacccaaggtcatgttcgcggactggctcgacatggagtacatctgtgggcaggtcgcggcagcacctggtctggacgctgccggattcgcggtggttggtggtgctgcaggcgatcagcagcagcagcagcagcaggtgatgagccaggacggatcggttcatcaggccgatgggccatcgtgcggcgtggacgattcttccctgcagcagcagcagcaggaggggttcggtggcaacggcggctgctgggattttcaggagcagttcgacagcatcgaccagatgcaggcgagcggcggcggcggcggcttctgcgacctgctctccatgagcgacttcgacctctgggccgagctggaacgtaccgcgtgatgggggaacgacgtgctcaaggatcgatttttaattagagcttgttaattcatagatgtcccgtggaaatcaaattaaggggtgtttgtaatactactgcattgtaaattatcgcggtgtatttatagagctgtttaaattagcaacatatataaggaagatcagaggcatgataagtcacttctgtacgaatttatgtttgccactttgctttggagagcatgggcaccgacagaaagatggaaaggaagaaggaaagctgtagagaattgcgcctatggatgcaattattttggtttgtttattgttgacattatctttgtgcttatagtgatagcattatggaacaatctattcatatctcactttcaaagacccgctgtgaagttccaagttttgttccactccatgaactgtcagtgtatcagaggtcccttcctttacacgtaggctttcatttccacataactcgtaatgattaaaagtgttcttgtaaatattggatcaatttcaactagtgttaagaaattgcaccctcttttataaagaccaatctgttagtgcctccactttcttcccttttcttcctgcagaactttaattttatttctttttcttccattcatctctttaaatgtacatatattagtagaagctcccacttaataaacgtcatagggttcatttgttttaaggaaacaaatcctataatattattgtccccatgacgtggttaatggcatgtgagacccattccccatgggcccacttatcagctaccacgtccctactactctatgttatattttgcattactcactcctaagttgtcttttttttggacggagggagtatatttttatgtttgactagaatatcatcgttacattttttttattacatactccctcgttccagaatataacaactttgagcactcaacatttgtcccaaaatataacaacttctccccagcaatctcgttccaaccaatcataaccctctaccattcacttttcccacctaccttcactacttaaccaatcataactgtaacgtcccgccttcccccaggccgggcccgcttacatctgatagctttcataggtcatacactcgtgtgcacccgagaagaatttcccggtcggtcacccatcccaaattgctccaggccaagcacgcttaaccctggagaaaagaagttgcaacttgccctaggtcgggatgttacaccttcacccccttaagagagatcgacgcccccgtcgatcaaccctaggccaggtcccacctaccttcactacttaaccaatcataactgtaacgtcccgccttcccccaggccgggcccgcttacatctgatagctttcataggtcatacactcgtgtgcacccgagaagaatttcccggtcggtcacccatcccaaattgctccaggccaagcacgcttaaccctggagaaaagaagttgcaacttgccctaggtcgggatgttacaccttcacccccttaagagagatcgacgcccccgtcgatcaaccctaggccaggaacgtcctctcttggccacgtccatgtgtccagtgccagcgcatgcgccatgctgtgtaaccactcccggtctacaccagccatgcgcaccatgccatgtcttttctgcacactttgtcctcactcgtgtgcacccgggaagaatttcccggtcggtcacctatcccaaattgctccaggccaagcacgcttaaccctggagttgtttggagattggcttccggaaaagaagttgcaacttgttgatatgagtattctattaatcctattaagccttaggtcgggatgttacaataaccctccattattcacttctatctattttcttaataaccgtgttcaactctaaaaatgcttatattctagcacggaggtaatactttttatttctaattttccaacagtgtaacaaaaaacaatattaccatatttcaacttaaaaaatttaatctttcggttggatctcccatcaatgtggagtttcagctttattctatactgtaccttcggttgtatggtatactatggttatgcatcatcccgtatacgtgacgtagaagataggaatagacatagagcattatttaagaaggataaagctttcttcaatttaaaccaaaagaaaattgatcgtaaagaggaaaagtaaatggcaaatatatcaatagtcatttcttctttcatgttcttctaaatggctataaaagcatctcctttgttgatcaaacaatgttagagatggagttcaggttcgagttcccttaataacaacggaaaatacttgttttacaaattagacttgacttatcgagccaggaaattcctatgcatatgcaacatcttgtgatgtctcacgtctctctttgcttgccaaggtctaagtgagtgaagatcaagcacacccttaataacaaaagagagaagttatgtttcaactaaatatataaaacatagctcgcccaaagtttagcatctctaaagcagattatttccgacttccatcctctgttaagagggaatccacaaatgccccatagatcatacgcagactctaatttgactaatttgaataataattcaaaactattttaaagagacagtgattacgagacattcatgctagtatgttgccattcaaaccttccaaataacaacggtaagctatggatttttttagaactacggtaagctatgttgatatactctttatgcttagggtgtagtcacatacatgttcttttttaccccaattaaatatcatcttttggcacctaaaattctattttcatattatttgtcgtagttacacttaataataacaattaaaacactacaacaaccatttacgatatatctatattaattatttagtcattatatttctatgctcctgctaatagattaagggttaaacttgatagatggaataccaatcacaagtagattaaaaaaaaagtaaaagggtctcattgtttgccttatgtttataagccaaagtttaattttgaatatgattttttgttttcttcatcatagtttattttacatcatttgtttttgagttgctatggacatgtatataaaattttactcataaataatttttatttgctaacaactgtggagattatgggtaccctatacccacacggcatggttatccgactagttataggggataacttatatctatagaatatgtaacagattatgacttgggtattacgtttccttgtatattacggaacggcctaaagtcctggtttgataagattgtaaagtagatttaggaaaccgataccatattggttaaggtttctatcttgtaatcctgccccccgtcctatataaagtgggcaggaggccctctagggggcatatgagcacatatgatcgttagatctaaactacatctggcggattcaaatcctcaaacaggagtagggtattacctctcattgagagagcctgaacttgtctaaatctttgtctccgcatccatccacttttaggtctcgtgcgctaccccttttattattgccgaattcatgtttcgacaacaacatatttggagtctaatcggtagtgcttactgcagcagcgcagccgcagccaaccagcccaaatctacacaaaacagttgatttgcagcaacatcaacaaggtgtgtgctacttgttggctgctgctgcactgtggcagccagcacaaactcaatgccttagataataagggagtgtttgaagagaaggggattgaggagattgggaagatacgcaaaacgaggtgagccattagctcatgattaattgagtattaactattttaaattttaaaaatggattaatatgattttttaaagcaactttcctatagaaattttttgcaaaaaacgcaccgtttagtagtttgaaaagcgtgcgcgcggaaaacgagagccaatctcccctatcacccctaaacgaacgatgcctaagtactttgagtaagcgaaacaatggaactggaagattgttttgaatttaaaaatacacataaaaaagtttgaaaagaagaccctgatttatcagcaattgagcatctcggcaaggttctcgccgctcggcgtcccggcccagccttttactcgtgggcataaaatagacagggccgatatcgtaatttcctccttcacaaatcccaaaccgccggtgccctagctatcgacgactcggcggcgacgcgcctccctggctccctcccgtcgctcctcctccccgacccacgaactccccccaatagggcagaaaggaagttcaaatttgctcctgatccgagcgccaaacgcctagattccaccacccaagcctcctctcccaatccgatctgccgttccctcttcgaatcggctcccccttctcgccgattaccgacgaatccgaggccctcctcctccttcgaatccatggatccgcgcgccaggtaccctcccggcatcggcaacggccgcggcgggaaccccaactactacaaccgcggcccgccgctgcagcagcagcacaaccaccaccagcagcagcagacgtcggcgccgcaccaccagcagtacgtgcagcgccagccgcagcagcatcaccaccacaaccaccaccagcagcatcagcaacagcagcagcagtggctgcggcggaatcagatcgcccgcgaggccgcgggaaccgacaggaatagcgagccgaaggctgtggcgcaatccccagccgtcgacggcatcgattcgaggtgagaccgtgagacgcgtaggccttagagtttggcgatagattatgtgatgttcaacttcaagggatgaattaaggaccagtgttgtgggtggcttgtttgtttaatttttttgtggcgaaattggaccaaatgcagtttgagacatatgctttccctgcagcatcctgcgaagtgagcactgcaatttcgtattccgtagtggcaatcactgaatgttttttgtccaaatatgtgttcatatgttgcctaggctggtactggaactagggtttgctgcattctaggtttgtaatttgtgaaactagaagttctacaaacagtaggtaggctggtgaataatatatctgatcattggcgcagatatggttatcacattgatcatatgctcaccttttgtgcagttcacaagactggaaggcccaattgaagcttccacctcaagatacacgatacaggacagaggtaaatcgcatttataaaattttcccctattttttcttcaaagccaggcaaccggtgctttgtatgctaaggattacacttgacaattgtaattgcaaaacatgttgactgtcatctgcgctttgccctacctatcaattgttattctgccaaacaattcagtgtggcaggagttcctttacctttatgattttttggtgtcgcacattgtaagctaattactatctccagtcacaaatacatgtcttgaaaattgacatggccttccaaatacagctttgacactaatttctaatttaatgtattaatagaacccactaaagttataatgttatgaaaaatcacctttcaagacaaatttacatatattatgttcatgtatccaatctaaatattgtaaatggtcttgaaagttttactaaatgcttgtccaaaacaagaattatttgtgacccaagggattattaattccgatgattgaaatttaatttgctaaactgggtttgaacatcttttcacacccatgagatatcctaatgttgctaatcgatgctctttatttctgttatccaattcaaacaaacaaagtttaatcctatgtggtcattgtaatatcatgttgataccttcttgtctaaaacaaaataataccttgatgacttaaaacatgcacattaagtgttgttaagctggaatgccccaagctccttactatcctggaggccacatgactcagttaaataattaaagtttcatcttactgagttactgtgctcttatatgttttcccttgtgctctttaatcttatttgtataattttatctttgtatagttcttccccactgtcttgattgaaagaataattgaattttcaaaagaatgtgctctcatggcttgagtttgctctggatatcgacattcttattttcttgctcttattttttttgcctattcttttattttatttggagatattatttatgagtttatatgatgttggtgtcatactctctgcatactttattatattctgctgttgttgcacaggatgttacagccaccaaaggaaatgagtttgaagactattttctcaagcgtgaacttctgatgggaatatatgagaaaggatttgaaagaccctctccgatccaagaagaaagcattcctattgcattaactggtagtgatattctagccagagcaaaaaatggaactggcaagactgctgcattttgtatccctgcactagaaaagattgatcaagagaaaaacgctattcaaggtttgttccagaatccaaactattaaacttattttgtaccaactctcacagtcaaacatgctataaacctgtgcctttataatgcctgttggacctcctttggtaccgtttattttatattattactttttttggggtgttggggggggggtggcctgtaggggatcttctttagtaaatataatattatattgtgcaagaatggttcaatgattgctcttgttatttgtagttgttatattggttcccacaagggagctggctttgcaaacgtcacaagtttgtaaagagcttgggaaacatctgaagatccaggtcatggtcaccactggaggaaccagcctgaaagatgatatcattcgtctctatcaacctgtccatttacttgttggaacgcctgggcgtattttggaccttacaaagaaaggtatctgcattttgaaggactgctctatgcttatcatggatgaggtaattcatctattctttgcaattgatattatattctcatgaaaactgttcagcagttcagtactcagtgccttcccagttgtatatgttatttcatggctcaaaagattattttataaggagaaattagggattgggctaaaaagaatagtaaaaatctcatttacaatcaaacaattagtgacaaaaaaaattagtgtttctatatacttaatgcaagtattttttttagttgctctttcctaagtttttccttcaaattaatgtttgcatccttcttgggttgtgctgaaccaatgaaccccgtttcttgtgtttacaactgattattctgcttgccaatacccatatgctgaattcttgttattacactatcccttgtttgtacttctttccagatatgtttgtctttagtaaatttcacgaaagcccaggttttcaggcatctgtaatgcaaaacccattgtattttaatttgttttaatgaaccccagattttgggaaacacttgactacctattgcactattttacttggattgtaaatttattgcttaagacaacagcaatgacaacacaactaggaatattttggaacatcctgcatacagggaaaaataagcacaaaaaaaagatttgagtagcccattcagagtgtgcggtgtgtctatgataggtacttggccaccgggaggtagggacttagggtgcgttcacgaaacgagaaagctcattaacacatgattaattaagtattaactactataaacttgaaaaatggatttatttgttttttaaaagaaacttctacatatattttttttttcacaaaacacactttagcactttggaaagctaatggaaaacaaggaagttgttgcttggagttgaagcttagagcagggccttagtattagtccttctaaaaagaaccagtgtaatggttcatgaggcgaagtagtatcttcaagtgagaactgagaaacatcgtggtttttcttttttgcaccatttaagattctagtgaactatatgaacctctgttttttgagaatctacgttgcatgatttggcttgataacgataatttgttttggttgtgtagcattgaacattttagttgataagaatttttatcttcttacgagtgaaatattgccttctgttcaggcagacaagcttctctctcctgagttccagccttccgtggaacagctgattcgttaccttccagcgagccggcaaattttgatgttctcggcaacgttccctgtgactgtgaaggagttcaaggacaaatacctgcctaaaccttatgttattaaccttatggatgaacttacactgaagggaattacacagttttatgcttttgtagaagaaaggcagaaagttcattgccttaacactctcttttccaaggttttaccgatgagcacctttgctttgtgttcagttagccacttttacctcccttatagcctgtaaatcatgcacatttgttttgatgcagcttcaaatcaaccaatcaataatcttctgcaactctgtaaatcgtgttgagcttctggcaaagaagatcacggagcttggttactcttgcttctacatccatgcaaagatgctgcaagaccatcgtaatagagttttccatgatttccgtaatggggcatgcaggaacctggtttgtacaggtatggaattctccgtgttccgcatcaactcttgactggttctattcttgatggatatttgttactgttcactgtctagtgaaatctcattaatgtcctactagaactaattgtttcagccgatctgaatgtattttgttacttcatccctgcttttgtatattctttttcttcttaaaaagaagcgttgatgacagtgttggtgtgctttatttacccgcaatccagatgttccgtagatggatttatgtgaatacgcatgtgttatatcttattttactaatgtattcattatttgtacatgtgcatatgttgttgttagctggtggtataattaaaatgtatgcaacctttttgatccaagtgtaattaattttcaaactcacaatgtgtcatacatatatttgagatgtgtggcaacacaggtacaatgaaaaggaggaaacaatatgctaattttaatacttcactaccaagttctgtttcttgcaagcctccataattcacttatatggaatagttttgaaatgttgtgattttgtgcaagtatatagaaatgtgtggatatattgcttacggctacacgaaattctgatattctttcttctattttaacttttcatttcttttttctttgcagatcttttcacaaggggaattgacattcaagctgttaatgttgttatcaattttgatttccccaaaaccgctgaaacatacctccacagggtatggcatttgaataaattcagcttttgatcttaggctttaatctaattaggatgtcatatgctgctatgagaataatattctagaaactaatcttaaccagtaagatgtttgtactaagaagaaaatgcacacacaagtgttagatcaaatgtggaaacatgcacacatatgttttatcatgtaattggttgcccctgtaatttgttcatagtttggaactaaataccaactgttattgtcatggtatctctcctttgcaatgttgtgtaggcagtgcagttctttaactgttattttgttggcctttttctaggttggtagatctgggagatttggccatcttggcctggctgtgaatttgatcacctatgaggatcggtttaacttgtatgaacaattacccaccacaattttattcatgtattttattctgacgtttggttcattgaactaagttttctttctgggaacaggtataggattgagcaagagcttgggactgagataaaaccaattcctcctcagattgaccaagctatatattgccaataatttgacagagttccagcgtgtattcactttctctaagggtaataagaagacaattcttgtaaataccagctcatcaggtaacttattcttatgatgaacaagggcaatgcttagcttttaattttgttatttcacaactaccgcaatggaaactattgttttctgttttttttagttagcctggttttactgtcagaaaatgcaatctgcacatatccatcaaaggcttttttagttaacgtatgtccacatgcgaatgtggcatatcactggtcacatttagtccaaaatgaaggtgactgtaagagcgaaatctgctgcatgaacatattagtgacactaaaatgaatgtaactgggtgttttggcatccctcggttgtcaataaccatgcaaatcatccatgctgcagcacatacatctgagtttgatttggaggttgaaaagcgaggtagatggcagatgtcttggaaatgtaacttttcatacataaaacagtgttttcaactttatctttttttctgagtcttgcctactttattcaaagaactaggagttatcactatttctttttctagaatttttttgctgttgtgcattttgtcatggcatgtgcatttgttactttattttgccttaaaagtaccatcatagtatttaaatgtggcagttccatgttcactcttttaactttttaacaacatagcagacatgatctccgtttgtatatgtgttttgcatgctgagattgcttgctcaagagcttataaattgccaaaattcaggagctttagttgacattgtgttacatgtgcaggttttatcatggatctcctgtggcatatgggaacattcatttttggagttttatttgagatgagacagactactcttccgatggacaccttgtgcttatatcattttggctaactaaattcaaacgccctcactgaggcacacagtagtgtatattgctaggtgcctgttcatgtgcctgtcctggcctcttagctcttatgataatctctccccttctctagatttcgttatcggctatttctcacaggacattttaaccctgttagtggttaactggttgtgggctgtgccatgtcagtgcacacattccagttgacgtgccatcgggtgtggacaagttcatccaacttgtgctctgaactgtcaatgaacagtaagcagcacaacaagcgtcttcagatattagcgaataaatctgtcgcaagccgcgtttctgcatccgtgccatgcagctcttctcttgcatgaggcttgtgccattatgtttagattctgcctcttataattgagtctaatggttctacaaactgagtttacctgtcctgagaactgggtaaaacatgtggtgaggcacatgcaacttgataaataaattttttacttaagtgaaattctcactcctggttcattctatgtttgcctttaaccgtgctggaatattttcgctgatggttaccaaatccacggtgctatggttggtgaaatcttgaaaagattatgttaaatagtcccaattaattacagctatcttgaaggatatcatctgttactacttgcaatgatctactcataataccttgtttgggtgtcttaaatcccaagatacagtctgttatacgggttcgtcgaagggatttgtgcaccctgccatgcttgtaccctgcatatgctatcggtggttctgaaatcctagcacatatccctttcgtttcataataaaacaacgtaatattgagtgtgacacgttctaaaattataaatctggatctctatcagatttgtagtattagtttgtgtcacattttttatttgttataaggttggtttttcatgggattgatggagtatagcatactgtagcagccaagaacagaaagggaaatataatcatgcgcaatgaatgggtttgcgtatcaatctcccttccattgctggacaagcccctctgcacagccctcacgggcgtttagcatggtaagctgagagtggcaagtgttctcaagcaacaggggtggggtggtcgtcaatggctccaacgtgtactaggcactactgaaacatacaccccctgattcccatgcggtcgactattatatgcttgtgctgcgccttgcattcaaacagtaacagtattttgtgttcttttctcatagtcgatttttgcagttgcagtgccatcacggtcaggggatatttttctccggcctgccactcttttttagataagtttctactcatctctgatgctgcgactgtgagaacgacaacacctgaccttgctacggagtattttgtcgtaactcttgtcttgcgatcgtcctggaggttattcaaagctcgactaggctagtttgaaattggaccaccaattgcatatccagaattgatgcactggaaagcgacgccctgtatacgaaatgggcagtgttgcagatcttgaccaatactggaggatctttatcctaagaaaattgtgggaactaggaaaattgtgggactaagaaaattatgaaactgaatactgaggagttgtacatctctctaccttgggtgaagtagcaagactctatcctcctctcctgttccatgccgtctcgactccatcatacaccatgaatgagaactgacactgcgtcgccttggagaacaaaaaacgtggtacatttggctcatctggatcgtctggctgaaaagagcgccacactgcatcggaaccgctacagtgcttcgcctacagcatcaacgacagaaacagcaccggtacatgtaccaacagattaaccgaacagtggcactccgagtcccccccaccaaaacacctgtccgtttgagatcatcatggcgacgcccgccccgcgcccagcccacccgcttcaaccacgagccctcccctctccctgcgagcctgcgtctgcgactgccactgcagtgcagcggccacagcgagcagtggatcgcagcgaggcaggaactcatctctgaactccacatttacttcgcccctctctccctctctctatgtgacccatacgctttcccagactcaaaatccgagctacgctcgtttggccagaagcctcatttaagattactccccctgcttttcgtctcggcatcgccggccttgctcgcactattactcccacgcagttgctgctgctacccccactcatcacactggctgtcaacgtgcggcgctgctaccgtgctacgctcaccaacgaaagctgccccgtgaaaggctgtaggggagcatggagttccttgaaatgcatggtaactggtagagatgttttaaaaataatagccatttccctataaatttctataaatttattgaaataatggagatttatagtaaactggtagagatttatagggaaacttgcgatgggaaatagccatttataaattttaaaaataatgatttatttccattatttttaaaatttattgaagattttttttttgaaatttatagtaaacttcttcaataaattttaaaaataaaccatacattaacttttttttgaaacaaaaccttcagctacggttctagccatagtgtttggtgttacatgctaggatcagtgcactgtaatattattagggggctattataccacgagattatgtctaaaccaaatgataccaataaggaattagactctgatacttatcagtatcagatatagtacatcaattgatacatatggataccagccgatacctaatgataccaggcagataactactagtaccagacttggtacccgtcgggtatcatatatgaagcttagaggggagggagaggagcggagatggttaccggctgcgattctctcaccgtgagacgatggcgaaaaacgcaggcgatgccaaatctaccttccttttccatttcccctccatttcctatattcttcctctttccttcacatcttcctcctctgtttcttctaaacgagacccatcccgtccttttgcattgtgtggctataggagaccaaattgccccctatctatcaatgttaaggcttcgtcacagccatcagctcgaccagtccagtccataccatcaccgcccctgtgtgtgaagaacccgcactgcaccaacgcaccacaaacagccgctgcaaaatctagccaccaccgtgcaacaatctcgtcgtggaatctagccatcttcaggtcgttctttgtcatagcggcgcgaggaagtgagagatcccgtcccaaacacgaggaatggatttcctgtacctagcattcccataaatattatgatggagttaattttgctaagagcaatatagcttaaaaagagttactaactgtacccaaaatttaaacatttcaatctaaatttagctagaaatgcttgtattttaggatcggccgaggaggttgctagatgtacacttgcgtaggacggtaggagtaggcccaaatgcgacatgaggtcacggccacaaagttatgatacacttgcgatgggtacccaacaattagtactactagtggtgcttatcatacagtaataaatacttcatctgaattactcacttgaatgcttgatctgatggcccgaagttactcttcggctagtttgctttggtacaaagtactccccatgaaaggacatataccagtgatagttctatctctcccccgcttgcgtatcccggccactcgactactcgagtagtggcagcagcacgactgcacgacgctagtacccgggcgtcaccgtcgccgttgcgcgcgcgcgctgtacttgcaagcaaaagcccccctcgtcaattgaatgcgtgcgtcgcgcaacgcaacgcaagcacgcgccgggttttattttcttttcttcgtcgtctcccacactctccgcttccgttccgtctcgttgttgttgctgccgcagcagcgcaggtgaaaatctccggcatttaaggttgcgccgcgggggatcctcctcggccacaaacaaaaccaccctcgtcctccgcgcctctgctagcgagtactcctacatagactagccacgtctccccccaaatcttttcgcacttcctttcccctccctttcacccactgaatcactcgaagtcgtcgtctcgtccacggccctgctgcctcgtgcgctccggcagctttgccgggggtgggtgggggagcgcgcgccatggggagggcgccgtgttgcgacaagaaggggctcaagaaggggccgtggacgccggaggaggacaagctcctcgtcgactacatccaggccaacggccacggcagctggcgcctcctccccaagctcgcaggtaccggctggcttctctgttcttgcgaggcaatgctttgcttctgtcacgttttcgtgttcgcgtgccgcactagtgctgaactgctgatcagcacattctgagaatctgtcttgatgatttcggccttagatgctgcttatactcgattgcatctgcataccttcaagctgcaataatcacccacaagctcgattggggctaaatacacaaattatttcatcgtatacaaagtaggagtactgattaagtcgtacactcggcgagtactaggctcactcgtactactccctgctgggttttccttgatcttcactccaggcatcagcattgcctccagctacgaacactcggtcactcactccagggctccaggctcctaccataccatgcccatgtgtgctactctcttttcgtgcatgagaagtactcggtattattcacaggagctgagagactctagtccgttccatctggataacacttcgttttgcgttgcatgcagggctgaaccggtgcggcaagagctgccggctgcggtggacgaactacctccggccggacatcaagcgcgggcccttcaccgccgaggagcagaagtccatcgtccagctccacggcatcgtcggcaacaagtaaagtcccccttgctcgtcttcatctccttcacctagcgagcgagtagccgagcaggactggcagactgaccagctcacatcgcacagccactgtgtgctagtgtgcactgctcggtgcgcagctaagctagcgcaccacaccgtagcactgtacatgcacactgtgcatggctcctcactcattcaatgttgacacatcgcattctccgatcatcacatcatatatgatatatcccaaaccggccggctggtgtactaccagtatatatagtagtggtacttgcttgtttggagtatgtacatgtctagtttagcttggagtcccagtgtatatttaggccattccactctaaaatttttctccctatcacatcgaacattttacgtttgaacacctacgcgaagtattaaatataggcttaaaaatgactaactgcacagacacaactaatttgagagacaaaactttaaagctaattgctccatgatttaacaatgtgatgctagattaattaggcttaataaattttactgatgaattctataattagttttttttattattgcccaaacaccttatataatactcgattataatacccgatgtgatacgcaaaatacttacatcccggatctaaacaccccctttactcatttactgtagttctatactgtggtaaatattcaatccagttagatatcactagagtgtactactactagcagcgcattgattagaagtggtggcacacacctgctgtttgttctggccaggtggtccatgatcgcggcgcagctgcccggccggaccgacaacgagatcaagaactattggaacactcacctcaagaagcagctgcgccggatgggcctcgacgatccgccgcccgggccggcggcgggctgcccggcggcgcgtcacatggcgcagtgggagaccgcgcggctcgaggccgaggcgcgcctctccctcctctcctcctccggcgccgcggcgacgacgacgatcaccgccgccaccaccaccacctccgcctcgtcgtcctccaccaccgcggggcccgtcgccgccgccgcgacgtcacccgcggacgtgttcctccgcctctggaactccagcatcggggactccttccgcaagctagccgtggtggcggcggggtcgtcgtccccttcgcgggcggacgtcacgaaggacgctgtgaagcaggaggaggaggcggcgccggccggggacgactcgtcggcggcgtccaacgaggtggaggcggcgaccatggcggtggacgagtaccagatgttcctcgacttcgccggcgaggagctgggcctgttccacggccggtacggcggcttctcgctcttcccgccggtcgacttgctcgaggcgtcgctggagacggcgttcaagtgacccgtacgtcgacgacgaccttgctcgccgcgcgccatgtacgacgtactacgtactccgcagccgcagcagcagcatcatgcctcgacgtaggagtatgtatataagcaagtgttctggggcgtccggacagtaggcgcgtccgtgtgaagggtaggacacacgtacgagacgtgggagaaaattttggggatcaattagggttctaaggataatctgtagcttggggtttaggcatggggggaacatcatggtgtgtattagtattacggccttttggatggcattctctggggggcaaggggcttaccggagatgctctaatacattcaatgatgttcgatctttcagtgttggatatggagctggttttatctgtgttggttgatctcagcaggaaaccaagagaagagagagtttgacgccaagaaagaagagaggaattcaggaaagttatctaccaggaaactacggcccttgactttctgtagaccaacaatggacctcgttacttctgctgattactcttcagccttcaagcactggagctgtgctatagcccctagtttatcctcgtgatctttctctgaggttgtgttgaatatatatacataatcggttatagtttagaacttaaatttatattagatattaggatagtagcgaatcttctgtgagcgtatcttttgagtttacttttactgtcttatgagcatgtcgtgactatcccgacgtacggtaagtatactatcaagattgaggagataacttcgatatacgatagaaacaacatgctactttgaaatgtgagacatgtgtcagaactaaggaagagatcaatttcacttgtgagcctgcctacataagaaagagtggtcgtattaggtggattatgatagaaagaccataaacatcatgaataacggaaagactgttatgactagtgagaggatgaggctcatgtttgtgcaagctacatggggacacggttataggtggagtcatagaagatgggtatgttggtgttgcagtgcacgttcttgaagaccgtgaggcaggcaaaggttcgtcgagtggcttgacgtgagcggcgaaaggaaataacttaagtctaggtacacggaggtttgcacattgagtaaattcagatttgcttgacatattcgctaggtggagtttgttaaaatttgtatctaatatatgtacgtaaatgattatgactcagagtcgaactatgttctaggctctcctaaatagagatacacatatgttctaaccacgtagcaacttagcatagatgattcttttaaccatagtggttatagtcaattatccagttccattcattatgcatgcatatcccttcctccctactctacatcttaggctgtgttctttccttcaagttcccaacccctctccctcgttttccgtgcgcacgcttttcaaaccgctaaacagtgtattttttataaaaagtttctatacgaaagttgcttaaaaatcaaattaatatatatatttttttaaaaattagctaatacttaattaatcatgtagtaatgcctgctccgttttgcgtcccctcctcccgaacgcagccttagatagcttgaagatcaaccccgtctccctgacttcccacccttttggtcccgttcgtttctgctttggattaagattaaaaacgggcatgtaaaacaaaaaactattagcgtatgattaattaatatttaagtactacaacttgaaatataaatatatttgttattttaaagctattttcatatatattttttcgcgaaatacgacgttttaatagtttaaaaagtatgctaatgaaaatcaaggtaaaattttaattttattgagaaaaatgtgctaacgaaaaccaaggtaaaatcttaatttcatcctccctcgcaattcttttgctccttgataatgcttctactttgagccattgatcatcttctgtacataatcgtctttcacatggcatcactttttttcatttcccaaggttcgcacatgtaaacactattattttatcaccctttagtatgtaactttggtggtgccattatcattatcaggatttactaaaccattgggaacaaggttactgtcaccccacggtttggtggttaccacggtagccatgcggttactgcgaaaattataaagtatatcgtgattttaaaaactgagaatattatcacctataataaccaccatagcacgattttataaactctggtcactatacataattcttgaaaatccgttaagaaggaatgtactttttattgataaattttatattatagtagtgctaatatgcatgcatcgagatgcatgaatttttatgtaggaatcagattacggttttctttagagctaacattgctataataccactttgcttaaaggatattgctaccactgagtaaaagcgcgtgggatcagaaaaaggggtccctgatgtgcagtggctgactctgtttgacttgtttctattcagaaaaaggagtaaatgcaccggatagccggtggggccagcccgacgagaaaacgaatttattgccacgctcagataaaaggccaaaccagagcagcgaaaggtttgccacgacacctgcagcacaggagcagcctgttgcctgtggtggcttcatcgccaggaaagaacagaaatgggcagggcaagctcgtcgcccctacgctaatgattctcttctgggagatactattaaatgccgtgccattgtggtcctttggatatgattgtcatttagagtttgtatagttcatgttaaaatttaaagtttggttgaaattgaaacgatatgacggaaaagttaaaagtttgtgtgtagaaaagttttgatgtgatgaaaaagttaaaagtttgaaaaaaaaattggaactaaactcggccttaatcaggactgtcgtgatggataacagtgaagaaacgattcttttttaggagtaaagtaaccttcccacactgtttgctcggtttgtgatcgcggcaaaattttcacttcatacccagggagaacgtaaaaattactacgtatgttccagtcatctagtagaatatttaggcccgctttattcgaaagaaaattatatgatttatatggattttattcctatatgatttttttcctcatatagtcctttgaatcaaattaatggtcactatagaatctcataaaatttatgcgaaatatctcattccgtctaagttttggagaaaatctaatatgaggtaaaaccttatgaatttttttttcatattttcatctctccttaaattcctatgtttttttatggtccaatcaaacgatcattctcatcttttttttttcaatcatgtatgttaaacttgatactatcaaaataatgtgtttttcgtgtttcttcattttctcagtcttgcattttaaaaggccctttatacttactccatttcaaaatataatcgtttctaattttatcctaaattaaactttcttagtcccaccgtgtttatagagaagagtattaatgatgatcatttggtgtcgcaaacactattgtcatttcaatacactcgatcaaatttagaataattcgacttaagtaggatgatgcttatgatataggacgaagggtcacaaatctgatccaacaacacgctgtagatggcgagtctttgatcttgtcagagggtagaggatcctagcaacttagggcacctttgaaatggaggattagcaaaagaattttggaggattcatttttctaaggattttttacctatagagccctttgattcatagggagaggataggaaaacttccatatgattgtattcctatgatcaattccataggaaaataagcaagaggttagacctcttgtgaaactttccttcgttgagtgtatactgtggtataatcaaatggctcttctctccatttcctgtgttttcaattcctgtagaattgaaaaaacatacaacttcaattcctacgtttttcctattcttgtggttttcctatcatgcgtttcaaaggggccccatgtacaatggtctttattagtggtctatctttattgtcatgcaagcatatttggtgacgtggaagagagagaaggacaaagaaagatggttgctacgcatgacaacgacatagagtcgactcttagcattattaggaaattttttgttgcattgagtctaataaagaaaagataactagtaagaaaatattttagtacattaatgttagagaccgtattgtcttaactattgtaacgtgatagactctaattaacgtaaagaccatactggtttttgtctttgtacttgcccttaaactccataacaatatgccaatccaaatcattatttgtcatgaataggctcttttggacatccaagtccttacataataactcccatggacaagagaaagaaggcattaatagaatgaacagcctaatatgttacacttaccgaacaacgtctatgtttggtcatgtgttctacaagtgatgttgtagttcccatatggtggagataatttcggtacttgctatatttcactcaagaaggtagaaggcaaattgctttacgcgatccacagagaagtcaacttgattcacttccccggccggggatcctatagataagaagattaggagagttgccaaactctaaccatcatgcatgtaccacacacttctactatgccaagggttgtttggttcaccatcaaactttatcatgtcacaattctggcatcccatagtttgttttatccatatttatttcataatcacacttatgagttaccgcggttaagctaatcatgctacaaacttgtaccctataatttattggcgacactttgtagtttaccataacttggatgcaagcttataccctaccaattatgccctatgttggtcctacagaccaaagacacaccaaggttctagactaataagccataacacctattaacaaaaaaatattttttgtacataaaacttttttatatgtgctattagcgacttacaagccaatgctagaaaataaaatacaatgaaaaataataaaaaaatgaactttaaatttaggttttaaaactcaaattttatttgggcatataggctgaagagcaaacaatagagttgcaaaatgtttaggatttaaggttttgtgtattttagaaaaaaaaactgatctactttcattttatatttcaagaaagcatgggtaatagaacatttaaagggatataactaaaagcaaaatatatattattacaataaatacatatgttgagtatatatactcctttatttaaatagactgcaaaggtggtgacagtgagtttgccaccctatctattcctatatattgtagttttatgtattacaacttgaacttcttaatatgacaagatagctaaatctaaatggatagctatatataaaattaaattaaagtgagtattctctaaaacaaaaggctggtaacatatttgatgaaaattatgccttttagtttcaggaaatattatgatttttttcctttaatcatattaaggcatggacatttagatagtgctacaaatagataaacgataaattacacttactttggtcttgaacaaaatgttttaaacaatcatgatttcagtggttgtatttgtattctactagtatatcctacgactgtaagtgtaacagaagatatcgtaaaaacaactcttccacaaccatcaatctgctagtacaatacatttgtctcggtttagaaattcccatgctatatgtgagatcatagtattgattatacggactacccacacttataaaaaagagtaaatttcacaaaactacaggtgttttgaccaaattatcacaaaactacagatttaaggagttgtatcacaaaactacatatttagcactaaatttatcacaaaattacagattttagattaagtatcataaaatgcatatttaatattgaacttatcacaaaactacaacttttggagtttaaatcctagcaccattgttatggtggagctataaacatcattactttgtgattaaattgattataaacctgtagtttcgtgataatttagttactaaatatgtagttttgtgatacttcatcttaaatgtgtagttttgtgataaatttggtgttaaatgtgtagttttatgatacatcgagttagatctgtatttttgtgataatttagtcatagtatatgtagttttgtgaaatttactctataaaaaaataatgcattcgctctaaaatatagaatattaataatatagttatatggataaattttctttatatttcaaaatggagatagtaacgaaagatatatactacgtgctcaatccttatttaatcttttgaaccgtcctgctttttgccgacccttagtttgtgtttagttcacgttaaaattgaaagtttggttgaaattgaattgatgtgatataaaagttggaagtttatgtgtgtaggaaagatttgatgtgatggaaaagtttaaagtttgaagaaaatgtttggaactaaactagacgtgtaaaatgccacgaaatttgtgggaggacatcacagacgcggcaataccgccaattggctgagatgcacccgatcgttggatgccacgtaccctagtctctatggcattgttggctctgaacaaacccaaagcatggcattttctggctatttactcccagctcctgggctcaaataatgctcaatcaaccagggacgatcggagctgagggagctttacaaacaaccgggtacgagacgagtcgatcagccggcgatcgacgcactctccaactctggggcgaaacgagagaagacatgcatgcagaagttcacgttgtcaaggaggcgatctcagagtaagtttaatagtagtataactctaaatcacctatagataatgtaatagacaattcatacaataattacttactatactattaatatccggtcccactatcatatacatattacgtcttggagtccgtactgcagctggctacaaatttatcgctcgctgctcttctctcttcttttatctttttaaaatatatttataactggcttataggctgctatggtaactgctctcacttttgctcggtgttggctctgggcatcatgcattgaatgcgcctaggacgacgaagagaacggagtcggagggagagaggcgatgcagttggggttggggccgctgcgacgacgcatgcagccgcgcagacaagcgtaggagcagcaggggaacagtagcaggtcagatagcgtgtgcggcgcgagcgagcgcagcattgattgcttgtgaatgtgcactgcctctggcacccacgtcaaattggggaaaagctaggccggtcgacttgaccggacgatgcgccgtactccaactctactactccagtcttttttctcggttgcacgagtactcggtgtaccgatcgggcgggccggcacgacgctacctcccccgtacgcgagaacgtggtgcctgatcggaggagtacgctacactatgagcggggaaagagcgcgggaggcagaagcagaaagagttagcgtgtgcctcagactttgattgcggtacggctccgtctcaggggcggcattcaatggttgtaggcatttggcgtacgtcgtgttttgctcgacgttttgtgcggttattcgttgatgagaaacagccgggggacgacgaggggtggcactgtactggtgggcctggtgtctggaggccttgggttccataaagttcagtttatcagccagattaccgcgaccagaccaggagtccatgccgtttattgagccgtgaagacgccgaagtaaacacacccttggcctacaacaaggtcttcgtcatccattgatttgatttgattgcgatttcagagctcaggccagatgacacgagcataaacatcgtgaaaataattttccagcaagtcaacctgtcacgttgaacgaaactgcttttaaaataactgaatgagtcaatttgtaccgatgtacgaaggtaaaggagatattatatccggttttacggttaaggaatacgattcaatccaaaaggaagagttgaaagtcgaaaacagacttatacgaagtgacgagccatcaaagtgtggacacccaagagcccaaaacttttgcaggctgtagcagcctatccactgcggatgtcaacgacccaaattcccgtgccagctgttgcggtgttgctcccttcacctcgtgagtcccgtgcccaccaccaggcgcgcgccccacgttgttgcccgttgggaccggagagagttcacgcggcacctgcgccgctcccgctccatcgcgacttccgcggcccgtctatgcgccgcctctttttttttttctttctttcggggcgatttcttctctgttagtgcaagataataatagagctcacttactattattagccaatcttaaagccaacacatataataaattagctataaagttggctacaattttcttctcatctctctatctctcacttatacattaattgtatttgtcttggagcttgtgttaagctagctcttgtatgagagccaacacccttaactttttgttacatctctcctccacataagcttatagtaggattatagctaacaattatacttgctcttagaatctttctcaataagctgataagaaaagttcgttttatgagaaaatgcatcgacgattatcaatcttaacgtgttattattaactgcactcgaaatgttttagaccacacaaagaaaaaatcatgagtcaatgacatgtaggacctacataagtcaatgacatatgggtcagatagcatatctcaaattttacaaaattataatggcatggttccaatttttccaaagaaaaaaaagtacacacttacaagttacaacccaacacaaataactttcgaaagagaaagaaaaacaagtatatggctcggatcgatgtttcttatgccccaaaacacccgatatgtttcttcggtgtcactccggttgcacggtacttagctgctatctcctcggccttgatcacttcttcaccgcgccgggccatcaccattgctctcttttcttcagcttccttatggacgattgcttccttgttcttcgccttctcagcgtactctgccttcttcctttccaactcttcctgtgtactcacaggttaattgtagaacagtgtgggtgatacacatttatgttgccaattctcaaacaagcaacatggactacttaaagaaccaatcactcatggattttgagtgtcaccagaaaacagagcaaatttcttccgtgtatcatttttctatgtactatatattgctcgtacttcacacgctgacaagttaatcaggaattcattgcattgcaattaaacatcatatcctttcccaaaataaaacaaaatccaacatcatcacaaaccattttgaaattcttatagatgagatgtgcagagtattcaaatttcaagcaccagaaaacataataaaattatctatctttttttattaaaaaatttatcttttttttcgcgaacgattaaaaaaaattatcttgacaagtgaaaaaacaatgaacttacttccttctttttcagttgagtttttattactgccttctttgtgttctcccatgaaataatatccaataacttcttagaggccctgacacagaaaagaagtgattcggaaggttatgtgctatgtttcctcaataaacacaacatgttgtaatggagccacatatgccctgacagtaagacatggtttcattttggtttacacatcatgttcgcacggagagagattctggccaatacgggcgattaaattttgattatgtacctgttctccgcttttgccttttcgttctcctcccatgctttgatcaacgattctcgcttgtctgtctccacctttgcaagggcaatatctaaaagtattcaggtgttaatttagctagaggccctcaatttgccagtgtgtaaagggaaaaggacagcataagttaatcacctctgtcatttgaggtccttgttggtgttgctgttgctgttgccttctcagcatgaggtttatcagcaacctctggtatgtgaaaaatcatgatcagataggtagaaatcagaagaatgacttaggtcgacctttgcatggcaaacaagctaaaaagctatagcgttcaagaaatcatgcacactagtctaatctccatttcatatgttgtttgaattgaaaaatgaaaagatgtgaatggctgagcattctcaaatagtattactataggtaaaagactgcacgccaaattcgacaaaactgagccagcaaagtactatactcactctcgacgaagacgacgagagccttggagtcatcggccggcggctccgtgtcatcatcggtcttggagatcaccggcgatgtcgaagccgccgggatgacggccttctcctcccccgcgttcgctgcggcgggcgtcgcccccgcctccttcaatgcctccccggccatcttcaccgcgctcacgctacgctactgactcggcgcggctgcttacaatgaaaccaggcaccgtactgcttttggtagctagtatactatacgtttggtcacgacgactcacgggctgctgcgtagtgcgtactgaataccgactgatacgctgaggcctgagctgtgggtctctttatatacagcttctacccggccgggcttctgcctagaagagcctggagtgagtgcgatcggtccatcatcaatacattagattttggatttgaatttgaccgtaaatacgagggatttggagtacaatctttctccatccatccgatcatcgtatttattgctaactggttgtcacatggctaacgtgattttttccaatcaaataaacttttagggacaacaacgtaatttttacttttttacattaaactctgctagaagcctagattaacttagatttattaagccgagcaggttattgtcacatagtattatctacttgattataaaagtaaattaaaaatttgagaaataaactaaacagatagattaaaatacgtgatcttaacaatgcaatggaacgaaatttaagtttagccgtaaaagtcatgttgggatagttcgatgaataatctttttaagagagaaaactgaaaatccattatagttatcgacggagagtgtacttattttagtaagtagtagtaagcagtagtaagcagtaacgtgactggagaaatatgcgggcgcgtacgtgcggcgcacagggtgccgtcctctccagctcgccgccggatcggtcgtgccatccatcctcaaccaagcgtaccgcgcgggcgatgtaccgcggctccgtccgtgtattccttgactacgtgcgttgcctctcagacgtggaaggcaggggagccgcgagttttccgaatgagctattctgctgcaatccgcaagctaatttacgttgtggctacttgtttctagggtgaaaatggactgggacgattggattatgacattcctattatcctatattctaacccatatttttttaaaaaaattcggaaccaggtacggataatgccgaataacatatcactcatctcatatcctatcccatattatttccttcgaatcggatttgggaacatgtctccatttgtatctctaattcatagatattaaatataataaggtactccctccatcccataatattagacatggtaaaagttacacggtctttaaaattaatctttaacttataatttctcatatgctataagagttgtagcaacaaaatctatctattatattattaaaacagccttgaaaggaggcaccacgttcgctgtgggggctagaaattcccacattaatcggaaaaaaaaagaagagtgcaaatagaaatacaatctaaaaataactgaaattcggaattaaaagtaagcaatattgaaagaggagtccatataagaacccaatacgagattaatcaaaattctaaataaaaatgaaataaaatccgaaattatcaaaaaaaagagagaagagttcgagtaggaatacaattttaaacggaattaaaaataaggaatattgaaagaagagtacatacatgaatccaatacgagattaattaaaattcaggataaaaaataaaaaaataaaaatagaaaaatgaaaataaaaagaagagttcaagtaaatacaatttaaaattaattaaaattaggaattaaatataagcaatattgaaataagagtaaatataagaacccaatagtagattaattaaattcggaataaaaaataaaataaaatatgaaattagaaaaagaaaagtaaaatttcaactaggaatataatttataactaactaaaattgttgataaaaataaagactattaaaaaaataccatctaaaacacatgatgagattaattaagtagcaggtctatagaggagcagagtggtggcggttcataggacatctaaaaactattaataaaacgccaaacaaaatcctaatgatgattaaaacgaaggacgacgggcaggtcgtgaatcaatcggtcaaggcggttggcggggcttctagaaagtaaaaaaataatccccaatgataatcatatttgatttttaaaatctcaattacaataaaaataaaaggcagctggcgggtcgtatatgagtacaatggcagagccaccgatggttgtgggtcttctataaagtaaaaaatgaattccaacgatagttatgtttgagttttataatcccaatggcaataaagagtatgtggcggatgggtcgtggaggagtatattggtagcgcttgataggatttctattatgaaaaaaatgaaacccaacaggacaataaactctaaaaactataaggtccaatttttaaaggttcaagcttctaaaaataaaaaaataaaccccaataataatcatgtttgattttaaaatctcaatgacaataaagaagggcggcagcgggcgagccgtagaggagtacagtgacaaagttgctgtagtttcggcggaacttctataaaataaaaaaatgatcctaaacaataattatgatatatttttaaataataatgataataaaaagaagatgtaatggacggtcgtagaggaatataatggcagcgtttgacgggacttctagaaattataaaaaagaagtccaacaggacaataaagtctaaaaagtttttagatctaatttttaaaggttataaggagaatgaaatagaaacagtggtagatcgagttatataataacgaataatatgatagaaataaagggtgctgatgtgatttttaaaaactataaaatttgaaacacgaggataataaggtttggctttgaaacacgaggataataaggtttggcctttcaaaatcttaagacatcgagataactatttaataaattttaagtaaaattatattaaaaaatatataattttatatgggtgctagccacgcaattgcgcgggccacccagctagttataattatatgaaagtaaatttaaatgtcaatctaatgacataatttttaacaaataaaatttatttcatattatattaaatgttggtcaaatgttttaaaggttaaatcttaaaatacgtgtatgccttattatgggatggaaggagtaattaaattattaaaagagatacatcagaaaaaaaacatataatattacgtgtgggcatgtaaaatagtgattaaccaatcttttatcacatttttaggtggacttataataaatttttgtacatattttataatacggaacatacgggtggatacatgtctttccgtatcctaacccgtatttttccaacgaatttggattcgaactcggttagtatcgggtattccttttttctcccatattcctcccgcgagtcttgagttgggtgggcggtcgggaaatacccgccccattttcacccctacttgtttcagccttctgatgatcgatcaggccttttatacgcgtcgtccagtgaaacttttatccgtttatggtgagtatttgcgccctccaagcatctccaccgtttttttttaaaaaaaaagatgcatctccaccctgcgtggctgccgcccagctgccacggcgtcgagtttgaggatttggatcaggtgcagtcacaatagtgactgcaacttaatcagtagcattagcaccattggatgcgaactggacagctcagatcgcgaactgtagcactgtagcacgggtactgttcacatggccactgtagctttacatctaaaccgttgatcagaaaaacggatggctggtgttgtgtgcagtgttaacttgcagttacaactgtaactgcaccggatccgaattccgagtttgagtatagccaatttaattagccacacaaccaatgaggggcagggttttaagttttaactgaattttgtttcgaatgcgaaaaatattacacatcaatatattatattagaaggaagaagttttaagcgagtgatatacttatcgattaaggccatatttgtttcagcttaagattattgtaatctagattattaaatcagattactctaagctgtattataataagctgacataaaataagctatgagttgtttgtttctctggattattagaggcatctaagagtagtggatctttagccactcaataatctgaaaaaagctagcttctctagaggagattattggattatagtaatctggcttatatgttataataatctagcataataatctacttgtttgtttcagcttacagttaataatccagattataataatcctaagctgaataaacaggggctaaaactagacacttgttagttgccgtgtttgttgcagcccatcatttctttcctattccttttccagcgaggtcgtttgcaaatatttagacgaaacaaattaaatatagtgatccaattgctcaaaaacagtggttgttgatacaaatcgcgcgctattaggtctgtactatcgtgcgttagtttttttatattttttctgttgtgtagtactgtatagtctgtatggaactagccctttattcagcttcccctaaactgtacttttttgttggcaaaactttttccgtccttgtatttttttttcagactataaatacaaacttttttgaaagaaaaactgcaaatacaaactatatgcactcccacacttatataactatataggactccctatctcatccttttcccctttcacaaagatgtatgcaatttcgtgctttgacaacaattgtgacttggaagcagttatctaactagcagcttttgattattctatatgcgtgttacattaagcacgtttaattggatcgtcactataatagtataatcaatggaggttggagattctgccagctagtagaattttactccttttttttccagaaaaaaaatgaattctgattctgctgaaaaaaaagagggtgttactcatgtcgaaaccatctgttgccaagtggtggtgatcccattctcatcatctacaagagtacggccctgtttaggggagttttagattctgagaagcagctgtttggtagccagcttctgagaatctagaaaagctctgaaacccagcttctccagcttctgccttcttagttcatttttcagaatatgtaactatagattctcagaagctgtggactgtttggggcagcttctagcagaagcagcttttgagaaaagctgcagctgagagaagctcctccaaacagggcctacaagtccgatgagacatccaaagtcacctcgccatcagcgatgccaatgactgtttggtggcgccaccacctaccgatgcgaaggatcatgagacaaaatacgattcaaactaccaacaaatttgcccttttgtgtgacagacttagagagggtataggtaggctgaactgcaacgatgatgtgagcggctattggatggtggcacaggaggacatatcaaggtgggaaagacaaagccaaagtaaaaaaaaatccacatgctggtagcatgggaaatatgatgtgagcggaacaaacgagtatttccaaaatcaggaaaaatccttgccgcagctgctagacaagatacagaatgaaatcaagctatggaaaatatgtggagcaacaaatatcgtgagatttatcggcctaagatgttttgattgattagtagcttttttctttttttttctctgcctctttttcctctcttttcctctttcactgtttggtgatcttgtaaatactccctctataaaaaacgaatctagaaccggatgtgacacattctaataaaatgaatttggacagagatatatccattgtagtactaggatgtgtcacatctagtactaaattgattttttataggacggagggagtactttcttcttccctacttaatataacacctgctttgctggctttagtttcaccaaaaaaaaaaaagcccaatccacacagctaccacgtagcattttcacctatcctcaaattaaacacgttaaaaaataggtttgtcctaacccgataatccatgtccctccaatcaaacgcatgctttcttactcacattaacacaaggattgttggccaatttgaggaatgccacccctcacggattgaaacgaaagagaaatcagctcggacggctagaaatgttcctttacacgaacatggcatggacggtagtgacacgtccgacgccttctatattaatatagattaaccacataacaaatacacacacaacaaatatgcatatttcctttctttgtatgtccagtatgttctttctttgtttcaaggggagttatatgaacaccagccaccaggtctcactgtggcaacaacaaacttctttggttgtgtttgtatatgctgtaaagttgtaaactacagatgttctaactttcagggattggagcatactcatgcggttcttcaacgcgagcaggagaaacagcagcaaccacgacggaagcaccgaatagcacaacaatcaaagccgtgaagttcaccaaaaatgcctctgcgccatatttgtcgagccctgagctttggaggaaagtgagcttctcaagaaatccgagttctgcggtggccagggctaaaatgtagacgaagagcccaaacagtatatgccaaggaagaacacccttcctcacgcttggcgaagcacgggggaagaagaaagcaacaaacccgaatatccactgcaatagacaggcgcattttacaagaagttgtcaacaatcaagtaaagttatatataaaaaaaactctcaccgggcagatatcaactactacaataaaacttcgcagttcaataaatgtgttgtagatctttcagctctgaaaagcaatccattttttcatgtctttcggtggccaggaaattattggtactaacagctactggtgtctgctaacttattcagattcatgagtttttagttgtgaacagcacaacaggatacagagtaatcatttaaccaaacacattcagaaattgatgcaacatcataattgactaaattgtaaaaaaaaaaaaaaaaaaaaaaaactcttctatgtgcatgctttaccagctattttaccagttggttctgttgtaagttgacggtttcagacaaatcataataattggactaagtcaatggcttatatggaatagaattgctgccatatgcaaggggttacctgaataccatacaaacaaattgttccaatcccaagccaagaatgcagactgtagaggttggcaattccactttcattgtgaaatttgaaagcgcagtatatcccaaccgcaccgaatacaagggcaattgcatggagaattagatggatcagcttagttgtatcatgcttccaagtaggaaggaccttgtataccattatagctgccaaaatggagaaggaatattactaaaacttttccacgaaccacagaaataataataataacaacaaaacaacttaccttcactgcctaggattatatagccaataagcataagaacagggtgaacctgcaatgtctcaacattagagatatgggcaaccgatttgaaacgctaatgtacagtagtatcctgaattactagtagtaaggaatatgcaaatgattagaaactgcagaacagaaaagaaccgaatatacagtttaaattttaaaaggtccatttgccgttaagtccaagtttaacgtcttttaaattgggcatgcaaaattaggtggcgcgtttacagaaatgtgtagcaagttgaaatgcaaaatacgattgctttttaacatctttctgtggaccaattgcatttttaacatgacgtcatgacccgcttcatctgatatgaattcaacatcatgcaatcattattcagccctccattttccccatcagatggacaacatgccaatgtgttgaccaacatggatgcatgagcataagagcatccataattcaatacccaacaaaaaacatgccaatgtgttgaccaacatggattcatgagcataagagcatccataattcaataccaaacaaaaaaccaaataaagaatacaccacatggtgcctagttcaataacctactccatcaagcaatcaaacgatccctgattagatgttcaaactgaacgctcaacactttggctaacttaacacatgcagcaaggcctgcaaacttatgaaagtcaacccaattctcattaagtagtcacaaatccgaacaggttagctaaaaaattgcttaactacatacgtatagcggggaaaaaaagcaatcttaacaacaattcatctgttcattcataaccgataacacaacctcgacaggactaaaatttaagcactatcctaatcaccatggcaaaattaacagcaaaaggtaaagcagatgccatcaacatcctgcttttcttgatcaaacgccaaacggatacgacggccaaagtatttttgcgcttccttccttcctaataaagctacctacccctactggatatgactccaaaattttcttttgggaaacaaaaaaagaaaaaacagcggcacccaaaattgtccatccaatccaatatctcgggacggtatcactagaaagataactagagagacggggggcagacgagaatcaagtactcacgttgaagatgaggttcttgtttgtggcctcgaaggcgaggccgccgcggaagtggatgcaccagaccagcaccatggtggcggccgccacggccagcgcgtgcgccacgtacgtgaacggcgccgccctcacgccgagccccatcgcgccccgtctccttcccctcctcgcttcgccgcggccgcgctgtgccgtgccgctgctaccggcggcgggtctcgggtgagtggagaagagaatgccggagcgtagttgtcccccacccccaacgcctcctataattaatactccctccgggaaaaaaaaaacaaaaaacatttaaccgtccgtcttatataaaaattatataaaaaaattaaaaagataaattacgtataaagtattaatcatgtttattatctaacaataataaaaatactaattataaaaaatttcatataagactaaaatgaacagtcaaacgttgaacacgaaaattcagggtttgtctttttttaagacgaaatgagtactagtaaagggatattttggtcttctttaaaaaatccccgtgttgttttcgtgggtttccgatgaggccggaaggtgccaatgtacaccaatcagttgacgccacggctgtatacctattgatttgtaagattgttgtgtatgaaagcatgataattatatttgaaaatggagattagaggtatgtaaaaatatcatatgccttcgttagagtgaaaaggcagcgaagggaaacggaagaatctggtctgatccgtgaccttcgtgtcttcggctccgtgggatttgggaagaaaggaaccggccgccggcggggcccggcatgacaagcgacggcgcgagagaggttggttggtgggaagtactggaatgttcaggcataacaagagttgggattatgcaccacggcattataatgaactgttaaaaaaagtttatatacacatttctcaacaaagggcatttggtctagtggtatgattctcgctttgggtgcgagaggtcccgagttcaattctcggaatgcccccactttttttttcagaatacaaaatcactttttttttcagaatacaaaatcactttttttttcagaatacaaaatgtgttttcttggacattgacaagttctttttttttagtttataaaatgtgttttcttggacattgacaagtttttttttcggtttacaaaatgtgttttcttggacattgacgaggttttcaaaatatacttgtggctacttatttgtattgtaaaatattatgtcaaaatttatatttatactttaaagcatctgcaaaaccgggcaaacataagatagtacgaaaaatgttttttttcaattcaaatgtccacatgatactttcacaaggttacagaatgtgttttcttggacattgacaaggttttcaaaatatatactgacttatattgtaaaatattacatcaaaatttatattgtatttttaaagtatatgcaaaaccgggcaacacataacattgtataatcatgtgatgattaatcttggtgatgaacaattgtcaaaggtgagtgttttaaaaaaaatacagcgaatagtgttttctgttggtgaacagtgcgttggtactatgtggccgaactaactagagggattcaggcggcctgactgggtgacccgatggttagactagaatactttgggttggagtcggttttaagttgttttcatgatttttttagattgcttcatatttataacttctagattgtttctattagtatgtgatactatcgtgtgctgatgtgagttaagttggtgcgaattgtactcaaatacaatttttttattcatgtgcaggtgttgttggagaccataggagtatagccggtgatggatcgggactaggcctgggagaaattaaggtctagacggcaaatgatatcacgtggaatgctcaggctagagaataatgcacctggaggtaaaggtttctatatgatatatacgtggtgttgtgtatgtatgaaaaatgagtcaaatttggattggagttcaagtttgaaaaaattagagtgtggagttgtatgggaatgttgtttttcaggtttcgtaagcttcctatgtgattaggagtcctagttctagttggattcgtggctaggggcagccacgttgtgagtataaatagatgaggaattgagaccggaagatatcaacttttttttttttaaaaaaagaaaagttagggtttgctttgaggtttcgattctagttcgtgagttaagatatgagtgctttagatgcactttataaacatatattagtgtaataaagttgatatattttcaagagttttgtactttcgtcgatacatgtttttttgcataccgacggtttgatcaaagttcattgggtggtctaataagcagcatggcaacgtcaaaccggcatcaatctagctgtgtgattggtgtaatttcattaagtttaactataacttttatttccactaaaagtttagattttcggtgttcgtaccattcatctctctagtaggtttggtttatgtattcgatcctatcaagatagtacagaaaatgtttttttctatacatatgtccacatggtttttgttatgtgtaccatagttaatattccctccatcctaaaatataagaatctaggactaaatggaacatttcctagtactacaaaactagataggcatcttatcatccggtcctaagttattatattttagaacggagggagtaggatagtaacgatgtttaaggttttaaatggttaactctaactccctccgtttaaaaaaaaaacccaattctagatttgaatttggacacacccaggattggatttttttgacggaggaaataagtcctcagacatgttcaaaacaacatgctttcgtgcttccgtgaccggtatgagtacaacagttatttgcagatagtggcaatgattccctaattttcaacaccaacaatatacgtgcttcttaaactgctaaataatatgttttgttaaaaaaaatatagaaaatttgttttaaaaattacattaacattttattcaaatttaaaataattaatatttaattaatcgtgcgcaaatggctcatctcgttttttcatattctcagctgatattaccagcgtctcccctctccagctctccttaaaagagcctctgtctcctaaaggcctaactagaatttgcttgaataatttgctactgcagcccagcacaagcgacgccatacatgcgcgacaaaagatcccaagcgggcctgctgtgctgtgtacagaagcggtctataaacctactgagccatcagagtttgaatgccctcccggctggcccttctccggttgaccgtgtgccgcgccacctggatgcgccgccgccgacggctgccgcccgctactcggccccgctggtgctgtcgcgtcagacccatcgccgcgcacccccaccaccccgccaacatcagcgccaggcgccactccctggccatgcccgggctcccctgccgtctccggagcagcggcgccactcgcgccgggccgacgagagggaaaccgcccgccgcgtcctcggaacgtcccgccgccgccgccgccgcgtactactgcccgcttcgcgatattgcggatcgggccaaccgcggacgagcgcgatgcctggaacccatgctgcgggtgcgggccttcgtgccacgggtgtccgcgcggcggcggccactggcgttgttggtagccctgaaatggcgcgtgcggcggaggaggcgggtggcggccctgcagcagcgcgtccgggggcagctcgccgatgttcacgaggtactccgcggcgaggcggccggctcgcagcagcacctcgtccctctgctgcggcgtcatgacgacgtgcggcggcgcggccgctgccgggtggtggtggttccgtggggcgttgggtccggtactccctcggcggaagcccgcgccgtggttgttgctgtagcgaccgaacggtgccgcgttgttgccacgggggttttggcctccgggcttcattgcctcgacgatggcgaccgagatgggtttacgcagacaagaagaacgacagcgcggcacgatcgaactcgggaattgatcgcggggcgctggtgattgataaaggcgctggtgattgatcgagtccgtgttagatacggggcctcggagtccatcttagagaatgtatcggacaccaattctgagcctcccatgtatgaaatcgttgctagtatatttgaggaattcaaaattggaataagttcactttgtgaccctcaaaagcgatcgaaatctaatctgtgaccctaaaccacaaaccggatatcttgacccccccccaactcttaaaaccggtgcaatttgactccctcggcggtttctcctacgtggcggttttcaccgggtctcctttacatgtggcgttgacatagcgcttaggtggcattaaaaataaaaatatgtgtgtgagacccatttgtcattcaccaaaaatatgggtgggacccacataaatcatcctccccctctctctctttctcttcccttcggcgagccgcgagcgtgtgacgacggcggcggcgggcaggagccggcagcgacgggcgagagccgccggcggcggcggctgtgggccagagcggcggcggcagaccgaagatggacggagagcgacagaggtaggctcggcccattccaccccggcgacgaggtcccgacgatttctcttcccattcggttggcggtggcggtggcggcaggcccagctcccgcccgtcgccgtcgatggccgccgcatctaccgctctcgccggccctcggccgcccgcccgccgatggttgtcgtcccgtccccactgcccgtcgatggccgccgcatctaccgccctcgccgtccccgccgtcgctccagctcccgcccggcgcccgacccatggtgccatcgtcagctccctccgtcattcacggcgccgccgagaggacagagcctatcctcacctccaccggcacagcgccctcactaggggacaagctccctcacggcgccgccgctattcctgaccgccggccgccgccgccactactcacgaccaccggacgccgccgccgctactcccgaccgccggatgccgccgccgctactcccgaccgccggacgccgccgccatccccactgccactccggtggtgaagagaggcggggggagagaatgagagaagggagagagggaggaggaagaaggggaggagagaggacgacatgtgggccccacatgtcatcctctgtgtgaatgataaatggattatttttttatttttaatgccacctaagcgccacgtcaacgccacgtgtaaaggaaacccggtcaaaaccgccacgtcagcaaaatcaccctccaaaaccgccgagggagtcaaagtgtaccggttttaagagttggaggggggggagggggggagtcaagataaccggttttatggtttagggtcacggattagatttcgatcacttttgagggtcacgaagtgaacttattccttcaaaatttccccttcttccataacgactgaagttccttactgggcctctagcttttgaagccattcttttcaaatctcacggtagacagggaagccctctttttctggcgtaaaatggccttgccccgtaatacaaatgatgcaccatatgtttattataggagctttgccactgatcggaaacgatttggtacattatactggaccagagcaaatctcttattatggttgcctcggatgtcctgtaaagagaagtccacacccgcaaaaaatcatcgacatgcgggctacagcctacagtacatggaataagtatgcacatccgtgtaaaatatgggttgacatttcacagataaatggagtgcactgcaccccagaaataccctttttatcgtaagctttttctttgtttgaacgaaaggacacaagctatgcctattgcaccaaagagtaataaagaggataaaatagaagtttacaagcagaagggaagaaggaagcaacacaaaaacgaaaaactcatgcaaactacgctagaaaatatcctccaggcaatgtcttgtgactaaaggcactggtctcgaaaagttagcctattcaatataccatttaacctataccgccagtgcttttgaatgcatgagcggcttttaggtgtaaatcacttctttacgtaagttaagagtttagacatatcttcatggaatatctttacaaaataaaacaccagcaacttaaatttgaggatacagggacagggagcttatctgacctgacatgaaaatctacgtactttcctctcgaaatctatttgaggatagggcacagggagcttatctgacctgacatg

SEQ ID NO: 54357 - DNA, 8123 bp, Oryza sativa
  unsure (1)..(8123): unsure at all n locations
ttctgcacaaaattattcaggttttatcttcattgcatctcaaacactagaaaattcacaatatcagaaaatgtttcagcacgtacctgtcttgctctcttgtcaataggagtccatgttggatcaatggacggttctatcctctttttgtgacttgttggttgtacattgaaatctttccttgctctgcgattctgtgctttagctccttccttgcctttcccataatgctgagtcccaattgaagggctctggtccctcgaaggagtgtctctatctcctcggtatctgaaggattctttaggtggaggatttagaatctttgagttgctatctctcattcttgggatcgacatacctggtgaattactacatctagatctctcctgacgtgcttttctctttgcactcatttgccttagataatcaatttcccagcatgacccctgtgaagttgcatggctaccaaaatctagtttctgaaaagcaagcgaacttgctggatgttgcataatttcatctcttggttcatgatatctgttgtccatatcatatctgtaagagtcgtctacagtacctccatgtgcaagccccttccatgtttgttttgtacctcctgaaatgttccactcaccaggatcatcgttgatctcaaatgcagttgaaaatactggattgctatgagttctgctgcaagatggtctgcttgtgtgaaaagtgcttttgcttggatgcgtaccaccaaattcaggttgccagggtaagtcgaatgtgtccaccatattgccagtccttctgttatatgcttgattatttggtgtcaatccattgctgaaatcatcattaatgacttgattaccaggtattgcatccacatcatgcttcttttgttgataagagaatccctcacttctcatattcaaactttcgtcgaatgtaaagacatctgggagctcgggaattgtattatccatgtcagagaacttcctcaacttagaaggtgagaatacctcagcatgttctgcatagtcaccaggtatttggtttagagaatcagaaaagaggagcttattagttggtactgcacaagcctgcaatgaacgctgtttccttttcctcggagactgcaggaatgcactactgatatctgaatcgactgaagagcattcagtcattacagaccttgattcacctaactcaccaaatttgcacaaagcattaaatagggaaatgatctttggagacaaaagatactttccaactgcttgaatacggcgctcatgtggccaactgaggaactccacaaggctgcctccagaagaaagtaacatatatgcagacacgggattgatggaagggaaacttgtgagaaatgattcagccaggctttctgattcaggtatatctggaagaggagctttataacagctagtcacatttgtaatgcaattgagaattatttcatctgttgacctgggtgtgtgtgagaagaacagctgcaagttcatgtccaaactagcagctgcagtatacaatgaatcagatgagtccattacagcagaaaggaagtcagcttctccctcaaagacctgcaaaagtacaaggaaactgttctcttatgatagatcaagaattatcacattcacaccaaaccaaaacagacaggtgcatttgcatcaataacatagcaatggcctgtgatgctaactatatacgaaaaagtaaatacttctagagggatacaaaattaattaccatgatgcagccagtgaaagagaaactaactgacatcagaatgttggtcgcaatattctctacattttcttttataccagatgtctctgctgatgttgttagttcattggcctcaaagagcgcagtctcataccatactaggcagacagcagcactgagtatcagatccacaggcagatcaatatctcgctccacgacctgcattcctcctttctccagagctagtatctgctgataagatgatcttcgcgaaacaagcatcgtctttccatgatttccagtatttacaactatcactacatctgggacggacagtcttcctggcatgatgcagtcatttttcacacaggaaggtaagtcagtagtggactgattctcttgagggtctttcagcacattggcagatacagaagaagtagagctactcttctcaactgtgggtacacattgtgaattgacaacaggtttattactcagtgtttgctgtatatgtagctgttcatcagcaagcacaacgttatgtgaatcaaaagtattcttcttgttaagattttgtaatctgtgtggttgatcatctggaagcagttcttttgtagcatcagcagcaaaatgtttgctccgtttttcttgaagaccttgcagttgatttgttgctggtatgaagtttaacgaatcaacaatacgcattttattcatcctctcctgcaaatccttctgaagtgtaagcaaaactttatcctgcaaatagtgaagcattcttaggaagttaggatgttccatgttgatcatttgctacaaacacctactgccctattactaagtgtaggccctcaaaaacaaatatgtggggaaaaaactcatttgtatggttttccctctaacaagatcatgcaggaaactcatgctcaattgaagtactcaactacaatggatagaagttatgattacagagctgagactaagtgtttcatattacaatgagctgtgtgtacaagatataaaaattttcatgtagtgcccccctccccaacacatacaaaggctggcttaataataaacaacatgattggcatatgacaacagaataaatggcagcatggagtgagtgataatcaccaatgtagatttcaaatcctggtctttatggttgtcctcgactagagcagctggaaagtccttgccatcaactttgacatagaggaaatgcagaggtggcaaaccatctaatttaggagcgagagataacaaggtagatgatttattcgggcctccatattccagtatgatgccaaacttgtcaaaagggaatgaagctggaatgttccttcaaaatgatgacaagaatggatatggcataatatttaatatcagacaagcaaaaactaaactgtgcatagaaacaatttttttgacaaaaagagccaatgaacttctggtacatttaagttattgtaaaaaagaccccaaaaatatgtctaaactctaaccacagttgatcaacaatatgaacaaccagtgcaagatgactcagtggctcacaaggcaattgatccttcttaaagggcaagctacttctaaaaacatgatcgtcttgtaatatgtccatgactccatgcactaagaaatgaaagttgtggcaaacatggagggactgttaatgtaacacattcatttagctcaccagaatgaattcaataaatcctgcactaattcttgtacagtagaaaaaggtacagcaaataactagctaacccccaagaaccagcctatctgcttgttgaagttgatttgtaataagaaaatgaaaagcaaggaattggaaagaaaattggcttggtttatttatcaaatggacttacttgttatctagcagaatgcaatctgatttcagtaattcttccagcacccaagctgtagagtttgtcttgttcaccagatccacaaaagttgttgcagggttttgtccaaactcaacaaatgtcatcctcatggatgctagcttttgacccagtggcagccagaaagctctatcagcaactataaggatcttttggtcgatttgtttattagatctcaggatagtctcaatgcatgacaatgacggatgagattcaaacagttgcctctcagatttcctctgtgcttcagaaatggaccatagaatatgttttaacctctcaggagtgttttccaagcttctagtcaggttgctaatgtacaaatgggccgcatgcagaccaaagaaacataagtaatatgcaacctgctttaatgcatacagtacaatgagttccatcttatctttgtgttcgcagtgattgtacgagccttctgaaccttctcccgttatcagttcaagaagtttctgctttgagattcctaaaccttgctcatctgagaaagaatgcctccaatatgtgctttcttgcagagcagatgtatagcttgcatggatttgttctataaggccttgaataagatttgaggggctgacaggatgaatttctatgagtttgtcaaccttagccctggttgaaagagataatgcttgctcttctgaatgcgggacatctaaagtagaagtattctcattattggttccactcttagtggcacttctgacgtttaagtaaaaatttaggtcaccagaatgtgatattaactcagggaaggaagatgacttttctggactcggtcttttcatggaactatggtttctagtaccaccttcttgttcgcatttttgagttgcttccaatttttgtggatcatgagacagtggggcaggaacataaatatcgctatgtttatcctcatcttgaagctttggacttctctgaaaatcctccagaaaatcgctaacaaatactgatgtactctgacaactcctttgcagctcagaacttaaatggcaagtttttgcctcctcaaccatgcttgcataagaacaacaaatctcccggttgcatggtccttccagtaagagatgccaatccaaataaattccatcagatgctgatagagggtgtggttttagggagcatagtatttcttgaatgggagggaccctagacctaactgctatatcatcatttaaaataggtgtaggcaatgacctaaatgtatcatcaaccagtgctaactcgcagctaaccattgattcatacaaacgtcttgctggatcaaaatcatctttgaatatttcatcagatatattcatcttatttgtctctgactgaacaagcattttgaatacattatctgaaggaaaatcaatgatctgtacctcctctaaaagaatggagcaaggcaagtctgaacaggtgccatcaggcttgagagggtagagtgctgaatttttctcaagcagaatattgccattgatcctcacaacatccatttctactgcagctttgatttctgctggtttatctacttgaatgtcatggcatggtgcatcttcacaaacaaaggtcagcatgtccatgtcagttgatctcaagaactcggttgatttaaacactgaatgctgaatctgtgcttcatccaagtgtctaacaacattatcaaaaacaccgtatctgtcagtctcagtcagacaatcgtcgagctcccaagaattcctacttacttccaatcgaggtattactgcaccatgatctagtgctgcaatctccaagcagcagtcttctctcagagaagaatggccattgccatcattgtcttttacagggaccttttctacttgatacactgactctggaagatcagattgatatcttatttttatgtcggtctcaatatcaatgaaatcctgtgagaaacagagacgagaacgtgagcatgatgtatcaaagaatatgtttgagttaataaaacacaagggaatcaaatcaacatgttcaccagcaggcataagcaacttcaactgatttatgtttttgcaactttgatggtatgatagtgatagttacataatacagaaatatgacagggaggatacaaatattactagtgaatccacaattaacacaaaaggtaggagataaccgcttatcatgttattgtgtagaagtatatattttgggtgatgcgcgcattacaatcgaaatacaacatggtataagaacggaagtatcataaccatttaactctaagtacaacatgttcatatgtctcccatagctgaactgcagctccatgcgcattattgatcttttgggagtatagaggagcgaattatttgatattgtgatgagatgatgtagttaccaaatggattttcatatctggaacacgaagcaacaacgtgacaccaccaccagactcctcttcaccaaaggatgcaatgtcttcttgcaaagccttagacaccagaacaatcgagtttgaatttgaaaaggaaacaacataataatatcaaccaatatcactgaaacgctgctcaccattaggagatccacctctacaacctcaaatctaagctccttcaattgttcccacctctagcaccacataatgcataaatcgaacatcaattccctaagaacagtcaaagcatgtacaaggctagcaaactaactactatgtcaccttcataactgaggagatctccagaccgtctgatctagagccctcccccttttcatccttctcgcggttgatcacgccatacccctatagaaaaacaaaaaagtgttcgcaaatgctccataggaaattcagcctacagaatccaaacataaaaacttcacttgccttagggattctgaatgcaccaaactcccatgagctgaaatcctcgccgtatccgcctctgtcgtacaggaagtcgtccaatacctgcgtgaagcagaatctagcagatgagctgttgcaactcacagatgccacacgattttctcacatagaaatatcaatcaaccaaaaacagcacagagcaagcaacagcaaccccgagccacccccaaccaagccccgcacgactcgagaacgcgaaacccgaattcgcaggtggctcgctcacctcgtcggccgcgggcacagtcggcacaggcagggcctgcgggataaccgcggcgaggaaatcggagagcgcggaggcgatggggagagggccgagaccatcgtcggcgaccgtggcggctgggagttcgtcggcggaggtgaacgggaggaagtggggatcgggaggaagggcggggacggggagagaggggaagctgaagaactctagggctagcgctttgccggcggcggaggaggaggacggcgcgaagtagtcggtggcgaggaagcgggtcctcatggcgaatggcgcggcggagaacgaagcgaggggagcaggaggttgaagacgaattttttggttttcaaaatgttttgatacgccaacttttgatcttggcttgcggaatgcggagttgcggtgggtttccgctgcattgccttgtgtgttctactaaaaaaaaatgtgtgctcttaattagccgtttctaaagtgtaggaatccgtttcagaaactgggcctaggattaatgggccggggtggtggtgccattatggtcgacgtgaacactcgtgtttcgtccgggaaaaagtccactgtgacttcctcaaaatatatatagctccaatctaatttatattcttaaaccgcaataccggatatcttgattctctcaattattaaaaccattataatttgaatatctcaatggttttggaggatggttttactgatttggcactttgacttggtataacctgttaaatcatcttgtgagaccctcctgttaatgaccctttttatctgtcggtctgcttgttgttaaattattatgtgttaggagggnaggnagngangccctcctccctcccccacccaaccctagacatgtcagtggccaaaaccggcaagtcctcgttgcggtggtcgagggggattgaagggttgaagtgaggagggaaagggacggaagacaacaaaaaaaaagttacataggatgactcaatagtttggaccaagtcaaaaacgccaagtcagcgaaaccgtcctctaaaaccgttaagggagtcaaattacacagttttagtagttgagatagtcaagatatccgatattgcggtacatggatatgaattagattgaagctatatttgaggccatcaaagtggacttgttcctcgtcccgaaagcgagtcgtgagcgtgatcgccaacacggcccatttcaaggcgacgtggtgcggctcttcaacatttgggatggcgtcttcgaccatctccacagcacaatggtagtactacctcttctgttccaaaatataacaacatatctttatcaaaatataataaattttaagtga

SEQ ID NO: 54358 - DNA, 4485 bp, Oryza sativa
  unsure (1)..(4485): unsure at all n locations
tcgtccatgactgccgccacctccacgagcaccgggaccgccatctccacaaactccgccacctctgcctcgtctacgaccgccgccgccaccttcgcaagcgccgccgccggtcctctcagatccgggcgccgccgagtgcctccgcccctagacggcactaacggtgagtacaaatccgtccatcccatcccacctcaatcccttctaccaaacaaaaaactataaccatcccataccataaaccaaacagacaactggaaccatcccatcccacaaaactaggataggtctgacccatcccacttcgtccccaaaccaaacactaccttagcgaattctactccttaccattttactctttcctagagtgacaaatcagggtgcatttttatcatgtttgcaaaccagaaattcttcctacaatgaaatatctgcggttgcataaacagatttacaggattgatccattctgcatgtctttttacaagagagtaaaatttttcagcattttttcatgtctttagatgtcagcattttttagtagtatatagtacaacataacatgatttaccatacaatcaaacaataactgcattgttctctttttattttcctcaacaaacttctaacaatatgaacttctctagatatatgtttgcaatctttagacttatatacaaatatggcctaaaagtaactgattgtagcttatttgaagtaataaaggccagaatgaattccgttacctagaaggagagtaaattttgcaaaactataaaaactttcgatgaaactatattacaaaactattaaattccagcagcggcctaacaaaacaataatgcaccaaattattaggatactacatatgtaaattacgatatcacaaaactatatatttccgcgtaaattcaccataaaacttcaaattcggaggttatagatctcttgcgttattgccaattggatttcaaaatttatgattttgcgatactatgatttataaagttgtagtgtagtttttattactgctccctcggtttcagattataagatgttttgactttagttaaagtcaaactgcttcaaatttaactaaatttatagataaatatagtaatatttatattaccaaattagttttattaaatcaataattaaatatatttttataataaatttatctttggtaaaaaaatattactattttattctaaaaacttggtcaaacttgaagtagtttgactttgaccaaactcaaaaacatcttataacctgaaaaaaaaaagagggagtagttaatttgatgctatataggcatgtaattttacaatatcataccttaaatatgtacatacttaagttttgtgataataattttattattaggaaacactactggagtaatttctgaaatttactctgtttgcgattatttgcaattttattatctcaactcatattcttccttcccctgcaggcaatcctgacctccacgcaggccacatccatcccgggcacccccaccgcgccgccgccgccgcgccgggcctactccatctcctgctcgtcgccgcctctccgccgcgaccccgccgtcccgaagaacatctcccagacgctctacctcgcgctatcctcccgcccagcctgcgcccgcgtccccgagccccagccactcccccctaccaccaccaactcctcctgcccggcctacttccgcttcatccacgaggacctccacccatggcgagccgcgggcgggatcacccgcaggatgctcgagcgcgccagggacacggccaacttccgcctcgtcgtgctccggggccgcgcctacgtcgagcgcatcgcgccggccttccagacccgcgacctcttcaccatctggggcatcctccagctgctccgccggtaccccggccgcgtccccgacctcgacctcatgttcgactgcgtcgactggcccgtcgtccaagccgatcggtaccagggggagaacgccaccgccatgccgccgctcttccggtactgtggcgacgacgagacgctcgacgtcgtcttcccggactggtccttctggggttggttagtctacttctcctggtcttcacatcattgtatttttcttgatggagtgcttgcagattaacattatattctactggttaacattagaatgaatcccaatatcccacaatcaaatcacaggttatttcctatgctgttattgctacgctactgttactagaagtagcacaatgattgtgttcttcatgatagtcaggtccagtaagcataccatcagtgtgcattgtgggaggatgcacatgtttatgtctgctgctgtgtttctgacacagtaaatatatgtgcttgaccattgcagtgcttagattaaagatcattcctaagactgcaccaaaattaagtatgttctttttacgctttcattcggacaaagcaccagagcttaaatagactgtctgtgatgataggccagagatcaacataaagccgtgggatgcactgcagaaggatttggatattggcaataagagggtgaaatgggtggatagagagccttatgcttactggaaagggaatccagatgttgcaactaaaagaaaagagctggttaagtgtaatgtctccagtaagcatgagtggaatgcacgaatttacaaacaggcaagtatttgtgcctatgatttactgtgcctagtcgcacttcaattaagtttaatagtcccctgttctcgcaagtttagtccttcatattccttttaaaagaataattatattttagtatgtgagttatttatcaagaaaacagttatgatgatgtttatgattgattagctattttgcgcatgtttctcatatacaggattggatcaaagagagtaaggcaggatacaaacagtcagatttggctagtcaatgcacacacaggtgtgttttcttttgttaaaaggaatataagagtcattttgctttgttgacagtactgaccattgtgtttggtgacaggtacaagatctacattgaaggatcagcatggtcagtcagtgagaagtacattctagcgtgtaattcaatgacactggttgttacaccaaaatactatgatttcttttcaagggtgctgatgcccactcagcattattggccagttcgagatgacaataagtgcagctccataaagcacgctgttgactggggcaattcaaacaagaaaaaggtatcatcttttatataacatttaaatatcaagcaacaaagttatgtggcactagatatcagttttgatcatgattggctatttctatgagctgaaacacattggtcaacaactattaatttgagctgaaactccatattcacaaactacttcgtgtgatatgctcaccctgatagtgtgggaatcttttgcaagataaaaaatttaaagcttctaatgttctatagaaagtgatgcccttcctttatctatttaatataagcacattgatggagctgtaaataattgcattgtttttctcgtgtatttcatctgaaagttttgtgcaataaccaaagcattgatgaactaatattcaaaactcgaaattatttcttgatgggaagttatcaaccgtagatcttaatccgtgctgacttgtccaatatttagtgaactagaaatttttacttgtcttttcattagtaatgatcatgtttggagtcaaaggttacatttttctataacatagaatattttaccatatcgtcctgtgatagtaatatttatatgaaaagcatactctcatatctcccttctaaaaactgttgaaggcacaaaaaataggaaagcaagcaagcaacttcattcaacaagagcttagtatggactatatatacgattacatgtttcacctgttaactgagtatgctaagctcctacggttcaagcctaccaaaccacctgaagctattgagatctgtccagagttattggcatgccaagctataggccgtgaaaggaagtttatggaggactctatggttaagtctgccaacgatgcaggcccatgtgatctgccacctccattcagccctgaggaattcaaagaattacaacagaggaaagagaagtcaatgaagcaggtggaaacatggcagcaaaaggcttcgcaaacctgaggatagcaagcattgagagttcactgtttttcctttcctaacgacatgcatataaagttttggtcaattatttagggtcaatggtctatacacatattctgtagtggtaataatgaagagtttttcttattcgattgaatcaaatgcataacatctatagaacttacaaatggttgnnattgtgtgnnannaaccccccccccccccccccccctccaaaaacaaaaggaaaaaaaacacccttcatgcttgttaaggaaatttttacttctaactgtcattttttatactttgttt

SEQ ID NO: 54359 - DNA, 14059 bp, Oryza sativa
  unsure (1)..(14059): unsure at all n locations
aaacctagctactccatattctcagaagctagctaccaactagttactctcagaatgttaagctttccccaaacaggccctaagtacagcatatcctagccgcccctttctcaagggaaatggcgcaaggctaaaattagaccgttttatttgtcttgccctgtccatagaagtctttaattttagctgccttagcggcttcaaaaatgactcactatgtccataaaagactttaattttagctaggcatattaagtaagatattaaaagatcaatatgacattcattaatatggagagaaaacaagaagcagaggcaaataaggacataaaggaagtgtaacgccccgatttccgcgtggcgttaaaagctaattcaccgaaaaccctaattgcgaaagttttgattcttttgagtgatgagtctaagttgtgccaaagatcacaattaaaatccctcaaatgtctcgataccctgttatcaaagatcgtctccacaaaatttccatcctaatataatcccgaagtttgatcccttctattcggagttccgtcctgaaaccccacccgtgaactttgtcgaatgtccgaaccctaacccactccaatgattcacctccgattcctaaactctctcattagttccttcaaaccgattctcaaatccgaattcaatctctcaggttttgattcatctatctttctctctttatcggttcgtcaatctacccttgttttccttctcgaacttctgacccaagtctgaatatgcaaatcgagaccacttccacccttgaactctaaaccccaaggttcaatccctttcgcctgagttcttcccaaaaggatatccgttccgaaataatctcgaagtccgaacccttctattcagacttctcttctaaatcccttacccgcatatcccgtcgagtagtcaaactcaagctcccaagttacaatttctttctctaaattatccatctccctttgactcgtctctgaatattgttcccttccttgactcctttctattctcccgagaccgagtatcaacttcgaattcgaatccagactccagccctaaaacctctccaattaaacctctctgtgaacgtctaatttaccccccccccatggtggtggattcccttctttcatttcctcccaggtccacctcttcctactcttccggcccatatctctctccctctaaagtctagacctatcaaatctacctatttatttcgcccctctctctacatcgatctacctagcgatctatctatcgatcgatcgatccatttatctatctactatacctacctatctgtttacctatccatccgtcaatccatctgtctatccgtccctctacctatcgacctatctctctgtccatctatctatctatctttgaactctttcccaaacaattgtcccaactccaagaatactaggttccttttgaatccctctcaaataactcttgagccgccaaacacagaaatattccagaaatatataattcccgcctttgaagcccttccatgacacccccatatttgccaggatcatatatccgattggaatccaattcccgactcaaatgctcctcaaattccttaaagaaattcccccgaaagtctatttcacctccctcttggtcgttgggccgtttttccctttgccggcccatctccacctctcggccgctcctcctcccccgcacgtgcgttgcacgcgactgagtcgaaagagagcgccgctctctccctctctctcggtttctctctctctctccctcgatcgatcgatgccgtccctctctctctatttctttctctctctctctctctcacgcgccgacgctgatttcccaccaacatcgctcaaacctccaccgccttcgcccgttcccgcgcgctcgcgcgtggccgaccgcccggccgccgccgcgtcagccctggtcccgccactagccaccaaagcttggaggcagagaagctcgcctcgtctgccgcatctcctcaaaatgggaaaagcaaaaccccccctttccactgcctcgtcctccctttttccttcccgagctcgaccgctctccccctgtcctcgtctctttgcacgcagaggcagagcgccgctgatgatgccgcagcagcttgcgcccccactttggccacactgcgcaaatcctcccgccctcgcgatttgattctcgccgtccaacccaccgcctccaccgcgccctttgcatctacgccgtcgctcgttctcgcgccgctcgtgactgcagccgagcgctcgaccaccaagtcggtttccccctccctaaaccgacctcgcctccgctataaaaacccgagcccctcccatcgccctctctcgttgtctcgcctcctctgcatgccgcaccattgccgccttgacctctcgtcgtcgccgtcgcgcgtgctggtgaagccggcgtgcgcgcggggagcggaagagactccgggcgccatcccttcttccccttccccggcccgaggccggagagctctcccgcgccgccgccgctcgtcacggcgccctgtcccgacgcggtagccctccgttcctcttcctcgctcaccctctccctcctatagtcgcacagtagctcggatagccctccggtagttcgtagaagcccccccaagccccgcagccgcctggcatggcctcgccgccattgccgcccgctcccgggggccgccgccgtcgccagccctcctcggtgcctctcctccccatccggcgcctgaaacggattccccgagccccatagatactcccaccgccttgaatcgaatcctcatcgcccctccgccgtttcccccttttctcgtcgccggcgtgcgccgccgcgattcgtcgtcaccggcccctcttcgaaggatccgatccgttggctcatcccctctcgtgctcccctttgtaccggtgaactccctctcgatcgaatctccgcgtcgtgcttcggtgaagccccgccgtcagccgccgttggttggagctcctgtgcatcttcctcctctcgcgcggcccgcgtggctgccacgtaggcgccacgtcggtgccaccttggcaagaccgagtcaaggcagcccagtcagcctccccctccgtccctttcccctgtgcgcgcggtccacgacaagtcgagcggctgcaagtaggcccgccgcactcccgtccacaccggcgcaccacccaaaccgcgtccacccaaaccctagcgtcgcatcccgcgtgcaccccttccaccgtgaaccttgccgccgacaagcaggccccgcccgggaccccgcgcggtggaccgcgtacacccggtcgaactccccctcccacgcgcccctaatggaccgatcacccgcgcccgcaccggcccaatggcctgaccgcactgcgcatgaccccttgggccgcgcctaagccgcccgaggaagtctaaatgacatccctcctatccttttcttttccaagggatttaatataaccttttccctttgttccataaatcaattccttattccaaaattccataaaccatttcctttggtccagcacgtcagtgactgtcaataatgttcttgagaatattatttctataaattccataaaccatttctctattctagaaattccatttaaacttccgaaattcatatctctcaatccgtagcttcgattgactccgttcaacttccagtaattccgtaaaattgagatctatctaatggtactattaattagtctaaataggatctttcttttggtcttttgtttaggttttcgattgtttgcgtatagttgcggttgcggatttttgtcgatcagggatttctcgaagattcgtgagatcaagaccctgagcaaggcaagccacctttgaacatcttgagcctataattgaacttaattatattgcttgcaaaatattatgcattgataggattgcacataatatgtttgccccgtctgcgaggcagatcagtgggcatacctaacttgttgcatttgatccttccattgttaaattgttatatcatgtttccttgtaaccacctggtcgagcctcggtattcgtgcactcggtgcgagtatcgacggtcgccgtcaaacttaaaatatggtaaacatcttgggtaaaacttggtttacaaaacgattggaaaacccgacgcctggatcggtgccttgtgaaagaaattgagatttaaaaataaaaatcgtgacacaaggccattcctgggcggaatgcttgtgcggtcgcatttaaggaccgattccttcataattacatccgagcatataatagtgcaaccacatgggtggagtgggacacccctggctgagtaattagctaatcaggggagccttgatgccgagagacaagtggattcgccggggtagtgtcggggaggacccctaggcttcctggcacagtatggtctgggacctaacctgttgttggtctgggacccttctcgtcggcatatggtaaacctgtgttggctttggaaatgccttgtcatgaaagcttggaggtctcccgacgtggctgatccccacaggctgggtgatccgggttagtaatgtcatgtgggtaaagtgtaccccctctgcagaggttaacaaactgttcgaacaaccgtgctcacggtcatggacggatgtgaggtgattccttagcgtagtttttcgttttacccagttttatgaaaaagtgataaggtttgggaaacccgatatttggaaggcaagtggctgtcagggagacagcgggacagggagtccctaaaagtgactggttgtttggagacaaccaaaactctgaaagtctagaaaattggtttggtttgggaaaccagctttgaggccaactctgggagttgtgcaaatcttgataaaataatattgttcactcctcacccccggccgagttgagacttgtcttgctctggtcgcggaatgcacacacttagattgtcaaaatgcttgcaaataaaactgattgaaaaataacagccttcccttgaagcttgcattaaccacctaagttcccctggcttgttgagtacgtaagtactcacccttgctctctatataaacatagttctgccagctctgaagatgaagttgaagcaaagattagggtttcatcctagttcccagccttcgcctgtggtgttgggtgttagaccgttggttccgctgctgctgttgttgttgttggtgtttcctcgtccgcgtcgtcggttgtattctcgggctgttctgagctgtaacctaagttaaggtaaataagtcctctatttaatttaaggattgcaatgattcatatttatcaccgtgggtaccagcgctatatcctaggactggtactgagattgcggtttcgtaggaagcggttcgcaccgtttttcctacgacacgctcctgtcaggtgccgttgtacgacggtaccgaattggggtgtgacaggaagtaccattggttcgatggctaaaataaaaagaaaaagatcaagtagtatttaacggatttaatgaacaaattttcaagcttaagagagtttttagggaccgatggagtatagaggtatattcaaccgcttcaattaggatcatggttttttttacctacttcattggattattgttacaaattatatgttccatgcttctaaacatatgttattttttagactactcgtggcgtcgctgcccaggcgccaacttgtgtgcgtgccaatttgtattgatctgcgtgttcaccttcatttcttttctctagtaataaatattaagttcctgcttgttatccatttatttgttttaaaataatgttttttgtgaaaaaatgttcttctatttgttaaatttatttattaaaatatttaatttattctctataacatagataattcgacacaataatcggatggctagtctattttaagtggaaaatctaggtatagcatagaaagccactccttccatccgttctaaaatataatcgtttataacatttgaaatttgtactataaaaatataagagcaagtataataaagagttataagaaagctgaatgctgagctggatgagagaggagaggagagatattagaagcggactgtaagtttacagccggcttaggcacatgaacaaaaaaaaaatatgtgagacagacaggtggaccatgtatgatggttcccaacctctccttctcgatttccgcgcgcacgcttttcaaactactattttgatgtgttttttataaaaagtttctatacaaaagttgcttaaaaaaatcatattgttccattttcgaaaaaaaattagctaatacttaattaatcacgcgctaatggatcgttccgttttccgtgctagagccaaaagttcccaacctgctctctagaaacagaaacagagatatgctataaagctctagtattagcctttgctctaagcatttgtaagcattattgagagcaatacttgtcccatcaattaatgagccagagggacaattgacaagctagagatgcttgtactactttcgtcccagtataagtgtagatacggtttccgtatccaatatttaatcgtccgtcttacttacaaaatatatataattagtatttttattgttgttattagatgataaaatataaatagtaattaatatgtgactatttttttagtattttcacaaatttttcaaataagacaaacggtcaaatattggatactgaaacccacaactgcacttatattgggacggaagtagtattttgaaatggaggaattgacagcttagcatggccattttatgctttaacccattgttttgtttgttatacagattgtccgcattccaatccgcagaaaccttcttggtataaagctaaccaattgaacaaacacatacagatgacaaaagctggggccataattttgaagcaacactgttcatatatattgaaaaccaacagtaacgaaaatcctgctccataagattcacaaggatccagcatatacatatcgcaagccataatgttaagggaagtgtcatatttacaggtgtcaaaagatgaatacaattgaccaaaaaaaacttatactcaaacatgctaaatggacagacgacttattgactggatgcagtagctactgattggaatttgatagtcagaaattacaagaggaatcaggtcctaagataagacgatcatgagttggtacaaatggctaacacaacagacaaggcccacgactatcaactctttcacagaaaagtggaacaagatatatgatcacagacgctcatctcttaatgagaaaaccaagcaggattcccagaatagcaataaccagcacaaaaactagtgagaaaccaccgtgctgactccccatttgcctccttagaagatcctgttcaattccaatagaagataaatgaaactacgtgagtgttgcagtttagattcagatttcattgatgcacaaagccataatagacaaacaagatgatatttgtagataacgaaatacatctgtacttgtagaaattagtgggttgcaaataaacttgacaaaaaagtaaagaaaaacataaagcgcatgtaaactggttattctgtctatctaactcaaagctaaaaaacgtattagtgtttttttcgggtggactggtcactgctggcctcagtaaaagaacagggaatgagtaaatcatgtggtgattatttattggagatgcaaatttatcgacatagctgttgcttaaacctaactagcttatgcggggggataaattaatctatttcttactgccaaagtaaaaaaatatattgggtcactaaatgtttgcataatcaagctaaccagttcttctcgaagcttcatgttctgttgaatggcagaactcttctcctccttcaactttgaaatcaaggccaatggctgcacatagttgtgaaagagatcagcatattgtgctttggcatcattgtcaggtagcataggaagtcggaatcctctataagaagacctctcagttcctcagtttgtaacaaaagtaaaatgctaacaaagtcaagatatgctagaggatgaagcatccctcagattaagttatcattggcatctaaatatgttgagatgaagagccatgatttatgcaaggagaacattaatcaaaagatcatacatgtagagtggagcaagaagattgacaagcaaaaataaatttatagtagtatgtgaagttaggatttagtgataacatagcattgtcaaatttaacaagagaacattgcaacacatatatcaagaaaagtacatagttttcctcagggaaaaaacaaagtgcatagcataaaacagcacacacatagttctgttggatcagagttctaaaacaagtgtcatgcagaggactaggaaataagaagagcacagcaacactgtaaaatataattaaacaacttctgaagcaatgctcttggataaaatcacacatagtatctctaaattatgacacctatcacaagaaaacatagatgtttcccatctgaagatgcatacctcagaggttactgtttctgattctctagatccttttgttgcctgcaaagagaagttcgcaatttgtttcagatgataaggcaatgaaggatcaatgcactaacaagaaacgacggcggatagctgttagacatgaaattgatgaaagccttacttcttgataactcaagcttcctagaccttcctcagacccgccattgagagatgtcgggtgaggttgagtataaacaacctttaacttcacctcatccaccacattacctgattctttcgtaaactacataggatcactcattaggacacaaagaaagcagccaacataagctacaaatgcaggacacactagaaactagaaagtcggttggttaccatgtctccggtgatatccttcggtgtgagctcttgtgtcactatggcactctgcacaaggaatttgtccttgcattgcatgtccggtggcgcctcccgctgagcttgcattgttactagatttgataatcaattgataactaaattcttagcataaaaggcagtcattcagaataagataatactgacgcaattcatcaaattaccaagaacattggatgtggactggggagccacaatgccgttatttggacggacgcagtacttctttggactagttgtcttaacctggagaaacgatgttgaattaatttagttacttattactgcaatgcatatttcctcggaattagaggccaaaaagattttattaataccttaaacgtgacatattcatctgtcttgtttgttaggtgcagagaacacgagatttgcttctttaattcgactgcatgattaaaaaaaggatgcgaaaggatgaatattctgaacaagacaatattatcatcacatattaaagaattaccaaaatttgcacaaaagaatatgcttaaaacaaaggcaaatcggactatcggtgaagtgaacaatcaatattagctcaaaaaagaaggaaaaattccccctgagaacaaccctgaaatttcttcatacataaatttctcgaatgaggccgcattaaaatacacccggaaatccatcggaaccaccgaatgaactgcaaaactcccttcaaaaaacccccaaaaagaaattctcgggacaagaaaacgcacaggggaagatgagctccgggggatcgatcccgagcagctccctggagtcggagctcatcgccggcgaatactcccgaggatcaaacgggaagcgatccgctccgacgggcgccccagaggcaaggcctccaaagatcgaatcttttttcgcctcctgcatccgactattctccagcaaaatattattcctggagcagaggaggaagcggagcaaaacggggaactcgttggaattttggaacggaagagagagagagagagagagagagagagagagagaggcgctgctgtctggctgcttgcaatgctaatcctgaagggaaacgatgcgacggacggacgacacaacgctgggaatcctccaagtgtgctgtgctgcgcagcttgctgccactagaggcacacggcgaaatgcgcgtcgctctctgggacccaaaaaaaaaatactcctgcaaaaaaacaacataagagaggctttgtgtttctcttctcttcgtcgtcttcgttttctggaggcggcgagaaggaaagggaaaggggagagctgggcttacttatcgttatcgacgctttctggccgtatttttctgctcaatggctgcttagctttgctccgcgatcaagacatgtcaaaggtgtggtagggatgtactcccccgtcccgaaaaaaatgaatctagaactggatgtgacatattatagtacaatgaatttagacagaggtatgctcaaattctaggttggttttttatgagacgatgagtcgacatgtttttgggaatacgcgaggtgcgcatttttattaagaaagaataaatgtatgtacaagacgggccgaacaaattaaaaatgaagaggacagggtacaggaggggggaagaaaaacagaaagcctaatcttctagggaatttggtgacccatctatcaaagaaggaactaccatggccggtatggctgccctagccatccaccaaaggtccgcttcacccgtcatagccctagcgatctccggccaggttctgctttcctggttgaagagccgattgtttctttacttctagattgtccaagctaccagtgtggctatcgtgtcaaaccctcggctatgatccttggtcatcctcttgcggctgtcacacaaccaaacatggaaggactgctcgttgattggaagacattcggaatgtatgtaagcgggtcgacatgtgaatctacttatatatatatcaaataagtgataattaacaggttttcatatcatggtccggcttattatcatacctagaaatataagtgatcgatccataaacttatttatagattaaattagtaggtaatccacgagttaatctacggccactaaattttacttataagtgggtttatgggttggtaacttgatacacttacatccctagctagaattatatggccagtgggaggaatacgatcgctccggacgtactgagagccggatctactcctgttgcaaatctgatgtgaacaactgcaatttagtccggtgaaattgactaagctcctccacaattacttgttttagataggtcatcggtcaatatattgaaactttgagtatgaacataagatgttttttctttcctcgcaatataacatggacatgctttttaagtggatttgtatacctcttttgcgctaataatttggagagcatataactctttcggacaattctagactctagagtgcaatgtatgattgtatctgctcttgtcaagctaacttgggcgtgcagcctgctctttgaaatttaatcggcacgcttggcaggagtaggttctctactgtccttttcagaagagatatggtgcagcgtcagaatcaataacatatgttgcccatccaaacagtaagtgtgtacacaaatcagcgtcagccttttccaagttctccaagtttggtggttccttccaactactacctgtaagtcagacagtccctctaataaggtcctttttgtttcattttaaaattattatactctagattattaagtccaattgctagctataagctgaataataataaactaaattagaataaattgtaagttgtttgtttctctgaattatttgatacatgaattattgggtttgaaatattaatgtctatcatcttcttggctattttggatgcttgttcacttttttatcactgtatataggaaatatataattggtagtggctaaaaaatattgtcatatatatactacagtggcaatataaatttttcttggtagaattttgtgacatcaccattcacggttactcgtattagctattgtcgttgtccatacactgcatacaaattataggagtactcccagttcttttattacacatgaagaatcattgtctaaaacaacccaaatctacaatggcatagagcaccttgaaaacctgtatagcctattttgttttctaattaggatgtaacttttcttgcgaaaactttatagacatgaagttgctataaaatattaaataaatactttttcacttttaaaacttaattaattactacctccatattttaatgtatgacgccgttaactttttgtttaacatttaaccattcatcttattaaaaaaaattatgtaattatcatttattttattgtgacttgattcattatcaaatgttctttaagcatgacataaatatttttatatttgcataaaaattttgaataaactgaatggtcaaaggttggttgaaaagttaacggcatcattcattaaaatacggagggagtataagctaatggtttttctcctattatttgtatcacgatatctctgaataccaggaagtcaagtcaactagccatcgtgacgacaacgacatgccacccataaggagttagtactgtacactatacatatacgaatcgtcgtcctatacaaaatccagttgcgactgtaccagttagttcgggaagaaaaggtaaattataggcggcgttagctcacacgcacggtccaacaatgcgacgcaccagcagtccgtccagcaccccaactccccgcgagtcgtggtccggtccactgcgacggaaataagggaaagaaaacacgtaggtgtggtactatttagtatatacgtcaagacagatcgatccagccacagtgtggtacgtggtggacaggtgctacctgcccgatcgatcgctgggtcttcagtcttctgccgccgttgctcgatcggttagttgagtgagacgtgcacgtacggattggagtgcgtagctagccgtgaagtcgttcggggtgcagtgcaccaaggaggcgcagtacggtgttgcgtgacgactccggccggactgccgcccgcctgcggcctgccggagggctggtgtgatgcggccatggcccgtgggggcgcgttccgtttctccagcgagaccccgtattcgggcccaatggaatatgcatatgggccccttctccgaaggcccgtttagtgtttacaggacgattagaggccaccggtatcgctcttgaggaaaaagtgcaccgaaggtccctcaacttatcatcgagttacaaaatcgtcccccaactgcaaaaccagatatttggcgtcccataactaataaaaaccggtcacaatagctccttcggtggttttgaccctagttttgtcttacgtggcagctgagtcagcgtgggacccacgtggggcccacatgtcagaatgccaggtcatccttctctctcccttcctcctctgtctctcactcttctcatgttctctgggcaaagccggctggcgctggggaggagggcgaggtangagaggaggaggctgcgggcaacacggcagcagcggctcccacatgatagtcccaactcttttctcttctttctgtctcgcaatggccgccagcggaggaggggctgttgctgcctccttcccccttctcttctctccctagatgcaattggcgaatggcagaagaggaacaagacgacgccgaccttcccggccttctccttccttgagctcctcaccgatgcccatgtccacccgcctcctcttcctccacggcgcagctcgcagccgtgctcgcctgagcgtcggctgactatgcgcggcggtggtaatggaaaggaggggctggcaccgaggtggtcgcggaggtggcgcccatgcgggccggcctagccgcgcgcagggtggcactcgcggcgtggtggcggccccaagcaagacgaagaaggctacaatcatggcggcgtgggccgtgaagacg

SEQ ID NO: 54360 - DNA, 5869 bp, Oryza sativa
  unsure (1)..(5869): unsure at all n locations
ccgacgccgtctcgccttgccgccgcccaccccttctcccgtgtctccgccaccgcgtcgcctcgcccccatgcggctatcgcttttcggcgtcggcagcttcgagaactccccctcatctcacctccagctcgtgctccccatgctcctccaccgggacctcctcctcctcccgccagaatcctccgcccatgctgacctcttcgaccccgtcctccgcggttgagcgcaccgccgcgacggcgatgggcttctccgtgccaggcatcaacgacggttgctgccaccaccaactaggcgcatgtgcctccccgtcgcccgcccgcgccgccgtgcttccccactgcggccgtcaccgccggccgccattgcggcaccgccctcctcctctcccgcctcgccccgccgaccggcgccctacaggcacatagagagagagagagaggaggaatcgaggaagagaagaggggagagagaaggatgatgtggcatccttacatgtgggccccacatgggtcccacgctgacttagccgtcacgtaggacaaaatcggggtcaaaaccaccgaaggacctattgggaccgattttgattagttaagggacgccgtatatctgattttgcggttgggggatgattttataactcgataataagttgagggaccttcggtgtactttttcctcgctcttgattacatatggaggacggactgattgattcacaaaaatttataatttgatcctctccgaaaactaatttcacaaatgaatcgcgaccaaaacttatttaaaaatgacccttttgttaagcgtcaaatcgtatgacgctgaacttagacacctcagcatcacgtcaactggcgctgaatgctgtgccaccgcggatgggaggctgagtcggcgtgccaacgtgcattcaacgccgtgctatttgacgctgatatgtctaagtttagcgccatacgatttgacgctaaataaaagggtagttttggccgcggtttatttgcgaaattagtttttacaaaaggtaaaattgtcaaattaaatgctgattgattgatattggccatccggcgcagagccgatgctctcgatggaagtatttcagattttcatcgactgctgaatttcacggtcatctacagtatacattgccgcgcgcagggaatgcaagcagcaaacaggccgtgcccggtgcactatattcacattgcttgtcatatgacgacggccagtgaggcaggcaggcacacggatggcccacgcacgcactcagtcgaggtagttgtgatcagaggagataagggcaagggcaataaaaaagacgactgcttactctaatctttatacacgttatttggaggtaacttaatagataataaatataatagttgtctctttacatttactgcagcacacatatcaataattatttaattacttctctctcgctccttcccagcttttctctttcctccaagccaatcaggaaagattattcatgctaattttttgttccgtcgatggtgctgtcgatagaaaggcttcaaaccagtgctaggtgtattggtgcccgtgcatgatcgtcgacagattaatcgacgatgtttttctcttggtactctctctccaccacgtaggtataaaatccaacgtaagcttactattagccggtaatttcaagttattgtacttgccgtaagaggcaaagctcgcggcatcaccgtatcactagtcacctcatggggtcacacccgagcgtgattcagggccggccgggctctcggtctagcgctccgacactccgcgcagcaataaaagagcagcagcagcagtactgatcctgtgcgatccactccacatcccggttgaccgcggcacgcgcgggcgtacatcgcgtacgggcggctcgcgctagctagctccacacgtcgcgtcggatcggatggagcatcgtcgcgtcggatcggagacagcatatacatgcgcgcgcgcgcgtgcgggcgtgcgcgcggccggccgccggccagcacctctccgcgtctcggcgtctttctgtttctctcgactcttgctttctgggcctatatacgctacggcagggagggtgtgtgcgactgtgcggtacgctcatcttgggtggggagacaaaaaggcacggagaaataggctttgtatatacgcccgggtccgccgaccggccggtccatgcgagagaaaaaaaaaagggagtatctagccgggcggtgatggatcggaggtatgctatctttgcggcagtgttgcttaatggattactttttttaactttgcttgaaatacaataactatacacatatatcattaccggagactgatctttactgggtcatgtgaaaatcatattagtatagacatagtagtacgactttcaagaaataggtggaattggttttctttttgaagaaattaaattaaatctcgtgaaaacttttaaaataatgcattcattcaaaaaaatatatatatgaccgtaccaataaattagagggtatgtgcaaacgattgtccattttaactatttgtgtcctttctatattgaagtagcagcagcacggaggcaaaggcggagggtggaaggggacgattgtttgctttgtaggtcaagcagtctgttcttgaagcaacaacaaacaataaatagaatacacaacattaagatgatcaccgctccaatcgtagtcgtcctctaggttctggtttgcgagcgtgagttgtcacatgcaacatggacgagtcatttagagggttgggaagatggcatcactactaccaccattgatgtgtcaaaatactttcagaggttagtttttgatgtagacgttgtcaaaaatccagccaccatggctaagctgagatctaaccaaaacaacactccattgatttttcgttactttcgaacaaaacaatttaagatgcacattttgagagcgcacccacagtaatcatgatgaaatatcagaagaaatcaagaatactataaaaattagggtgccaagtcaaaccagtatgtgcattgttttatttggtcaataatgaatatatttatggactacgataaaattttgaaagaaatctaatgtaactacaacgtaatataatggtaatgtaattatacgatggacgaaatattggaagtttttctcttgatttttgatcgacgaaaatttagcaaatccttatattgagattgacgaaaattttcatataactaaattataggtcgttatattttaataattcgagctaaggcatgcaagttcaattaatttattttaaaccaatatctttgcgtaccaaggtccaaaatactactccatacattcctttatattttgttgtgtcttcagctagcaatttaaggatgaaactactccatacattcctttatatttatctctgttcgtactcatcatggaccgctaaaaacttttaaatggttagattatgataaatgaaaatttaaattaaatttatgtttagtatgtaatacactttgataagattcatctagttaagtatttagattttttaagaaaaaagataaatgatcaaagtttaaatatgaacaatgcttatattagcgacgacaaatataaaggaacagatatagtaattaaccaatgtcgtggtagtcgattatatatctggcaagggatttttgtaactatcatagacagagtgtaaaagttttttttagttgaaggaatcaaagaagttatattattctctttttgaaattttacaaatttatttgccaaaatcttagcactaagcacttaatctcataacgaatgtatggtgataaaaacccaaaacattttctattgaagaaaagcacatgaaatattaaagaaagcaacgcatgcatgcatgggtttctagaatttatattgctagatgatgttcatgagttcgtaattaagacacgtcttttgggacacaatcaggcaacggaacagcaacttctctacactctacaggtgaatagggagtacgaagatagtcctgaaagaaagaaaggataaaaaaataaagaaggaaaagaaaagagaaaaacagggaaaaaagtctctacgaggaatatggttataagcataaacctaggcactcaacaggattccccatctctcttctacacactcagaagtactctaattaagcaacacacatgatattaagagatgatgatctgatgctaattaaacccttgctatatagctagaatggcgccacacatgagagcgagctagggccaccaccaagaattcggtgcttgcggccgctttgccaaagctcgctagaacggagtgacgcccatgtttgcggctgcagcggcggcggcggctgccgcagcatacaggctatccttgagaagaatgtcttcagaaccatcctgaaaatcacgacacaggaagcggctacagatgaattgctcgcaaagcactaaagtaaataagagcagtgcatatgcagtgtttgccgggtgggtctgaattctgataaggctatatgagtgttcaggttacacagataactaggttatgcttgtgtctcccatagtagtatacgttaattctctcgggattctggttacctgaggcttgaaggtcttcttgaacccctgatccggcatgaggccaaaatggatgtgagggaaatgggcccactgattgcaagcacaaggaaagtaaagccaaagcaaaggcaggtttggatcagtaaaggagatcgaaacaaatccgaacgaaccctagctatagcagctgtggggctaaaagctcccagaaaccacagccgcttgctctcggcatctcgcaagcggccgggcacaagctgccgctgtgtccgtgctgacaatgtaaggtgtccagtcaaatcaagacacgcgaacagctagcatcaagctagatactacaggatgagtaggagttcattaatgcgcggatcagacgaagaaagtttacattctttgcggctgcactgaacgcctcccggtggctgatgtccgggttgccggccttgatccgctggatctcatccctgtgtagcaattcattataagcagaattaattttttttacgagatgataccacgaatactgattaaccaaagctcaaaggaggatccatcagttttaattaggcagaaggtttatagagaaatcttacttgatgaaccggttgtacgcagatgggactctctgacgcttctccggagctgcaaaagttttggatcagacagcatccgaggaaacatggacaaatgggtaagctcacctaagctatcagtatacatgctgtctgcaaatactgaccggatcgatcgaagcatgggcttacatggccctgccacaacaagacatgatcgcatgccttgttgatctgtactatcatttctagtgctgaggagcgttcttcaagtgaatatagtacatattaatttcacacactcgaaagaaacactggattgaaatttgaaattcaacacgtacactagtacgctaatgtgtgcatatatgcctaagtaggagctataagtagctaattaacccctcttagcaagctttctgttcttaaacctcccaaacaacggtgaataagcaacaagctagcaggagaacacactgtggtgcataagtacctttgactacaaaattctagcgtttcaaagaaagaacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54361 - DNA, 715 bp, Oryza sativa
acccatgcattcagaaccccatagtccgcacatcctcaaatacaaagcacttccctagttagatgtaggttagacttgccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatataatccgtcaaatcctgcgggaaattgtaatcccattcaccagctcctacatttaattaacaagagaactattgtatttatctaacacctggattatctccacctttcatttgatccctatttat

SEQ ID NO: 54362 - DNA, 914 bp, Oryza sativa
tcgaacaaggttttgccttagctcgaaaacacgacataaaaaaaagctcgaaagtatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaaaaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaaaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaagaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaagaagctcgaaagcatttacccaaattcgagctcgaaaactaaaaagtaattgcgacgagggaaacacgttcgacctcgtcactcctttgaaacgtaagggggacggcggttttcgaacaaggttttgccttagctcgaaaacacgacataaaaagaagctcgaaagcatttacccaaattcgagctcgaaaactaaaaagtaattgcgacgagggaaacacgttcgacctcgtcactcctttgaaacgtaaggggga

SEQ ID NO: 54363 - DNA, 17623 bp, Oryza sativa
tgcaagtagctcatcaaagcttgagctgaattataagaggctctatcgtactatattgtatactagaataggaagagagtagagtagaagaagtcgaatgaattccggagttgtcggtaatcttctctcatttcttttattttgtttattactctatttcaatataatattcttcctgagtaatttagatttatcttgtgagaattatctcttggttagttcctaaatagcatacgggattattgttcactataatcaactaaaatatagtgattgctttggtgagttataaacactaaagtagatattaattacttagacgtggtgtttaggtaattgttatccagtaattgctgcgtatcccacagtacgtttaaggtaggtgtagaggtggtgacagccatcgagatcacttaagtcctccctgtccgagtacgtagtagagcaatatctgggaacaacaggttgtcaatgcctgaagtattgcgttaggattaaacttaagctttcactagacactatttctcaccagtaaatcatctatatcctaggctatcctttgcttggtgtccttggatgaaccggaggaaaatctgaccacacacgttcccttggattcgataccctttggaatactccgtagggaagtgctacatcggtatatctgtgcgcttgcggattttatctgcgaccgtaagaattaccaacagtgggattctagaggcatttcataaaggatttctccaaaattgctagacccctaattgccttgctagctaaggatgttgttggtatttcttaacgacattactagaaatataattcccagcaatggcgcagaaatacttatggtatattatggttacagagttcatccgcaagcgcacggatataccattatagcatttcacccgagagtattccaagggtatcgtatttattttatcccgtggaaagatcatgtagagagaactcaactaataatttatatattacttgtgacaatcatattctaagcatgggttaagataatccaagggtagagtgacacataagcattaactactcatcctcataatatatcatctaagctaagtggaaagaaaagagaaaggaaatctattcctatatttctagtatacatagtatacatacattctagctaactgatatactagctaataccctctatccgatgccctcctggtacttcgagaagccaccctgactgccgagttccttacgacagcccgtcatgaccatacaaccggggctaaatacggaggaataccctccctaggaaattaacttaggattatatataggcgcggaggaatacccatactgagctgtcaccatcagcggcccacctctcgaccgcaatatataaccccaaataatgatatcacgtaatctagacaccacgtctaaactaccagatactactctaatatcatcgtcatgacatagagtaattgcataagcaaacactatacccgcaccaaagcatctcccagataagctagccgtatattcagtataacatgaacataatataaagtaggtacttatatactcggaaagtatttcaataccataaatgtatatagaagagtattctaataaaagtacaaggcttacaaaagaggaaaggaaagctgctagagccatacccgaactcttccgaagacttctggactcctgattcctattctaattctattccaccagctagatactactaaactaaacttgagagaaatgagagatctcttgcttgaggtgtgttgaagtgaagagagtgagctccttatatagaggtagttatgacggttgtggaaggggaattgtccgaagtgcccttcaaccgtcattgggatgcaatcctggacgtccatgccaaaacctggatccaatggcgctaggattggttcagccgaacctggggatggcccaatccagcccaatttcagctggtggcctcctctattgctcccctccgcagaccaattctaagttcttggcctattcacacacaagtctggttctcgacatcgtccgattgatttatcgtctgaattgatgtcgattctcctctattttatgatcattctctgcaaaaggttagtatacctaatactagtggaatattattattctaacaaatatatgtattgctagcatcactaattctcccctattttggtaatattgatggtcgaaactgatcgataacgaccgtcaacagatgccccgtttgactttgatgatgagtgtctaaaatcatttaaaatctttaaggaatcactcatctcagcactaatcatctgaccccctgattggtcgccgccatttgaaatcatgtgcgatcctagtgattttgcagtgggtactgtccttgggcaaactaaggataggaaacacaaagctatcgcatatgctagtaaaactttgactggagctcagcttaattatgccacaacttaaaaagagctcctagccgtagtgtttgccattgataagttcatgtcatatttagtgggagctaaggtaatagtttacattgaccatgctgcactaaaatacctgctcactaaaaaaatatgcttctactccaaaaattaggagctaccgataaatgactatctgcgtgacggcatgctgttgaaagtcacagactctgacccgtggtatgcaaccatcgtcaacttcatggtcgcgtgccatgtaccaccaggagaaaataagaagagggtgatctacgagagccgcatgcacttgtgggatttaccttacctttacagagtctgttcagacgttctactacggagatgcgttccagtagccgaaggcataaagatcactgagaagtgtcatgttgccccatatggagatcactatggagcattcaagacacacgcaaagatctggcagagtggattcttttggccaacaatgtatgatgcaaaggaattcattcggagatgcacaaggtgccagaagcatggagggatcactgctcgggatgcgatgccactaacatataaccttcaagtcgagctatttgatgtattgggcatcgacttcatgcgacctttcccaaagtcctttgagtgcgaatataacctggtggccgttgactatgtgtccaagtgggtagaggcaataccatgcaaggccgctgacgccaagcacgcccgctggatgttccacgagattaccttccctcattttggaactccgcggatggtgataagtgacggagggtctcatttcatcgataagaccttctaaagctttttgcaagagcttggggctcaatacatcattgccactccattatcattcccaaacaagtggacagacagaaacgagcaacaaacaaatcaagaatattctgtagaagacggtcaacgagatggggaaggcatggaagaacaagttacctgatgcactttgggcatataggactgcttgtaagacacccatcggtatgtcaccgtaccaacttgtctacgggaattctaatatatattaaattctaatatatattttttcagcccaaaagaagtttaatgtaattcctataataatattaggtgcaattatgaagtaggaacacatatacaaagaaaggttattctaattctttaaaataatctatgcaagatgaaatcatggaaaaatttatgtaaactatgtttagcataagcaattcactataatattggtacaagttaataactaagtttaataccacaaattaatcagtcaaagcagaaaactaaaagaaatcaaattaaattttaatcggctaaagccatacttcatccaaaaagtacatttaactgcacataagtgaacatggaaaataatttattcaaatactagattatttatcatgcctaaatataatttttctagaattttcctcctctgtttaggcttcctaaaaattcaatctacctttctaatagcccatctttgtttaatttctgtgagcagtctacccattatttttgagtgaaaccaaagaaaatggaatctaggttaatcatttacctccagaaaaatcaacactaattaatttgttccacacattaagttatgaatctacaaagttaggggaaagaaaataatctaaaaattcgtctaaaaccgtgttcacctagaatcttacccacacctctctcttccacctagagcacttcgtcctgggcccacttggcagcctctccagctcgccctttctctgtgcctcaccctcagccgaccaagaacacagagagggagagatcgagcgaaccgacgcgtggccacaacgtgtcgacgacctcgggctttccttttctcgctctcttctcctccagtctgagtcgccattcctcactcatcactcagagccgaagaagccgaggggagcaggtcctctgcctctccgtcaccagcgacctcaccactggccatggaggtgacgaccatcgccatctccgtttgagtcaaggtcacatctatctctttcgcgtttccatctcttcacacaatgccgaacctcttctctgttgaccacctcccattttgtgcatcacagccaccggaatgtgaccacgccaacgatgccctagagcacgcaccggagcgccgccgcttcgacatcgttgtcgtccggccattctcgtccatcccgaagcaagccgttgtgccaagaatctcgcgtcgaccacctcttcaagacgcctcaagaaacatcaagaacacggagaacacatccttttcttcctcgacgccgatccgaactcgcctccgcagtcatcgtcgattaccactgcctcagtgagccattgttcgatttctcgcgcatacaccatctccttgacctcacaaccctcgtgcatgccttcctttagcagctcgtcgtcccgttcgagccgtcgccgttcacccgaggaggagcaccgccgttgaaccgttccaaccgaagccgctgctatccaagcttcggcgatttcttcctacagcttggtgagcctcctgacctcttaggaaacacatgcatggatgcatctagcaaaatcaaagcccctaggcaacatgcagtaacagctcatgtataccttccgctcaccctcaccatcggcgctactccgatgtctcctagccacgaaaactagaggaatggaatcgtgagagcattctcttcattttatcttttgacctcattcccaatcgagccaccaatcgtcgccgacgagctcgccaaagccatggccaagctcccagtccatcgggctgctggaggttgaagatgaggactttgtcctgtaaatgatcaaaaaaatagggttcaaactataaaacttcagagatttacatgtggacccacggacctaaatgcagttcatataaagcctagggatctttttgtatattggttcagccaccgatcagtggacccatgtgtataaaaatctgaaaatgcaaaggaaaaataactaaaacattaaatgtttaacaggaaaacacccaaacttgtaaaatccatataaaatcaaatgtaactcattttgagatgattccagttgctgtagattcttaaagttatgaactctattttagaaatataaaacttgacactcactgtacaaaactacaaataatgtctctaaaatttatctaagataggtcatacataaaacatgtacaaacttataaaatacatagaaaattcatctcaactcattttgaaacaaaatcaaattctacagattcatcatcatgcactctctgattaggtgaaataaaagtaattacttactttgcatcaaatgcctctaaaactattatctctagaatgattagtttatataagctaaactttagaaattcatgtagaacccaatttagcttaaatttgagtaaacttaagttctataggatcacaaaaacatgtatttccatgttatgaaataagattatatacttactgtgtagtaaaagtctctaaatattcatataaggatttactaacatagagcagcctttaatttgtaaaacttgtagaaaattcatttttagtccaaatgaaatgaacaaagtttctatagaaccagcaaatagttagcttcaacatagtaaaataaaatttggcaccttttgtagagaacatagatcaaaaccttaatctagtgaaataagaatttaaacacagtgttgtttaagtaatacataaacatgtataagtatatatacactttaggtctaattaaacctaaataaaaacttgattgaccagtgaagccatagttccatcctcatccactaaaacttagaagaacttagttcatataacaatttctaggttaatataatatattgttagtttagattagagcatctctagtttataaaatatgaaccatagtagtaaagaccataaacatgtgaactaaaaatgttttagttaaccaaactacttcttttgctcaacttaaacatactgtagcatattgtagcatattctgaacctacaactaaaaagtcatgaacatatgaaacactatatgcctaaaacacgttgtaacttgtaaaatctataagaaaatcattataactccaaaaattgtgaaaccaaatgagttattcttataaaacacacctctacaccctgtgaagtctaatataataaaaatcactttacaaaagtattttataacactacctaagactatactactataaaccgataaaacttctaaaatttataactccctaatggaacaagataaaataaaaattctttcacctaaattcattttagaccagtacctaatcactgtgcataaatcatgcattttagagcattttagattttcagctctttcggtgtttaattgcataacgtgtcctttatctagataactagacgaaacccagcgtattgctgcggaaaactaaggataatccatagaaatagcaagcaaagatatatcccacaatcaatatagtattttgtcaattcatgcaaagaatgggccaatgtatgtacaatgaacaaatttgagcgggcactgactggatccatgggatagaggaatgagtggataaaatttcctccctaaaacaccatgggatcatccaagatttctaagggtgtatttgcactgacaataagtaaatgcatgtgcgtccggtttataaaagttaaagcctacgaaaaccttttaatatcttttttgatttatgacaggttctataacagaacttgggcaaaaagtatatcaaatagcaatcaaaagaatggaatgtatcaggacatatataatacccatattaacctgattataagcataagtgaaaatatatgcatgatgataacttttgtaacaacgtcgtcagatatctgtaggctcgtaaacttaacttgtttaaatcctgtgtaacataaatctgatagagataataacaaaaaagataaccactattctgtactaactctataaagaattggagtaaacacaaattctggagtataaggagaggcaaacccatatccagatcagcacgaacagggcagttgcaacaatccagcgaccaagcagtaaacaacacagggcgaatgcagaagctaaaaattattgcagaaatgctgaaattttttggtatacatacctcagtttttcaatacgcttgaatgacgcctagtagagttcagaaattaactcaattttcaatattgtcatgtggatgaatgggaactaaatggatttcttgacactgtcatcaaattggatgtgaataaagtagcgcgtagtgttaaaaataaagcaatagccctgtaaaacaattttagtcaaagaaaaccacttatcatcaggactaaaaataaaaatggataatgaattagattaacccatgatgcttaagagcagggagaacctacgctgcgtagtgtttgaacagtagtatacagctcctatactgcaatggcaacagtaagatcagtagtagcatcgtctcctcttactggagtagttgtagcagcagcagcaatattagcgtggtttctggatgaggttacggaggtcaagaacatagtgcatcatacctgtagggaggatcggaccatagtgattccaccagcttccgccccgcttggttggtataaccaataggctctggcgcttctccattggtgtccagtgcggatgatcaccctgctggcattggggatgaatcgagagtcctgaaagtttacgacggagtgtggtttttagaggaactgaaagagggaaataaatggaattaatcgcaactaatggaccactcattgttggtgaccgttcctggtgataaatgctcttgctcctagagggagatgatgggtagctcaacagccgatcagaaggtgaatagatcaactctggctattgaagtcggagatcaacatggagagcgcacatctgatatcggatggttaggactaaaagagatgacgtggtttactcacaaagcagcaaattagctagtggggatgactcctataggtatataggattgcataatcggtgaaggagtggattaggtgctaacatttctctgatcaaggcaagttttctcctcccatcctttgaacacattgaatcccatgatttgaggaatgaaaatatttgtttgtaaagttgcatgtgaacttagactatatcggtatttaaaattgggttaaggtagttgtgacatatttgctgcataccccaccttgaataattgatcctcttgctgtttgaacccctagaaatggttagagtacactctttgtgctcaaatgggtttatatatgctctatgtgcaactacttgcttagccatgcttagaaatatgcaaatgctcattccatctataattaaaatgtggttttgatacttgaacctttgctggaataaaatgaatatgatgggtatttgcgaattaaaatgtgtaaaatgtgattttatacttgggcggcaagtggtgtgcatatggtgttagttgcataccgataggggggagtgtttgcccaagtccataaggaccgaacttgtgtcacccatttaaagttattcgtacatccacatgtgctagtatgggatggcctaagctgattaatctatttaggactagccttgcattctgttaggccggtatgtatgagttagtcgataattctgaggaattagtcgatgattcagaggaacttcctatttgcgccgacgtggtagtttaggtgactaagtctgtccaatacaacggtattgtgccacgtgggtgggttctcgttgtgtccgccaccacggcgttaagtttaaggcgtgggcccgccacttaacggttctaggcatattccaagtatgcctaggatggaggaacacgtatcgtgctagtgcaaggctaggctctaagtagtgtaaaggctacgttatgacctctagatcacattcaacatgaagagtgtggtggagtcttgcaaactcaaaacaaactagagcgttcatatcatgtgggtaaagctgtacaaactttgcagagttctttaaactaatcgattagccgtgctcacggtcatgagcgctttggtgatgtgtcatgagtatagactttatgttttaaaatgtgatcatgtgacattggtttgaaattgataaatgtgttaagttgtgtgtgtgaggtgatatattatgacttgttgtcaaaggatgacaacaagagattgattatgatggaattatgatgaacttaatattgaaacttaaaatttgttttgttaattgaagcatcaactcctttacaaaagaattgcgaaacaaaacttgctttatgctgaaattgaagtacatattgcctttctttgaatatatgccttacatgtagtatggtaggattgacttgtgcttgccagtacattaacttgtttaatgtactgactcttgctgttgatataacattttgtttgcaggtttagatttagtcttttgagtgatgtgggttccgattgcttcttctaggatgagaacttaatggggtaaacccctagtcggtgtgcttgtgattgggtagtcaagcttccgctgttctctaatatgtctatttggccggtcggcctatgtagttattaagttgttgtaagtcttaagtttctttaatcttagttgtgtttgctatgtataatcatgcttaagatgaaagtgtggatctagtgcacatcctgggaactagattcacatgagtatgagttaggaatatttgagaggttgtagatctttagccatttttgtcaagtctcctgaatgtgtaacacatctggtcaccaccttcgagtggtttgatgggcacatctcaggctgaagttgactggcaggctaagggctcagcaatgtctccaatattcctctctcgaggcgtcggatgtttcattatgcttgtttgatgacttaaattattcacttcatctctcaaatataatggaaggtccgaagtgcctacgacaacgcactaggctatccggacttggaacatggacctaaagggagacggacatcacaggaagatgcagctctctgagctggaggaatggagggacaaggcctatcacaatgccaagatctgtatggacagaaccaaaagatggcatgatagacagatcaagcacaaggagttcaaagcaggggataaggtgctgctgttcaactcacgggtgaagctattcggacatggaaaacttcgaaataaatggatgggcccatatatcgccgtcgacacttcatcacatggagccgtcatacaataaaagtaatatctttaagataaatggctatcattaaaaagtttttcttgatccgttagaagttgatcgtgttagacgtagtgaatttagtcgcttctagcttctacccggagtccttaggcccccctgatccgttagttttcaatgccctgagtccttaggtccccctcttgttatcttaggtctaggttctaataggtgcacttaggtctaggttgtttagcttatttttatttcatttcattcttgtaatgtgcctatcattgacgaccgtatttgccggccgaaagaccattatgcacttgtacaactaaaatggtataagaaattcataaaatcaaacttttaaaggttgtaaaagaatgttctcgaaacttttcaattagtcgagggggcatatttagaggaggtttagatttcgagaagagctggttggaatccaactagtgaaaatctagaaaagctgggaaaaccactttctgtcttctagttcattttcaagattccgcaactacaactttatagaatctacaaaaaggtggatattttaggggagctttcaattctaggagaaactgtagctattagaaccttccctaaacatgttttagaatgtttctacatgtagctcaaatgaaatattgaaatgaaaaaaaatattttatgactcacaaaattagaaaaaaaatacaaaatatccttgtgtatattgactcgacataaattattttgtgaaacatttaaggattaaatcattcccacgatgcaatttagaaaaaccacacataattcacttattttatgttcccaggaaaagttaatatctttaaatgaaaattgcttccttcatattatgtggcatttgttaaaaaaagtgttatttcattacaaaacatatgctagggcataaatggtccttacaagcaaacttaatggtcaattgtattgtggtatcattggaattaagatgtttattgtaccgtttgttagttgacggataacaatatcatctctgttctttcttttcctccacaccttaaaaaatgttaaatgacatcttatcaatagacaacacctcctatggccatatgaagtgttgtcgcttcttgatatggttacaagtgatatttgctatccaaattgaaagggagcataatttgaggatcatagatctcgcctagatggagatgaataggtgtttcctgcaattacaaacacttgcagcgaaaattagtattgaccggttaatcaggtatcattgcggataatctaacaatacacagtgtcagaaaatctaatcacaactagacagtgcaaccaaacacagagaatataggaattcgcctatgcacaatatagacccgtacaatccaactaagagtggacaaccttggccttataaagagagtgaaaaccgtagggagatggagcactttgcacactagatatgagcaagaccaagaggcatcaacaagagataagcatgcaacaatatgatcaccaaatagctcaacaagaaagcggtaagtgcagagtaatgagagataggagacattgcagttcaagtcagtcgatcctacgtctccgttgagggccccgaaaggccaagtctctcttaaccaactgcaaccaatcatgcattggtctcttaaagcaaccaccaagagcaagctcatgctccaagcgacccccaccggtccaagctcgaatgtcacacaactttcgttcgacaaggcgaagctcgatttccactatttaccttttctcttcttgaggtaaggtgtcaaccttcgcaatcttctcccaaatacacaccacaccctcacgagattctctttctcctcttacaattaagagtggcaatttccccgttggatctgggtccccgcagggggctgccacaacgagggtgtggacggatgcagattttctcccacgggtctgtcgggcggggccctgactttagacatgggcgggggtcacgcccggaaatatacaccatttccaaacgctcagtgcattaatcctcgtcccaggaggcgaggtacacatagacatttttgattattacaagccacacttgcagaaacgtaaaggaaatactccatctatctacttttgatagttatatttcatcttgacacacagaccaaggataaataattctacttattatccatttaaacatgctactagttattcctcgtaaacaagcaattcattaatatttacatttctcgatgcccatgcagccaatcttatgtggaagaatggaaagtcacgtattaaatccgagaaagtcattaagagggtaggttgttggattaaaatatgcctatcaaaaataaattttttagatttggaaatatgcctatcaaaagtagatggagggagtactttattacatgggcgactctaggccctcacactcaaagataaacaaataaaacagcagaagactacggaacagcagcagccacaagcactcgacaacggagcgaactagagatccaagccttcatcttcttcaggtccatcctctggattatttttgtgagcaagagtgagtaccaccaccgtacttagcaagtcacaccggaaatgcaacaataatgcatagggaaatcaaggaaatggcctaatagggtttattttgcataaaaccatagtttaaacattttaatcaggttaaagctcattttaaaacacgatcctgttctaagccaatattttaatcaccaaggtcgcatgagcctgcgaacctgccttagcccaggctaatctccacatgactacaccatcatgatttcaccctcccaaggttttataaaacaaaactaacttttggtacattactcagcttgcccataaccgagggcgcggctattcgaatagtttttaactctaatcagaggtgtacaactttacccacaagacacaacctcaacacgcgttgccacgcgccgggtaccaccacggtactcggataaaggtcgtgacaagactatccatctaggtctacccaaaacatgagaacccgctgaggtttcaccgcccgctggtccctgacaaggtaaaggttgccggatcttacagagaatcaacaatgtccaccccccttacagagaatcttgttctcgagattcgaagacgcttccgatgaggtgaggatgggtggacttcagttcgtcttctctttcccatgttgcttcctcttctaaataattgctccattgaaccttacaaaaacggatcactcggcttcgggtatgtctttcagatgtttctaagatccttataggcttctccacataagtcaggtcttcctgaatctcaatctgttctggatctgcttgctctatcgggactcggaggcatttcttgagttgtgacacgtggaatacttcatgaactcctcccagagatgccagtagttccaattgataagcaactttccctcttctaccaagaactttgtaaggtcccacaaaacatggtgccaactttcccttggtgtggaaacgacgaactccatgaagcggtgtaactctgagatacacaaagtctccttcttcaaaggctaactcccttcgacgcgtatctgcgtagcttttctgtcgggactgggcaactttcaggttcgcttggataaccttgaccttctcctctgcttcttttagaatgtcagtcccaaaaacttgacgttctccggtctggtcccaaaggagtggagttcgacattttcggccatagagagcttcaaaaggtgccatttgaagactggcttggtagctattgttgtacgaaaattcagcatatgggagactcttatcccaacttttgccaaagtccagggcacatgccctgagcatatcctcaagaatctgattaactcgctctgtctggccgtccgtttgagggtgataagcagtgctgaagttcaaacgagttcccatttcttcctgcaatttctaccagaacttagaagtgaattggctgccccgatcggaaacgattctctttggtaccccatgaagacaaactatcctggcaaagtataattcggccaacttactaccaggataagtggttttgactactatgaaatgtgcaactttggttaggcggtcgataacaacccaaatagagtcatatccagattgggtccttggaagaccggtgatgaaatccatcccaatctcttcccacttccattttgggatcttgagtggttgtagcaatccggttggcctttggtgttgggctttaacccgttgacataaatcacagagtgtcacaaactctgctacttcacgtttcatactgacccactaatatttcattttcaagtcttgatacatctttgtactgccggggtgtattgagtattgactctcgtgagcctcttgcagaataagcttcttgatctcaggatcattgggaacacaaacacgtccgccgtaccagatggtcccatgttcatcttcagaaaacccaattgcttttcccctcatcatattcttcttgatctcttggataccataatcacctttttgtgcttctcagatatggtaaagcagtgatggtttcgcccctacggtcactatttagccataactaactattcccaaattcaaggcctctagctctcagcacaatccaggaggacactgttcatagatgatagcattgcagtaactcttccgactcaaagcatcaaccacaacgttaactttccccggatgatagtggattcccacatcgtagtctttaatgagctctaaccatcttctctgacggagatttagatctggttgagtgaatatatacttcaaacttttatggcccgtatatatctcacaacggttaccgataagatagtgccgccagatctttaaagcatgcaccacggcagctagttccaagtcgtgcgttgggtagttactctcatgaggatgaagttggcgggaagcataggctaccacttgtccgtcttgcattaagacacaccctagtccttgtttagaggcatcacaatacacctggaaatccttgtggatatttcgcaataccagcactggggcagatactagcttctttttgagcaattgaaatgcctcttcacactgcgaggtctatatgaatttcacttctttctttagtagctgagtcattggccttgttattcttgagaagttttcgatgaacctgcgataatagcctgcaagtccaaggaaactgcgaacttgggtcactgatttgggttgattccaattggtcactaattcgacgttagttggatccactgccactccttgagctgaaattacgtgtccaagaaatttcacttctgaaagccaaaattcacatttattgaacttgcatacaattgatgttctctaagcttctctagcgctaggcgaaggtgttgctcatgctcttctgctgtcttggaatagatcaagatgtcatcgatgaagaccatgacaaacctgtctaaatattccatgaacactttattcatcagattcataaagaagactggtgcattcgtcagtccgaacgacataaccttgcattcatataacccatatctggtcgtgaatgccgttttagggatgtcttcctctcggatccttagctgatggtagccggatcgaagatcaatcttcgagaacacggttgctcctttcaattgatcaaagaggtcatctatcctcggaagaggatatttattcttgatggtgacctcgttgagtgcacggtaatccacacacattctcttagttttgtccttcttttccacgaagataactggagctccccagggtgaagtgcttggtcggatgtggcctttttctttgagttcttccaactgctttttaacttcagctagctctttggcagccatgtggtacggtctcttggagattggcgctgtctcgggcactaagtcattcgaaactcgatgtccctcttgggcggcatgcctggtagttcctccggaaaaacatctagatactctttcacgatgggtgatgaggacataactagctcggatataaccattgaaagtgcattgatccccctagtgggttttggtgattaatgacaaatgtggttaagggactaatgagttcattgagttactttcaggtgcattagcccaaggtgtggaagatggatgcttggagacccccccaaaagtataaaatcaaagcggaccggaactcgagaagtgcatgggatagtttatttattgcaatcgagtttttaggaaaaaccgtactattaagaggggctccaggtgatgctctgagatatgtcaagtactcttagtgtgaaccaagtgtcaagtttccctaggagttatttttacaaatactccatctgtccaaaaatgcaagtccggaacttcctgtcttctaggtccggaagttccagtttggtgaaaaagattttcctaagtgtagtctagaagttcctgtcttctaggtctggaacttcctgtctagtttccagttcaaattgtgagtaacggttagatgacgtcacctcatccagtccgaatctgattttgagttttgggccttgtaattgtgtcgtgggcttagcccaaaggggtgtgcgccctagggcaaccctaggatgtccccaatcacttttattcaatagccgtcatcgtttagagtcgggttttgcttagattattctgttgagaacagtttcgctgctagatcggtttgtggaaccctaaattcgtgtgcttaatcattcatatgcaatttgcttgcaatctatcttgtt

SEQ ID NO: 54364 - DNA, 1980 bp, Oryza sativa
cgattgcggggctcagtagcgtgttcgttcagaagccggattaagttgtaacaggaccatgcattagggttcatatacttctggtcagcaccgctttgatccttgcaatcgccacatcacgtccttcaaggtgtcacgaaccagccaccggttggaccgtccttagcattgctggtaagacacttgtaagagcttggtaagatgctccattgggctgagttgttgaggggcaccactacaccgcgtagcagattattagggataaccttcattgtttgttttttttgtgtttgcaatgacaggtatgagtggcactcgaaatcagcgataccaacaagatgcacgtaatgacagtactttggtgtaacaagtgctaagctctcaaatggagaaagcagagcaatggcagtaccacgaattatttgaaacaaagtttatggttaaggatagagcatgtcgtactataatcgatagtgagagttgcaataacatggtgagttcagatttggttgagaaacttgagttgcctacacaaccgcatcctcatccatattacatcaaatggttcaactcttgtggtaagtttaaggtaaatagaattgtgaagctaaacttttcgattagaaattaccatgatactgccaattttgatcttgtccctatgcaagcatgttctttgttgtttggtcaaccatgggtatatgataataatggatcgcataattttgttgctaatacatacacatttagacataatggtcggaaaatgaaattggtacccatgagttttattgaaattttcgaagataatcttgaaaggatgaagaatggaatcgaggaaaatttcaaagatagtattgaaaggacgaaaaatagaatcgatgagattttcagagataccaggaaagatactatctttgaaagataccagggctcagtagcgtgttcgttcagaagccggatcgagttgtatcgcgactccgcccaaatcgactgtttgtcaatacctatcggaagatcgggacctacattcctcatcagtttcagaagaatatatatggagcttgggaggcacaatatatagtagcaaaggaacgtaattgtactaatcagaaaatgcaaagttgaataatagttcaaagtattagtcaatgtgctggcctagtctagactcaactctagctcaagcaagcacccgacaacactaaggactagatatgaatcaatgcacaactctgcactctgaaaacatactccaaggatgaatggtttttctttcttggtgtggcttttttaagcacctttctgccttttttttcttttttttgtgcggctttttctttcttttttttctttgcacctttccgcccttttctttctttatttatttttttactttttattcaacaagaaccgaccactgacctcgaacatggactcaaaatataaatatcaatattacagggactcaaatgtaaaatgcaaaactaaaattagatcatcttaaaaatggaatgctcacatcatgtaggttccgtttttataaaaatatctcaaatccactacttaacaattctagacagagaaaaatatagatagtcacagatagatctgatctgatccctcccctcaggcgcacagtactcccctcacgcgcgcgcacagtggtacaggagctctagaaatcgagtaactcccaaaccgttggataaaaatttctccaaaatacaaaaacggaaacccgacgacgaaacgattcaatttttcaaggtcccggcaagaaccgacaagatgcaaaactggacctaaaattgacgtacaactcacacgtgataaatcctagacccaaagtgatgaacagatgcaatactcaaaactaaaaattaaatctaaaactaaaccagcactcaacatgacgatgcaatctagaattcaacaaagcaaaatctaatagaacaatgcaacggctcaaattgtcta

SEQ ID NO: 54365 - DNA, 15785 bp, Oryza sativa
tgattaagcacacgaatttgagattccacaaaccgatctagcggcgaaactgttctcaacagaataatctaagacgatgatggctactgaataaatgtgattagagacgtcctagggttgccctagggagcacacccctttggcctaagcccacgacacaattacaaggcccaaaactcaaaatcagattcggactggatgaggtgcgtggcttgttttgcagattcccggcaactcggtaggagttttgacgtgggaccaaaaccatctgaaagtagacttcataagctttccaagaagtacttatgggccccgaaattccttctagatcagtgagtaggtccgtttgaagttgatgctgtcaggaggcccgaatccgaatccaaaacgtgtagaactttatctcttgtcttctatggaccaaaagtgacgtggtgatatgaaagaagacttaaagaaggtcttggtttggtccccaatcaacttcttcaatcatccatgtattccttacgctcggtctcttttctttcgcccaagcaagtacctctgcaaacaaaaacacacaaaactcattgtgtcgcaacgtttgttgaaatatataacaagtaaatctaatatagaacataagcacctttatttgattaatacataaggtagtcatggttatatccgagctagttatgtcctcatcaatgggtatttcatccatactgacgtggttcagaacttgcttacaaggaaatacaggcttggcatggaaagtgactcgctggccagtacccctagtcatagatgtggatcagctggcacaatctataataccactgtgcttggtcaaccagttcatgccaagaatgacatccagattcttagagcttagaaggatgagattagccagaaaagtgactccttggatctcaatggttaccaatgggctaaagagcttagcaggtagttggcttcctggggttgatactatcataggtttgctaagatcttctacccttatttggtgttttgccacaaaatctcttgatataaaggaatgcgtagctcctgaattaaaaagtacacatgcatgaacagaattaatcaggaacgtaccaagtatgacttctggcgcagcctgtgcctcctcagccgagacatgattcacacgtcccctcaccaggttgttgttgttgcagttgccattgttgttctagttggcattgcatgcagatgcaggagcttgcggacgctttggctttgggcacttgtcggcgaagtgtccaggctcatagctgttgtagcacacaagtatcttcccagagctatctctgcgtgtcgatccaacctgggcaggggcagaacgctgattgttgttccatcctgagttctgcagcttgttgttcatctgtggacggggtgcacgctgtgctaccgatgaagaaccaacttgagggggaaacgcataacgtggtttctgacttggtccttgaaacatcctagcattggccaacttacgcttcttgctttcaatctttcggtgcttgtcctcctggcggatcgccttgtcgactagcatttggaaatcttcgcagtcaccagagatgagctggactaacaactcgtcattcaacccttcaagaaatttctcctgctactcttcattggtgcgaacgtcctcaggagcatatcgagccaacatgttgaagtcgtgcaaaaattcagttacggtcctgccatcttgcttgagttcacgaaattctttctttttctgtgctacaactccaacaggtacgtgagctctacgaaaagcagtagagaaacgagcccaagtaataacttgtccaactggctgggtggcctggaagtggtcccaccactcggaagcaggtccatgcagttggtgagcggcgaaagcgactttctcctcatcagtacactggatgaggtccaacttcttattgaccgcgtgcaaccagtcatttgcttcgacagggttggttgtgcttgaaaaactaggaggtcggactcggaggaattccgacagctttgactgcggtggagcgtgtacgtgagcttgagcagcgggtgcttgcgggttttgcatttggtggagcaaagctgcgatgaattggttttggttggcgagcacttgtgctaagttggggtgatcatggattggcggaggtggcggcggtggtggtggaggggcgtggccttggtcctaattctggttctggttctgattctgattctgagctgaattcctagcacgagcattgttagcagcagtactccttgtgttcaccatctgtagtaaccaagataagagggaaaagaagaagggagagatcaggacaagaacacgagctattaaaccaacttatttaaattttattaatgtgatgttggttacatagagttcaagttgcttaagcaccacaaaggtatagctatatcacaacgggccgatatagtccataccaaaaagcacacaaggcaacaaactccagcagaagataaacgataaaaacatacgcgcactaagacttcgcgtctactcttgagaacgactcctagaggggctacggtccacaaatggctcatccacgttgctgatgccgtggcgaggacaggcgcttgatccaacaggtggtagggtcttgacgacggttccaggcatcccactcttcaagtccttcagctccttgcgtagagcgcgaagctcattctccttgtcacgattcttctgaagcactgcctcgaacatcctctccgtcatcctgtagtagaccatacggtacttgtccatcgcggccatcatcttggacatgtgcacaatggtggtgtccccttcattgcgggcatcgcggaagtcagcatcttctgcgaaacccaagcgagcagggtggtagtggaacagagtggtcttcaactggtcggagtgactctggcaaagggccccaatggcatggaatgcagcttcttggcaggcagattcacggctgtcaccttctcctgtgaaccagcaactttctagcatcatccggttggagatgatcatcaccttggcactccaaagtggttcaagtacaccctcgtcttcgaagttgagaaccacgcggtactccatagtgatacagtatccgacttcagcggccaaggcacgaagttgctccacaaaaccggccaagttgaagcagcgggtagtctcgaactcaggcatctacaacattttgaaataagagtcaatgaccagttttgtaaagagtggacaggtgaagatagaataacgaaggttttcacaattaaagaactagtttctaaaaaaaatatcatcctaaggcttagaccactggctcgtcctacggtcaaggtggctctgataccaacttgtcacgcccggaaatatacaccattgccaaacgctcagtgcattaatcctcgtcccaggaggcgaggtacacatagacattgttgattattacaagccacactagcggaaacgtaaaggaagaactttattacatgggcgactctaggccctcacactcaaagataaacaaataaaacagcggaagactacggaacaacagcagccacaggcactcgacggtggagtaaattagagatccaagccttcatcttcttcaggtccatcctctggattatttttgtgagcaagagtgagtaccaccaccatactcagcaagtcacaccggaaatgcaacaataatgcatagggaaaacatggaaatggcctaataggatttattttgcctaaagtcatagtttaaacattttaatcaggttaaagctcattttaaaacacgatcctgttctaagccaatattttaatatcaccaaggtcgcatgagcctgcgaacctgccttagcccaggctaatctccacatgactacaccatcatgatttcaccctcccaaggttttataaaacaaaactaactttgggtacattgctcagcttgcatataaccgagggcgcgactattcaaatagtttttaattctcatcagaggtgtacaactttacccagaagacacaacgtcaacacatgttgccacgcgccgggtaccaccacggtactcggatagaggtcgtgacaagactatccatctaggtctacccaaaacaggagaacccgctgaggtttcaccgcccgccggtccccgacaaggtaaaggttgccggatccccctggacgagacaggctccccttgcgccgggtaaaagaaacggcattaatcctggccccacacccttccaaccaatggtctttgttttgagaagatctaaactttcagtcgggccttacccactagacttgtggttgcacaaagaccggtccttatattagccggggtgcgactaccaaagtaactagcttgcaccctgagcccagcccaaaaatatattttagttgcacaaagcattttatcacccatccattgacaaaccagtcaatagtccataactaatcaagttttagttgttaaccaccatagtctagtttatccaaaagttctaggttggaactaagcaggactatgcatttacctaaagcaactagtcagtccatcatgtagggtactagactagtcaagttataattttactagggttcacaaagattatggatatcaaatcaacataatggccataaccaagagcataggaataaataataaaacaatattaataatgaacggtataatttataaagcaatgcaatataagtaaaacaacataattttcacaatatgggattcaacatgtttaaggtagatatgacttgccttgatcgctcacaaagtcttcaatgtcaatgacgatgaagagctgatcttccggaacggcacgatctacacgaccattgcgaagaaatacaaaaaggctaataaaatccatatgaacagaagcaataaagcacataaatgggttctactcattttaaggagaaattagagatttgaacggatcgataccgagttcaaacggtcaagatatggccatttgaagtttaggtgttgtttaaacggaaatttgtaattttgtgaattatttttctaaaggaaaacttgaattattgagagagagcgcacgcggactgggtccacgagcgggtcccacttgccagccgctcggtccactgtgagccgagcacaccgacgcacaggcacggcagcaaccgagccaggcggctcgccggcgacggccaatggcgtggcggcggtgcgacagagcacgggaagggaaaaacggaaagaggaggagacgacggttctcaccgagcagacgcggcagcgagaggttgacggtgttgccggcggtgaggaagaaacggaggggtcgttgtcattcccgccgtcttcgtgctcgacggaggggtggacggggaagaggaggaagcggcgaagcggatggtggcgactccgggctccgacgaggtcccaaccaccagcgaggggcggccggagttgcaacggcggcggcacaagaagagagcggcgcggcggctatggagagaggagggagagggcggcggtgtgtggggagagaggagggagtcggggtcccttttataggccggaggggagggagagagacgccggggagggagatcgatgccggccatggtggagctcaccattaaagaacatcatcgaaatccaccgcgaataatgctggatcgagtgggaaattatgggggaattggagaggatgaggtgggaattaattcccctcaattaatttgatgaaacggcgagtggaggaggcgaatcggaggttgccgtcgcttggaattcggacgaagagagagaggatggctggaggttagggatgacgagtgggacccacctatcatcgagaaggagcacacctgtctctgactgggcgcgcagagaaggcaaaacagacttcggtctgtgggagggggaatgagctgggctggcccaaggagagggagggggtggggagagaggaggaaaaagtacaccgaaggtccctcaacttgtcgtcgggatataaaatcgtactcgaaccacaaaagcagacatgcaagatcccttaactatacaaaaccgatcaccccaaatcctttgtgattttgaccccggttttagtctacgtggtggctgagtaaatgtgagacccacgtgggccccacatgtcaggtgtccacatcaccctctctctttcccctcttctctcccttccttatctctctctcacttctctacaagctagccggggcgaggcgggagggcggcgccgcgacggccgccggtggaggcggcgggcgaggggcgagctggagcggtgtcgcacatggagatggccgccagggtggatctgctcaaggcatggcttccagcaatcttcaaggtacaagaccccggatgcagaccagggcagccgcgcatcctcactgtccccgccgccatcgccattgccatcctgcgagctcggtccctcgtacttccagatcaagaagcatgccaggaccatgcaggagtagacccagaccgcgcagagcatgaacctccagttcagccaatactcaggagcagtggtgtcgacggccatggctgatgatggcattgctgcagtgacgaggcgttatgcagccagattcataatacaggatattactactcaaaccatgtctgttcttcaactgcaaattagattcttgcgccaagataaagagaggaattattattgccgacgaagggagaaatgatcagtactacgattcttatcatttcaagacacacaaaagaaaaagaaaatcgacgctagccagatgctatatatcctgataccctgcaacctggatccccacgcatgcagatggtaaagatgcaaatctttatttccatttccatgattccatgcacacaaaaaagaaacgaacaaatgccccacgcatgcagatggtaaagatgcaaatctttatttccatttccatgattccatccacacaaaaaagaaacgaacaatatagagaagaataccaagaaacacgcattggcgcagaggagggtggaaaactaacccaatctcaacggtgattgggttcttgtttcttgacttctccaatgcctccccttctccaaccttttctgccgccgcctctctctctccatcgattcctctccctctcgcgacctcgaacaaaccgagaagaagccaacgaaccaaccaaccacgtacgtgctgcaacgccgccgtgttaggagaccacggccggtacatctccgcgagcacccggcaccccaccaccgcgtcccaccgcgcgtacgcgtcgccggcgccgctgccagtgccgacgcgttcgccggcgcgcgcgacgacacgagcgcgcccacgtcggccgagcgggacgaggaggcggagaagccgcagcgctcgcacgccccctccgccggcggccgtcgcggcgccgccctcccgcctcaccccggccagcttgcagagaagtgagagagagattaggaagggagtgaagaggggaaagagtgagggtgacgtggacacctgacatgtggggctcacgcgggtcctacgctgactcagccaccacgtagatcaaaaccggagtcaaaaccaccgaaagattctagtgaccggttttgtatagataaaggaccccgtatatctagttttgtagttgaaggactttttttatcccgacgacaagttgagggaccttgggtgtactttttccgagagaagagaggggtggccgggctgggccaagagagggagagatgggctggaagcagcccaacaggaggaagatgatttcttttagcttttcctttttataaaattctttaattgtttttgttgccctaaaattatttaaaattcaagtaaaaattggttaaatatttttaagcatggggaatttattaaaaatgtccacaagccaattttatataaatcttggtgagttttaattgttggaggctcttttaggcttttaaaatttctagaaatacattaaagcacgatttaaatttagggcgattttcagggcgttacagtggggatggggacaggttgagatctccacccgcgggtccccgtggggccctggaagtactaaaatcgatgttgagttccattggtgagctctagcctcgactctagcatgtctgcctcctcttcttctccaaacatgtgggtcctcgacttgtaactaaccccagcccaagtagggtctatgtggggtgcaccctaatctggtggagcacggtcttagggacctcttggtcgtcctcccatctctttaaatagctaggtaccacttcaaggttccttagatttcattagattaatgttttagccattgctactttaccttgtagttacatgtgtcggctagaccacctaattactcgtctttagaaccccaacttattgtgagatttaattccttttcacaatttagattacttttatcttgttcttgcttatttctttgatttacttgtaaaaataagattgatctgcaccgatttgatcaacaacccacggagaggtatatcgatcgctaaggtgcaacacaataatggcctgtacggttatagtccgaccgtcaacttctcttccaaatcatagttatctcaactcactgaaagatcgagccaatcaaaaccgtgatcgtatcaaatggatctcaaggtttatcaataacactacctatttatagccccaactcctccatctttggtaccgttccttgagtctaccaaaagttgtatagggtcaaagaaaatctggtatcacactgaattgtctaactctttatgctttttgaacggtaaccgagcaactagctattatggtataaagaggtggacaatctagttgctactccctccgtatcttaatgtataacgccgttgacttttcgatcaacgttggaccattgttttattcaaaattttcgttcaaatatgaaaatatttatatcatgcttaaagaacatttgatgatgaatcaagtcacaataaaataaatgataattgtataaattttttgaataagacgaatggtcaaacgttggataaaaagtcaacagtgtcatacattaaaatatagagatagtgaggtagtatgtgattgtccaattgtgcttctcagaaacaatttggaatacggcagaggaccctaagcctaagggttttctttttatggcttggggttcatcttccaatccaaccatacaaaaaaaatttgacactaccaataagacggtttcatctagtttgtaggaggaacaaaaagtagtattgccaaaaaatttcaaaccaattctaataaaatcgcacattttttttaaaaaataaatggctaaaattttgttaaggttacattgttaacgaacaaaggacaaaccattagaatatactagagattggggcgcgcctttgcgcgccgcctgttcacacagtgtgctcgctatgcaagaattttttagggtgctgcatacacataaagataaaggtgaaacagaatatgatagcatggttgttcatacaggacagggtgaattgtctttggttgcatataagtacaagcaaaacaaccaaagacagtacgtaaggtaccgtcagctcctgttctgtaacagcacgctggcataatagtttgggcgtgatttttacatggaaattgagtacccatgcaaagcatacaaagaatgatactaacagctatagaagtagcagagtgaaaatatagcctacgatattaaaaggataacagcttgtgttgcatgagcatcttgctcacagcacatctattgttgcttgcagctgattagtctggtggaagtgaaagatgcagattgttccaacttgtatgccgttgcttgttggaaaatgggtccatcctgatttcaggttaaagcgcttttctgtggagtggtgaagaaccatggtggttgaggagtgccctggaatccgtacttcgatctgcgatgtcttcttccgcacgattagtgcaatgtatgtcatagagaattgctttgaaaagtgctgcatgataagtatatgttagtttttaaggtaagaggtatataaaggggtagtggtgcagttatcttaccaccttatcctgcttcatgaaagttggatttatggttgtgacatagaattcgtttgaggggtgcagaaattgcgcaatatctttgaagtagtctttgagttcagttgatagattgatgtccctccccggtgcagaagcacatttcattgatagtgcgtttggtgttgcctttcgaaagaggagtgaatgaatacatcaatgcacattaaaagagacgcaaatcaatggaactgaaaatagaaagagaagtatctgtacctgtacaagctgaccctatatcggcttttaatttctgttgcatggggtgttgcatgtgtggcttagtcttggttctttttttctgcaggtgaattggcgttgcaagcattaacggaaatcaaaagtagagagtggaatcagtaatgtaatagtttcagatatggtgccatagatgaaaatgatttgttgtcttgataggagacggaaagtgggttgaagatcatttacctggtggttttggtttctgaagcgcgtttttctttagctgtgagttgcttggtttgcttggcactggacatctaagataaccactcttggcttatatgatgacatgcatcttggagcgtgataagactttgaaaaccacatattctttaagctgcaaaccagtggcttctatgaactggggccatcctgtagtgatgtatattttgccagatgctctctttagttcaatgtagaccattaggttatgggttgttactaatttgagtctctggccatcctccagctgatatccttgtgcgattgcagctggtctgcgctgcagaattgaaatgatgtattaagactggcgtgtattaagctagactgtatatgttatatctgttggtaaggttaccacatagcgctggtttgctgtggttagtctaaccgtgaaaaacctaggtggattcatggctgtatctgcaaaaaaaaaaaggtagttaaaagaaatttataagtgcaaatttaacagtggtagggaagttgcaatgtacacagtgataaacaaagggacagataacagagctgagattgcagaggagagtgttaggtgcttgttatagtgtagtggtaatgagcactgatctttgttcttcggtggatttattcagatactaaacatgagttgtatattgtgatgtataatgggtcaaataggggatgagtaaaattatacagcagtcttcttattgttgaaaaaggctctgttttaagggctgctatatggctaataccatttttatttgttgccgaagtattattttctttcggtttgtatttgaaggaatggcaggttaccaatgatttaagggctgatatggttaggtttaaccagggcatgagccatgcgcaaagaatgttggagtttgcatggacatgtagtttgagctacagtgatctgtaaggtaggaggttatttatctggaaaacaaactttagcattgaaattaatccttgattatcctttagcgtatcatctctatgcatagcatatttatatgaacacacgaatggtgtttcttcatagcgcttatatattctgaagggtataaggcacggcctacattcgaaattgttactcaggctagctaacaatattttcaggtccatttggcacatatgacatcgcaccccaccagcatgtgtgaaatagaacaataatttacctccctggaagtatcagcaccaaaattcatctttgtggatcaggccatcgtcgatgatggagcagctgatcttctactccaactccaataccgtaaagtcagtgacctgcactgaaaaacaaataaatctagaagatgtaaaacagcatgctaaaatgtttaccagaaagagttgtgacttgttaggtacaaacgcagcagtacaattttattaattgcaacctaaatcctcctttacatcacagcagaataaataatcaatggcaatatattttgtccctctgaatcagaatgtgggtaaatgcactacccggtaataacccacacatatttactaacccacatatcatggttactgaaacatctagcattaatgttctgaattagatgaccatcctaaagatttcctatttttttttttggacaggctcccagtttgccccaaggactgcccaaactaaactgaaataccatcacatattctcaatttaaaatcagttccattcaatcatggacctagagctaaatctttcgaacttaaatatatttaaaactgaccttcgcgtgaacaagaatcacagaacaagagcagagcacataactaaggacttgattcaaacgcgtccattgcctgtaacacacagagagatgtagggttacatatatttaataaaaagctgtcaattgaacaccatagctaaggaaatgcaagagagcacagaccagtgaagaccgatggcgtgaaattgtagcttctatttcatataggaagctcttgtcctctgagcaccagcaggattgacggtgctacgaaataaaaaaaataaatgcggtgagcaaagcacactaacggtaatgtgactgaaaagaatacgtagataagaagtctataaagcatggcatcaagaatgctgtaccccttttttttcccatcaatggaggctaattctgcaccctgagaataacagcacaaaagttgttatatctatcaatgcttagtcaatagccgacgataaatagtatatttcatgtgcaggtaaggaagcactgcatagcggaaaaacataaaccacataagccctgcatacatatattaatgcagcaaagaaatacaaaatcacctttctgaaacaacagctgtatctatatcctttccttcggacgcgcccacctcaaaagttagcttcttcgatgcacctagaggctgccacaataatgtataaatcagaaccttgaccgaataacaaaaaaaaaacaaatggtctgtctttcctaaggtaggagcagaacatacaaggcgcataatggggcgtcgtttcctgctatcagcatgggctttctccatatcacccacaggggtattagaagaagcaggcggtgtcgaagtatgatcaggacactcactttctctacatatacttgaaccaccagcaaaaggtgaaatgacagatgatgtgagttgcaatgtctgatccctaacctgtggaatagtgccttgtctgccaaagaagtttcaatgctattgacttgaaacgcgatgttcctctgcatcaagctcctttcggtgacagaaacgcagaaagtgaatttttgggacacaacactcgcaatctctcgaggaatattgtctgatcctcgttccaacctgacaagattcattccttgctattgttgcacagatcttccaattcttactcgtgggagatatatcacagaacagatcaaaaggcatctgaaaaaacaggaagaaacaattcgatgtacataaaacgggaaagtattaaacaaggaagtaaatgcgatgaattacctatgggagcactgcaacacaagacaggagaggaatcacagtatagctaactaagggttgctaattttaaaacagctgtacgactccaaaaatgtgaacaggacaatgatatctgtacagaacagctatagtataggcaaaaacatatattattactatctaacagcagaaaatatctcgcggtacacgatgttccaagtgcgagtagtgcaattgccattgtcatcttcaattaacacctttaagcctgcgcgagaagtgactcgggaaagagcaacgtataactggccatgacaaaaaacagggtttttcaagtaaataccaactgaacgtaacctttgtccttgacttttatttatagtcatagcgtagcagacacggacagggaactgccgacgttctaatgtgaagggccattttttgctggtcgcagataaggttattcttgggatataaacagtttcccccgcattagaaccagttataatacgcgcttcgatcaccctatcacccaagtttgtaacaatcatccttgtcccattgcaaagcccagcggtctgatctaaatttctcaaaagcattatgggaacacctatttttaggcacaattgatgttcaggataattgttaactttgatgctattcaaaaattcaattgggtataaaacatctaaatcatcagacttttcatttgtttttgcaagacgatcaaagctcaagtactctcttgcttcaccaggaaaaagttgtaaaacccaagagttaatagcagcacacacatcattcgtaggagaaacaatagcacggtcttgcagatatactggatcattgtactgttcagcaaagttggtgtaaactgcagctacaatagctccaatcttttcatcattattcatgaccaaaagatcatgagggatttcaatccaagttggttcaacatcgctgccgtaactacacgctgctgctgtgccatcaccgatagaaaggatccaatcactgaattcagcgacttcgcgttgcatatcagaatctagagaggaacaacgtaaacgcatgttgatcgatagctctaaaacacatacatatgaccaaagaggagattttgatattgtagcatcaattgttttcgatctaacgcctccttcaacaacaggcaagatctggcgaaaatccccacccagcacaactaccataccaccaaaaggaattgatgcagctgaatgatcatcttcagaaagaatatcacgcaatgttctatctaaagcctcaaaacatcgccggtgcgtcattagagcctcatcccatataataagagaagtggatttaataaggtctgctaacattgtaccacgctttatatggcaaattgttgtttcatcaatttctatcgggattttgaatcgtgaatgagcagtcctaccacccggcaaaagcaaagaggcaactccagatgatgcaacagcaagaacaagctttttttcagacctaaggtaggtaacaatacaattccagagaaatgttttcccagtaccaccaaagccagacacaaagtagaaagcaggtgattttgtcatgacactctgcacaatgcgttcatatgcatttcgctggtcagtattaagcttgctacataataacggagcattagcacacaaatcatctatatcataagacatttcatcatcgatcaatctatttgctgatccaaaggaaccatcgcaattcacagtaggtaaattaaaagatgacatagcaacaccattgcgaagaaaagcatgtgtaattcttgcagaaccatatttctaagttcattatcagggacagaatatgcagcattatttaagctttgttgcaaatcaaagagaatatcatcagacatcgcatgccaatgtttattgaaaaatgcagctccatcagcaataccacaatgaacaaccatgagcacaaagagcgatctgagttgcggcccggtcccccagctcacagcctcatcaaatgcaaatgaccactctctgtcatcaccaagcaaccctctagcagcacaagcctccttaaatgtatcgtatacgacatcattgtatgttctaatatctgcatagctcctagcgcctctcacatacataagcagcattctcatgaaatacccttcacct

SEQ ID NO: 54366 - DNA, 34613 bp, Oryza sativa
aaccaccgatgccaggtttgcgtctgatctaaagctaaccgtgttcatgtttggtaaatggcatgctaaacgctcaacaggagggttcctaaagtgaataacatactcaaacaatctccaaatacattggttggcacataaatatcgacactcaatgaagtcagctatttcatctatcggtgctggcacagtaaaatcagaaccacgcatcttttttctagaacctgatgaaccagtatcatcaatcgcaacgactcagctttctttttttgatcctagaaaattttatattggcatgatcgggtccttttgttacatacttaaatagatacttgatcatctttgatttgttgcaccattcaacatttatatgagcctcaaatttacgcagcaatgacacattgtatggcacgaccgaacgattatcaagcttgataccatttttaagcacatgcgaaccattgtcacgccgcctataaacaacaaatcccttgtcatctactgttgtttcagagttaaaatcctttgggtattttttagaacaggatccatttctcatgcaagggcattttctattgctatcaccgcatgggccatgcatcataaattctttgaccaacaaataatcaagttcgttttcgttaggatcagggagttcagcactgatgtatgtgtcgacgatagatggtgttgcatcggtgcttggcgcatcacgccacaccagtatatggacgtgcgggaggcctctcttctgaaactccacgctgtaaagcactacaccatatggtaggaaaaccaaccgaacaaaattaataacacaacaaaaaatgcaaaccaaagaaatagcaaaaaagggaactaaccagcacgcacacgcccaaagggaacaccagacataatgtcagaaaccatttcatcaagtttcattttaaaaaccctggcctggttcgaactgcaacgcatcttcaatttcttgccactttggattgcaggtaaaagttgtaaaaatatcaggtgcgccataggcacggcaaatagccactacatcctgataattctggtacatgtatcgcctaccaccagtgaagcttgcaggaagtattcgttgcttacctacgctcgcaccatctaaggaacccttagcaactgcatctgtaattccttgcatgtgttcgcatctaagttcacgttgctggtcagctatgaatgttaatctaccctcttcaacacaagcataaccatctacttggccttgagaggataaacgaccgcaacataaataaggattaaattgatctcgacgataatggcagcagtaacagtaatgctcttgcatagaagcctttgttcgtatatcggtacgattcaagtctacccctcttaaatttataaccaagctgaaagccacgctcaccataaggaaacagaagtggatactgcaaggccatataagcaggatgtaagctagaaacatggagtgggccaggaatgctttggacaattatatcgcgctttgcattctccaacgaaaaatcacctacaattaacccagcaagttcatcggctgttggcaattcgtactgaacaggcccattctcatctgaaccgactattctaattgcgaactgctcatcaccattatcagctaaacgatctctagcaatcctgaattgcttaaccaaaggattacaattgtccagcatatctagcaattcagcagcaatctgaggatctaaatcacagtcttcgacttcttcattaagaagagcacgcatcctattctcgatctcgttttgagtgtcataataaatatatagttgagcaaactttagtggggtttcttcgctaggtaaaagtgagcctatacgatgatgtacttgaccatttattttaaagacataaggaccgccaccgcgatttaagctatcgtcaatatttgcacccattgaagtgaaagcaaacagcgaattgtactgccttatgtgctgcaaacaatgcctgcttcgagcatccccatcgaacttcaaaagcgaatttaaaggttctggtggttgtgcaaatggaggaacaaaaattttgccgcctttgcaacaaagactataagacatacggcgctgagttatagctgaatctctcttgcatcgttcttggtaccagaactgagcaccacacatgcggcactgagttatatccttcgacgtctctatatgcacatgcaggtcaaaaacatatctatatttagatataatgtcggtgcacgataaactaaggcatggaaaggggtaaaataaagtggaaataactttttaaaaatttgccgtaatcactatcaaacctattggaagacagggacgatatacgagaaagccttttacctacaggaaaaatcaacagacaacctgcaaataagagaggctgacagggacatatgaagggaagtaaaaaaaataccaagcataaagacctgcagccaccagtcgtttgagagccaatttttttgatcgtatctgtcgtctcttcgaagagtaccaagcaggataaatagggaaaaacccatcatctagtggagggggggaaatcacataaacaaacagaggggtgagcagcgatggggcacaacagcagcacaataggaacaaacaacgcacatacttttacgctgcgtagcaactgtttcccaggcatattcaccaccagccgaaacaggagagcacgctaaacaggaaacaaacaatttaacgatgacacacaacaagctgtggcagatcacaaaccagctacaaaggaacaaatgatgataaagcatacatctaagagaagcactatggcgttctagcaatcggcggtcccgtcgacgaagaggtgcaatcacatgacccccctccatagagcgactaaacgcaaagagagtaacaatgcaacgaatattaaaacaacacatagccaacaaaataaacataatggatgaacaattgattaacacacaaaataacagagagtaatgtatatacctccgttgatcaaataggatagcagagagtaatgtatatacaaaagaatgctgggagatataattaatatgctaataatcagacattttcaaggctagctttttacctgtactcttgccacgtgaacttgctgtgcaagctggcttagcctaatcctacttgacttcaactgttgaatgtaagcctgaacaataaagcagtgtatatatatactcatcaatacaaatagtatataaagccacattaaattttagcagaacttatcaacttgtgctcgtatgtgtccataaaacaaacatatgaaatgaaataatatataattcatgtttcaaatagccagcaccctaataatataagactcaccgcataatacataagacccatgtttcaaatagccagtaccatcataagataagactcatgtttcaaatagccaggaccatcataatatataattcacacctgagaccataaagaaattggaaatgcacatatgaaaagtgataatgtttcttgcattggtaggccggtcaaattcacaataaagccagtaaaaataactatgtccttcagcacataagtcccaaagaaagagccaaaaacaaccgcatcacaaagtcggtcagcacatttaatcgcgagctagcactccatgcatgcatgtagcaaaacaaataaagttgataacaaaagcacatatgacagcacttgcgtgaacaacatgtacatgtcatatacactaacattattgttaggatatatgtttgtacttttcgtaaagtattgtacgtttctgcaagcacatatatatacaaaaacacacacacacagtacatgcaggagagattcctttctgctagcttgaattaataagctgttgagtttcttggttgaccgactaaccttcttactaaggctacttttccttggtgcctctctattctgtgcaagcctcctcagtgtctgcagaatgtgcatatatatacacacacatattcacacaatcaagctgtcagtctcaaaaaaaaagtcataaaatatgcaggttatttcctgcagacagggatcgttcaacctcctaattacttttttatgcacttttgtgtgctgttgaagtgctgcggagggagatcatcaaatgtatcaaaggtatggctggatggatgattgactcactaaccttagggtctagtgtcctccttccttctctttctagatcattagatgttgctgcacccttcccactgttgcttccttccttctgcaaggcacatttttttggccccttcagaagacacacagaggaaaaaatatatatacatatatacagcatatatagccggatttctatccactgtctaaaaaatataatatgagagagagagagagagagagagatgaataccttaatgaggctattattcttgttatccttgacagagttaggcaagggaacaatcgatcaaataggatccgccatacaacctgcaggcaatataaacgtgatctagatgctatagcatatagaacaaaaaagcacaccaaattgtagcgcacaggtaagcaaaaaagacaacaaagatgctggctcgaagaagataaatgggaaaggacctaacccgaacaacacacaatgacaaggatcgaacagaggttcttcaattactttgatagctcaaacaaagactctaccataggtagaacacaaattccctagctcaagaaaagctaaactgttattgtgtcctattttgcagcatatgcatcttggtaacctagcagtgcactcaactaaattctgttgggcctaatgtatgtgatacttataggcatcaacacaatgcactgaatttagtatgcaagtgaattatgatgaattttgtgcatataatctccagtaaaaaggactccaggatacacctaacatatactgcctcagaaagagcccgccgatcttcatgtaacacaagtttcttgaaatctccccatcgggaacacttgccttcaacaaaggctttgatctacctatctagatatttgctttaatctggaagcagtgtgccaaacaaatagtggaacccttacgcaaaggtgccatagcctttaaattgtaaactacattgactgtatagatgatgttacaaggcataaactttatattttcactgcactatatagaacaaccaaatccatacaagctgtagaaaatccaggccatgaattactgtatggtggaaggatatgggctgaataaaggtaattagccagagaatcacatgcaaaaaggaacagaacacatttaatttgtctaggacagtaaactatacgaaggattgaattagacagtttcatttatataaactcgcatgtaacaggaataagggccaccataaatcaactcaagtggtggttttcaacatgaaacagtgggagaattaactatcaaatctgtagttcagtgacctaatgatcaggaatacccacctcttgatgcatgaaaagcccaatagtacaaccttatacttccctttggcttcttgcatttaccatcctgctgtaatgatagaaggggaaacattcagaacaacagtaaagcatatataccgtctttcatagtagtcatcatgtaacaatctacctctaataaatcaatttcctggtgaatacattcagataacaagtgcatcccctaaatcaaaagaaggattggaggataagatagttaagcaaaacaaatctgcaatcacaaggatttttttcacacctacataactattctaatctaatagttaattaaaataaataagcaagctgatgaggaaaccaagataattaactgtagaattcccagaggataatctagcatgttatggcaactctatgctgtacatgtgaccacactgaagcactacatgcactgatgatcttgcataatgcagtatcattttattaagtatgcacctgccctcagcgacctgatcactaacccaaaaaaataaaaagtaaggtggtaacaatattcaatatatcactgcttatttttcttgtcaaatatctgataactgctcagtaacatgacataggaatagctcaaatgttttagtgatcatattcctcatgcagagcgcccaaaatagatattttgagctgtgtactgaccctgaagctatataatctgcagatataactgtgcctcaatgccacttgttgcaactaaatgggcacccacatgattggaagtaatcagtgcctatcaacaaagataatgcaggtatgaggtgaatttacagttgtggttggcgagggcacccattgcggaagacaaagggaaaaaaattagactatctagggtagcaaaaatctagctaatgagaatctgattttcctaacctctgacttttaatttattttattgatttaacaactacaacttcttgaaatctgaataaaaaaactaaattatttaagagaacttcaaattctaggaaaagttgtagctgacaaaaatttccccaagcatgacaacctcatgaatctactccaaaatctctatgtagaattgtcatttaatatcagaagtttcaaaatagaaaataatatgtaatcttatgtttcaaagtgatctatagaatattcttttctaatgggttggaatcatataaaactcctataatttccataaaaatcggaatgggcataaatttttactcgctctgatctaaaatgtagttaatcttatcaaatttatggtactacgcatcaatattctacgacgaaggcagcatagttttacttctgtataaatattcaggagtatcgtgcccgcactctacttttcaatgtaatatcttcgataagctgacccatttcaactaccacctttattaaaacctaataaaataaacatttcacacaatgtggtgcatacttgcttcatacattgacttgtacttgtactgtctacaatatagttcatattagcccttaaaatgtaaccaatgaatccgaaaaccagaagttccagaagggtatacaagcgcacaatatcagactatcaactggaaaatagcaacgccatatttaaatataatcaaatataattgccctgaatccacaagatgctgtcagaaatcacaaataggataatatgacatgaatatgccaacatggcaacaactaaaaaagaaatggtagtttagtgctaccagccctctggacaaacgcattgtgtttagtgtttactcataagtccggaagataaacgaaagaacgagggcaacctgctcatcaccgggaatgtccgtgccaccatctcgtccctgcctcccttgacctccacatctcgcacaccgccgtcaccttgacaccgcaaagccacacgagtcaacaagccaaaacgtgattcgaacaccaaggaaaacgaccaatggggttgcagggagatgcgcttacggattcgaagaggctgggatcggaggcggggttggcggcggcggcggagtccctggatgcggcggagagggcgctgaggtagaagtcggacggagacctacctcgaacggcctcggaacttagggcggcgaagcggatcggatcggcggcgcacgccctcgccctcccccgggacgcccccgcggcgctcgctcgcacgcacgcactgctaggctaggatagggttcccctcgagctccagcagcaagcaagggcgagatgggagggagagagagcagctagcgcaagcgaggagagagaaggaggtggacgcggcggcggcggagctggacggggccgccggggcggaggccaacgcggccgccgcaacggtggtggacgcggcggaacaagggcgagatgggagggagagagagcagcgagcgcggccgcgccggagcgagaaggaggcggccgccgcggcgggggagctggatgcggccgccgcggcggaggtgaacgcggcggcggacgcggcggcgcgagggggaggcggcggcaacggcggcgtgagagggagagtgacggcgcaggacgagagggaggagtcgaggagaggcgggggaggtggctagggctggggttagtgcgcggaactttttcgaaaaagaccctcgactttctatttttacagaacgctcctatttcgcgtttgtcccctcctgcgcatgtaatatccggattttagaagggcccttacgcacaatatcgcctcaggggcaccgttcggcagggacctactcggaattacgaacaaaccgaagggctttctcgcaaaaaaaccaacccgggcactgtaggactagcttttcgctgacgtggcacgccccctcgctcgccactcatgccccgcataatatttcccgatatggaaaaatgatagcaaaatgttggttgtgccgtgcgcttcctcgtgcaggaaaatatcatatatccatttcggccgagattaaggagtttagcagatcgtttgtcttttgatattaattttgttagtcaccatcattttttttcttttgatattaattttgttagtcaccattgtatacttaggctcatccttgtgcaaagcaggtttcacaaggtttgattgagtgcgcgcgccaagaaacaccgtagttgagattttgctcaaagacctactttaattaagttagtaaaatctccttttgctctaaatcccaatgaacaaggaactcaacaacttgtaatttggtgcaaagaattctttatgtggaaacccatactcactcaggccacgcagcatcacacggtgagagggatgaactggacctgatgcattggagtgcaatcagggcagcagccatgttcgagtgacctatcacaaaggaggctggatcgtacgaggatgcaatggtgctagtaacaggatactgggatagaactgattgcggcgtaaccgtaaatccatgagtattttggatacgtgattacacgaacatgtggccctgcttgtgattggagggctcgtagcatcgactactccaaaaatcatacaattgttgtaaaatatatacccgaaccattatgtcgaggggatcctccggatcgatctcacattgataacgcgcccttttcactatcggtagtttgagagaagtttcctagctacattctcatcagccaaatagtaattagtagctacaaatcaaatactccccaaacaagcaaagtctacatatgtcccaaaatataaaggattttaatccattatagaagggaggtagtaaaaactgaaacaaacacagttgtccttgtccatgaggctatgtgaaccactcattttgatgcggacatcactccttcgggaattgaccgaacaatttgacgtttagaatctgttccggcgctacgacgtcgtatttgggcttgtgggccgtgtatcatgttggaacccattagggttgcatcaagggttgtttgcacaaccctaaactctatatatcaatacccgtcgtcatctctagggtttgggtttagcaatttgattgtaattcaattcatgatgatcataagtagaaagttcatgttcttcagtcattgataaacaggacagtactcaacacaattaccacaaaatatacaaactccgaaatcaatactataattaagcaattgtttccttttaatatccttttcaaatctccaatccacaagaggtagatctatagggcatacgcgaacacatacttcacaagcaatacatttatcaaattcaaagtggattcgcccccagaaacgctccgatgtaattgatttttcataggggtagtgaatcgttataggtaaacgatttgtgtgggataaggtaattatgaaactttgaccaatgtaccttgctgtgcgtattgtttgttgaccataactcatgaacccagttaccatagggaacatattcgaaatatctatgaaaaaggtatgtttctttctcttgtttgagagaacttttgtgttgaaaatattcttactgttattgtattatcttattttatagtgaaacaagttgggaagaagttgttaataagagattgcccagggaaataggtaaaagaaatttccatccaagatttaataactaatccattctcatcctgggtaaagtccatcttattgtgatagaaatgaagagaaataaataagctttagttaatgtaataaagatactcattgtcatttctaaaattccaaccattttattcatttggaaaaatccaaaaaaggatatatagggaatagacaaattccacccgcctaagcagagaactgttacaaataaagaggaaactaataaatttaggtaagaaacaagataaaataaaccatatttgatagcagaatattcggtttgataacctgctactaattcttcctccgattctggtaaatcaaagggtaatctttcacattccgccaaagaagaaattagaaaaatcagaaaacctataggctgacgccaaagattccatcaaaaaaaccatattttgactgtgcttcaactatatcaactgtacttgaactgttggataatcatagtcgacgataacatcccagttcccaccgctattccaaaaccgtacatgaaaccttagtttcatacagctcctctatgatcaggaaaaaaggaaagtattgtttcatttcgttattatcttcttgggcgtagttagaattatctaagataaaatcgatttcaacgtcctaaattagaccaaaggaattctatctgctagaataataaaaaacgcttcggaattcatctcatcctttataatataatggtactttttctttgttcaacaataacttaatcttggaataaaacactcgttataacaattaataaacgaaaagagttgggtattagttcatgaagaattctgtatgaatatggataaacgatggaaagaataaataaagatcttttttttattgcattccatatcttttgtcctattcttctttccccgaggagtatttaaaaagaaaaaaggaataaagggttaattcgttcttgatagccatttccttaacaagtgaatgggaacatactctggatcggaatccgaagaaagtactacttgctcatttccaccaatttcaagtccttattatgattccttttatgaggaaaaatatctaatgctttagattccctcattactaatcctttatgtactttagtgtttctaatccctcactaacttttgatggattcccttatgattacaactttctgtatcaggaatctcttattattgcccgcttcaagatatgatgactaatcaaaaaatctcaaccttggggtaaagaatttacaccgcttatgtttacttccattttttcttgtacataggaaatgagattttttctttttactacaaattaataagcagttttgtttcactcatatagctatctagtttaacttactaacctgaatatagaataagaaaaggaggataaatattcaatgaatttcagaggaaaaacatcctattttaacgaatcgcacgtagagatattgctagtacacaaaaagttaatgggatttcataactaatagattgagcggcagctcgtagaccacctgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtactattctattgtgattcccagtaagagggtcaaaatgggtagaatccatatcagtccatagacttcttttaataattccaagttcgaaaaagaattgatagcttctacatgtaccctgtctattatcatttcaacgatcaacttctcccataatgatatctatactacctaatatcgtcatgatatcagccaatttcattttttttactagctgaggaagaatttgcaaattaataaaaccgggtggacgaattttccatctccaggggaaaagactatcatctcctaccagataaattcctaattcaccttttagattaatctatcaagaatagtttcgccgctagatcggtttgtaagaccccaacttgtgagcttaatcattcatctgcaattttggttgtattctttcttgttcttgtttttgttcttcaattcataagcagggattagccttctcggcgaggtcaaccgggtttcggcactgttgataaccagaggagacgtggtgctgcgattgcggggctcaagaacgtgctcgttcaagaagccggatcgatttgtgtcatgactccaccaaatcgttgattatccgaacctttcgaaaaatcgggaacccttgtccacatcacatttcctcgtgaaaatcctgccaatctaagtacatatttatcgtgtagctacaaaagttgacatatcatctgttctagtaatataaacataaattgtaaggtatagatgccacactattaatatctagcacaccactctcccacaacttgttagggctcgtgttaagttgggctacaatttcactgttttaccatgccatctgaggtagggagacaaatctatactcaactctcctccctttgctagctgagcacaaatctaatgcgatattaatggtccgcttacatcgtcttactgtattcgctctaatacaactaagaatgatccgatagttgtatttttatatcggtaactggcaatggctattaccctgttgaagtcgctcaatgaggttagtcatgttctcttgccaataatacaagagccgaaatttagggcttagaaatatgatgattgctgtcatatttatgtaatattatgttgctgtactgtttttgatttcatataagagaaaatgttggaaaatagagaggaggatcaaaattagagaacttaggagtgaaagactattccagcttattcgtgagagtgatattgcttgtataagcgagctccgaatggacaggaggacatttcacattctatgtgacatgcttagagacgtcggagggatcggtagcttcattcttatatatactatctcaccatttaaagaatagaacaataggaaagttttttttaccgaaatggagagactgtaagtaggcatttcaatttatgactgctagctgttctgaagcttcatcaacttctacttaggccttgtttagttcgctaaaagaaaatttttggatgtcatatcggacgtttgaccgaatattggaaggggttttcggacacgaatgaaaaaactaatttcataactcgcctggaaaccgcgagacaaatttattaagcctaattaatccatcattagcacatgtaaattattgtggcactaatggctaataatggactaattaggctcaaaagatttgtctcgcgattttcatgcaaactatgcaattagtttttcattttatctatatttaatgctccatgcatatgtccaaagattcgatgtgacgtgtttgggaaaaaaaattggaaactaaacaaggccttaagaagccagaacctatacctgaggacaccaccgacgatagatggaagtatttcaatgcaacccattctaaaaaataaatcacatttcctttcaaaaaaaatcacatctcaccactattaattgtaccatattttattgatgtggtgttctagattgtagaattgcctaggtgcattggatggtacacacataaaagtaactgtcccaaccaggataaaaggaagatataggtcaagaaaaggagacattgttgcaaatgtattaggtgtttgtgcacccgatatgcagttcatttacttactacccagttgggagggttctgaacatgatggctgtgtccttcatgatgcaattcacaggtcggatgggcttcgtgtccctcaaggcgagttttttttccaataaatttattttgaagtgtgacactccacagcctgaattatactgatatttctttttttttaattttaaaggttgctatttttttagggaaacactgtaggggaagcccccatagtaaaattaattaaaatataaagaaatatttacaacaagttcaaccaacccaagagcagatgtctctctattacattcaatctatgaactaacaaagagagatcacttttaaaggttgctattactttgttgatgctggttatataaatgcaaatggttttttagccccttacggaggccaaagatatcatttaggtcgtttcacagcacttgaccgaccatgtagtgcagaggagtactttaacatgaggcacacaagtgctagaaatattatagagaggtcttttggaagactaaagggtcgttgagcgattttgaggtctccatcctattttcctatcaaaactcagtgttgaattataatggcatgtgctttattgcacaacttaattttgcaaaagatgtctagtgatccatttgaggatgaggatgagatactgtcggatatacttaagggagaactcgctgaacctgagtttatctcagctatttcgacatctgatgattggacgaattttcgcaacactcttgctcaagggatgtataatagctatagggctcattgaggtttgtgttttaaatggaatttctaattgattgcaaatcagaactaaaaacaaatgttggtacaactatggacgctcactgatgttagttttctgttgaatttctaatattgcagttatggagcatcttggaagctcaagcattgtgcgtgggagaggcaataacaagaggatttggacgtacttcgaggatgaggaactgatcaaggcactgttcgagattgctttagatccaagctggaaatcagaagggggtttcaaaaatggatactgccaagttctagagaacgtgcttgctaagaagttgccaaattctggccttactgctgttccgcacatcgagtcgagagtaagacactttaggaccaagtttggggcaattgaagtgatgctaaccaaaagtggcttttcttgggatgacaacagaaagatgatacaatgtgagaaacaacaatacgatgatcattgcagggtaagtcatcaaactaactatataattatatggaatacaaaatttatttattgattcattagtgcattgaattgaaatatgtgaaactaactgtaagatattttctgaaattttgttccaaataagaggctatgtaaaattcctttgaaatgtttgcgaagacaacattatggttttcttgtagtatgctctctcataaatatgttctcttgtgtttttcatgtaattgttgcatttttgatatgtcacagtagctgcataggtctctcttctgcttgctaaaccatgaccttaattttgtgtcattctttgtattttacagaaaaacaatgaggcaaagggtctgtatggtgtagcattccctcactatgatacactagctgcaatttatggtaaagacattgctactggagaaggtgcagagggttttggtgaggctgttgctaatatggagaaagaaattgttcgagatattcaagatgaagaggatgaggaggatgaagagagagtgtctagagaaacgcctcgacggagcgttgattcatcagcacctcgacggagcatcgattcagctgcacctcggcggatcatcgattcagctgcacctcggcggagcatcgattcaactgcttcaagctctaagaagcggaagaaagacagcaacaaactgaaacataccttgtcaagtgacccttttatggatgtctttgccaatgttcaaggtgatctgagggatgttacaaagcatgtgggagcaatggtggcatctatgcaacatgaagctgagatccaagagaaggcaatggttgaggaggacccactacaaaaaattcagaatgaagctattcttgagtgtcaaaagcttggattgactggtactgaagttgtcaatgatgcagctgcttttgtaaaagtgccggctcaaatgagtatgcttcttgctcttccagaatctctcaggagggagtacgtcctgaaaatacttgctggtaattccctatacacatttgcatgttgtattacatactttattttgaggtcattaattgtaagcatattgcattttactactttagcatttcatatatgcattcactgtgaacaaattcgcatcaaataccttttattgccttatatactatttgtctgaaaccatgaacaattataatgcatgtatgggtccagctgtccagctcaatgccataggaattaacctaaggaggcataattcactccaaactactcctagctggagtatgtgcctatgcctttcttgcttgcttgcacctataaaaaagtggttcaagaaaacaaagcttttctaccaattccttgtacatattctgtgatcaaagtactgtcctatttttaagacaaaagtactaccctagcttatttgttaactaatctggtagtttcactcatgtcaattgttcatccaatcctttatcgattgaattttgaaggtgtgccattgattatattttgcaaaatattatctcttgtcttgaattcttgctgtcaaaatttgcatccaaatagaagtgacagtgttgtgcttgttcactgcatttgcatccaaacagaagtctccatattatgtattttctcgttgtgtatcagtttcagaatttgatttctcaaccgacacatgttttgcttgcacctgttagtctgttacctggctgcctaaccaaacagcgcgaatgaattggtatccgttacagcaactatccagacaaagcacgtaatcggttaccggcggaagcattcccaattacgtttacgttaacattattgaaccaaacaccaccatgttctcttgccaataatacaagagccgaagagttgccaaatgttactctgctatttgcaagttccgcaagggaccgcataactgcaaataagcctggagctcaatgcttacatggcctgaaaaggtggccatactctgaagaatgattataatgtatacatatctatgtgctgagaaatataaaaaactataggacgagaacagctaaaatacaacagaaaaaagaacatcttgaggccaaaggaagcactgagctttacaggaggctcgccaatccttgctaatagttggtcaagattttatctggtgatacaccatctgctacaagggctgatgtgatctcctgtgaagcagaatacatcatcatcatcatatacaattaatgaacgggaataatggaactcatcagattttagttaacgatagaacttaatgagataactcgtaccaaactgccatccaaaagaacaagacaacaaagaccgataaattcatctgtacaatcgaaaatccgtacagtgcacgggcaaaccgcaaactaatttgtaactttgcaccacttgcacccatgtattggtagccaagagcaggctggccagtgttgtgtgttgaaccaaacaaactcatcgacaatgaaatcgacatcgcagtgctggccatcgtgttgaaacaccatggtggtttgagcctaccacagctgctgcaatctccaccagaaacttatcatgctattgaagatggccacaacccaagcaaaaccagcttcatagacatgaaggactagcaggtccttaccatagatgacccgaaatggagtggaatgcttagctgtctagaaatgagttgcaacgaatcttagcacagggcattcagtgaactcactgtgggccgatcatcagcgacgcagtaaaggtacatctgccaatgggattggggataaaaggcaaagctcatgtgtagcatgacatataccaactggaagagatcctcttaaaaggcactggtgaagatgggatcccttttgctcataatagataacgggatactctgtagctggacgatcgcattggacaaggcccttgcgatggagcttgctatattgggatggtcaagggcgatgaatcgctactgtgtagtttggatgatgttgtacaagaaagcacttggggcggagctatattaggacgttcaagggcaatgatgtgagcgcacttcaagaaccagtccttgacggtaggacggcatacataacattcacctttcggagaacctcaaaaaggggatatgcacctacattagagatgactcctgaaggggttgcatgagactaaaggggtggaggtgttctatattattgttttgccacatgatattcgcctatacaaaagtcctataacaaatgtcgcatgctggcagtggcgtatctaggtttttctatgggtggtccaaccaatatatatttttttaaaaaaccctaaatataacgaagctaggagtataaattgatcaaatgtgcatcaaaatgcattaataagggtgctttttttctttttcccccaaaaaaattcatttttgtatatatatgcattgggctaggattttttttaggtggtcccgggaccacccttggatctgcctgtgcatggtggacacatgcaaaagtgcaactgtagttggtgcaaggtcttttgggtgtcctcgtcataccatggtgtcggccaacaagttagcgaaattatcaatcgactggcacatggaactttccacggtgccgtaggagaccatcgaccgtgctctaatattacatgttccttgtatcacaatattgcatcgaggcctgcctatactctaccctaaaagcataacagcttacctaattatttggtgggatcgtggagaggcattgatcctagatgtacttcaagctaagaggtaggtgaaaactatggaaaacatcattgttgcttgatgtgtgacaattctcacatcataggtcaacgaggagacatcgagatcaagtcacacaacaatgctagattcaaacagttaccaaatgtgcatacgggctccttttcaggcccataagtacttggtggaaagctcttggagtcctctttccaacagatttaacatcatctctatattccatcaaagttggccacaattaaagaaagatggtgttgtgccacctgtcatgagcctttatgcttataattttgtgtggagactaggacctcggtccaagtggggcccatgtggagtgcccctcaatcatgtggagcacaaccctacacaccccaaggtcatcctcccatctccttaaatagctaggtaaccttcagtatttctcaggttttcttatattaaagttagtcattgctactttgccttgcagttgcacgtgtctgccagaccgcctaattactcgtcttcggaaccacaccttatcgagtgttcgatttatcgtgagcttgaattcctatttgtattatcaaattactttaatcttgttcttccttgtttcttcgatttacttgcagaaataaggttgatctgaccaggtaagatcaacaacagatggagaggtgtatagatcgctaaggtgcaatacaacgtctagtacaattgtagtcgggtcatcaacttctctcccaaattataggtatcatcaactaacagaaaaattggaccatccttgctcatatcgattggaattacagagttgtgagcgtttcactactaaagacaaccttaataagttggatcaactctcactcttaggacaataactttgtgttaaggtatgtctgccctgttgaagaaagcaaggagggaatcaacttgatggagaatctgactgaagtctagacccaaggtgtcacaatcgactgcagaaagtgtgttgatgttaggatctgcaagacaagctagtgatcaacaaaaaatttaagagcttggaatgtacgctcgcctttggtcctccaaaaaactccttcacaagcttggatagctaaacaaagtcgtaatcctagataaacgttttgtagtatccacacaaaaccaccataagatctatcgctgtagaggattaggtatttagctcacatggtgtggcctctaagccatgctaggtgatgagatgtcgagatggttctgccactagaaggacatgggcgagccatcaaatttccatacatgtgccaacattttaaacaactatacattgacgatgtcgaatcctccaagaggaattgtcacccttttgctaagccaggtgcttgtcacccaattgttattagtgatgccaagcttacacgcattgtctcatgcacatagttgtgtgagttgtagaccatgagtgcaacacattggaggtgcccttgatagagactagcaactattctacttgtgtggatgatgataacattaagtgatacctagatgtcctcggttggcttacaaggctcttccaactctctatagtacagcaccatgggcgatgtagtggtggatgagaccaaaattcctaggcaattctaacatagccgcctgggttcgattggtcattttcttgggttaattagatccatgccatcacaaatttcacgatttagaaaaataccattactattcacctatttttaactatgccactgcaatacatctgaaatcggatccatgccactctatacaactcaaacatgtttgaaacgtatttttgctactgtattttcgtagggaccaaaatacccctcgtcctatccccataggacccacctgtcaagttcatcttcctccacccttcccaatcttcctcttcccactctctccacaagctcttccgatggtttgcagggacggctcctgatagtggaggcagtgacaatagtagcatccgacgaagccgcgacctgaattgtgctctccgccaggctcgaggtgcagtggaaacgaagctccaaccagcggtatcttctgaagaaaacttaaaaaataataacggtagcttctgaagaaaactagaaaactgaaaaaatattaaggggaaagggacaaatcagatgacgggagctagcaaatctcctctcctgtccagggtgcttctgcaaaggcagacctcctcccatagcggccaggtcggtcagcttgtcggcctgatcctgctactactctcagccatggctccggcagcgcgcgcggacaagcctgcgaggggctggctggcagtgacggtcgaggtggacgagtcctccgctgtgtactacccccatgggtatggcttatccaaagaagagaggcagagtggaggaagatgatggatctgacatgtgggtcccatgtgagaaatgggaccaggggtattttggtcactatgaaaatacaatagcaaaagaacatttcaaaacgggcctgaagtgtacaaagtggcatgaatccaattttatatgtattgcaatggtatggctataaataggtaaatagtagtggtatttttccaaaccgtgaaatttgctatggcatgaatttaattaaccccattttctttgggtgagttgattggaccaagacataaggccttacattgggggtgagggtcgctagcgccctgttagggcattgctgtaagcattgaaggtggctcattggacgcagttggcttggcaactggtttggctgtgatgtcctctatcaaacgccattggaaagtgtgagtgaggcacatggccacatggaggttgtttggcatattcctccttaaacctcttaggtggagtaattccaatttgccaacagattgttacacattcgtggtccatgtgcatattatctaaaaagtgaggtcatgaaggactcctcatcacgctcaagcatatggtaacattattgtgctactccggagaagtggtgcaccgtggtgcaaccaaccacaaccctactctgaaaacaaatgttcacatcattaacacaggagaaggtcgtacttacgttagaaacttaagctatctgcgtagtgctgctttcttaaccaacaatactaacttgaactagatagaactaagggtggtagtttctccattgggtctagggcctaggcaattttctcacccacgagttgatcggggtgaggcacttactgcttccgaggggcggaggcgggttatatgtttcatccacggtgatcggcaaggccccgtatacataggagatgagaaaatacatactccacaaaagcccatcaagaaaaccctatcccgttatgtcaatctctcggtccccacaaatccatcccacaccaccatcgcagacctccccttcgacatcgtgtcccttgatctgcactagaacgcatgtagccaaaccactatgctacgttcgtcgttgcggacctatcccttgaccttgactctgcatcccgatgaagtagcggccagggctcctacgacactgcagctggcctcaacctcatattcctctatcctaaagcgtggtggtcgacggtggctgatggctggccttgacctcctattcctctgatgtgtcgcttcatcttccacttccgtcctcagagtggccagggactgatttcgccccactcttcaccctggggctggggttgttcttgtccaatccacacccgccccactccgttgccaacccctagttacatctattgtcaccaaagaagatgacatcaacttaccacaaatcgttttggacaatgacatggtctccaaaaaataactttaaccattgttttctattataatatatataaaaatatcaacaaatatttagctttgcttctcaataaataatattataattattatagttgaactaaattcaatcttcttaaaattttacttaccacatgcacattgatggtataatacttcctctatttcacaatataagacattttgggttttgaatagattcatgcatggatctaagtatgtgcttcatatatgtctaaattcataaggatgttagtaaatatagacgagtgatggagagaccaaaacatcttacattgtggaatggagagtagcattttgtacccaaatctgaattttatattgattaaacgtatgtattggacacttcatgatgtggattatactccaattcataagtgtgcaaactaacattactagctcctgactgcaacttgcagagttcaataaaatttcagggtgaatcaaattagctttatctcaagatgtaatacagatctgagcacacaaaataaagtgcaagagctagtggtggtttgatatagctatatttcttgcaacagacagcattgggtttatcacaattatgataagaatctaggaactacactaagcgcagggcaacatttgattgctacaaagtgcagggcaacatttgattgctacagtaagtgtaaattatttttctttttttgggaacaaatagctatcggcctagaaaaaaaaggttcacttttggagtatttactgcacagtattgaattatatccttaaggtttcagctctttggccagaagaaccaaacataatatttgtaacctgtagcacacataacaataggaatgtgcaaaagtaaaaaaaaaaaagagaggataaacatgcctcagacatttgtttttgtccacagagcactgccccagtagaaaaatgatttgctatgttctgggctttcaagaaagcatcctggaaaatgaaaatgatatgatataaggttgtatgtacctatgaacatataacaagattatagtaatgttggagttttcatatattacctgaacatatccccgttctcctttccaactatcatctgctcgtgacaataccggtattattttaagcccagttgactcccagtttgtaaacctatcctgccagagagaaaaggtttatgtgaagatattgtttacatagagcagaatgaaggaaagttccaagtctcaacctgatatgccattgtttggagatttctggcaccgtaataaagtcgtacatcagctctttgatccgcagcaaaaccaaactcaataagtgaccgaaccggactgcatgattaacatacaaattaacctgggtaggattccatcaaaaggatgccagactatacttgatcaccaaaaccagacagtcagcaacaatatggaatcagactaaattatcgtaaaagatgtatcagcattcaagacatatttagccctgtctttcctatccagcaaataagataacagcatgctgatctcccttagaagcaaggaaaccttttcctgctcttgggtagttacaaacaaaatacacgtccttgacaaacgccaactaacatcatgtacatgttagtgaaactatcatgaaactccaacatctttttttcgattgccctattgctaggttgatctggaacattgtcatgtgtgcttttaatttgggacctatcctgaacagtaatcagttatttggcacatggctttctgcgtttgggaaaaaacttaaaaatctggtagtcactggggtggctgcagtgttttgggctatttggaaaacaaggaacaaaaagcttgttttgacaaaaaatttcctaatgatccaactgatgtagttttctttgtttgccattggattgaatcttgggttcctttgcagaaagtggaggtagatcaaagaaggctgctattgggggccaaactcataagacaggtagcaaatgagatcttcaattccaagtatggattgagaggaggcgcaagaaggattggactgtgaagtcagcttagatttgaagacctgtggtggctgctgccttgctatggtctttggattcttaggtgtcttagctttactttaaaactgcagggagttgagtcctttgtgtcataggggagattttggttggagtcttctggaaaaccgtattttggatgtagtttcctcagaaaactagcttgctggtagtccttgtttcctttgtatgaaagaactctgtagtatgctcatttctagtaatggaaatgggggcttcatacccttggtcaaaaaaaaaaaataaaatcatgtacatgtccttgccaaacgctaactaagtttgctttgatggtgaggaaagggaactaaacattctcacaatattctaacaaatgtgaagcaatagttcattttaggtccagtaaattggtacaaccattcaaaaacatataggagcagaaagagaaagcagaacccttactactatagtacaaatgcatttatctatttaactttatgcattgttctctttactactacagtacaaatgcatttttctatttaatctctactattataaaaattgaagatgtttatgccggtcctttggtatgtcatccgtgtttgagtcggtttttaagttcgttcgcttttagaaatacagaaggagtcgtataagaaatctctttaaaaaaactcgcatgctaactaagacgatcgaactcctaattgcagctcatgattttgtaaaacaaatatccaagcgaattcccacaggcagctatgagacattaacattggcatctactccctccttcccaaattgatcatcacataatggaattcaaaatttctcaaattgatcatcatataaccgcatggacacagatttcatcagaatacaattaatacaacatgggagaatgtgtgcatgctaaggtgtaagagcaggtacaataacaggctataagccagctataaacatattttaatgagataaaggaagagagagaagagcagcgggctacagatctgtagccagctgcagcacagactccaagacatacagtgtgtaggatcatgtattaatagtgttgtaagcaactattgtatgaattggctattacattggctataaatgatatggagctagtagttagctatactattaaacttgctctaactggaatgatgttttaatcgatgcatgcattgtgggagaatgtgttcatgatgacttgattgatgtgatttaaattatcattggtcttgatgcataaaatatgatgatcaatttgggaaggagggagtaatgtttttctttaattttctttttctttgctttactttatgtttgcctctatggcttcttacgaataagagactactttgaatcttcaatactcttaaaatttcacatgaacagatattaaactggcaaattagtttaatgttcggttttacatgctttatatgtaaaaactattttttttttacttttcctaatcaatttcgagtagtgacatatgatataagttttcccttgaagaaaaagtattgctatattataagcttagctttcacagaatacgatatcttccatgataactgccatcgccattttgggcccatgggccatgagacaaagacatgaaaatcatgattcttttaaacccttgattacatgatattaagttagcttaagtcctactttcttacatgtttccctacaagaatatttggggctaaatggggggtgatggccaagcagatcaacaaaaccaagagtgctgattaacctatacaaatttcgtactaaaaattgagaaagccaaaggaaattgcccactatttggcttattaaaaaaattggcatgcgaaaggaaattagtaatactaagccaaaactagccaatctgcagaccattcgatgggaaacaaacagctcacaatcttttgctgcccaatcagcatgctggggcagctgggctgacatggaaggtggtgattggatgcatgaaatatgctattggtttatttagtactaatgcttaaaagatcatatattctaaactaaaagtatttattttgtaatccatttaggaaaaatctatttctcataacttagcccagtcagtccagtcatagaaaattcacttttttttacatagagagtaatagaaggaaggtagaaccaccaattcgtcatagtcatatacatattggcattttaccttgctcaagccaaaggctacccgctaccctacctatttgccaaaacagcatgctatctacccaatccttcaatgccaaacattttgtcatgcccagatatcggttgtaaccaaatcttgatatggtttatcaaggctagcaatcaaacagtcaacacaactaaggtttggctatttcttccgcctagccaccgctgcaaattttggcatgactactgaccagggatggtggccagagggtgtgtgccccaacaggcccaggatcacatgctgtttaacaagccatctcaacttgtgtcacattgcatatgctgtaaggcaaagtgcgttgcctcaccatactgctgtagtaaacatgccatttaaataaaagtatgtaatgcagtatagcgtaattgctaatcttcgtacacataccatccatttctcatgttaatttttcatataggtaattcttttgtgatctatttcatctgtaaggaatgtttgatccttagcaaaacaaaaacaaaaggcatttttttaggaaagaaccaaaggtgaggtactaattttctaggcttgatttatatgcataagtaatagataacacaattatgtcagcacctacggttattattagagatactgttgctcgacgatactgttattttctcatcttgcattcttccgctaagtcagcctttatttattttagcaaactggattatagtaagtaaatgagtcgtccgattaatgagatacatcaaaagaaacaagttgcattacagtgacaacatgttcaaaattactgaagaacattgcgatatctctaagcttatacatatgaaatttgttatagctcagaactattttaaaagcttcactatgtgtaaactgcaaaatgctactaataaagcaatatgtgtgacaactgactattgcagtgttaaccacattaaactcagctcagcatatatacaaaaacaagcattcatcagagagagaagcaatcacctgatcccggtccctgtagcaaagaggagcacagtttgcgcctcatcgggcggatttatcctgctgatggggaacccattacccattatcgcgccaagctccagcacgtccccgtcgcggagcccacacagcttctccgccgtggtaccaggtacggtcttgaccaagaactcgaacgcggcacccccaggcggcgaggcgatggccatgaacgccggtttgagctcatcctcgccggggacgcggattaggagatactgccccggcgtggtgtaggatgcggcgaggtcggtagcgtcggagaggtccacggagaagtggacgagcgagccgtcggcggtggctgggccgaaggaggagacgggggcgggggtccagacggccgcatcctgctggacagcggcgaggcgacgggagcgcattcggcgccggaggaagggcagcgagcccattgcgggcacggcgaaggcatgaggggagggaaggagggggagggttgtgacggtgttggcgaccgcagccatggcgaccggtggcggtgggattcttgttgggagcaccctggtcgactggggatttgaggcgccgataaatctggaggggatagaatcatagaaatatagaatgatgaggtggggttcactggatggaaacacaaagataacgggtaggagccaattggttgtttggaacacgtggattatggggggggggggggggggggctatttgaaccgaattttttggtacagtgtttcaggttacagtacgttttgaatttggtcaaagtcaaactattttaaattttactacttttatagaaaaaaaatagtaatatttttacctcaagataaatttattataaaaattttttcaattgtatatttaataaaactatattgatgttataaatatataacatcccgaaaattaattattttctaattatgcatcatgttgattcttatattcttaataacctcctaaaccaaggacattataattataattagagggaactcctaaaactaagtcgcataaaacctctccttttatttaatttctttcgtatttttcatttaactagcaaaaatacccgtgcgttgcaatgggtaaaaacattctaatgaaaatatacgtttttcatgcataatcatgtcaatgacaatgttttattttaatgagcggcttgttttttataaacaatgtttttttcttgcgagattttctcaaaccatttttcagaaatggcgtatttctttctaacagttttttcctagcattttttttgctttttttactgacaaagaaaaccatatttttctcctttttttgcttttcttttctcgtttgtttttttgcctgttttctcgcacgtttttttgcttgttttttttcgaatgttctttttttcttttttctaatacaggagaatatatgacaaaataaaagccgtgtagtagatggcaaaaaatcgatgaatcctatccgactcaagtgtccatcaatttagcttttttctgatagtttttttagagcgatttattttttaatagacggtattttttcttgcgtggttttttaaaaccattttttagaaatggcatgttttttctgacagtttttcctcgcatgtttttttaaaatttttttaccgacgatggaaataatttttctcgcgtgtttttttatttttttattgaagatggaaaacctttttagcgtgtttttttgagctttttctgacttttgcctcacgcgtttttttaacctttttttctcgtgtattttctctttttttaatagttagattagattagagatagagaagagatatatacttgttagaaataggattttttccgccctttccaaattttttttcgcgtgcattttttattttatatgaaccagttttttattttttaagaaccatttttttcgccactttcttagggaatcggacgaacttttttagatgttttttcggatttttttcgcctttataggaattagacttttttttcctgtttttaaaggaatcggttctagccttttttttcaccacttttttttgccttttatatgaatcagatttttttttatttggatctacagtttttttggccacttaggggaaaaaaacttttgttatcgttgtttttctttattttcttttttgtgcggcttttctttttctttttatgcacctttctgcctttattttctctcttttattatttttttaacaaaaacgacctcaaataccttattgcaagattatagggactcaaatgtaaatataaaaattatagagactcaaatgcaaaagtacaaacccaaaaattaaaatcatataaaaatgaaatgatctcgacctgtaggttctattttttaaacagattttcagttcggctcatcaatttttttcaccaatccagagtcggactttttttcgtttctaaaagggaatggatataggagtcggacttttttattttttatttttcgctattgtttttgttttgacgggagtcggactttttttattttttttcgctattatttttgtttcgacgatgaagaaagcatctcttattttttttaagcagtagagaaatatatttggttaaattgaggtatttcttgatggaatcctacattaaaccttctttcgactaaaattcttttattgaaatttagtttgaaaaccctttctacttttatgaattatggtccaagaaaatcctccaattccaattttgaattaattgttgacccatcctttgattctaaacctatccttatccaaattcctcctttttatctagtcgccaatttaatttatgtggcttaatttcctcctcggttcaagaataacagtattataaatatcagaatgatttctcttgtgctaagaagaatagatttttattttattcctctcttccaaattaattccctattagccacaaatatttcttcaaatattcatactaccagtttccatctctcaaaattattgcactcaaataattaggaaatctctcttttgaaaactatttctaaaaataagttcatctcaaaagttagccacctaaatttcttccaaatattaatttggattcaaatttcatccttcaaatctaattcgaaaatacaaaaagattttttattcactgtgggccaaaaaatttcaatctagcccattccttttccccttcgcttggcccagagggcccaagaggcaggcgcctctctccctcctttgtgagcgcgcgtggtgcatgcaaacacgccgctgccttttcgccgagccgacgcgccatcgctgtgcggccttgttgctccttctccaccgctactgccaccgacgtcagccgccacctcacctcgctgacgtcaaccgctagccgaaccgactccatcgtccaatcggagacagagccgccgccgtgctcctcttctccacgccgccgtcgccatgtcgtccttctcctcctcctttacgaaccaacctctcgctgcctataaatagaaggcgagccctccccttttctccacacatcaacaaagcctcaagctcttcctctctctctctccccaccatggcaaccaccaccggccgccgtcgatctccttcaccagagacacgccggccaaaccctcgcgccataagctttgcctcgacgaggcaaatccattccccaaattcatctaaattcaaaatctacattttgatactaaatttactattttaatattttatttgaatatccaatttaaacatatatttacctttcaaatatttccctttatcccaaaatacctattagctactaaaaagccgccggttggaactttacgtcttccatggggacgttcatgcggtctacgggtcccgatgtcagatcattggttgtaaagcccggtagaaccaaacccaaggtttaagtgctgctcttggcaccccacgccttgatgcgtacagcggtcagagcttcactattcccttgacctccaccgcacgctgcacagttagctctcgggctctgtgtgatcctagccactccgccgccacccacggttgtcggagtaacacttccgccccgctaaacctgcaccaacctcctattcctctagccgatatgctatctgttgacaccaactagagaaaataccaaacctagtcgttatactgcccaactctagcaacgactagtaaacaaccaaaccctagccgatatgcttccctactccacaatcggcttaaatataaccaaaccccagacactatactacctaaacctatcaccagctaatactagccatatgcctacttagccagttcaattacctaatatactctgtatctccaaacaaccaaagcccatacataaaatgtaagcaacaatagttgcttaatcctctatccaacctagcctacaaccctttagaacctacatatgaaatataatccctatatcctatagaagagatagattataccctaaaccctagccctcctagttgtttatcgttctcttgttattttatggcttttattgaatttggttcttcctcttctttagtagaatctattatattttggatgacaacctgtgatatttcgaggatcggataatcaggttgcttatctcggatttatttgcgttggagcaaggcaagttattattccccccctttgagcataattgttgtcgtgacctaagggcatggacaaagttgggagatagaagggaaaatgtaatttcccgtctatcctaagagtgagctcaaaagacaaataccaaagtgaatgaatgtgctttttctatattcatctcctcccgtgcttacaggatcttggttggcttaaatagtgctcaaccgcatgtccaagatttacaagtttgtcattacaggcttacatgaagttaccattttacccctataaagtttatgacctataggggcattttggtacattctggtggtccctaaatgacatctggtgctagctggtgagagtggttgaggtggtccccatggtactttcccaaattagaccatttgctcaatggcacttttcctcaacttcatatgctcgagtgagatcacccgtgctaaggctcgaacacattctcccacctttcaggctccttgtcaccttaacctgcctgaaacacagcttcattaattagtgatgttagtttgagcaagtaactttactcgaatgctttttccttgggacagatcctttagggtgaatacatatatattcccatacctaaaactactttttgggtggaaacttcattcgagtcaataaataactcgaacacattttccttcttgacatatgttttcggccgggcatgggggatggtgtttaccacctgctacaacaagcccctcacgggtaagggcgaagtgttttcggccgaaaccgtgctagatcaaaaatgcaggggagtaaccgccgtccccctgttcggtcgaaaacatcattgagatagctgcggtggaactccgcatggcggggaatttgcatatttccatatcgctcggcactacacaaagcagaattctcagtttgaatgcatcaacttcatcgtcgcaattactttttagttttcgagctcgaatttgggtaaatgctttagagctttttttatgtcgtgttttcgagctaaggcaaaaaattgctcgaaaaccgccgtccccctaacgtttcaaaggagtgacgaggtcgaacgtgtttccctcgtcgcaattactttttagttttctagctcgaatttgggtaaatgctttcaagctttttttatgtcgtgttttcgagccaaggcaaaaccttgtttgaaaaccgccgtcccccttacgtttcaaaggagtgacgaggtcgaacgtgtttccctcgtcgcaattactttttagttttcgagctcgaatttgggtaaatgttttcaagcttttttttatgtcgtgttttcgagctaaggcaaaaccttgttcgaaaaccgccgtcccccttacgtttcaaaggagtgatgaggtcgaacgtgtttccctcgtcgcaattactttttagttttcgagctccaatttgggtaaatgctttcgagctttttttatgtcgtgttttcgagctaaggcaaaaaattgctcgaaaacccccgtcccccttacgtttcaaaggagtgacgaggtcgaacgtgtttccctcgtcgcaattactttttagttttcgagctcgaatttgggtaaatgctttcgagcttttttttatgtcgtgttttcgagctaaggcaaaaccttgttcgaaaaccgccgtcccccatacgtttcaatggagtgacgaggtcgaacgtgtttccctcgtcgcaattactttttagttttcgagctcgaatttgggtatatgctttcgagctttttttatgtcgtgttttcgagctaaggcaaaaccttgttcgaaaaccgccgtcccccttacgtttcaaa

SEQ ID NO: 54367 - DNA, 5835 bp, Oryza sativa
cgtgttttcgagttaaggcaaaactttgtttgaaaaccgccgtcccccttacgtttcaaaggagtgacgaggtcgaacgtgtttccctcatcgcaattactttttagttttcgagctcgatttgggtaaatgctttcgagcttttttttatgtcgtgttttcgagctaaggcaaaaccttggtcgaaaaccgccgtcccccttacgtttcaaaggagtgacgaggtcgaacgtgtttccctcgtcgcaattactatttagttttcgagctcgaatttgggtaaatactttcgagcttttttttatgtcgtgttttcgagctaaggcaaaaccttgttcgaaaaacgccgtcccccttacgtttcaaaggagtgacgaggtcgaacgtgtttccctcgtcacaattactttttagttttcgagctcgaatttgggtaaatgctttcgagcttccttttatgtcgtgttttgtcacgcccggaaattcactaataatttccaaactaatttgtgcataaaatcctcgtccagaaatcagccgaggtacacaaactgacaatttaatatacaaatccatcataataataacgttacatacttacaaaagaaaagaaaaacagcagcggaattaacggtctagcgatggcttcagctccactcccacaggcaactcaactggggtataagccaaacgtcttctccttctggatcccttttcttcaactgaggttgattgattattgcaagaatgagcatatgatatactcaacaagccacacagcaaatatgcaagtgcacaaggataccaaaggatggcataatatagtctcatttgcgaaagcagcatttagcaaagagttaagagtagtaaaacagtagagtaattaatcagaaattttaatcaacactgaacaacacacccatgctgcacaggcccaaccatcctgaacaaccatacccggctgtacagatctaactccaaaccaggagctaaacaaattattaccagttatagcatcaataattattgtgagaggcgtgagactaatcacgaaaaacattgctcaactcgcccataaccgcgggcacgactattcgaatagttttactctagccagaggtgtaccactgtacctacaagacacagcctcaacatcatgtctaccatgcgtcgcgatactggaaagtacccgaatagaggctgtgacaataccctctgcacaacacaactcaccacagtacaccattcctggatcataatcaccccttataaaacaaggcatggactccccagcgacccccgtgggcttatctccgccacttctcagtctggtgctccacaatgaaccatgctatacaaaaggtaaagccgttgcccacgctggcttgtggttggcacggttaatgtttcacaacagtagctcgcgaaccggtccttaattgccatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcatggctaagcaattatatatataacatttagctgaaccaaaccaatacataaggttcaagctaatcaatttattacccaaggtatcaaggaatagggcattcaatgcagattggccataacaaaggaataggttcacaccacccagtgacattcgaaaataaatgcacagttaaaataaatagagaatttaaatataggatcaacatgctcaaatgattgtgtttaggatctgtgtgacttgccttgcaataatcggtctcaattaatcttctgaacactcccgacgcactcacgaaccttcgcaatgacggaaacgacaagctaacacgcaaaacgaggaaaaagactaataaaaaccaaataaacagtacaaagatcatgattttagatgaatttagcaacttgaaccactcaaaaccgagttacgatgatttagttatgaatttccgaagatttaatctattaaaaaaaactgaaaaagaggagatgatgacgtcatgacgtcatcgacggcagccacggcacgggtggcgacctcgccggagctagggtggtcggccggacttttggaggacacatacgcgtagaggacaacattgcgaactcaatggtgctcaccgatacgacaaacgacgacggacgacggccggcggagaggaagagcggcggcgacgacttcggtcggcggtggcgccggagctgcggtggtcggcggcttcgggggtcaggcggccgggcttctccaccctcccgcgcacctaacggtggtgacggcgaccggcggcgacgacggaggcggcggcgcgacgcggatggaactcggccggcgacgatggcggggtggagcacgtggcggcggcgctacgaggcacgggagatcacgggagagggggcaaacgaaagaggaggactagggggtcctatttatagccttgggttgaatagatcggactcctcccgcaagaaatcgctccgggaaatcaaaaactcggttttggagataaactcaaaacgagttcgattcggataaaatactcaacgatttgctccgatttttgggggtaaggatagaggaagatgagaggataaaaacccctcaaaaaaaaacggaagaaaaggggagagattggggcggattcggcgcggcaaggcggctcggcatggcagccgactcggctcggctggcggctggagcttgaagacgcactgtagcgacagggaggaaaagtagacttcttgccgggcttttcttttctcagcctgattagaagagggagtaaaaccggactttggctgagagaagaagagaggatgcaggctcgggttgggccggcggaagagagaggaaggaaaggaatgggccgattcagcctaagacaagggagaggagaattttattacttttccaattaaaataatcacttaaatgatctttgaattgttaaaaatacttccaatgctcaaataatttcaagaaaaatcctgaaaatacttggacactcaaagtaaataaaaaattataattagaccatttaattattaattaaatatgtgggtaattactgaaatgttctttgtatgattaaaattaggaattgagctccgaaaaaatccgagataattccaaagagtataattaaccatgaagaatttaataaaaattaaatccatccatcctttatatttaggaaattttatttcccacatttaacttcacttgaaaattaatgaacatttaatataaattctaataataatttattaaatactttaaaaatcctaaaacgaaattcaggatgtgacatgttttcgagctaaggcaaaaccttgttcgaaaaccgccgtcccccttacgtttcaaaggagtgacgaggtcgaaagtgtttccctcgtcgcaattactttttagttttcgagctcgaatttgggtaaatgctttcgagcttttttttatgtcctgttttcgagctaaggcaaaaaattgctcgaaaaccaccgtcccccttacttttcaaaggagtgacgaggtcgaacgtgtttccctcgttgcaattactttttagttttcgagctcgaatttgggtaaatgctttcgagcttttttttatgtcatgttttcgagctaaggcaaaaccttgttcgaaaaccgccgtcccccttacgtttcaatggagtgacgaggtcgaacgtgtttccctcgtcgcaattactttttagttttcgagctcgaatttgggtaaatgctttcgagcttttttttatgtcgtgttttcgagctaaggcaaaaccttgttcgaaaaccgccgtcccccttacgtttcaaaggagtgacgaggtcgaacgtgtttcctcgtcgcaattaatttttagttttcgagctcgaatttgggtaaatgctttcgagctttttttttatgtcgatcaacataagcactgccaagtacctgtgaagaacgaacgagtacgacagcaattctcggatgggtgtagacctagccaattaagttatctagcaaaggtggtacctctctctatagtggttctatatttaagtccttgcacaggaggcaaacttatgccgagtagggcaatggtgatatttactgaggtacaagtaaatatttgatataaactgtgatatcacgaattatttgtaaaccctgattgcgatgacatggtgtcatacaatcagtcctctctaaagaccccgggaatgccagaactcctctcgctgctgataacatacgttcagagtgcatggggactagagttcatggaacaggtaccactgatgttagaaaccgaaaagctgggccgtgactaagctaatgaatattggcatgtcatggattgcgggtaaagcatatatctactgtagtatgaatattcttgaaactattcgaatacctatgctcacggatattgagcatagggactaactatggcatcttggttagaaacataattcaagattttattaaatactgttgcattccaaatattacaggctttctacttctataatctcaactttctgcaagtaaacctagccctactcaattacttctatttcatgaattcatatttgatataatagcttgctgagtacattgtactcacctttactttaaccccctctttcagaatcaatttagagtttttgccgaagccgggagttcaatcatataatcatataagttagtctcattccaacttagctcccaagtctagcataggtagatggtttaattctatagcaaaacattagggttgggtcatcctatagcttctgctatgttagttagccacaagcttgtaaataccctattatttatgtaaagaagtcaccttcggagccttattcaaatgtatgcaatgaagatccagattgttgaacctgtaccaatctactgatcttgggcttgatacagtctaaacatgtcagtttccgaattattagttttgggacccgacaaaatattattacttttttctacagaattagtcaaacatagagtattttgactttgaccaaagtcaaaatgtcttataacctaaaatggagggagtaattattatttaatgaattaaataaatggtaaatcatagtactatattggatttagagaaataataaggacgcagactgaatcagcgtttgtgggtatcaacgtccacaaggggacgttgttcttgcccacgtccatggtatctggtgcaacctgttatgaaacctatcttattgtggacgaattaaattatgagtgggaagcttactacagaagaaagctaacaccagaagctagcttacagaagaagctagcttacggcgcaagccagcttacagaggaagccagcttacaggagaagctagcttacggcgtaagctggcttacgacacaagccagaaggttcaaggcttacgatgcaagcctctaccctcctccgcctataaatagggcccagaaggtccaaggcaaggacaaccgatcttcggtctcctgcttctcctcttgtagcttgtactcaaatccagaagaaataaagcttccactcgcttatattttctgtgttccacagctctgtgtttatctgcttgtgtgctgatcagtagaataaactggtttctcaacacgttatcagcacgagactctatcgagctaaaaaggtaaaccagtgagaaatcagtttctactgatcatcttgctcttgatatgcaaa

SEQ ID NO: 54368 - DNA, 1717 bp, Oryza sativa
atcctctcagcaacacccagtaacatgatggcggcttctgccaccattaccgtccaaaggcttgagatggtacatccccttagcactattcgataacacgatggtggctctgctgccgttatcgcccaaatgctagaggtgatgtaggtgcctgaagcaccggcatggcaacttaatggacggctctgccgccgttgccaccaaatatcggaggcaaacgaaccttctgcacgaccctgaagtgtcgttatggatgtcctttgttttatggatatcacccatatgggcccttgacgcctctaaggtcagctctgccaccatgaagcgtgggcacaatatgcatgaagtgcccatgaatgctcttcattttgttttacatgcttactttgttgtttgcatgactttcataacatttattttattgttatgaaattgatttcctagcatgattgataatatttaatcaagcaatctgtaatcctgaagattacttaagttaatttgctaggaaagattctatgggaaattgtgtgataatcttgaagattacacacactagtaatcctgaagattacgcatgaccaattcatgttgaccctgcacatcgtatttacctgtcgtaaataccaaatgatgttgcaggacatgtcggacatagcaaagaaggaattcgccgagcttgccttggatggtagtaactacctcacttgggcattggacgttgagattaaactcgactccatgggtctcgatcatactattgtgctgcccgaagttggcactgtggagtctacgaaggccgagaaagcaaaggcattgcatttcttgcgccaccatctttacctagacctgaagtctgagtatatgatcgagaaagatccactggtattatggcaatccctgaaggatcgctttgaccagcaagggtcaattgtgctcccacaggcacaacatgactggatcaccctacgcttccaagactacaagtctgtggcggcgtataactctgcccaccataggatcatttctcagttgcatttatgtggcctgaagatcactgacgctgagatgatcgagaaaaccttatctacctttcatcccaacaacatagtgctgcaacagcaatacaggaactcaaagtacccgaagtactctgatcttatctcagtcctgttagttgcagaaaggcagaatgaggttcttctaaagaatcattctgctcgacccactaggtctatggtagtgcctgaagcacaagccaatgttgttggaaactcacatggccgtaaaagaggccatggtgagaagaaagggaaaggtaagggaagtatcatattcaagggcaagagtaagggtaacccagaggtaaaggcgaactcaagaaggttacaggtgaatcatctggggtaatgcaggataactgctatagatgtggaggcagagggcattggtcccgtaactgccatgtccccaagcacctggttgagctgtaccaacaaagcatgaatgagaaaaagagccaacatgagtcccacttcaccattgagcctgaagctcagattgaaaagcatgatgacatgcttatcaatgttaaggatggtggggacatccgtatggacgatgattgagacaaccttcttgaaaaagatgatgacatatttggagacctgaagtaatctcctatatgtcagtcatatgcagtgttcggcatgagtag

SEQ ID NO: 54369 - DNA, 7103 bp, Oryza sativa
aaatctcagccattcaatctaatctgcgatctaatctgggcgctcggtcttctcctttctcagccgccgccagatgcgcgctctttctccgcccagcatgcgcccacgcaagttgcactgtgggcccgccgtagatgcggattcccctcgcccaccgcgctcgcttctcttccacccccgtgcgtgtgcgcgagatgcggtgtggtcgattcccctcccccagcggctgcttcccccagcacgtgcaggcccaccagccggcttgctcgcttctcctccccgtgtcgcattgcctccgccgtcccccacgcgccagccacaccgcagcgttgcgcccctgtagccctagcctggcacggctgcaggtatcgcgcgtttgaagagccctagcaccatgccagcttcaaacgccccctccctcatcctcttcagcattagagacggtattcacttcctcccttaatcacccgcatttacaataaaaaccgccaaattaattgggtgaggaggcgtagtggttaatacaagttatgtgctctactccctgcaacaattttactcaagatcgtcgtatcgcctactcatggccctgtataaaacggccggcctctccagttctacatccgtcatggtctctctttgaattcctctcctctcatattcacaacaggcaagttaaatctggctctcagaaccataaacagatattcggatcatgcgagtgtgagaatgtcttgctgtttattctttgcagttgcatatgttgaggctgctatgataattttcttcttcttgatgcagcgttcacattgggaatttgggttaccgtaccatatcctgcacattgcttcttcttcagtatcaaggttggtccactcccactgtgtttcttccgttacttctgcatcacctttttgcttacatacatatatattatattgctgaaaatagttaacccccaatttttattgatccaataatggttaatggtttatggatatgtatttgggctatgtgcgaagggaatgaattcaggtacgtatctgatagtttcagagatttgatggttacgacttaggagcatggtgaaatctgaatcactatttttttttctaaacaagctgctctaggtttgttgacccccctgttcacaagtttgggttgcttagtgcagattgcaattgctgtcaggcaatgctaatttcagcttgaagttttgtttataactaatggccaagtaaagttgttggttgctgaattttcacactaatctttaagttttacatggttagataacatatacatgctcatctctttgttttgaatcatattgagtcaaataaatcttatgtttttggtgcttcctgtgtcatgagtgcaagtcactgaaacagctctgagaaattaaagtttatggtggaataaacatgataaaggtgagcctttttctaaaatcatattagcatttcatgaacgattcgacaaaaccaatttctaggggtctaagatgtgtccggaattggtccttcaaaattgtttgtacttttctgtgggcatgattttataagacttagagttgtttggtctgatcgaattccttggcacatttcagtagctaagtgtaatttgttattacgtgctttactctaattgtgtcctaacaaaaaaacatgtaagagcatgaatggctaattgtttttcagttgaaggtgatgtatccatcaaagaacaaaacgtccttcggtgaccaactaaatgttaaaaatatgctggccctatctctcggaggtgcctcatagagttagagtgtgcatatgtgcctttatagggataagtgtgtgtgtatatgagtttgtatctttttgttgttgtccaattttttttcttgatcctttgacaacaagatacatgttttagggactgttaggtttcactgaattaaaagatcggaatttcacttaccccaaatcaaacactgaatttgaggaggcgtgcagtagactccaacctaacctgaagcaggagagaggaatagtaagcaataagcgagtgaacaaaatatgcacaagggtttaacatttccctttattaagcagagaagatatttaattgttgtactagattacgagtgtgtacgtactgttgaaacatttggtagcgagtatttaagtttgctatatcgattctctctttttctctctacctatggaattagtttattttacatgtagcatattatcttctcttaaaacatcatccatacgaatttcatccaaattatttttacaaaatcccgcagcaacgcgcggggtattcatctagtttcatttatgtttatgttccataaacatacttgggtgggtatcccatggcagaagaggatatatgtctactagacagtgccaccactaatacaatcttaagggaaactagatatttccacaccttaactaagaaaactggaaatattatgaccattgccggaagcaatgctcatatagtaggcaccggaagtgctactctagttctccctatgggtacccatatctttgtaaaggatgctctattgtatcctgattcaaagcgtaccctcttaagctttaaagatatccgtgcaaacggtttccatatagaaaccgagattgagcaagatgttgaatatcttctcataaccaaaatagatggatatcaaaagcaagtggtggaaaggctcccttcatcgccattgggtttgtactacacgtacataaaacccactgaggaatatgttgcgatgaaaaccatatttagaagcccagagtcatttagagtttggcatgacagactgggtcatcctgggttgggtatgatgaggagaatcatcaataattctactggccacaatgttgaaaccaaagacttccctaatcctgaagattttatttgccctgcttgtgcaaaagggaagttgatcattaggccatccctcctgaagattagggatgtgtcacctgttttcctggaaaggatacagggtgacatatgtggacctatccagcccctgtcaggcccgtttaggtatttcatggtactgattgatgcttttaccaggtggagccatgtggacctgttgtccataaggaaccatgctttttcaaagctaattgcccaaatcatcaggctaaaagctagcttccctgatagccgcgtacaatccattcaaatggataatgctggtgagttcaggtcgaaggcttttgatgattattgtttagccatgggcattaaggtagaatattcagtaccacatatccacactcaaaatagcctagctgagtccttgatcaagaggatcaagttgattgcacggccactgttgcaggattgtaggctgccaaccaattgttggggccatgctgtgttgcatgcagcaacactaattcaactcaggccaactacatatcatagtacatccccccttcagctagtgcgtggaaaagaaccaagtatttcccatctgcgtaaattcggctgtgcagtatatgtgccgatcccaccaccacagcgtacttctatgggaccccaccggaagttggggatatacgttggttatgagactttgtccataatcaagtatcttgagcctatgactggggatcttcataaggctcggtacgctgattgtatctttgatgaggaccatttcccagcattagggggagaaaggcatccagaagaatgccaagatataatatggaatgcaactgcgatacagtccttagatccacgcactagtgaagctgaactggaagttcagagaatcataaatttgcaaaatcttgcaaataagttgccagatgccttcactgattacaagggagtgacaaggtcgctatacctgcagtaaatgctccaaaaagagtagaggtaacccataaggttactgactatgctcttacctcccatcctaggaagagggggagacctctgggtgctcgggacaaggttccgcggagacgtccgcggagacaaggatctgagccacttgttccactcaaagaatcagttgaagaagctcaacctgaagttgagaaagccccataagtggcaactcaacctgaaggacactatcctgaagatggaggacccagtgccttacgcgtgcaccttggcactggaagatcggaacaccccaactcggtcgttatgggaaatcacgacaagttggaggaaataaatgaggagatttccactaactatgctgatacaggagagttacatcatagaaagaccactattgtcgacattcactttgcctcaaaggttgccgtcataatggatccggatccagaactaaagtccatgattgagtgctagaagcgctcagattgggacaaatggaaagcatcaatagaggcaaggatgcgctcgctttataaaagagaggtttttgggcctgcagtcccaacacctccaagaatcatccctgtaggatgcaaatgggtcttcctccggaagaggaatggccaggtggtgaggtataaagcgaggctagtggcacaagggttcacgcagagaccggtattgactatgatgaaacttactctcctgtgatgagtggaatcacgtttcgatacttgatctcaatggcaactaatataaacttggatatgcagttgatggatgtagtgactgcatacttgtatggatcactagattcagaaatttatatgagggtccctgaaggactcaagattctgaatccgaaaagaaattgcaacatgtatagtgttcgcctgcagcgatcattatacggattgaaacaatgatgattgtccctgtgtgttcataaagaaatccctgaatggattttgtatcatctcagtctatgtcgatgatcttaatatcattggcaccacagaggacattaaagaagcaatggcttatcttaagaccgagtttgagatgaaggacttggggaaaaccaagttctacttgggctgctgctcgagcatctccctgaaggagtgtttatgcaccagtctacctataccaagagggtccttggtaagttcaatatggataaatgtcatcctttgaaaacccccatggtggtccaatccctggaagcagataaggacccatttaaacccaaggaagatgatgaggaaatgttgggacccgaagttccctacttaagcgccattggagcactaatgtatctagccaattgcacgagacctgatattgcttttgcagttaatctattggctagatatagtgcaaccccaaacagaagacattggattggcgtcaaaactatcctcaagtaccttcgaggtactcaagatcttgggttgtggttcccgaagaaccaagatccatccatggtgggatatgtggatgctggctatatgtctgatcctcataatgccagatcccaaactgggtttgtatttctttgtggtaatactaccatttcctgacggtctataaagcagaccctggttgcaacgtcaaccaaccactcagaaataattgctctatatgaggccacacgagaatgtgtgtggcttaggcggatgatcggttacatccagaagtcatgtggcctaaatattgataacacccccaccattatctatgaggataatgctgcttgtgttgcacaagtacatatgggctatgtgaaaagcaatttcacaaagcatattgctcccaaattcttttatccccatgagctccagaagagcggggagataaatgtcctacaaactaagtcatgcgaaaatctcgcagatttatttacgaagtctctgccagcatcaaatttttacaaatatgttcgtggcattggcatgagacgacttagtgaattgcaaggatcagggggagcaaacaattaagagaatagcccatgattgtgatcctgaagaatcacaaacaagtcctgaagacttgaccaactgttgtactctttttcccttggtgagtttttttttcccattgggtttttctcacaaaaggtttttaacgaggcaacaggtgcaacacaatattcagagtgccatgtactcttttctcctaccattttttcccactgggtttttgggaggagattttgatgaggcatgtgcataattcaaattcgtccaaggggtagtgttatgaaacctatcttattgtggacgaattaaattatgagtgggaagcttactacagaagaaagcttacaccagaggccagcttacaggagaagctagcttacggcgtaagccggcttacgacgcaagccagaaggttcaaggcttacgatgcaagcctctaccctcctccgcctataaatagggcccagaaggtccaaggcgaggacaaccgatcttcagtctcctgcctctcctcttgtagcttgtactcaaatacagaagaaataaagcttccactcgcttatattttctatgttccacagctctgtgtttatctgcttgtgtgttgatcagtagaataaactggtttctcaacacaacccaccatactagcccgagccaaaagggaaccaaacatacatagcgagacaccgccgtggcgcgtcgtcgtcaatctctcgcagtatcgctcccctcgactcccaccgtttcagcttataagatgttttgactttggtgaaagtcaaactacttcaagtttgaccaagtttatagaaaaaaatagtaatattttcgaaccaagataaatttattataaaaatatatttaattactaatttaataaaactaatttggtaatgtaaatatttcaatatttgtctataaatttcgtcgcacttaaagcaatttaacttttgtcatggttacggataagtcatacctcctatcctacgacttatggaatatacgagtatggtataccttcacgtgcacgggttgtgtaacatcctgacaacaataaaaataactaaaatttcgaactttttaaaacttttgcatcatgctagatgttatggttgctattgcttgccaaactataaattgtcacaatgaaacattaaattaaagatgtacaatttgcaagaatacgctatctatcgattccataaatattatgcacaaggcagaaagctaaat

SEQ ID NO: 54370 - DNA, 11213 bp, Oryza sativa
atgctagaatgacttacaatgtgaaacggagggagtaatttctattggataaattacaaatcaaatattaaatattcaaaccatgtttgattatttaacaaatggaaacagtaagattaaatcgaattcatctgaatccaatctcacatgaaataatgaccacctcattacactaatcccattataaaagagtgtttcgctagaatatttaaataaatatttaaaacactttatcaagtctctcagggcataaaattcattcatataaaataaacggtcgtgtaaagtaatggagcaacacaccatcactatgtctacttagattattttaataaactcctaagatatatcaacgcccccaaaattgtctaggctaatatttgggattaaacctaatttaaataatgcaatggaaatataattgtgccatcacaacttttgagtaaaatctagatttttggatattaaatgttaaattaggtttcctggcaaatttacagattaacccttcctttttcccttatcctttctcttctctttctttttcttttcctggcgcaactgttcatgggccgccaggtgctcgatcaagttgtggcccaaaccgactgagccagccacgcccgtgtctgcccacatccatcccgcacgcgcgcagccgtgcgccaacccaactccacccgcgccgcttctatgtgccgcgcctccctcccctcgcgcctcatccctccgcatccgcgctcgcgcccggacgccgcgcacgcgaccgaccatgccacctctgcaataataggcgctttgttttttgtgccggggaggagggttcccaacccctcctcccgaacacaactttagccgcgtcaacttccctaacctagaccgtagacagccatcgagtgcgccagccgccgattttatcctccatgccattctggcttatccctaagccaagccccataaaaaccccctttctctctgtcttttgccctcaaatacatttcatcgagcaccttctatgcatgatctcaccgctactagagaccaccattgaggggctccccggccggagctggaggttggaggaaatggaggcggagcgacgctgccgctgtcgccgttggggaggttggacgtcaaggaacgctgacgaacactttcgggcgccatcaacgctgtttgcctctgtgccgcgacacaccgagccctactccgccgcgtttcgccgtctcgccttctcacggtacaccctcgcgcacgtagcatcctctaaccctctaatagctagcgccagctccaattttgccaactagtacctgtggccgtgccggcctggccgccattgcgccgtcggtgaggtcgccgtgacaagccatcccgggaactcccctctccatctagctggtgaaatcgaatccccataccccgtagatgttcacgctcccatcaattttgttggatcctagccctagcaccctatccccttgcaacccgagctcgggccatggcgtgtccatgctgcgccactcgccctctctccgccacgcgccgctgccgcagtcggtgggtcgctcgagctcgccgcaccttcctcggccgccgccgtgccggcctcgcgccaacccggccgcgcccagccgcatcctccctcgctacttccgctcagtcgggaggttgaagacgacctccagccgagccactgacgagccgtctccactcctcctatttcctttggaaaattaattatatgaaaaagaaaatcaaagctttgaccccacatgtcagcagctgttagggataaggatatattttggattaaaaataaatgaattatgaacagtgcctttttacaatttctcggattaattcaaatttgaatctttacctagcataacttattcattttaactcggatttgagtgaaacttgaacctaaattcataagctttccaatggtatatactccctccgtttcacaatgtaagtcattctagcatttctcacattcatattgatactaatgaatctagacatatatatctatctagattcattaacatcaatacgaatatgggaaatgttagaatgacttacattgtgaaatggaggaagtaattcactatttaataaaatatatttataattataaataattaatatcatatgattaggttatggtcaacttaaaaatatgctaataaatagaattggtattgtacagtagagtaaatgtaataatatttgtttctagcatgttttgtcacagtagcaaccatgtaaattaagtataagtgatgtctcaaatgaatggatgtataggacaatattagtacttatttaatattcaatggccatataattaaacccatgacttataggttatttaaagcaagtttagccttgtgattatgtaaataaaatatgaatacacatagatgagtctttgacttgtttatgcgaaatgataacagagctagtgtgattaaatcatctataaggaattaattacttaatgtcacgccccatggagtagtatcttttaagttggtaatcaatctcaagttaataaacagtaccaactcgccaaatccacctacatcacatatactgtatagcttacagtaaatagctcatgctcagtaaatatctaatattagtatgtcattgcactcacaactactgtacagtccatttaaatcatacacaagaacaataactaaggagtctatgataaacgtgtatagtagataaatactaattataaatcttgacctcacacaattgtagttcaaccgtgacttagaattatttattgtaaaattatgcaatgagataatctttaactacactattatggaccacactaatctaacctgcggagcacggtaatttgttggccggtcagaccggctagggcatgccagtcagaccgccactatgtggccggtctgaccgcccctggtcaggctgatcacatacaagtgtatgaaagtgagttttagcactagtctaaatgcacaatgacctaatgtggcaatttaaatcatctctttgctaggtcattacccctcttaatagtacagtaaagctataaataaactagcataattttgatcgcccaacgccttgatcaaattaaaatgaaaacactagtttaccgtcttctcttccttttgctttgcgccgtcaattttaatccatcggtagacatccatgcgcacacataatgtgaacctaacttaaaatatatagctcaatagaacggttagtccagaattagcgcttgtcattaattaccaaaaattagcaccaggggcctagatgcttcacccctgttttgactctgacttatacaagtaatatataaactattagcatagttttctcttatcaatcttcccttgggattaaataaatacgatacattggaatactttcgggtgaaatgctacaatggtatatctatgcgcttgcggttcatatttgtaatcgtattatactaggaatatttctgtgccattgctgggaattatatttctagtaatatcgttaagaaatacttatccagggtctactggccgtggaagtctatgtcggtcttctttgtttaggacggtactaaacggtgggttatgccacgatcttgacttttccgggtacctttccggtacttctattcatggctaattgatattgtcaccacaacaagctgtttttgagaaacctgaaggcacagaggatcggcaccttaagccattatatgttaaggcttttgttaatgggaaacccatgtccaagatgctggttgatggaggagcagctgtaaacttggtgccatatacaactttcagaaaactgggtaaagctccagaggacttgatcaaaaaaatatggtgttgaaggactttgggggaattctttagaaacaaagggagttttgaatatggagttgaccatcggcagcaagacaatttcaaccacatttttttgtcattgataggaagggttcatatagcgtgttgctggggagagattggatccatgctaattgttgcattccttatactatgcaccagagtttgatttaatggcaggcagaccaaatagagattgtgccagccaacaggtcagtaactgttgctaatgttgatctatctgtttgggagatggaaggagttgatttcttgttaggaaagatttgggaaggagattatctaaaagtgtctggttgtggtatacaaccagttggagatggagagccccagcttttactttgaaggcatcgtggagggatcaaatttctacaccaaggacagaggagatgatttagatggcaagctaggttaagggtttatgttggccaatgagttagaggaagttcatattagaccaggtgataggcctaggccgacatatattagtgcaaaattattagatgtatttaaaaagaaatagtggaattattgaaagaatacagagattgttttgcttggtaataatatgagatgccagggtgatgagcaccaggctgtgaacgccctgatttttccctctctttcacggtaccaatcagcaaacaaaatataattcaagtggcaacaaaaattcaataatagataactggcttcagcttacaatgtattgcactccaaaccctagataaatattccatctacccgtgcttgaataaacacgatcagaaaggagaggaacctgtggtaccgagtagtgcaaccagggacgaaagaatcacctggactcgctcttcttccaaaccaaccagcggcaagatcttcagtaggaaacatatgggagcgctgtctataccttcagcaggggttaaaccctagaccaaccaaaacaataaccaatctaatctaaattacatgaccacttggcctatttatatgcacaagggcatactggactagtcctaatcgaagcccatgaacatgcactccgggcttgctcgatcaaagcccaaacaaaccaaaataaacccagtataattaatctaattaatgcaactaggtaatgatgccactaatgacagtaattagctaacacctaataggagcccacactgataagaaataaatatgaaacctatgccagctttatctcaaccagcatagagccaattttaacaattcgattcagcttcaactgtttactttcattattctctgttttatcttgcttcacaagaacagcatagaaccagcagtggtcttggttagggatggcaacgggtcgggtcaggcacgggcagagagaaaccaggcccggcccgagacccacgtgcccgtgcccgacccacgcccgcaaagcatatcgggcaaaatcccatacccatgcccatgcccgtcgggcacgggcatgcccgacggatacccactgggcttgcctgccatgctccgccgtgccgccggccgccgctcgtgcgccgccgcgtcgccggtcaccgctcgggccgccgcgttgctagccgccgcctgcgccgccgtccgcgctcgtgggccgctgcggagccagccgcgcgccagccgcctcccgccctcgtgcaccgcctcatcgccaaccactgccccgccacccgcctcaccccagccgccgcccgcgctcgtgcaccaccatgtcgctaggcactgcccagccgccagccacctcgtcgccagccatcgccgcaccgccacgccgcgctgccagccgcctcctggttatttcccctgcgccgccgccgcgtagaaccgatagaagattgagaggttgggtttgggagaaggataatgctagggttttgagtgaatgtatatattgttgtatgcaaatgggccaaacgggctattgggccatgaggggaggttaaactattgaggaataagttcatctgagatccctgaacttgtcaacgaggcatgaccgcatgaaggatatacatgggctaaaagattttcgggtcgggcatggattatccacggacgaaatataaaacccacacgtgcccactaagttcacgggtatcgggtcagacgtgcccacgggcaaaaaaaggtgcccatgcctgtgcccatcgggccgggtatctgcggatacccgaacccatgggcaatactgccatccctagtcttggtcacatcacaggacttagccgatctatagttgaacatcagttgtctattaaaccaggatatcgaccattcaaacaaccctagagacgatttgagtctgacatgtatgatcctattagggctgaaataacaagactttatgatgccaaattcattaggccatgctgatatgctgaatagatttccaatatagtgccaatgatcaagaaaaatgggaaacttagggtatgtgttgatttcagagatttgaacaaagctactcctaaggatgaataccccatgccgattgcaaatttactagttgatgcagcttcaggatataagattataagttttatggatggtaatgcaggatataatcaaaattttatggcagaagaagacattcacaagactgctttcaggtgtcctggtgcaatcggcttgtatgagtgggttgtgatgacttttcgtctaaagagtgcaactgctgcgtatcaacgtgcaatgaattatatatttcatgttctgatcgacttgctggttgaaatttatatcgatgatgtggttgtgaaatcaaagtagattgttgcacatctagcccatttgcgccaagtgttggagagaacaaggaaatatggtttgaagatgaatcgaaataaatgtgcatttggtgtatcgtatggacaatttcttggatttttggttcatgggaggggaatagagataactcaaagaagcttgaaagctatcaaaaatatcgaacctccagtgaataaaaagaaactacaatccttgatcggcaagatcaattttgtaagaagattcatctccaatttatcaaggaaattagaaccatttactacattgttgaggattaaagccgatcaagaatttgtttggggggagaagcgcgacagagagctttagatagtattaaggaatatttgagttcttctctagtcttgattccaccatagaaaggagtaacctactagctgtatttatcagctgatgaaaaaacaatcggctcagtgttaatccaggagtttgaaggcaaggaaagagctatattttatcttagtagaaggattttggatgctgaaacaaggtataccccagtggaaaaattgtgcttaagtttgtatttttcatgtaaaaagtagaggcattatctacattcaaatgagtgcacggtgatttgcaaagccaatgttgtcatatatatgctatcggctcctgtgtggaagggaaggattggaaagtggattttagctttgacagaatttgatctaatatatgaatcggccaaagctgtaaaaggatgggcaatagccgatttcattgtggagcagtgaaatgattcaattggtacattaaattagtgccttcgactttatttcttgatagattagttcgcactcatggttgtgttatcggcttagtaattatactgcctcggggggggggggggggagggagggcaagttttgagtttgctttcacaattataccatattatactaacaatcaagcagaatatgaggcaattttgaagggattacagttgttgaaggaagttgaaggtgacgctattgaaattatgggtgattcattattggtgatcaatcaattatgagagtatgaatgcaagaatgatgtcttgagagtttataatgtgaaatatcacgagttgatgaaggagttcaagatggtttctatgaagcatattcccaaggaacataatgttgaagccaatgatctagctcaagtgcatctgcatacaagcgatgttaaaagatatagagattgaaattgctgctatacaagtcgatgattggaggtacggaatttttgagtatttaaaaaatccttctcaataagcttcaaggaaattgaaatacaaggctctcaaatatgtgatattggatgatgatttgttttatcagatgattgatggagttttgctcaagtgcttcaaattagaagccaaagttgttatgtgtgaggtacatgaaggaatttgtggaactcatcaatcggctcataagatgaagtggtcgattaggagagttgggtatttttgtccgacaatgctagaggattgtttcagatattacaaaggatgtcaagattatcaaaagtttgggtcaattcagaggacacctgcatcggctatgaactcaataatcaagccatggccgctcagaggatggggaattgatatgatcgtccagataaatccaccatcaagcaaaggacataaatttattttggtggctacagattacttaccaagtgggttgaagcaattccattaaagaaggttgattctagagatgtgtggacccccgtttttataacaggaatcaatcgtgtaaacagtaccattttcctggatcaagtagtctggtacacacgagttaatagctgaaataccaaatgcacatacacgaaagtctagtatgaattattacatcaaaagcccgcaggcatagtcttaaatcctcggaccgagcggtccggaatacattccaaaaacagaagtagataaggcagcggagttaaggcagtggcacgccattgccacaggcaacgaccataactaagacctactgagcgccatcgtcttcatcaccctcctagtagtaagagtagggatcctccgaagcttcatctccgacctctgattaagtttgtatattgcaagggtgagtaccaaccgtactcaacaagccaccacaacaacaatgcacatgacaggggtattcaaaggatggctatggttcttttgcgcaaagcaagttttataattcttttcacaaacctaagacctagcacacactgatcaaattttagtaccagtgttcatattaaacaatgacggttctgaccaccatccattgtgatcccaaggatagcttcccgccattgagtcatcatggttttctgaggacgtccacattcccgcctctcaggaagtggctccatcagtatagaaatcatcatgcaatatcccatcccacacaagttaagaatttagagtctagccaagtgtaatacatgtctcggtgctcaataaccgcgagcacggctattcgaatagatttggtttactcacactgcgtgaatgtacactttacccgcactccgcgactgcccaacacatgagcctcatcccaacacatgagacgcgtcatggcaaagcttttcgataaccttgcattggcagtacccgctccatgaactttacatcctcatgcactctaggcgtacacggtttctagcagtgagaggagttctggcgcacccgggaagggaagactcacacatgcattaagttataattatgtttagattctcacatggcagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgtacggaggtcgtttcatgcttaacttcatggctcggtccttaattgaccggggacggtactagccttttccggataccacccaaatcctccgtccgccccagtcgaaaacagttgtttaattttatttctcctttcacaactcatgtcatcaacatcatggcaatgtggcgctcatgtctccacatgccgcatctcaattacattcccaaaggtaattgcccaagcatatagcatttgataaatatgagtatgcatgattctagaatagcatctctaagcatttgtcattgttgactagggactcatacgtaatcatggttacaagggaataagggtaaacaataatcaaggtatggcatattcacaaataggatgttcatcattgcatgcattcttatttgtaaataaaataattttgcaattgggatcaacatgttcaagggatagtgatgacttgccttgctcaaagtcttgcgggtcttgaccttcgcttgtatccgcaactccctcgggctctataattacgtgtgaagaaacgatttgaattcggttagaattcaaataaagatccaagtaaatccaagaagatatcaagcgcggaagtcggtttcttacattatctattttcgttcgtgaaatagagctactccgtttgtttaactctatccatccccaaactattttgtggcataattattttattagcacaagtttttaatttaatccgcccgggtattacatccatataataggttagaaatttctatcgcgagctaaatatcggacaaaatcctaaaattatcttataatattgtacgatttaatttagtctatgactaaacgattaaatataatacacggctaaaatcctagtaattaaatccgaatttctaccgtgaatcgatgacttatagagattaccaaaaataatctataagaaatcatctaattgtttagttattaattacatctaaattactaccaattttaatctaatccgatcaagaaacctatttctataattaacccggaattttgatcgaaatactattacactctaggaatttccaaaaataatctatgattaaccccgaccatttttttatttcctaaatcctcctaatctctcccctaatttctcttctattttctccttttcttcttttctattttctttttctttctctttctctcttttcttttcttttctttttccttctctttctctcttttcttttctttttccttccctttctctcttttcttttctttttccttctctttctctcttttcttttctttttccttctctttctctccatcggcttctcccttcctctctctctcttggctcttgctcacctgggtggcgatggcggtggatgcgaggggggggggggagacggcgcaccggcggtggcggtggcgacgatggcgacggcggcgcaagtcgcggcacggcgcggcggcctcgcggcggcggcgcggcggcttcgaaggcggcggcccggcggcacgacgacggcggcgcgtggagaagggggagagggagaggagggaatggagt

SEQ ID NO: 54371 - DNA, 2397 bp, Oryza sativa
  unsure (1)..(2397): unsure at all n locations
cggcgcggcaggcggcgatggcgacacgcgcgcggcgacgggatggcggcgcggcgcggcagcggcgaagagacggcgcgcggcgcgtggggcgcgaggcggcgggcgcgcggcgcgaggcgtgacggcgacgggcgcgcggcgatgggacgtcgacggtgatggatggcgacggcggctcggggcgcgaggcgcggcgacacgacggcgacggcgacagcggcgatggcgtcggcgcgcggcggcagacggcaacgacgcagggcggcgacgcgacgggcggcggcgacgcggagctcaagaccggctagggcgcagaggtgggagaggagggggaaggctagggaccgcatcgaacacctacgccataatgaacaatgtattttcctatttatcccaattttagtttatttcctatataaatttgattctataatttctaaatcttgcataaatgaagtttgctcaatacgtgtattatcccaaccaatggatccactctagattaattgtacccatattttatttttatataatttacttgattttaattagagttaattctcattccgtcgtatttagatttaattaatacaaatatgatcgcgataatattttattcgtttctatccctacctcaacctttattttaaattatatttcagttatttattttgctcatttaattttaggttttattcctaattaattattctttattcgcgatcaacaaactccgaattcaaaatccaatgaaataggcgaataaaatcggcatgatgcaatttattttaaaaagtttttgaaggcccatatttttagagtttagatttttgtcggtcgaatttccagggtgttacaagatgctattgagtttgtcaaggaacatattatatatagatttgggataccacaaacaatcaccacatatcaaggatctatgtttgtgtcaatgaaattgttcaatttgctgagagcatgggcataaagttgttgaattcttctcctgattatacacaagctattggacagacagaggcatgtaacaagagtttgatcaagttggtgaaaaggaagattattgaacaacctaaaacgtggcatattgcattagctgagtctttgtggtcctattagatagcatgtcatgtatctatacaagtccctccctattaatcttgagggttatcaccacctctatacccacctctataccgaactgtggaataagcagcaaatacaggtactcaatagcatatacaccacgtctacactatttaatactactctaatgccgatcaaacattaaagtaaacactatttctagtgaacaatattccagtacgctaataggaactaagagataatcctcacaaagtgaatctcaattactcaataaagatattatcaattaaagcagagtaattgacaaggtacaaaagtaagaggaaattacggacaactccgaaatttctccaactctttctcacttactctctccttattctaatgtacataaaagatacaatagtgcatcttataattcagttcatacttggtgtgtgttggaatgaaggaggtgaggggtatttataggtgtaggtgccttgggagtatggagatcctccatggaatcctgacgacatcttcactcccctcttgcaatccgtcctcgtaatgatggttggagcaccgaaaactgtgacaatcgtcattgggacgtcggtagtaactgccgatgaaatttggggccgaacaggccagttttgggttcggctgaacccttgctgggccatttggccctgaattttctccaggatcatggcaggaaggcccttaatctagtggcatagtgattgggcccacatgtatttcgttggacttatgggcccaagactccataggcttggatatgaatgtaattcttcctctcctttatgtatatttcttctcaactttgatggttgagaatttattgttagaaataaaccctaccactatgttggatgttttatactttcagatttatgcaggtattgactgtgtgaatttggtatttaatagccatcaacaacaacccactcatacaggccgatggcaccaggacacctgaaaagcagtctaatggatgtcttcttcagccataaaaatttgattatatcctgcattaccatccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54372 - DNA, 749 bp, Oryza sativa
aatgctttcaagctttttttatgtcgtgtttcgagccaagccaaaaccttgtttgaaaaccgccgtcccccttacgtttcaaaggagtgacgaggtcgaacgtgtttccctcgtcgcaattactttttagttttcgagctcgaatttgggtaaatgttttcaagcttttttttatgtcgtgttttcgagctaaggcaaaaccttgttcgaaaaccgccgtcccccttacgtttcaaaggagtgatgaggtcgaacgtgtttccctcgtcgcaattactttttagttttcgagctccaatttgggtaaatgctttcgagctttttttatgtcgtgttttcgagctaaggcaaaaaattgctcgaaaacccccgtcccccttacgtttcaaaggagtgacgaggtcgaacgtgtttccctcgtcgcaattactttttagttttcgagctcgaatttgggtaaatgctttcgagcttttttttatgtcgtgttttcgagctaaggcaaaaccttgttcgaaaaccgccgtcccccatatgtttcaaaggagtgacgaggtcgaacgtgtttccctcgtcgcaattactttttagttttcgagctcgaatttgggtatatgctttcgagcttctttttatgtcgtgttttcgagctaaggtaaaaccttgttcgaaaaccgccgtcccccttacgtttcaaaggagtgacgaggtcgaacgtgtttccctcgtcgcaattactttttagtttt

SEQ ID NO: 54373 - DNA, 915 bp, Oryza sativa
cctgcagcccgataatatgatatcatgatagcaacatgcttgggcccttcatttctccattggtgcatctcctaccaactcgccatgaggttttggccgtttgtacgcgcaagcatttcgatgccgaatcacgagctgatcagcctgggagtacgctttccggcaagcatcagggaaaaccaagccgtataagttaaaaccgagcgcccagctgaacctgacccagagattcacatgacgatcgacgagatccatccatcgctagaacattcgattgcaaatattttgggcggttggtttaagtttacccgtgcacaggcaaggaaagcttgtgggtctcaacttcgacttttgtgtacacacacagccatggatggcacatatactcactctcaacctgttgccaacacaagcacagttccctattatactatattcagtcaagagtgaaggacactcagcccattttagaacctcagagattttaagaagtagctgagacaaatatgaaaaagctgagttctcagcttttaactttcagtttattttctaaaattcatacccataaaggttctaggaatctagactaattcgaagctaaagattttctaaaaaagctacaactgcaagaaattaccatgtaaacaaacaagacgtcactctgcactgtaggctcccagtagatgatacagtccctcatgtgatcgttaaactagttcagagcccagaatccggagttctgggattaataacaacaagccaaaatctcataacacagcaagtgtgcagcgcagctgcaggccatggccatatacaaaaaccaaataccaaagcatcaccagggccggatgcctagctttggcagcagcaagtcacactccgtaggcagcagtagcaaaataaccaatatactag

SEQ ID NO: 54374 - DNA, 2483 bp, Oryza sativa
cacagccacgctaagatcattccagtccaacgtaggaagagcagatgcatatatggtctcttcatctcctcgacctagctagctgcttctgttaactactgagaggagttagcaagctatagctaatcaagagtgtgctggttttgttcgattctgcagggtaatgtgctgctaatgtaatcagtttaagatgctcacatgatgcaccaagacatgacctaagctagctacctttgttgctttgcattctgccgttattttcggcaacttattgacgtggattattaattgcatagaattgtttaagaagttgtgttgttgatgcttaccctgcagtgtcctgggagagacgatagatatgaaggttgatccgatggggaaactgttgttcttgcttgcatggattactctcttgcaaggtaataataccagttcttttaactattcctttgccctgtttaattagcttgcaagtgcagtatcatgtcacaccaattgtagaggttttcatatatgctttggaactttactgagcgtcacggtcatgtacttaaattattatatatcactatactctgttgtaaatcgttactgagatatataaattaagctacttctgaatttgtctgcaggttgctgcatggtgaaatccttttcttacgactactcatcaagcattgaggcaagtcgttctctaatatgatctgtaactgttagtcgtagtacacactgtacactagctagtacttcatctgctacatgttatcgacgaatgtatcgttggccggcctaaggcatcgacagaaattaattatattcctgcttagattagcgagcaattaatctcgcgattaacaattaaaagctagctcgattgggatgacaatagctatatcacgggcgggagtggcggcgcgatatgttaattattacgattatcggcctcacgcaatgcgtttccggtgcgagttagcatggaatttctttcttaatttgcccgtacgtacactatatgcttttcagtaccatgcacgatagcggcggcggcggccggcgcagcgtgtcatgtaagctagctccaaacaaaatgcacacatcattaatcatttatcattatttggtttttttgactataatatatactctctcattccctaaatgtttgacgctgttgacttttttaaacatgtttgaccattcgtcttatttaaaaacttttataaaaatatgtaaaactatatgtatacataaaattatatttaacaatgaattaaatgataggaaaaaaataataattacttaaattttttgaataagacgaacggtcaaacatgtttaaaaaaatcaacggcgtcaaacatttaggaatggaggaagtatatatcaatatatgtagttatatgcaccttttctctttggtccattcttgtgctcttcatcattttattttcttattgtcattagtttgatgatcacgtttaggtatgcttcagatgtgtctgcagagcaagcaaagcatctctatgttgccgagattagagcagcatgcacttttatgcatgcttagacaaattaataaagttaattaattaattatggcgtctgagtgtgtgggcttgttcggtacagtgcttgcctgagccgccggagccccagtacggcggcggcgtcgtccggaacgccgacttcagcgctggcctccatggctggtcggccttcgggtacggcagcctcgccgagggctcgtcgccggcggggaacaggtacgccgtggcgacgaaccggacgcggccgtaccagagcgtcagccagaaggtcctcctccagaacgacacgcactacaccctctcaggtctggtggtcaagaaatcgaacgtgtgaaattaatgtgtagccgtcacgtctcactttgtggttttccatgtgcatgcaatttgggactgagacgtcgcgtactacgtgcgtgtgcggtgcagcgtggttgcaggtgagcgacggtgtcgccgacgtgcgggtggtcgtcaaggccgccggcgacttcatccacgccggcggcgtcgccgccaagtccggctgctggtccatgctcaagggcggcctcaccaccgtctccggcggccgcgccgagatctacttcgaggtaactaattaatcactttcactccgagttgatttaattctttgcaaatactacggagtacatgcgaacgtgacgcgtgcttgcgtgcagagcaacgcgacggcggacatatgggtggacagcgtgtcgctgaagccgttcaccaaggaggagtggagcaaccaccgcgacgcgtcggcgagcacggcgaggaggaagacggtgaggctccaggcgacggactccgccgggaacccgctgccgggcgccgccgtgtcgctggagaacgtccgcaacggcttccccctcggcgccgccatgagcggcgagatcctgcgcaacccgtcgtaccagcggtggttcg

SEQ ID NO: 54375 - DNA, 22320 bp, Oryza sativa
ccgggtcgacgctcatgttcatgaacgagtacaacacgctggagcagccgggcgacatggcggcgctgccggcgaggtacgtgcagcggctgaaacagatcatcggcgggtacccgcagaacggcgccggcatggccatcggcctcgagggccacttcaccgcgccggtcaacatcccctacatgcgcgccgccctggacaccctcgcgcaggccggcgtccccgtgtggctcaccgaggtcgacgtcggcggcggcgcgtcgcaggcgtactacctggaggagatcctccgggaggcgtacgcgcacccggcggtgcagggcgtcatcctgtgggcggcgtggcggccgcagggctgctacgtcatgtgcctcaccgacaacgacttcaacaacctgccgcagggcgacgtcgtcgaccgcctcatcaccgagtggagcacggcgccgcgcgccggcacgacggacgccgagggcttcttccaggccgagctcgcgcacggcgagtacaaggtcaccgtcacccacccgtcgctcaacacctccgtgtcgcagagcgtcaaggttgaaatgggatcagggagccactacttcatccaggtctaagctctagctcatcactcatcagctagacagctacccgatgatttcattcagggctttggaaatgatcatactggtcattcatgcccgttagctgtatctcttcatagtatcaagatgcatgtgtagtcgaaattctgcagcttaaatagcctaatagtacccatattagccattcatgattcatgtaccaattttactctgaaaaattgcagctgaattgaaatggagctacacaaaagggaaaaatatagcctaatagtacccatattagccattatgctaaacttttggagtctcttgtactcatttccagttattctttctttctcgctgaaggatttcagcaggtttgctgtagcttggacggccgatccttttcccatggccattagcgtatgattgtttttctatcgagatgacatcatctccggtcatgattctgacttctgttacatttaatcaccaacaaagagtatactatttcaaattgaatcatgatcctataaaaaaaatagaaaaatgatgtcatccggaagcaaacaagcgaagtcacgagcagaacacggacaaaacaaaaggcacagcacacccaaacttccaaactgagttgccatgtcgcgttcaatccacacaccacaactacgggagacatgacgtaaacacaatatatactggagataatctagtgatttttatattaaaatccattacaatcaatatttcttttagcttgcataggcatgctagtgtaatctaccatagaatgaactgtagtgtagcaatcgaagttcacgtgatactgtaagggcattgacattgaaacaggaagctgacaccttctgattcagaatatgaaaaagaaaagcacaaacaacaacctatattctggtacagcacctaactaagcaagaagccagatagataacaaagggactagtatttgatggtaccaattttatgaggtcaacaagttgtcaccaagcttcaacaaagccaaacttgccgagcaccgctgtcgtttcctgccttgaactgcatttgaataatgtgtaaaacatcccatcagtacattgtgtaaaaaaacagacccatctctcgattttccaagggattcaaacggagttttgaataattggcatcactgttattgctcttaccttccatctctcaatatcttgtagactcctggtgttattaggtccacaattgttgaaccagcacgcccagaagggaggattccaccatcaaagacatatgaacaatgtggccacagatcctcaaaatctttgacgttgacactactaggatgcccgcttaagttggcgcttgtaagtgcaagcgcacttccagcaccacgggaaatggctcgaatgaaatcaaaatctggcacacgaactccaatgctttccaaaccaggattaagagatctctccaatatactgttgttacctaaatgtaaatgaatgaagagttttattagacacattatgctgcttaagaaaggtgcaagatagaagttttgaagcataggctggtgtccacacctcgttttaaaacaactgtgacaggcccaggaagtagactatcaagcaggccatgaggtaggtgatccacaacagcaaaccgtgatatgtctgggacatcagcaacacagattgcaagaggccgtgtctgtacgcgtcctttgatctcatatatacgattaactgcttctgcagagctgtcatgaagattgagagacccattttaaaaataaccaatggatgaatgcagccaaccagtcagagaatctccaaaaaagtaaacctagcttaaaatgaacaaagtcacgaaacattgcttccaaatctaaatgaaagtgagattcaatagtaactaatgaaagtttctgaactgtttgtgaatattttttgtacatgactaatttagatatgagcacacaaactcctcataactagaatctggatttactgatcagagtttcttttcaggggttggccttgttagacatctactcacatcattgcagaaggtgttaaattggagttaacatgagaacaataggacaacaaagcaaatgagaagaataaaattcttggcacaaaatgtacttttagtaaaactaaccatgcatcacaagcaaagccataaatcgtatcggtgggcaccgcaatcacttgccccctgttaattgagtcaattgctttcatgacatgatcatttgttgctggaaggatgtgttctgccgtggcttctattcggtgtgtcttgtcatctgacacccttaccgagcaggataccacagacttcgtctcatgttgagatgataatctgttgaccttaacaaaactgagaaaaacaagtgtgtcagtgcagtaatctgaataaacattttaaccaaagaaatacacagttctcccatgtgccaaaagagatttccatacagtatgaaattttacatagcaattaacaagtgtgctgaacaagataatatatacatcaagtctcaaggaaccatgtcaaattgagagcatcactcaattgcattaacatatatatgaaaaatttgggagaaccacggatggaatttgtgtataaaccccaaagttcctcattactattgcaccacagtccttagcaaaccaagaaagccccaaatttgttgaagaaaaataaaaaatcttatgtgcagatacaatttacagtaagtagcattgtgaagtcggtactctgattatagcaaattcaatcatcaaaacatcctagatgttcacttcttaccattagtattaaaagacaattcgcggggattatcccacatgaaaaggtattatacaagataattcaattaaatatacaaacactatctccttttgaatgaattggatgaaaaacaagagtacaaacacaagtcgtttgggcgaagtaaataagtagtagccagtaattcaacgtccgtggaacaatgtcaagattctagaattagaattactagcatgagaagtgcaaattctagcctttttcacaaataaataaaagatgtttgaacaaacgaaagcttagtatatttctagggagcgagcaaacaagaacccagagtaacgaagaggggatacctccgagccaggggttgcctggcgggagcaccgaccagggggagcctctcccccgctgccctcgcgcacgccttcatctccctcctcctcctcctcctcctctcccccgccgccggccaccgcgaaagattacgagccgcggagcgcgacgccgaggcggccggagcaaaatttctcccggagagagaggactagtcaaaccactaaacaaaaagacggttttactgtatatcatccgagcccgacgcggggaaagggtctctgcctcagtgtctcacagacaggtgggccccaccccgctcctgccttctaggaggggctgttccgcgaggaggcgtaaagtggaggggctcttttgcaaaaagataacggaattgctatccttccgtcgatagaaaatactacatccccaaatcttcgggattttggatcactgaatgtgcttcgtgattcgtgctcagttgtttcttttccaactccggcgtcctcctcttcttctccggcaccggcgacagggaagacagctgcgcgggacagctcgccgccactggcttgaggaaaaggagaggagagggagggggagggggactcgccggcaccgttgacagttgacacctttcggccagccggcgaggccggggtggcggcacggtggggcgtcggcggcgcaggaagcgcgcggtgtcgagactcgagaggaggagcgctcgagcgctttgtgcggcggcagggaggaaaaaggaaaagtggtttagggttttgtggattttgcacgaatctcaaaccaattcaatggtctaaaatttgcaagatattaggaggggttttctatcaaagattaaaaaataaactcccccttcgcttctcgctagggtttaagccggcggcggcggcgaggttgtgcagatggcggaggcggccgtgaggtgcctccgggacgggcgcctcgacggggagcacgctccggcacttgccgtggcgagtaatatccagtgcggcccgctcgccgccggcgccatgctccacctcgcggccgccgtggcctccaacgccgccgcggggaaggcgcaggcgaggtattattgttgggcttcttcgatggtttgctgctttagctcggggtggtatgggcgatgacgtgagttggctccgttgcgacttgttgtggcgcaggggactggtgatcgtggcgttcgatcggagcccggaggtgtatctcgacttcatgcggcgccgcggccttgatccaaatgctttgaatcgatggtaatggtcttaacatttcagagcttacaatttgaacacaactgccacttaacaattatgatcttaactgcaaaaccagagctttgcgtatctgaagaaatttattatgctagtgcgacctctttggcaaatctaaaatttaaataggctaagttggcacctcacactcacagccacctatagggaaatgcttgagtcaacagtattcactcatattgtcaacatagcttattgatggtagaacctacataaatactgagtgctcagtaagttttagaatctttttacattgttccaacagtgtacggatattggattgctattcagacccaattggatggaatcagaagattagaagtcagcagcaacaagaaagtggtgcagatctctgctcagcgaacaaagagaatgttacaattttcagaaatgtgaaggatcttgataaattgatgtgctccactattgatcttggaagaggtagaagctttttgactagctacttgtctctctttgtgatcttaaagcttatgctgttgctatgaataccagggtttgcaggagaaggcaaaatctatttttcaattgctgttgactcagtaagtaccttctcggagacgtctctatcttatagtttacttggagtttggatctcccatcaataaaattttaccccatatgttgcaattatgccaaagcttgcttcatgtttttctagacatgttcctcttataatgctgtatcaattgttgtcaagctgttctaatttggttgctgtggctggtgagtttattgaatcttgagctactggattagaaatgttccatctcaacaacaaaaaaaattgtttgttggactgtcttgcttagatctggaaataaagttaagcttgcacttttccagaaaccaagtttagtgttttctgtattgtattgtagctattgttcagcaagctgtcatttcagtacgtttggatggtatctgaaagccaaagcatgatctcacttttctccccatctgtataacaccaatatttcacacacaagtcacaagctttccaccatttgtgtcttaccatatgataagttgacattgattactctttgaaacaaaatcatctttactttaattctgaagttactttcactttcgtgatactgttttagcttttgttaatgttaacagcaagatcgtgtatgatatttcagattagttctatgttaaggcgtgcttcagtgtcatcaatttcaagcttcctcagtaatcttcggagccatggtatttactttctttccttctatttgcgtattcatggcagttggaagttggaactcaatgccaatcatttgtattaatgatgttttgcttgtacgtaacaatgatgtgttgttattcacttgatccttgaagtataaatttgtgttctcatattgcagatcaaatatcatcaatattttggctaatacattctgatctccatgaacccaaattttcccgagcctttgaatgtctctctaccatggttgcttcattagagccagctgtggttgattctgtttatgaggaagaaattccagggaatatttctttcctggaggaaaattattctaaagcaaagttttatttacgcctaaaacggcggaatggacgggtcaagcaccttgtaaggttttgacttcaatgttcaaatcattctgaatttcacgtcatgaagagtgtacactgataaatattattcctacattttcagtacgaggagttacatgttgagggaaatgatgttagatttgtttctgctccttctgtaagtacagaagtgagccaaagtctgttgcctaaggttgggctatacatttcttactcaagttaaaatactcttctgtcttcactgccaactaatctagtcttctcaacattgactgtattgcaacatgtggatttaacaggttcagttcaatcttgagctgtcagagaaggagtgcagtgacaaggcaaatgttgttcttccttttgaacatcaaggtacttaccttaccggaagttatttgccaaaagttagcttatgtttcaggtctccttgtcagctgcattctgactgcatgagctacatggatgatatatctgcaactaaattcttttaacaccctaatctcaggaaagggtgagcctatccatatatacgacggacggagatctctcccagaggctcaacaagatagcaatttaactgcatccgctctcctggatgaagtaaaatttcctaaatctgcagctccaaagggtgaaattcattactttcgtgattctgatgatgagcaacctgactccgatgaagacccagatgacgatttggatatttgagttccacccatggtgtgagcaccttatctgcatacagaatgccttgatcgtacttgcgaggtaaccgatagccccgatcagaacttataatcatgagtagtattagtatttgttacacctctgttttctgttctttacactgatggtagtgtttttgtgacaagataatagaatgatagtccgtccgtgctacacactaccttgtactgttagtgcatgcattcagttatccccaaaatgtttaaaaagtgtttacatatgcaaaacagcaacaaactacaatttcttggggaaactaaaatggaagcaggcgaccttttttttccctttattaaaggatggtagacaaggaaagtttttatgagaactatgtaccgtgctgattaaattctctcatcacagagtccttacaagttacaaatgaaatgtaagcattggatctacgtatatatataaaaaagttactagaatcactaaaaaaaatggaaggaaatgaagtgacaatgcaattagcctagaactagaaaaaatagcaacattgtgaccaaggaaacgactgctgatccagtgggcagcaaagtctagggcgctcctacaattcaaactaaatcatatcatattaattagtacgtaccggatctgagctcgattttggcctctgccttggagtcgaggtcgagggtcatgcagttctccttgaactccttgtgcttgacggtggcattgtactcgccgtggaagatctccacctcgaggacgcccttggagtcggtcttgccggtgtggccggccgtccactccttgaggagcttgtcgatggcgtcgccgacggggaggttcttgaagctgttgtctgtgaagcacatgacgtagcatcccttggcgtgccacgccccccagagcacgatgcccttgacggccgggtgcgcgaacccttcgcgcatcacctcatccaggtactccacctggttcttgcagggcttgacgtccacctcggtgagccagatgggcaccttggcctgcgccagcgtgtcgatggagccacgcatgtaggggatgttcggcgcggcgaagtggctctcgaggccgatgccgtacttgaggtcggcgttgcccgggaactcgcggatctgcttgagcttggccacgtacttggtcggcagcggcgccgcgtcgttgggctcctcgatggtgttgaactcgttcatgaagaggatgggcttgctgtcgagcttggccacgtccctgaagatctccgccgacgcgtccttgccgagcttgccctcgaagaagttgaagtggaggttctcgttgacgacgtcccagtggatcaccttgccggcgtagcgggtgacgatgtccttgagccgcttcgccatggcctccttgagctccggcacgcccagcttctccacccagtccatctgcttgtcctggtcgtcccagaacacgttgtggccgcgcagcgtgatgttgtgcttctccgcgagctccaccatcttgtccgaaaccttgtagtcctcctcgttctggtggaactccgtgctgtaccacttcatctcgttctccagggtcgcgtaccggaaccgcgccgcgaaccacttctcgtactccggcatgtccaggatctccttggtcatcgcgttccccagcgggaaccccttccccacccgctccaggctcacgtccgcttccggcaccggcttgccgtcggggcccaccaccgtgatcttcaccttcttcatcctctcctgtgtcaattgccaattaattccaccatcagtcaatgttactcttctccagctctctgattaattcttcagcatcagcagcaacgacatgatgcaatcgagttcatggtgcatatatatgcaccttcttgacggactccgcgcgatggcccttccattcgtcgaagctgaagggctgcagcgccatcccttccgccatcacctccgccgtcacgttggtctgcatgcacacaaaatacgctgttcattcccgttcattcctctatccgacttaaacagctagctgctcccttcgtcccaaaatataattgattttcggcagatgtgatatatcttaatactataaatctgaataagctctctcatcagatttacagtatagaatgtgtcacatccaacaaaaacctcttatattttagaacggagggagtatgatctactctcgtcgcgtggctgatgacctcgaagaagatgtcgcccttgccgtcgtcgtaggaggtggcgccgcccttgagcatggtccagcagccgcacttggccgcgatcatgccggcggtgttgaacttgccgtcgggggtcaccagcacggccctgatgtcgccttcccccttggagagctgcagccacactgcgtatgcatgcgcacgacgatcaagatcagagcgaaagagatcatcggtctaggagtcggctagccggcggccgttaccggacaaggcgtagtggtggtccttcttgaggtcgaccttgagggcggagcccttcaccggagcggcgctcttgctattctccgacagaagcttcttgccgctggcataccccttagcctcggtctccttcaggataccgccgccgtacagaggcttctccggctccttcacgcactgcacgcaaatatttgcacttcaagaatcgatctcgtcctttctcattgcatatcatagtgtacataagtgaggacgaagaatgtaacccggcaaaaagaggacgaagaatgtatgtgtcacttgcctcaatgtttgctgagtagtcatatggaacactttgagatctgaccaagcatcctgcattcgttgacaagagaggcgattaggcattagcatcttgatcttgatcatatatatatatacgcaggcgtatacggatttgacaacggcaaaaaaaattaaatgctaactgaagttctctgaaactgaaacggctggaagtctgaaacatgtttctagtcacatggccaagtgccaagtctgtgtgattacgacaactgatggatttcaataaaacagtaatttaaacagtagcacatcacattgtttgcaattgaaaggaaaatgcaaattgaagcgatctaattgaaagacccctaaccttcgaagaggataatggccaagaaaaagaccaacttccctgtgaaaaccttcatatatatttctctatcactgactacgattaatccgtgacataatgttgacatttctgcttatatagctatgggatgagagaacatcggagatttaacagtctataaataggaggaagacagtttcacatgtagggaggtaattaatccacaatgtttagtgccttaaaaatacattcagtttagaggatcaccattgatttccctagctttagctgcactccaactagtggttctgctttgtacttgatactccatagaaaccactagagtttaacagtttaatcgttggctttagcaacaaaaaaaaaattataggtaaggactcttatatcaagtatccttagctctttaaaagctaatgttagaaaataaactatgataataaaaactcaaattaactctagtttcgaaatttaaattttggctgataagccgattggaaaacgatggtgcggcaaaaatggactctcttaagttttaggatgagcctaaaatccatttagcatttctcgtcgtctttctatacgatgatgggaaacaagaacatgcagggtagactagtctcaatcaagagaagtatgtatataaagaagaacaaatggaatttcttcttccttttaatatgaacatccaatcaatcgcctctccaggaatgataaatcaatccatgggcgcatatgaaatcacacacaacaatcatgcacatggatacgtatacattgagctaataaattgagctaatagctagctagacgtgtatggtgaactcgttgtcggactccctgtcgacgctgaggctctgcgccacggtggagttcgccgccgggtgggtgacggtgaccttgtagtccccgtggaacagctcggtctcgtagtagccgtcggcgtcggcgacgccgacgtgggagcgcgtcttccactcccagatgagcttgtcgacgacgtcgccggcggggaggttcttgaagttgttgtcggtgaggcacatgacgtagcatccctgcgggtgccacgccgtccagaggatgatgccgtgcaccgccgggtgggcgtacacctcccggaggatctgctcgaggtggcgcgcctggtcgggccccggcgcgacgtcgatctcggtgagccagatgggcgcgttggcctgcgccatggtgtcgagcgcggcgcggatgtaagggatgttgggttgcgcgctgaagtggccctcgaggccgatgcccatccgggcggcgttgccgttccccgggaacgccttgatctgccacagcttgcggaggtacttgccggggagcaccgtcaggtcgcccggctgctccagcgtgttgaactcgttcatggacatgagcgcgccgccgtccatctggtgcgccttgcggtagaacgccgccgacgcctcccacccgaaccggccctcgaagaagtcgaagtggaggttctcgttcaccacgtcccacgcgatcacctgcccggagtaccgcgacatcaccgacttgatccgcttctccgtggcgcggcggagctgctcgccggagagcgccttcacccaccccatctgcgtgctcgggtcgtcccagaagatgttgtgcccgcgcaccgcgatgccgtggctcttggcgaaccggagcatcgcgtcgggcaccgagtagtcctcccgccccgggatcgcctccgtgctgtaccacttcatctcgttctcgaacgtggtcaccgtgaaccgcgacgtgaaccaccgctggtaccccgggttggtcaggatctccttgctcatcgccgaccccagagggaagccgttgcggacgtgctcgatgtgcatccgcgcgccggcgaccgggttgcctgcggcgtccctcgcctggagccgcaccgtcttcttcctcgccttcttgatggccgccccgtggtgcgcgctccactcctccctcgagaacggctgcagcgacacgttgtccacccatatgtccaccgtcgcgttgctctgccatggcatcacaccattgcatccccgtctcgtcagaaacagagtaatcttgaattcttgattgctatggcgatgagatcgatcgattcgtttacctcgaagtagagttcagcctgcccggcggcggcggcggtgagcccgcccttgagaatggaccagcacccggacctcgcctcgacgccgccggagtggatgaagtcgccgccggccgtcttcacaacggctctcacgtcggcgatcccgtcactaacctgcaaccaagctgcacacgagaccgagcacaaagcttccatgagctaccggaaacaacacggcgaaggaagaacaagacggcggtggttcttgtcgccggacggacctgagagggtgtagtgcgtgtcgtcctggaggagcaccttctggctgacgctctggtacggccgcgtccggttcgttgccacggcgtacctgttccccgccggcgacgagcccacggcgaggctgccgtacccgaaggccgaccagccctggagtccggcgctgaagtcgccgttgcggatgatgccgccaccgtagtgagcgtccatcggctcaggcaagcactgcagtccatagcttcattgttcagctaaacaaattttaccgaaggtaacaaaatagtaatagttgttcactgtggggaaactattctaatctctcgaggggatgttccctcgtttgcttaaaaaccatctaaacggttatgaaaaattctgaaaaaatttgacaacattcatacaacgcatatatgcaactctacaaaatcttaagtccaaactcaactcacacgtcgagatataaaaaagacaaattcagcgtatgaatagtagcgtactgtttatatctaaatttgtcttttttgtttctcgatgtgtagatcgaatttgaacatgaattttggtggactagtaggtatcattatactctatattgttaattttttttcagaatttttcacaattatttgcatcgaatttgaaagaaaaaggtatatgaggggatatcccctcgagggattagaatccactcccgttcactgtgataaaggaaatttgtacagtaatcaagattaacgaaatacactgttcataaatcatttgcacaagaaaatgtaaaaacttcagagaaatgttacagaagcagtggtggtttacactttacagcgtggtaataaccgtcaaaactaccaaaggatcctgtcaagatcacagtaaaaggtaatactaccaaaaggttatgtacggttcagacttcagaactgtacctatcaagatattagtagcagtaaccgtcgaccaaactagcatgagaacggtatggacatgccagattttgtttggtacggtatcacccaggccaaagccaaaacctacacatatttggtcttccacttgggtgcggtaactaattctgaccacaagctgaacctatcacaacaaaattctttgacctgccttcaaaagtcccaagtgacggcacctatatgtctaaccctgcagctaacataagactacccaaagaaaaaagttcagaaaagacaatggttaaagctaattactcgggaacagtacaaagctacttgtttggaagcatttgactttcctatcctggccgggcagtttcactgtgcagggtgatgagacagtcagaacagaggacaacacagacaacatcttcaccaaccaactaatcaagtaccaggagaaaagttagcatcagcgcatgatttgcccaatacagcgtgtggcggacaatggggtacacacgccctcctgctcgccgttcgccggaaaaaagctacccctgcaaactccggcacgctttgaccggctccatgatcaagctgctcctggtgctcataacgattctttccaataaaaaagatcgtgttcacaacaagcacagataggtgcgtgattgggtcgggtgcgttgcacgatgggttctcagttaggctaactgcagcatgtacagttcaaagacgggagttttgttaggctcgaattgaagtggtaaagaagaccgatttggaagtttggattggatggtgaagggttgaaacgatcgagccagaccgatagatggacgtgtgtggtgaggttctccaagttcggtgtacgaggaactaacttttggtttttttctgtggcaactggctcggttttgggaggcttttgaagaggctttcggttcttggtgtgctcctcacagattttttttttcttttgttaagtgaggtatcttgcagctgaaacatgcaagatttcatctccctcatgcttgtttggtctgtttccaccatctaccagatgatcaatggttaattaaacttcagtcatattcttgctcctaattgtagcttcgttcacattagcactaaacatgtcagggaggccctgcctacgcaaacccaacatgcagaaggtctcgatggtgactggtgagtggggtgaggccggcaaagatcacacaaaggcaactgcaacaacaagaaggaaaaaaatattccggcatatgtatgcatggcccgcatagcgcgcccacacttgtgtcacctgtcagtaacaaatcggctcgcccaactaacgacggccggtgttagctgcacatactacgcttgcatgatcaaaaggcaggtcgatcgaattagtgcaatctgatctctgctggctcagccaactagggaagcaactaagcaatcttaatcatagtattaatttgttgcactggtctgagcagatcgaggttgtgtgcaagcagcagtcaacagcagctggtggtaccatgttccagtggggtccaataactatgtgaccaacagaggttctgcatgacgcatgagctgtgggagagtgcgacgcaaagaacgaccatgctcacattggtaccatgaagcatggatttgacgatgataatggtgagagagaacgagagagagaggctgcatacctcagagcttgacgagtagtcgtaagcaagcggtcgcgccatgccagaagccgcctcagcagctggtgaaatgaaagaaacgcgagcttctttaacttaactatcctaagaacaagattgcaagaacatgcaaagaaggagagatcgagctccatgaccatgaatctgctacgtacccttcaccacgccggcgacgagccacgccaacaagaacacagcgcttgccctcctcctcatggctgaatcccgcccggctccctcccctgcccctcctccggcaagaaaaaaacccacgatgtttcgcacaagcgagagggaaagagagagaggtgcagcgagcgcgcgagagatgttgtaagctaagctaggcaggcgcgccaactgcaccgtcgtctgtgcatgccacggcgtctgcgtgggctcccacatttataggcgaggcagagagaactaccggtgtttgcctgtggctacatgctcccgcccgcgtcgcgtctcgcgttgcttgttggttgatgttggaacggaaaacgactcgatggcctcacccacgatgggatcgatcgatcgctgacgcgagcgcggctgcaatgccgtgccgtacgtgcatatggggttgcgacggcgggcgggcgggcgcggcagtttcgctgcggctgcgagagcgggcgagccatatgccagtggctgcgcactaacgaactcactctgactcgcttctgcggttcgctcgcctttttgaccatccacggctcgaccgagttcaacggacgcgcgctgtgtgtctactgtctctgtctagctccacttatctcgaccgcggccatccatgcggtcgacttggtgcaaagctagtagtgttcggttcaacgttcggtatactagggacgaagaacatgggagtgttaattaaacggtttgctaaaaatatgacggcacaattttcattcaatttcggtcactttttttcttcatatttgattgttctccattctatatgtatgcttctggtatctctcgtatatgctcttccaagcatataataaactaatacatccatcttaaaatgtaaaaaacttgagttagacacgtgtattaaggaaatatgtggagttaaataggaaaaggttgtgattgattgaaaataaaatgtaggtggagaaattaaattggacaaaattgtgattgattgagaatataatatagataaaaaagttataatattttagaataaattttaaatgctaaagttgtattttcaaatagatggagtacttttaatcctaacctttatgtatacataatttattagaaaagttacaatgtaaatatcatttacaatataattataatataaatgtaagtattttacaatataagaatggtttaactatttcttagaaatgtggtgtaataaatatactccctaattaatttgtttgaaagaggggtaattttaatcggaaaaatcaattgcaaaaggaaaaacacatcagaagaagaagaaaaaaacacatcgtaaacgtacaagcacataaaaaacctaatgtgctattggatgttttaaagagttacttccttgtttattgtcggtaagttttccaaactgctaagtttgatttgaaaataaggtacgataggttatgtttatcttgttttttataagatggtctatatatatgattggcataagggatgaaatggttgtattttttgataaatgagagggtgtggctcatatgtccatgagagaaagtgggttggattggtatattaattttgaggtatgaagctgacccgaatctaaagagaatatttattttatgggccatttcatttcatgtgtccttaactaaacatcccgaggaatatattcgctccaacctgattgatcccatccctccaaccaaacatgagcttaacgtctttttaacgtcttttgtgaaaacttcatacatcaaagttagttttctaaatttgtaataattactattcaattagttatgctctaatgactcatattgttttgcgtgtaagcgataagcctcagcccatccctccatctcgaacggagccttgtcacaggtgagatccgacggcatggggtgtgctgtaaatggacttctcccacaactcgaggctaaagagggcgccccggtggttaacaaacggccgggccggttgccgatgtgcgcaagcgctcatcatgcaaagctcccgtcgtgtggcacgcgatgccacgagacgaggacgaggccacgaggggcgttgcgcgatgacgcgcggctgctggctctcgcgcgcgtacgttggtgttccgtgggggcagctgcaacgacgtacggctggcccaggcctcggctacgtgccacggtgccagttgccacacagtagccgatctggttgataaacaaccatttgcgttccgagattagttcggcttagctccaatcaccgagttgatccggttgattaagccttttttgcgtcccgtgaacaaactgcctttgctatactaaataaatgatgagcagtggccgtatggacacacatgatagcttcagtgccactcttttgaaacggtgcgaaattttgagaaattttcacctttgtatagctactagtgtttgacactagttcagttggggcgaacaggggcaacatcagaacagagtacaatggccacgttaatgaccgagggtaatgtgtggggtgttcgatctccgacgtccatatcaccgtacgaaaccgcgcctgaagagagagagagagagagagatcaccaaaatcatcctgcggatcgtgccatgacgcgcgcgtggatacctgcgcttttgtcaacgcaacagcgacgtccccctccccgtccccggcatcccaccgatccagcagcgcacgccgccgcatcgatcgcccaataatctcctctgcttcacttcactcctacgcctctcatctcatctccttgccaatatgcaaatccctcagctcgcaacccgtacgcgcggttcacacttcacatgcaggtctgctccacgaaacacgcgaagaagaaaaagaaaagaagaggatttcctcgccgtttgtgccgtggaggcttttcgcgaccggattagtttctctctctctctctctctctctctctctctctctctctctctgtttttttttcttttttccgtgtcgtgttcgtgcgggcgagcgagcgagcgagcgggtgcgcccgtgccgttgcgaaatcttggacgaatgcacgcgtgagtcgctgaaaatggttgattggttgcaaacgccgcgcacgtaagggagactacacatggcggtgagctattggttggcttctgtggctaccagactgctgctgggattcgtggccatggattcgttcctcgtctgcagcccagacctgccgttaagttcggtacaggcgttgtcgcgttgaacggagggaagcagtttacagaaagtttctacgcgtagtagtgctcgagtcgaagtctagttgagtccgaccgactcgagatgtaagtcgaagaattcgacaagcttgggttcgaccgtcaggccgtgaaaaaaaaaacgatcgaaaaccgcaagatttcaaagtttagatgtgtgatgaaagcagatcccgagtaaaactgtaaatagtattcgaaaattcaaatttgaaacagcaaattcgaccaaaacctgatcaaaatttggtgaaaaaattataccaacatgggttgggaattcggacctggtgctaaatcgaaaagatgaacctggccggatgtacttccttcgccccataaaaaactaatctaataccggatatgaaatattctagtactacgaatcttcgtattactcccttcatctcaaaataagcaaaaccatgagtttttgtgtccaactttgatcgtccgtcttatttgaaatttttttataattagtatttttattgttagtagattataaaacatgaatagtattttatgtgtgatttatgttttttagtattttttttaaaaaataaataagacgggtgattaaaattggacatggaaacttatggttgcgcttattttaagacggagagagtatgtcacgttcattctagattcgttttttatgtaactgaggggtagcttggaataatatagctgacttgacaggattaattagaaacagtgacattgtaggattaattgtctcgtccacgggtgttaactacatgtacacagtgacggagcctccgccggtgacccaggcagcttggaataatagctaacttgacaggattaattagaaacagtgacattgcatgattaattgtctcgtccacgggtgtttactacatgtatgcagtgacggagcctccgccggtgaccccaggcaatggtatgggctcgtcgcaatgaacacgctgtaaaatttgttatattatagaattgaatacaaaattttcgtagtaaataattgttgtaattccgttgtgggctctctcaaaattttacttaacatttggcgtgatttgcgattgatccggcaaaaatttcttctgctggatgaacatggtcacgtgcgtgcatgctttaattactcgactgttagtgcggatttaacgtaaaaatgttaggtcaattggtttgaatcgttctttgtttctctctttctttttgtccttttattaattcgtttttggtttgctactttgacttggacgtatggcaggcagtgatcaacggcgtagaacacagctccagagctagctccttagttgacttgatatttcctgccttgtttaatcacagccgctatatgtttacgttatatatactgccattggtgtataccaacataagaggtagtagaattcaaaggaaataaaagagttagaatggtttgcttgtttgtttctgttagttaggtaatttggctggacttggtgtaatgtgatttctgccccaaccctttatcactagtcactgaaacattttttttcatcagctgaacctttcttcctgatagggaaaggtggttagaaccccagaaattcagagaatgtatgcccaagactacagacaatcaaacttcagagagaatccgacgtcactgtggctgaatggggagcccactaatcactgggataagcaaagaaaggcattgcaacttggctagggatcatacactgtccaaatgaatgtaacagctctccaagcccggtcaaaccataatcagatgctggtcggctacattggcacctgatgtgagacgttcatttcctgattgctttgcggctcgttgtctcagactgtgagtgctctttctgctttgatgctcatgattgcaactagagttcatgataattcatcacacagagagtttgtacacttgaaaaatagcagcagcaagatcaaaagaagatagccaaatgctcgaaatatcttatgaatatgacagtcactgagacactgactaccatattggtgtaaaaaaagacttccatttactctgttcccatacgatcagcatctggaaggtctttgaaacgataacttgaaggaaactgtgccacaattttttccttggaagtttaaacagtgagagcttaaactgcacaatttattccaaataattgggatccagtatcaaattatacattactaagaataaatacatctcacacatttttaaccggaatgtgcatgcggagtcaacaaattacagctatgctagaacagtacacaactacacaagagcgagtaacccatgatgataggccacatgtattgattgcaaattgatgcatcttattctggatcaaatggatcacactagtgtccacgagtggaggacactcaggaatcaaatcaatcttcacaaatatatgctaagcttgcaaatatccgttctcttcaaggtagcacagaacatgctgggccattgctttgggtgaaggacattccccatctaccatcttaattactatctgtggaaggccagaaaaaaatctattcagctatgttcaacaagcagataactttgcattttacatgtgggtaatgtcattcaatgtaatagataaatgatgaccctagttctttttgtctaaagtaaatgatcaaatcagaattcagattcatttatgtttggcaacatgtatgtcagattcaaaaaataaattaataagaaactccgacacttgtttagttgttttatccagctttaatcaaaccagccaaagcagagaaatcggaattgtgtatcccatcacaagtctgagatcaaaactaaatatattttttcctcatgccatcaattaaagcaagctacaatatgtgcatcaataaatgataacactactttttggttaaatattgccaattcttccgtgaatgaggttgctggatctaatagtgatagatatgtacacatataaacattaggaaggactataaatgaataaatgttcatagtcttatttctatggcaggagcatacaatgtaaatagttatagctaacagcggaatgatgatagtcagcactcggcagtaaagcactttttcagtagtgaataccctacacttagacttttagtttaccgtagtccgtatggaatggtaaggtgtggcccagtatgaatgcaaggcatgatctgcaagctcacctcactattcactggtgattcatatggatcatcaattccagtgaagcctgtttgtcaaaaaggaaaatttcaaaataaaaataccattaggcgttcaatccgtacgctcttttagtatactgaatgaactaaatataaaagttaattgtcccacaatgactcaaaaggtatcctgtacctttaatctttccagagcg

SEQ ID NO: 54376 - DNA, 1079 bp, Oryza sativa
agacatatgcatcagcattccattcacttgtgaggttttctttcgtgaacgtggaggacctctaggcttgacactgtcagcaatagcagtagtcattcgtggcatcaggcttcttatatcaattccctgaagaacttgcaatgctgcatcaaagtttcctctctgatgttccagtctacccagcaatgcccgggcttcctgttacattagccacaatgaatacaacactgaggaaaccagaaatatagcttatcttctcggaagagggaaggattcagacaaacctcataatttagtgaaagggtctctctcaggtctgattccacttcgcttacttggttgtcatcaggagttgattctcgatttcctatccttgaagaagaaccagttgctgagtaatcccgcgtcgcaagagattcaggcgatcgaggcatttcttcaaacttggattggtccccgctacaactgcataacataattgccggcattttctgctgtgctgatgatttactgtagataaatatctatctctcaagatctccccaccagaccaatgggattaaccagtcatcaagtatataatatactatagaacctgacaagtaaaaatggaaggtgcttagtgcacattttaagtaatcataccctaataattaattaaagaatagagctgtggtgctatgatgagtaaaggccgggatgttttattccattatcttaaaaaaagaatacagctgtggtccttgattcttgaacttgctagtctgatgtcatcctggtcactaaactctgaaatgcatatttaggactctaaaacttgttgaacttgtcggcttcactaatttgattgggctatggtggcttggagaggcgagtcggaggtggccaaaacagagcacgcggcggcgctgacggcaatcccgagctccagcggccaatttgcaggggcggatccaacttgggacatgggggtttgggggaacaaacaacaaactgtttgttacttgtattaacgttaaggctctgaaattaagaaaagagctgaagaacttctttcagaatccagatctagaagagaa

SEQ ID NO: 54377 - DNA, 3523 bp, Oryza sativa
cttccagacctgtcaccgtgctgccattggttcgctagaaccaaatcaatccaggcttcggagacgctgatgctagtgatttttactactggactcatcatggtaatattatcatgcttgcagattgcaacactgcgatgttctcatggtgctcattttagtggagacaatggagtactgctgctacgtgcaaactctgcaagtcacgtgaccatttgttccccgccattgacagttaccggtcatggacacaagatgccacattgcattctcgcagaacacgcatggccaaggaacaagaatcctatgttcagctatttttgagtccaaaacatggtgtcctgtgtcctagtcctgggtttattgtggccgttgagagagtgaggagaatttaggtgacctaggatacctttcggtgttaaataagtgttttagtgtaaagcacatgcttatcatttaaggggttagtgtgacgctccttaattgagtgaaatatcagcatagccgcataggtgcatataaaagatggctatttatgcagaacgttgtgcatggtactgactgaccgtgcaaggttagccggctagcatctactcttctcgaggtaccatcacatgcattcttgacctgcttttgccagagagcacaaatgtagggtacaaaaaaccctttacctattcacatctgcccccatttatcagatggggataaaagggacaacacttgacagcaaagtccacagggtaagcagaaaaacagcatcgacattcaacagttctatcaattggagcagagacgaggactgaacaacactgactatgtacattgttgggcagaggcagcacacaaggccgagtttagttccaaactttttcttcaaactagggtgtgtttagttcacgctaaaattggaagttaggttgaaattaaaacgatgtgacagaaaagttgaaagtttgaaaaaaaaattggaaactaaaccaggccttaggggcagatgtgtaacagattcgatgtttttatttttcagataaaatcagcaagtactgtaaaattgcttctgcaagcaccatcaacctcgtggacgactagctcattgaacaaaaaaactacaaagaatagaaacaaataacaatgtctacgttgtttcctcaatgtaagttccgtaacaaaagaatcaaggatatcagaagctgctaacaaaacttttctatcctctgagttcaactacgagatgcccatatggatgcacatcatatcaaatgtggcaagactactttgatcattgcctgagagatgaagatgcagtactcaggttatcgaacatctctttctgaagcagcgggaacttgagcttcataaataagtacaagatgcaggagacaggtttatgttccgctataacttaaccttctttgcctttatccgctttgcagccatgaaagtcacagcagcagaaagagtgtacctaataacaacgaaagatagtaggtggtcataaacacacaaatacaccagcaagaatgataccaactgtaaccatagcagtcaaagaaacaattatgtatctagctgacgattgcaaaattttagtgcatgattacagcgagaaaatttgcctgcatatatatgtgccatatgcaagctaatctgatgtaatatgggcagaccttaagaagagtttgggataattttttttttctataaaggagacacaacagctttccagtctcagctgaaacagaacaacacagtacataaccagcccagagagtttggaatacaaaccccatactatgtgttcctactccagtccagagtcacattcttgtaatgtacattctccagtttctgcaactcaattttcactacagtattgcatttcatgtgcatatatgatatcctaccacttagttggaacattatttagtgaaagaataccacataactatctaaggaagcaaatggtatcaacagattacacctggcagttctgtaaagacaaaaggcttaaatgcgatagtgagtacccgatacggtaggaaattgctctgaacctttctaatatgagcaatagtatctaactatctattgggagtcttaacatttctagtaataacaatccaagaatgaatggaatagtcataatcaagtaatcaactagatagcactcataaaacttgtcaagtaaagctgtagcaattattatagatcatcatataaaaatgtagcagttattatagatttcacacaccccaccaacaatgaggaatgtgcaaggtattgaagttaataggcacttaccatgtaacggtgtattttagatggtcatgtggcatcactgagtgatgaatcaaagtactgacatcttttggaacaggataaggatttgttggagagacatcctcatttatatcttctatataaatagtattttcagggaggccacatgcacgagcaatcatgggaacatccacataaaaccactggccaacactgggttcattagctggaacaaatatgctgggcttctcacttcctcggataactcccaaaactcttacaggaggttttacaggtttttcaatctgcaaaaggtggaaaagcaatttgcatcaaatttatgcacggacaataatcacagtggtttccacacacaaaccatcaacaactacaaccaatgatttaaagcacgcctggttggttattcataaaaagatatttgataatgtgctgtcacattgttatcatgcacaataagtttatgtaccatgttgctgataagatatcaatgcataaacttgatctgatgagcaaagcagaaagcattaacatttttaagcaataggttggaaacgacgcaaataaaggaatgcaaaatcacctcacaagattgttcaggctccttagagttagaccaaaacttccaccatgaaccttttccatctgtctttttatcagcctctttatattctggaacttctctgacgccctggtgatcctgtacgttcttatcacgccaatcacgaggaacccaccctctattcacaagtataggtggccacgaactgacaatatttttcagaaatacaaatattttaagaaacatggaagaaataagacaatgtagtttgtttctatggttcaagcaagcaatacagcatcaggcaactatgtttctttttatgtgttctctgtgttagtaacgtgaggagaaacttaattcagaactaattgtaagatcgcaacatcttcacggggaaaaaaaaaagaagaaaaactttgctaataccggtccaagcatggatagatggcatatcgcacaacacaacctcaagtggaagttcagcttatcagaaatgtaatgtaatgcagaaacatttattagaagctatacaccccaatttgagattatggcttgtgcagagcttctctactgagacaaataatgatacgttagttccattttagtcaagtagatcttatgttcatcgttgattcgtttctctatcctaatcttgag

SEQ ID NO: 54378 - DNA, 7273 bp, Oryza sativa
  unsure (1)..(7273): unsure at all n locations
tccgcagatgtactcgtgtggcatttcgcgggggcggtggagggttgagacctcacctggtggtgncggtgtggcggcggaagaaggcggcggaggtggctgggaggcggcggaggtggagggacgggacgggagcaggcggtgcccgccgccgcgcagccgacggcggaggagcttggacagcgccgccgccatctttgaggtcaggggatcagggggcttggaccggaggaggccgcaagacagcggcgactagaactagagtcaagacccccttcacccttggtcaattggagtttgattttttgttttcttataaacgagtttgaaattcgttttcccgttgtttgaagctcgtaactggtatatactgcctccttctttcatttttaaatagataacatagttgacttttgaacatatatttaattatttgttttattaaaaaaattatgtacatataatttattttgttgtgagttgttttatgactaaaaatactttaaacatgatttatatcttatgtagttgtgtaagatttttgaataagacaaatatttaaacatgtttgtaaaaatcaacaacgttatatatttaaaaaacagagaaaatacgtgagatgatatgtttattcgtatcatagattaaattaagtatttggaatctaaaaatgttggaaacaaagctttgtaacttgtaacactggaaaacagacccgggggaagacaaacctcggtcgatagaaaattcttcgagtagaaaaacttcatagtaaacgaacgtatgccgatagaaaattcttcgagtagataaacttgatagcaaatgaacgtactttccctaaaccatttcttctcataacgtgcaatttcccttttgcacttctaatttcatatcaaattgtacaagtagaaatcccttctaatttcataacaaactgtacaagaaattgcaaggtggtgctccagcacctttacttacctgcacacattatacaactgttctcccaggatgatgcaattcacttaaaagaaccaaatacatagtttaaatatttctctcatgctacatattattactctcagagtctcaagcacaaatttgcaattcattgcagcatcgatttatcaacatttttgtctccctttagtttcatccaaagtaaacaatatgatccacaaatcacgcataatttcaaattcaccaagcaagtatgcaacacgagggtggaacctcttgtaagtcggaaggaagcacatgcgtgcacaataccagatgcagtctgccaatataatgccaaagcaggttacaaaattatgaacacaacctccctgatcaacaataactcttgcataatttacaggccaagtgctacgcaacatgcaaaaagagagaatctgcgtacttcaaaagctaaaaatttagatcaattcttcttttttgagtgcttcacgagccagtcgatgacagagtcaatgtttgtcgagttcttgcatgatatcatgaagcatgccacttctcggtcagtgattgtctttagccccctgcaatgtcacatataacttgtcgaacacaggtttgtgcgtaagaaaaccttatcggtctgtaatagcttagcgtgtacttacattacgtctgtgaagctttgcttagggaaagcttcaggtttgtcaattttattgccaatgactagtaatgggatcccagtcaaagaaggcttgctcagaagatcatggagctcgcttttggcaatagccatgttctctcgatcggctgcatccacaacatacctgcaggaacccaaaacattccccatggtttgtaaagtcaattattgccaccagcaacgaaaaataaaataatataacaacgaaccagattttaaggggaaaagtcagctagaggggttacatattagaatttagaacatgcgccaagtgaacaaaaaagcaaaaatagaaaaatagaagataaagataaacaagacatcataattatcttcaataatgcaaaattaaaaaagtctgatcaaataaataaaagcatcatctttttctagaatatccaatatccaataggcaaggcaaattcaaactgacttatccttgcacaaggataactacgacataaggcagagggaagaaaagtgcagtatgccttacaaaagactaagaacagtttagttgagaaataaagaggttaaactcaagaacataagatctgcacaaaatcccatgtttcacctaaactatccaggttaagcttttgaaaccagtgaatgtgcactacaatatgaagctacttctgtctatggggtctagtaattaaatttcattgatgaagtttgcctaaatttcagcagtggtcaaatcaaaatgacatgaaaataattggttagcatgtgtaagcaacaaccaactaagcatgacaactactgagtatagtgcaattcctgctgcacatgcatcaaattagacaggaaaggaacttacacaattgcagaaactgcacgacagtatctctcccacatgctacggaatcttggctggcctccaagatcccacaattttattgtgacattacctttggtcacctttctcatgttgaatcctacagtaggaatcatgtcctcactaaagcctcctgtctgcagattacatggtgatccatgagaaatcattataattcagcaagtgaataaataattaagaaactgatacttacagcaatgacattcacaagcgatgttttcccagcattttgaagccctatcaaggaaagctccatctcttgcttgaaaaaaagactgcatataaaggaatatatgttgaatcctcatcaagcaatattagtaacaaagcatatccattttactcgctaatataaaccagaagttggcccacatgtcattacgtcgaagtagtgcctcaaagaaacaaaggaagttctccactacccaatcagtgcatgtgatgagagctcctttgttttcatactaacttacttggccaccgccggtaggtagatgtggaactaatcatagcctaccacaactctttttcataccaatgattgaaattcagtgcaagcatggccaacatcgtcctaattctacagtccatgatacaagaactttgtaatgtgaatattcatgacaattaacagagtagacccctctgttacatacaaaatcactctgcaaattctgtatcccctcacctcccttgaatttttgattgacacgttgaatgaatacagttgggcaggcacgttcaattaatacagtgattgacgcgccctgataatacttcgattggcttatacgatactccatttgatagtgttgttcaacagataaaaaagcttctgccatacaatgttcctacagcgtacttgtaagtagcaaaaggggccaaatctgaacttggaaaaacagaaaaggaccacaagaagccaaattcccctacgtatatcgggaataaacgcgggtatgcgtgtatcgacccatcaaaaacaacatttcccgttagtcaacgttgcaaaaggaaaaaattatctcaataccatacttattcgcgcgccgcaaaaccatccaatccagtaaaactatctaatcctaacccagatccccgacgcatcgatcgatcgatcgatcccctcccccgtcaatgccccaagcaagagcgagcttcgacgagcgtacctgcggagccagttgaggaaggcttcccagaaccccatggcgtcgtctcctcctcccccctcgcctacgaagcggggaccctgggtggtggtggcggcggtcgccgggagccggggtacggacggcgacgggagcctcaccggtggcggctcgcgcgggtttactttatttggagggcagagcgtgtgggaagggagggacgggggcagcgcggattgggaggagcgagcgacagcgaggcaaggcgagagcgacggcgcgaggaggaggaagagacgagagggaggaggggatggtattattatgtggcgatccaccaatcgtatgtggcctcgcggcttagctggccgctgtgtttagtagagtaggtttcattgttttaccgatttggatgtgcgtgattggtccaaaggctcctactaccaacattggtgacaggatccagctcggttacggaatctgctccccggataagcggtggtagttaatgatgatttgcggtagtaggtgaagctgttttttactcctgccgacgatttttcataatcatatttcatcttatcacataggccaaagataactaattctacttatcatttatttaaacatactagtactagtcatttctcgtaaacaaacgattcataaatatttacatttctccatacccatgtagctaattttatgtgaaaaaatggagagatctacattaaatctgagaaatttattgagaggataggctattggattaaaatatatctatcaaaataaatttttcagatttaaaaatatgattatcaaaagtagatagagggaatatgattatcaaagtaaatggagggagtaaacaaaatgttttaagtctcgccatctctggaccaattgtttcagaggttttgactcaccgggcgacttctttgcatgggcatttggcctgatgaggtgaacccaagaggatcatcatatatagcccaatcgagtcgaacagctcgtgtcaccgtgtagatgcacgtagactcggtgtttggttatttgcatctagcgttgctctcacttcgcataaaactggtgtaaatgtaatgcaggggtgtttgggggaaactattttaacagctcgagtggacgtccacccgtttattacatgtcatctaaatagttatgaaaaaaattaaaaaatatataaataagatagatcaacatgttatatatcagtccacaaacatgcaagttgaaatttaacttctacaagttataacaaaaataacaaacaaaacttaaattactatatgtatatttacaattaaatttgttatttttgttacaacttgtaaaagttgaatttgaacttgcatgtttgtggagtgatatattatatattgatctatcttattaatttttttgaaaatttttcgtaaccatttagttgacatgcaataaacggttgcacatccactcgagatattagaatccatctccgggtgtttggttgtctgcacagccgtcggcgtcgggtcctgagtttgcttgtgcaaaacggcctcctaaagttagacccaatgacaacgatgggattcaagctcctttcgttgtccagggcaaggcggcaagcggatacaaacgttgggtatgagcgaatgcaaatgcatgtgtaagtaagtacgcgctggtgttgtggtgcagggtgggactggccgggaccgtgtgcatccggtcacagccaggcacagcgaagcggccgcggcgatctccctttgacgaggagtgcgaggcggcgagatagctttattatgataaagtaaatatattgctttaaaaataatgctcaaatgataaatttagtgtaaattacatcagcagttcacgaacttatcaatctagcgcacaaacttgtaaaaatactcgttttggtgtataaacttctgttcgtgcggactaaggccaaaataacactacatggctaatcctgttgatttaagtgctgattaggatactatataaacatatatgtgagaatatcgctatttagaaatacatatgttcactaaaagatagaatgagatatacatgatagtagaaaaaaaatataaatactgatcaatgacacaagagttagaaatatatagaattcattatttcaattatgaatgataaagtaaagatcaaaattataaatatattgttttatgaatattcaatacatgtatgcatgtcacattctaatcaacaccagcttggtataaagttaacaatgtcaagttattttctcacacaaactagataagttcaaatactgtaacgagcattttacaagtttacgtatacttagatatttacctaacaagtttatataccatcaatataatttactcataaatttaacaatgaatatattgatatataaaaatgaaaattcagctacagtcatgcaaccaacgaaaaaaacataatcttttccgaacaatacttttgtacaaccaagaaaacaaaatctcatgctagtcgtgaaaagaaaaggctcatggaagcatcgactgaattcaagctaccgttagaagccagaatttattgataagaataatgtgcatcgcatgtatgtctgaataatgtgcatcgtacctatgtctcgtgtttcaaacctggatagtaatgtgtcttggtgaagtttggcggatatggtgtttataaactagacacacccatcacattttatcaaactcgtccgataaattcgtggctagctactctccctgtcccaaaataagacaaatcctgggtttccgtgtccaacatttgactgtatgttttatatgaaatatttttataattagtatttccattgttgttagatgataaaacatgattaatactttatgcgtgacttgcctttttaatatttttcataattttttcaaataagacggacgatcaaatgttggacatggaaacccagagtttgtcttttttttatggagggagtatatatgaaccggaacacatctgatctgacacaaagcaaagcatcgcgattgagttaatactatacgaccctgcgatggaaagtggattttgatccgtcgaggggatatcttcttgttgcttgcatgttactcaaatggttatgaaaaaatttaaaaaaatttgaaaagatatattaacatgtgatatatcactccacaaacatgcaggtaaaaatttaacttctacatatcacaacgaaaaaaataaatttgactttgaatatacgttaaccagctgcggtttgatttgtttttttacgagatgtagaagttgaatttgaatttacatgtttgtgtagtgttacatcacatattaatacatcttcttaatttttttattttttttcataagagtaaatttcacaaaactacatgttttatagttcaagttacagaaaaccacacacattttgacacttggcacttaagtacatatattttggtagtttagtttcatttggtagtttagtttcacaaaaccacactatcgatgaatggattcacccgtgagatgatgtggttgttccatttaggatggggacgtggcatcctg

SEQ ID NO: 54379 - DNA, 4392 bp, Oryza sativa
tgtcctcgtcctatgtgaaacaactacatcatctcgcgagtgaatccattcattgatagtgtggttttgtgaaactacacgaccaaaatatatgtacttaaatgccaagtgttaaagtgtatgtggttttctgcaatttagaccacaaaacatgtagttttatgaaatttactcttttcattatgacattcaaagaacaatggaatatcctcactagggattaaaatagttttccccttcttaaccttcaaaattctgttgcgccgggtttcctcgagttccgcgcaaaccccgtcgaaagagagatctgttgttacccacggaatttaacttctagaactaatttcgcgcagctaaaataaagataaccatcgaactgagcgaatatcgcgggatacgatcccatccatccgtttcccgttggacggcactgatctggccgaacatttcaccatgcggatccatcgggcgagggggtcccgcagccgccaaggcaaatgggccatttccttccttacaataaaaggaaaaaaaaatcccacgcgtttttaccgcagcgattatttccttttttttttcgtttcattttcaccgctataataatagtactagtttgttccaacgtactcccgcttccatctaatcgcttctccaccggagctgctttagggcgacggcgagatcgattcgacgggaagccagccatgggaggggggtccatccgcgcggcggcgaaggccgccatgatcgggggctaccgctccgcctcggccgtgcgccgcgccgtcctcccggcctccccggcgccccagacagccccatcggcggcgggcgagggccgcaaggcggcgtccacctacgcggcgatcgacgactgggtcatcccggaccgcgaggtgttcggccccgtgcccacccacgaggaggccatggccgccaccctcgacctcaaggagtccttccagttgtgcgtaactttgccaccaccttgcccttcacgcttttagttttctcatagccgttgaatgtgctcgtgtgatcggtgatcctattgctccatccgctgcatggttgtggcctccggtagttttattcgaatcatgcatgtgtgtggtgtgatctatggttcatagttattggacactgatgcgtggataagtttattcattatacaatgacttctagcggactataatttcttttgcagtaatgaaaaaaaaagttattcgcatctattggcttttgatgaagtgacgaagcatatattcatagtatttgtagtagagcgttagagtagtattacttgtgatgtttttctccttgtttttagaaataacatatatagagattgttgcaacatgatgtgcctctttgctgttcattcacatgtttattttaaatatgtttaaaagtttttgaatctttctttctcatcactgcttcttaatttgcagtatgtttcgacaatgaatatctccatatatatatatgcgaagtatgcctgagaaaaatgttaacaatatgtagacaaattattttgaagttgttcaaaccgtaaaatcattctattgtgcttttgttattttccttctatataaaggttttatgcttcactgctcttccttgttctttacccccaaaaaaaactgatgacctgttttctcttaaatagtgctaagtctgctcaattggagcctctcccctctggtgaccttgatgtccctacaaaggtgggtcaggagggtcttgttcactcagaaacacctcaggatcttgttcattcagaaacacagggtcttgttgatttaggagcatcccaggatcttgttcattcggaaacatctcagggtcttgttcattcggaatcatctcagggtcttattcattcaaaaacttctgagcatgaggataaccatgaaatttcacttgtttcctctggagcccctggacgcgttgtgcaagcgttcacaatgctacaggatagccctgaagcacaggtacttaccacaaactttgccaatgtaaatagagtcaactactaagttgttgtgccatcgtttgctagcgtcaatgaggattacatgtctctttttcaaacactaaaagataatgatgttttgtgaaatctgagccctattattgaaatttcacatgcaagcttgacatttgatcacaaaatctccagccttcatattttctggagtaacactttccattttattatgttagtttggttcaagcgctcaatttattccttattaaaatatcctggttctactgcaagcatagattctacttttaaattctgaaagttcttctctttggaagcttataaaagttgttacagatcattttatgataactgttggttgcaggaagttgttgcctcacttgcttctgatcagaatgtttggaacgctgtaatgaggaatgaaaaggttatgaagttttacaagacctatgcgacgagtaagtattagtctaggtgcccggcctattttgctcatctgattgagtagatttttcaaaatttaacctgctatccgctcttactactttccctctctcagagcttaacgaagatgaggtcgaaggcagtgagtcagactccgtgcagaacagcagtgagttgggcagcgctggagaagcgttcatgtgctacgtggagaaaatgaaggcactggtgtctgagatgatgacgaacctttcaagcattatgcaagatctagttgcaacctcggacgagggccagagcaaggggaagctgaagactatgatcctggactccaagaaagattttgcaaatgctccatcagccttcgtcctcttggctattgcttcgatcatggtagttttacttaagcgcgcgtaggccatttgcccagtcataatgataaaataataaggtaggattctttggtgttcaggacattcgggttcttttttttggtcagatttttttttcttctcagttcaacaagtagttgactgtacgaatgaatcctcgtaatcgtgttcacctgatacattgagagacatcgcgagagcttgaagtctttggtattgtaaagttttcactctccttataatataaagccagcttttgctggatctttcaggaaaaagaatggcaggaatgcattgcatggtttttgaactatttaggttgatgatacgttcgtgtacgtctggatagcatgtattgtcatcgcgtgcatacagtttcatactttcattattaagctatcggactatcgcgaatccatttcgtgttattctcagatttaaaaataataatatacgcttcactgataaaaaaaataataatatacgcttcactgataaaatcaaattagctacgatgacacgtgtaaatcatgcacacaaagcaacagattgattcaagttgatttcagtgattactggcaacaaatttatcaagttgatttcagtgattattggcatacaaatttatcggtataaacatgcaatgaaccaacaatatcaacagttccagattgagcataactcttgccataacaatatcagcagtcccggattgtggcagtaaaaggcttttcgaatcaacgagggaaagttaagatcccctcggcggctcggccctctcaagttttatttgtaataattcagacacagactgatggaagcatgaatttccagttattgaaccagtcaaatttcctaagtcccaagcatccctcttatagctcagtgtgcaactctgcagagaaaagaataaggtaaaattgagaaaactctcttttcatagtcacgagaaatactgtctgacagtcaaatgcacatactttcatcagggttgactcttgctctaacataagaaacgctaaaggcttagaattgaagttccatttctagcttacaccaacttgcttgggaagtctgttgttgtatagaagaaaccgctaacaacatggctttgatttatacaagacacaacataagtttacagtagaagaatctagtaataccttttgccgcaaaacacccacccagagtggatcatgttactcaactcggatctgcttacagagaatcttaattgtggaccttgagcatcttagtttaaatccatagcagaagattgaagaaatgccacagtgctgctaccgaagtttccactagccatttcttctgagagaaggggaggttcatcaggaatctaccacccagagaaatccttaaattctacattagacacactcgcttttcttttcttgtttgaatcatctgcaaccacatcagcaaagccagctgtccgagcttttaggtacttgccaacgccaccaccagagctagttgaaccagcaacgccagtgcctggattgctataccatgatcccaccttatcct

SEQ ID NO: 54380 - DNA, 2908 bp, Oryza sativa
tgaacatctttggtgaagcctccgggctgcgaacgaacttcgccaagtgctcagctatgcccattcaatgcacggatgagcaaatcgccttaatacaactggtgctaccctgtgctattgcgcccttcccgtgcaaatatctgggtctgcccttatccatcttcaagctgaagaaagaggacctgcagcctcttgttgataagattgcccgacggctgcccacatggaaatccaatcagatgccgccgatcggtcgtgtaaccatggccaatgctgttttgagcgccataccaatctatctactggtcgcaattgatgcacccaagtgggtgatcaaaggtattgataaggtacggcgtggttttctttgggcgggcaaggcgcaagcgaatggtggatgctgccaagtagcctggaccaaagtatgctcccccaaggattatgggggtcttggagtgccgaacttggagctcatgggcattgtactacgttcccgctggacgtggatgcaaaggatttctctggccaagccttggcagggattagcaatcccctgcacacagaaagagcgtaacttcgtcgccgcctccaccgtctgtcagttaggtaacaggtgaacaatcctttttttgggaggacagttggttacaaggaggaaacatccgagctattgcgccctcgatctacgagcatgcctctgctcgcatccaaaagtgccggatggtggctgaagcgctgattaaccgtagatggatcagagacataagcggcgcgcttaggactcaggcaatacttgaatacctcaagctttggtcgttgattcagtcagttgtttgttcatcctcagaaccagactcactctcctggaagtgggaaagctcaggcaagtacacctcaaaatctgcctaccgagctttgttctttggacgaattgcctttgaatccacaccgatctggaattcgttggcgccaccctcgctattgtttcttcctctggctggtcactttgaacagatgttggacagccgaccgactgcggagtcggggattgccacatcccgactgttgcattctctgtgatcagcaggaagagagcattgatcatatcttagtcggttttccggaatcaaggcagctatggtggtgggctttgagagcaatcgggcaccccaactgcctaccggtgaatgaagcttcctttcaccaatggatgtgtgacagcagaatggtgttaagtgagtcacatcgtcgaggcttcgatacggtggtgacattggtagcgtggacaatctagaaggaacggaatggtcggatcttcaatagcagcacagatcatgggtagatgtggcgagagggatggctgacgaggcttctctttggcgtaaagcaaacccggcgatccctgcgctgcaattcaggagggagtttggtcgccaaacctagcgcgagagatagatataggattaattgtcaatgtcctgtatcagtcccatgttgtttttcctttcaaatgtaaataacttttatttctcttaacggaaaaaatgcgctccttgcgtattcccgaaaaaagtattgactcaactactaatcatcatatggatctataatgatcgatgttcatttcaacctttatgtggttaatcacgaccaattatgttatctgatggaaggaaacgaactacacattgatcaagactaaacattccaatttaaatgataaaatcatatttctctagcacagagctaacaaatcaagtggagttattgaaaaaatagtagccaaaaaacatatcttacaacgtagaaaagcaattattattaaactttatcagggaagtaaaaggggaccaggctgtaaatcaagggagttctgaactgaaaataacctgagccgctgagtcctgtgatccaaatgacacatcctttttgccccaacaagttctgcctctcagattgtccaattgggcaattgtgccacagtatattggttgatttcccaatggttgacactagaggcttctctttaactgcaatgggaaccaagacatggttagtggcttagcgcaactctgttcctgttgttgaacaaacatatttgcatatagtacaaacaacatgaaaaaggataatctatataaaatataagggagagattatctttgacaccttttccttcacattattacttgtataatacaaaaaggtaatatctactctgattaaatgcacatgaattccagagttctcaatgctcccgaaagaacactgaaaagtactactatgattttctcataacattctcttcttgttgctaatcatatcatccatcaaccagacaagtatgtgttctctttatcataacttcttaagagggttcgcaaattgtgtactcacgttcaaagtatatttgaaaacatcaccaacgtcattccattgccccgtcaccaacttagtatgtaaataaactactcccaaagtcccaatatagtagaagattctacctatgatggtaaaaaaaaaaaaaaagaaaagctctaacttctccaccatgtagcaaaaacatccaatattctctcagattcgtcacaaaaaaaaaagaagcaaaaccattcaacattgtgccaaaatagagtattccatcaaacttcaaccagcaattcaccacccaaaggccccatacacagcaaaaaggacaaaaagaaagagcatcaggcataaaaaccatatgcccaaacacatcacggtcaagtgtcccatttgttgaattctgttacagcacgtatttgttctcaccaaaaagtcgggatcactaaatatgtggaggtcaccaacagaagcagcatccaagcagcgggaacaaaccaatgcattatctaccacgccattcccctcgagagattctgga

SEQ ID NO: 54381 - DNA, 1648 bp, Oryza sativa
tgattggagagggagggcgacgtcacccgcgtggggatgaattcgatgagctgccgtgtcggtctgccttgccagttgccactgtgagtctgcgaggggcgaggctaggggtggccggccatttatgcatttgacacgctgtggcaatttttagtgccacatcagcgagctcgatgttaaggtggtataggtcgcagggctgggaggagaatgatctatctcaaaacatatatagtgcagaaatactacgtaacgatatacggtttcaataggaaatatcagatccgatatctatcataccattttgatgttaatatggttactagatatctgatatctacgaagtatcatgttttgataccttagatattagattcagtacttacaatatcatactaatgttacgctgacacaaacacacattagctatttacacattagctattttgtttgaacattatactgttatgtagtctctcttaaatatatatagctattttaatctaaattcacaaacaaaaaataaccatatttttaaaacgaagagagtatattattatcatgatcggaatcgatgatcagtgacatccatcgcagtcgagagactttgttagcttattagccacaaatataatttcaattttaaaacttaattttagaattgtctttaggttttcttttatcgtagaatgctttttttgtttttaaatagttaatagcacaagtataaagactatctacaaatattctttttgaaaggaatttagaaattaaattcggttgcttcattcttttcttttatgacttagcaatcgagactcgaacgatcggagcctcaggagggcaaaagcttaaaagatgggtttaaatttgtacagaaaaatttactccatttcgaaaggtgtaaatctcaaacttgcaccgtaatgatcatgttggctgcactttgaaagaatacatgtccattgtccaaccatttcgacacaacaacagtaagtttgcgggttgttttttctggcaaattagcgtcacaattggctttcgcaataaataaacgaagcactcaatcaaccaatccttatcacctaattatttatttgtcatatcaaaacaataattatttatttagtagtcccctgattttccatattgaattttatttgattgggacccctcctctgctgggaaaatgacttttagtaaggaagaaaaccgacgatattttagaaagagacttttcaggatacgtgagcagaagaaatgagcttcaaacaggtaaatcccagatttatcaaatcaatgaacacggcaagaaaaaactcacgtaccttgtgcaaggaatatcaatatagactactggtggcatggcacctcagtagtacatagaaagtgagctttaagctaagaaagagaggaaaacagcatacatctaacaatgactagatgctttcatcaacagaagtagcggataaaatcatgtaaacacccattggctcctgcccacagagcagcaaaactttaaaagattgaagtaacaggtctgcggaacaaattattggccattgctttgcaaaacaaccaaagaattcgaaatttaacagccatcaaccacagacgatgtatcagggctgagtgcagcgctagaggg

SEQ ID NO: 54382 - DNA, 7082 bp, Oryza sativa
  unsure (1)..(7082): unsure at all n locations
ccgtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcataggatttttttccataggattgaaatcctccaaaattcctacatttttcctacaaatcaaaggggcccttagcatttagtcgacttacagcctactattatactttctcttataggggtgtgtttggcgcctctttcccatcccttttcctcgttttccgtgcgcacgcttttcaaattgttaaacgatgcgtttttttttaaaaaaaaatatgaaagttgcttaaaaaatcaaattaatctattttcgaaaaaaaatagctaatacttaattaatcacgtgctaatggaccgctctattttccgtgagtacttttttcgaatgggaacatcaaatggcgaacacatgtgttctttcatatgtttcccaacccctctcgctcatgttccgtgtgcacgcttttcaaactgctaaacggtgcgtttttttacaaaaactttctatacgaaagttgcttaaaaaatcataatgatctatttttgaaaaaaaagctaatactaattaatcacacgttaatgaaccgctccgttttcgaggatttggttcctagctcagagaacaaacgcaatctaagtccactttgaatccctcaatatatgtccaaattttattcgcggagaggaagggcggtggccggccggcagaacagccggtgaatccatccttccctccatttctttgctagcttccgccattgtttcttggatttttcccccttttcatttctgcagctcacacccgctcaaattcttcacaatccgtaaagtgtgtgtgaattcttgcatattagatgctgaattgctactaatagcctgcgtcgactcgtaaatttatgttttttttttggaacagatgggccgtggccgcagtacagctatgggatggtcatcctgctgcaggccaaccacattctacgttaacaaggtgccaaccacccatcttatataggggtggccatttggtctaaccgaaaattttggttttgatcttcgtttttttccatttcggtctttgaaaagtgaaactgaatttcaacaaaaaatgtcagcaccgacaaattcggtctcggtctaggtcctgaccgaaatacagcaacattttcataaatgcaaagaaataatggaaattttcaacacgaaaatcacaaaaaaaatcataagcacgtatgagtaaatactcttattagttgtatgtctaaaagaagtaggatgtgaaaattagagtttaatcctattgaacttagtatattgtaggttgcatttagatttttttttaattcggtcttttcggttaaccgaggagactaaccgaattgaccgaacaaaattcaatctttcactgcctacgactgaattaatgaccgaatntatcagtcttagtcttttcggttcggtctttttctgcccaccctagatcttatctttagaatttgatattgggatgtggtcattttctcccaattttctagcttcttgctgcaagattggcataccaatttggttgtgtaatttgggtgtgttcaattcacgtcaaaattgaaagtttgattgaattaaaacgatgtgacggaaaatttggaagtttgtgtgtggccggtgtagttcccaactttttcttcaaacttcaacttttccatcacatcaaaattttcctacacacataaacttccaacttttccgtcacatcgttccagttttaattttagagtgaattaaacacacccatgtagaaaagttttgatgtgataaaaaagttaaaagtttgaaaaaaatattaggaactaaaccatgctttatctggttttaccttgtgacagatctcgagattgaagacgatactcgagagtactggccgtccttgtactgcggctctttctcgacctgctttggtgggaaaagatctgttgagatggacgctctgttccaaaacctgctcctcctccctcaaatttagggtgtgtttagttcacgctaaaattaaaagtttggttgaaattggaacgatatggtggaaaagttggaagtttgtgtgtgtagaaaaattttgatgtgatggaaaagttgaaagtttgaagaaaatgtttagaactaaactaggccttacacaattacacctacccctcaaattccaaatccggttgagaacagccggcaaaacttggaggagggggcaaggtggcagaccccaagggcgacctcgccgccaccgacaaggaccgggcctcctctgagaagaaccgccgccgtcatcaccgtgtcgtctccttcgcccccgctggtaaccgcaatgcagaccctctttgacaccagcagggaggtcttccaggattcattgccgggcttcgtgccgccgccctaaaccgttgcgctactcgctgcccttctccttctacgcgcgcacttgccggccagcgagggagatcgaggaggaaggaaggatggctggcaggccgagggagatccaatgcagttatactagagactgcaacttaagcagttggaattatttttcatcgtcggatcgaaatgatcaacggttgtaatctgtgccacgtcagttctaaacagtaatgctacagtgctcgctacaggagacatccagctacagtgttttgccaaatagtgcctaggaaaatcttgacggctactttccaatccaacgatgcctatgtgaccgcttaatatagccactgcaggtgatctcaattccaggccgggaccggagagagagaagaggaggcgccgacgcaccgtggtggagatagagagcagggtaggacccactgatatgtgggtcccactattttttagttttatatgactgacatgtgggcccacattcttttaatttatatattttatttcaagtgccacatcaccgccacgtagaatgatgaccaagtcaaaccagccatgtagacgtcacgtctaccaaaaccgctatccaaactaccatgtatttcttttgcaccagttttgatagttgaaggacccattgtatctggtattgcggttcaaagataaaaattgaatttgctgtcaagttaagggatctcaaatgaacttatttcaaccgcaataccacatatcccgacccctcaactaataaaaccgatacaattgaactccttaaatggtgagattggttttcgtaaacgtggcacgttgacttggtcaatctatgctagtcaccaaaataaaagtgagccccgtatagctaggtgtgtttagttcccgaaaaaagttgaaagtttaaagaaagttgggagtttggaaaaaaaagttgaaagtctatgtgtataggaaaatttttgatgtgatatgatgtgatggaaagttgggaacagatgaaaaactaaacatggccctaagtgactagggaaaaacgtaaagcccacttgtcagtccccttctctcctctctatttttttccctaacaactccacgctcggcgcaactcacgtctcacctcgttggccttgcactggcattgccgcagccggagaagagggagggtctgttgcagcactggacgacgtagttggcgggcaaaaaaccgaatgctatagcaacgacacgaagcagaagagcggacgcgtccgcgcgtgcaaggaggcgtgaggtgggcaattggtcattgggggccgatcgtcttgccatggcaggcgaacatggccgctgctgccatgtgagggagtgcactgtggagagaaaatggaggtaccgagtatgaggatgatatatgggacctgctttagttttgttgccacgtaaacgcttagttagtatgagtgaatcagattaactttgctatgtcagtgaaactaatcacctatactatcggagaacctaatttaacctagctttgtatatgttggggagttaaagatttgtagtatacggtttagagatgtattttaaactcgacgtcaacactagtgatctaaattgtagtactactagtacttatcactagtgatcccatcggtttatgcagcatcgcgcttctgccgctgcccgaccctattacccaagcccatcatagcccaaaaaacccagaacaacatctcctggacggcccatgcccgactggcttagggtttggtacttgtgtcctgcctccacatcagcttcagagaccgcgccggcgccgggatgtattcctcacctcccaagggtttaaagcggcgcagtcgatttctcgctcgttcgatccgagcggggtatcgtcgtggttatggggaagctgctggacctgaagcggctcatgtccgtgccgaaggagcggaatcgtcgtcggcggcagcggcaaatccgagcccgcagtaaggcctccctcagtcgttctgcctctctagtctggcatctgtaatttgtttagaatatcactgctccttccattgtcttgtgccgttgcacagcactcggcatcgctattttgcaattgggatgcttttcagcaattttttagtgttgtttacagtttatttttcggcatacagattattttggatttaactaaaccaatgagctggatacattaatgttcatttcgattgtcagcatccactaaaaacatagacttcggtatccaaagataacatggaagcccatgcatagtttcggcagtataggggtaaatatcgggtaaacgagtgcaaatgtgcaatgtctcaactgggtagaacatatgaagtgcccatatgtacataccctaaatcttaagaaaatttggtcggccgcttctttggtcagcccagccaaaaagaaaaaaaaaagaaaaagaaggaagaagtagtgcgtgcccataaaactatattgcttccaatataagcaggacccctctaacctatcgtctaaagaggtgtaaaacaaaatatggtagacttgcagtattttcctgttgcaaaaggagatcactccctgctttgaaagcaaataaggttttcggcatagaagcaactactgggaacaccggcttacatagagagctcaaacaacgttctcaccctagccaatggacagcagtccaaaaacaaagaggaaaataactaaaatggtaaactaaaagacaagtgagctgaaaagcaagtttagatcttggttatgaactcatccattttagttatctcctctggtctgaacaacacccaccagaactacacgaagaaaagatttatcaactacgggactgtctggaagcactatctgctgaggcgccgtggccgcgctttgctgcagcaacagcggctgcagaagccaatagaaagcacgctgttcccacaatagattatttttttagggaatacgctagaagcatatctttgtattaagaggaataaaaattatttacaagaaagattgaaggggacggggtactggaatgcaacaaggacttaggctacaatctcacaaccaaattgaacgacctagggaccctagaaactagagaccaagcgccggaatcgccgcctttgccaggcaccacagctctgcctccgcggccatagctcttgcaatttccgcccagggctgccgctggagattgaacaccaggttattcctctctttccagatcatccatgctaccaaggtcgcaatggtgtcgaatccccgacaccgatccttcacgactttcttcctgctaaggcagagccactgatggaaggaggcctcttgcaggggtaggcaatccagttgattgattgccgagagtgcccaccaccagagttgacgggattcagagcagccaaccaagatgtgatctatacaatagattattttatacagcagaaattcaacgttgcagccgaacggctgtgcagttcagctgcagcccaaaccgctgcagtttaggtcttccaacggtcaatatgtcagctgaggaagttattagcaatttctaataagccaagaaagctgtaaacagtacaggatcaaagaatataatgatccacacccccagttcaaccaagaagctaagaattcagaaatatttgtaggaatattcaattttgtgccatggtaacgcctctttcaaacagcaccaagagcaacgagcaatgtgacattgaaagaaaacatggtacacactttctacgcaattgcattggatgcaattaacatcccctttccaattttttttcttcagctgtagatctatcttgataaagaagccaaacggagatttttacttcgagaggaatttcgcatttccacaatctgcacatcctccaactgatgacaccccagagaatgatcctatcatataaagacaaggcttagttattttcagattatttacctgattgttgaaacggattatttgccccacgcttcgaaaaatacattttctcgaaaaactttcttctcttgtattgcttcgaccacttttttaaagttatttgttaagtttatttatcagaatatttaatttatccctataatcaagtagataatcctcatcaataatctgtttcaaaatgaccttagtggtgtagacttgctctttttttttcataataagaaccaatgctcaagggaagtttttttaatggagacaaattggatttaaagtcactagagttttttttttcaaaaaaatcagacaaaaggtaaccaaattgatttgtggtgtgcacttgtgtgcttgatttaattgtttgcttgtatttgtgtctgtacataaccatgcatgatctattgtagatggttcaattgattcagtggctaaaagaaagggatcactctgccaacaagttgcaaattctgatggcgagagaagaacaagatattcagggcctaaccttccagaggtatgacaccaaatgctgataatgaagctcttatattagagtaaggtatctacgagtctatgactgctataagtagcctctaactgcg

SEQ ID NO: 54383 - DNA, 805 bp, Oryza sativa
cttttaaattttgatgagcagataacacaagaatcagtaacttccaggcaataactaaacttcccatcaccatctcaacgcattctgttgcactttcaacagctgcattcagtttacgctgcattgcattttcccaagcaaggctatacataatttcagggctatactttgccattgcagcagcatcctgtagcaacctcagtgcttcatcttgtaatctcaatttttctgcatgagaagtggaggatctagcaaaaggtccatagcaaacaccaagaagatggtttacaacactgacaaaatggaaatcatgctttctgaaagacttcatggctttatctgcaaattttattccttcagaagcacgctttgggttcttacaacatagtttggctcctaaaagaagagatggaatatgaggcttccctttcctttctaatacgttgaaaccgttccttataatgtttaaggcgctatcatccatgccagctgcactgtagcagagcgcaagaatataccatctttctgatcggttataggttccaggcaacaacatttccagatggctagccaagatttcataatggcctgataatgagagtgcaaacatcaaatggttcacaaggtcaggatcccactttatttcttgaagggctaacttttttgtaagtatcagcaacaacaaaattgcttcctccatgttgttcctaggagttgctggcttgtgttgatcaaattcttgagtaaacttcacttgagcaccacaatacagcagagtcactgctaaatctttttgtaaatttgc

SEQ ID NO: 54384 - DNA, 1339 bp, Oryza sativa
  unsure (1)..(1339): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcattcgattgcatttttcctacatctttcaaaatctaagaacgaacaaaattggtaaggacgtcaacagaaagacgctcacagttgcaagtttgcaactagatccacataatttctgatttctacagaatgcgttgccacagtttgagaagtgagaggtaatttctacaaggaatcctgggctattgcgttcctattgcagcatgatggggaggtgctctgagaagtcctgtatcggcgataactcctggagctcgtaggctgcctggaagcagtcggccgcttcaagcagtgatccttcagatttcaagacgagtccaaggcgcagccaggcttgatggcttgtgggttccaaacggagggcattacggaggaacgttcttgcgatcgacaatgatttccctccaagaatggttagaattcctgccatgcaaaccatgcttgggacatagtctggatcgatggagagggagagcgagaacgccgtcagggcttcctggtgcaaggactgagcctgcaatataaggcctgcaggggaggctatcatgttagcattctccaaaatcataagccgtgaaatgaataactactatgttagatgcccatagtaccaaataatctgaaaggtgcattcccccagttttttttttttgggtttaattttgctcagacacattgactaaagtctgccagtcacaacaaaattttaccaagcactaataatatagcttgaactagtaacacgagtacacgacaccatcgatcatgtttcaggggaaggcctatcttcttctggatgcagccaaactcaaacttcttctgtatggccaaggcagaacctgattttctggaggtgtttgcaaatgaacccaatctaacattgaggttctttatgctgcacataaatatattttgaagtgcttgagaatatttacctctgacatggcagcacttgggagagaaagaactgatagatttggctttgtcaagacagacatttgagtcatgccatgattcaagcttcgtgtatattgacgccaaatctaaccatgcttccatctctaaattctgtagggatttaacctgcaaaggccaaagtgtataagaaagaagaatacaacacaaacattttgagttccaaaaagaggtgaaagggacaatgtgatcgtaccttgtcataaggggtctgcttccagatttctttctttgcttgga

SEQ ID NO: 54385 - DNA, 2792 bp, Oryza sativa
ctaaccaatggtcgatcgtcatcatcaacaggaaccttttcatagccgaaagagtggtcaagccaccgaccacatgccaaataccgtatgcttgaaatttaaatgtggtgcggacttgtacaagatgaaaaattgggacccattggtatgaggcccagaattagccatgctgacaacacctcttcctgaatgtataagttttgaattcagttcatccttgaaaggtttaccccatatggactcccctccacttcctgtgccagttggatcacctccttgaatcatgaaatttctgtaaaaggaattattaaacagataagatttagatatgaccataagtatgcataaaacaaatgactaggtaaaaaggactaatgtgatcagaacatacttgatactacgatggaagataagaccattatagtaaccattttcacaatgtgtgaggaaattttcacatgtccgaggtgttatatcacaatgaagctccaaattcaaatcaccatgggtggtatgcaactgaacatatcccttcttttttggattcttttcaaccttaacatactcaagttcatttttggtgacaggatcataggcagttgatgtgaaagaacgtgaagctgctcctgtggtgtaacggcttttaacctgaaatcattgaatcatctccatcagagaaaatccactgcgtatgtaacacaaaccagacaaaatacattgagatgatacgaaagtgtaccagtttagcatttacaggagctcgatctcctgccatgtgcattgctattctagcagctgttttctcagcagtagcagcctttgctgcggctgcacttctgccatgaacagaagcagaagcagcatctacaatactgaaaggctgatgaggtttaggttctttgccagattttgagtcatccttctccttttttgccaatatagcagcaagtgcagcagctctttccttttgagctttctgccctcccccaccatgcaaaaaagctaactttcccttttcagttccaagttccttaatcatttgcttaagatcaccagaaatatttatgttgtaggttggatcatttttcattcgttgcaactctgagcaacagtcatacagataaagcatgtaagttaactaggaaatagcaatatgaaagaagtaagagtgaaagagggaccggaatcaaccttcatcttcaagtttgaggcctttcttgacatggtcaaattcacctaggatcttgctatcaaccgcatttggattcttcaaagttcataagatgaatataattagattacagggctaaatgtcaacaaattgacactgagtacagtagacatgcagttctaaatacatacctgaattgttatcaagtcatttcgtgtaaagggctcatcagttagcaattctctccaattctttggcttgatgttgagttcttggattgcctgcattttatgagtcaagaatgcatgagctaaaaagtaccataggtccataatactaaattgttcacttgaaaaagctcaccaaaccccacctcataacagaagacgttcccagtagtctttacagcaactatatgcgtgaattctgtaaaaactttattcaaaacagggcactggaactctcctgcaagaaaaaggacagatatttaatgtccgagatagaagagtacatgtaccgtaacatttggttcaagatactctgaaatttttgcgacggtttaactcaccatctgagttcttgtggaatgttaaaggcattagatcttcctgcttgagtggtgttcctgttactgggtgcttcccgaacttcttaatgtatggaattatgctcctacatttatacacagccaacacaggattttcaggatctcagtctctaatattttctccaaaaacatatacaaagaagaacaatgaacttacatcaaatcaaagacgcttccatctgctgtgcacactggatcctcaaatggtaaaaacgtaagcctaaaccaccaaaccaaataattataatcagtggagaacggaggaaattaacatttggtatacagatccatccactactaagctcaatcaacataatctaaaggttaaatatcatcaagtactgaagttgaccacaaagaaattactatactttgctaaccgccttaactggtaacatatcaactaaaagatcaacaggaagcgcaataatgaagtttatgcactaaataagaaaagctacaagctcaggctctccccaaaccctaatcagaatagtaatgactagcagaatacacagaaggaggaaaatctcccttccggctagttccaaaaacagtagaggaagggtaattacgcgcagcagtagaagggaaggcgcttgaagggcgtgccggcctccttctgcttggcgccgccccactccgtcgcccactccgtccgcgttatgaacatccggtccttgctatgctgcttcttccccatctccgatgagcctacaagatcgcgcctacagccggtggtgctggtgccgctgcttctgctgctcgccggcggcgagaaagaggggagatttgacggcgaggagcgtttgggtcggattggtcggggagagagaaggaagaagaagccgattcgcccgcggctcggctcggctccggttggaatacggctcgagccgccgcctcactaggtcggtccagagatagtttcggcgagtttttttcgtttttagatttttttttaatattacagaaataatctatcgactaaaaaaattgcagaaatagcccctg

SEQ ID NO: 54386 - DNA, 3352 bp, Oryza sativa
cccatatgttaagtgaggtattattttgtaccttattcgacgtattagtactcggataatttatataggcctatcgcagtctgggtcgtagaaacattatatggatttaaacaaggagaattatgtaacatgaagaaatagtagtacaatttgaacatgatacgactatttgcattgcgattacatagatgatattagattcgaactaggagggaggtagtgcaatagttgggggcaaggggccgcctgcaaaatagccggccccgactggcttttttgtattcgggccccttgccgccccaccagagggcggcaagggttttcctgcaaaaaaaccctccctccgtcaccgcccgttcctccccccgtttgccacgtcagcttgccgccccagaggtgggcggcagggtctatttttgtaatttttttggccggtagattatttctgtaaatatttttttaaaaaaatctaaaaccgaaaaaaattctagtttcggctcagctcggcccatctggaaagcctatgggccggctatggcccatggatagagtgcaatagcacacgcgagattcggggtagcgcaaatgggcggcggcggcggcgggaggccgacggcgagcggggcgaacagcagcagcagcagcgatgatgacggggacgccgcctggaaggcggccatcgaatccatcgccgccgtgggtttcggcctgccgctgtccaacggcgcggcgaaggccacctctggcggcggcggcgaggccagccacggcgtggagcagcagccgccgcaggaggggaaggcgcaagcacctgggcttaagctttaccagatcaaggttatttcgtgatttattcttgtttgctgctgcttcccgttccttacttataatcgattggttcgttcatgccccccagggataggcagttaggtgcgtaatgtgttactactaacttaacgcattcacttctatgatattctaagctgttttgcttccacacaattatttgttctatggttgattcggatactttgggaaaacgcatactacttcgtatgaatttcctagcaatgttactaccatggagagcacatacatgagtcatcaatttacctatgacccccttcataattctaatagcaataactcctgatggttggtacccttctccatctaccgagattctcgatgacaaggcaaatctagtgccattgtgaatgataactctcaaaggcatatatgacaactgacaagaatataaaaaattttagcaatttaggaaaaaagaaaaatagaaacaaaagagagagccatagattttcagaaacatttgagatactctgtcaattttatctcatcagttagcatcatctaattattgtagtgagtgttgagtcaaccgatgcatggccatttgagagttaagctagtggattttattcatatatcctatgcagttattcgtagctctcttgcatggtttttttatgcataattgagttgatccaaactggaaagcctagagagaaactgtaagatgctgtgacagtgttattgatttggagctgtaaatctgtaactacaccaccacagtttcaccatttcattatggtgagctgttcctactttaattttctctttgccttttgttcagttatgtttatgtgtttccttttatggttgggaaatttcatgctgcgttgtaatctttcaagttccaaatggtttgtttcaggtaaggaacatgttggacaacatgttagagaaaaaccttgaaatagtcaaaactacctgttcgaacttggccgatcctatggaaacagatggagggataaaattatttaaaaaggctccacctggcatcagaatggatgccatgggtaagtgtcgaacaacaagtattattttcaacaatattattgggtaagatctcttgtgttagcaaaacatacttaactgtatatttccagataaataccatgtgcaactgaagagaccaagaattctgcctggaacagatatcgatgagaaatccaagaaggttggatagccattatcataatataattataaccatgcttgaagtttttttgtttaacttataatactattgttccgttgaccatgatttcagttcaggcatatgcttaagtctgttgctgttgatggcaatgatatacttgtttccgcaaagaaatcatcagaaagatcattggctagattggaagcaagagaagctgcagcgaaggcagcagccaagagggaagaagaaagggtgcgggaactgaagaagactaggggagagaaatggcttccttcaattgctagacaaatgaaggtaagaccaaacataaaatgcatactgtaatatgttcttccagagaaaggcccgggggtcttccagctagccggcccgggttcgatcctcgctcttcttgataaattccaatatgagagtccctcattttttatctagcgtaacatgttcttccattgatagtttggtgggattaggatgggaatcaattgatatttgagcggctcttctacacagactatgcaatcacacactgaattgctcctctttcttttccctgcgcaggaagaaaaagcttgggagcaacggaagtgatgatgccaccatcatatcaataggggtacctgtgctaatctctgatgccatcatcggcacttcggcagtgaccttcttcactttctgtctatgacaagggacagtagatagatcatagattaatggatgattttgcgtagctgataattcagttctggatgtcagcattgctctgatccctatatgggccttctttgtagacaattttgtattgtaacattccaggatcttgtgtgatgaaagtagcgtatgtatgcattatttggatatgaatctaaaaagcttaaacaactatagttttgtctgaagtttagaaccggaagaaagtggcgagttgtcaccagcagtagcttcaacgaggctggccaattcagcccatgggctgcagcttgtagcctctttacggcccaaccggagccctcccttgccccaggatttctccgcttccctcgtcccccaccttgccgcgccgtcacaccgccgccgcctcctcgccatggacaccccgccgtccgccgccgccgccaccgccaccgccgttgcgtcagactctgattgcgactccgcgctcgtcgccgacgtggcggaagcgctcgtgtcggcgtcccgcctgccggagccgccgcctatccccgccctcctcgccctctacctcccgcgcctcgccgacttccaccacccgcgcgtgctctccctcgccgccttccacccggggctcgc

SEQ ID NO: 54387 - DNA, 4170 bp, Oryza sativa
tccactccctccgccgccgccgtggcgttcgcccttccctccaggctgccaacgccgtcctctccgcgctttcgcgcagcccatccaccttgccgcaggcctccctcgatgtcttccgctccctcatcgagctccgcctccaccccaaccactacaccttcaacctcctcgtccacacgcattgctccaagggcaccctcgccgacgctctcgccacgctctccaccatgcaggggttcggcctctcccccgatgccgtcacctacaacacgctcctcaatgcgcactgccggaagggcatgctcggcgaggcccgggcactgctggcgaggatgaagagggacggcatcgcgcccacgcagccaacgtacaataccctcgtgtcggcgtttgctaggcttgggtggattaagcaggcgaccaaggtcgtggagtccatgacagcctacgggttcgagcctgacctgaggacgtacaatgtgctcgccgtggggctgtgccaggcggggaaggtggacgaggcattccggctgaaggatgagatggaacggctcagcaccgcgttgccggatgtagtgacttacaatacacttgttgacgcctgcttcaagtggcggtgctcatcagatgcattgaggctgcttgaggaaatgcgtgacaagggggtgaagccgactttggtcacacataacattgttgtgaagagtctttgcaaggagggtaaattggaggaggcattggggaagctggagaagatagcagaggaggggttggcaccagatgtaatcacgtacaatacgttgattgatgcatactgtaaggctggtaatgtcgcaaaagcattcacattgatggatgagatggtcggaaaggggctcaaaatggacaccttcacacttaacaccgtgctgtacaacctatgcaagatgaagcgttatgaagatgctgaggagcttttgcattcacccccgcagcggggtttcgtgcctgatgaagtcagctatggtactgtaatggctgcgtacttcaaggagtataatccggagcctgctttgcgtctgtgggaccagatgattgagaggaagttgataccaagcatttcaacgtacaacacgttgatcaaggggctttgtaggatggagaggctgaaagaagcaattgacaaattaaatgagctcgtggagaaggggttggttcctgatgaaaccacatataatatcatcattcatgcatactgcaaggaaggggacctagaaaatgcctttcgattccacaacaagatggttgagaattccttcaagccagatgttgttacctgcaacactttgatgaatggcctttgtctgcatgggaagctagataaagcattgaaactctttgaatcatgggtggagaaggggaagaaggttgatgttatcacatataataccctaattcaatcgatgtgcaaagttggggatgttgatactgctttgcacttctttgatgacatggaggtcaagggattgcagcctgatgcatttacttataatgttgtgttatctgcactatctgaagcaggaagatcagaagaagcacataatatgctacataagttagccgatagtggaaaattatctcaaagctttgcttgtcctctgttgaagccttcttctgcggatgaagcagatgtcaaggaacatgagggtaaacctgaggcagaatccagtgaaaaagcacaagacaatgctctggagacatacatggaacgcctaaatgggctatgtaccggtgggcaattgaaagaagctaaagccgttttggatgagatgatgcaaaaggggatgcctgttgacagttcaacatatataactttgatggaagggcttatcaagagacagaaaaggcaaacccatgcagctggacagtccacactatagatttttgctcccgtgggatgcgggcatgtgacatcattagggctttagtcataaatctggaaaactcaagtgcttggctaccaggattaccatcatggacaaaaaaaaaagaagtcggtatgtcaacattttttttctgcagtcagaaccttatatttgtaactttcagtacaaagtaaattcatttttagttttttcactgcacgctatgttaaatgtataaagaataccagcagtgatttgaatctttttttgctcctggtaaaatagtgtagcttctagattccctccaacataaaattgttgagcttctacagaaaaatatataatcatgtgcgagttcttgatcataacctattaaatcctaaccacccatccatcttcaacagataagaattgaaaattgtcgatgactatacttagtaaaacaaagtatcttctgtgatattgtaaaatacatcttgacaatacggtccatgttcaaccaatatatatgtcttaatcaaccttgtaaaccataattccgtgcaatcaggcatttactcttggaccttctctgcttgaagttttcatagctgtcacatatgcttgtgtgattccatcagcatggttgagacttctgttagttttcatgaagtatgtactgggtagttggacattcgggcaatgataagtttactcattatacaatgacatccaacagactatagtttcttttgcagttgaaaaaaaaaagatagttacttgcatctattggctattgatgaagtgatgaaccacagattcttatttgtggtacagtgtgatttttttttgttcttgtttgtgaggaaaaaaactgttgtagaatgatgtgcgtttttgctgttcaatcgtgtttatttgaaatatgtttaaactttttttatattcatttcctactagtgatgccttgcctgaattcagaataatatgtttcgacaatgggtgtctatacacacacatatgaagtatgccttgagaaatgttaaaagttatgtaaatgaattgttttaaagttgtccagaccataatttgtcattgtacttaaatatatttggattgtatgttcttttagtcagtggcggagccaggacccagcaacctgggcaggtgcctgggctccgtccaacgcatgcatgactagtaacctaattaccatgcatgcttagctagtcattgtcccagccatgtgtagcagtagtattatttaattaccatgcttaacaaaatagcaaaacaagtgcttgaggattgtcaattttacttgcgtcattttgtatggatttatttgtactagttattcatcaatttttgttagccttgcctcattgcccaggctgaagataatttctagatccaccaccgcttttagtaattttcttctatatttaggtttatactctactgttcttctgactgtgttaagcctggtatttctaaggctcatctctcaactagccaccttgatgatcctagagaagttgccaggacactgcacttcccgatattgttcacccagaaccatctcagggctttattctttcagaaccatatcaagatcttagtcattcagaaccatcttaggatcttattcatacggaaacatctcagtgacttgttaattcagaaccatctgaacataacctcgaagttcaattgttgctgcctctggagctcctggacgtgttgtgcaagcattcataatgtaacaggagagccctggagctcaggtacttccccccaaatttttcattgctaatttcaatagagtcaactgtcgaggcaagctgttcccataatttgccggtttcaatgaggattaaatgtcttttattgacattaaagtttcgtaaaaattgaaccctattattagaaattcatatgcaacttaaattgacattgagcacaaaaattctagtcttcaatgcaacctcttttatgaacagaacaccttgggaaaaacactctcattggatgcttttaaagggaagaaaactccacacaaataattgttcacttaggtgcctaaaaattttgtcccctgagtgcttttaccattttatgttagtttggtccaagtgcaaaatttgttccttaaagtatccttgttgtactgcaaacatttattctactacttaaatttgaggttcttttctctttgaaggcttttgtaacaattaattggaatgaacgtttggagcgttgattgcaggtcgtagaacgtttggaa

SEQ ID NO: 54388 - DNA, 2496 bp, Oryza sativa
tgcccctcaccgatttcattcaaaatgctgacgctggatcggcgggaatccgcccgcgccctctctgccaccggaatgccatcaccacgcctcgccgctctcctccgacaacgtgacgccgctgccgcctcaagcacctccgccagtgatccatactcgcgctgccgatgccggatcggcgggaatcgtgcacgcatgggctaggggaggtgctcgtgtgcgcacgggccgtctccatcgatcgatcgatcaacctgcccgcttgctcaaccaatttgattaacaccaattctgaatctctgatcatgcaagcgcaggctgggatggtggagcagcctccacagatccgttctgtcaggcatcttggcttacgggtgaactacacagcgatggtccacatgttgccccgccagatagagcagatcctgaagagtttcccacgtttaaaatcactgaaaatcctggtaataccaatgaacagccaatcttatccaaatccaatcaattgttgcataattctgaatttgctgcttattaattgctttgcactgatatgtctgaattctgatttttctggttgagtcgtggtctgaattctgaattcgctgtcaattcctctgcacaaaagtgtgtgcattttgattttctgactgagttgtggtctgaattctgaatttgctgctaattagtgatacttctggattctgattattctgattgagttgtggtctgaattctaaatttgctgtcaattgctctgcactaatttgtactatgcattttgattttctgattgagttgtgttgtgccctatttcagagatgcgatgacgttacaggtatgcaaatgaaatcgattgcccgcttgctcaaccaatttgattaacaccaattctgaatctctgatcatgcaacggcagatccgttctgtcaggcatcttggcttacgggtgaactacacagcgatggcatcaatttgcagttgacgtgaacaatcggataagtatatattcttgtgctttctaaattatgaaatggaatatattgttcttttgtgaaatttgatttatctcataaaaaatgtctgtcctcagatatggattggctatttactattgggcaagaagtgtttggtgctttgcatccaacagccatatgaggctcagtctcttggtatgaattcatcagataactcttctcttcgtaatattcatctttcaaaatatcatttcaggatcacgtcaattttttcaccattgatcttggcatagtatgaactggacagactttggtccattcccctggatgtatgcaatatttattccatttcaggaatgtacataagtgcatcatactttgtatttaacagacattgtggctaatggatgatgatataaacacctttgtatgcattttaacgaaaaaccatcctttgaaagctttttaatggaagttctaaaaggttttaattcttgtttattgtttattgatggagagaacaatttctatcttcttaagtagatggctcaggacttggtttccaatgttacttgaaaatgatactgcaagctaatcggatcaagttttgttatattgcaggaggctagcattatccaatctgctgctttgactgcatggcgtgctttatacgacaactgcaggtgaacgcgattcgacttgtacccctgattttgtctggcatcttgttccaccagatcggctgcaatgcctcccgtcaaggagttgaggaagagccacagcaacaccccctaagccggttgccctgattgtgtcccgtccctgcaaagtgctgggtacccattttgctgcttcttttagaagaaaatcgttgtttggtttatagtgtgtcccctttgttcccctttatttcttattgatgaatggaactcattggatttagtttggatgcaactgcttgtcgataatgaggtagcaaactctcctgcatcaatacattggctctctatgtggacctaatgaggtagcaaactctcctgcatcaatacattggctctctatgtggaccgtgcatttgttttacttagtacttacgagatatatgttgttttcttttttaagttgatcttcccattctattacagtaaagtccaagttcttaatttcaaatgagatgtgaccttctgctctgttttatggttgcatgtatttcaactttgtaccaatgcatgctactaaatttttatgctttttctagcagaataaaatcctataaactggtaaataatttatgggcttcttctgcattataatggaatgcctaggctgtaaggaaattaagcactttccagtatttaggcacacatatacggatttttagattaatatatcaatcttccgtgtatctcttatttattaacttctgcacatctctacccaaagatatatcatatatctcatacattgactaatgtgatcattggtgtgtaatgtgatcatttttgtctacttaaaggaa

SEQ ID NO: 54389 - DNA, 1061 bp, Oryza sativa
gatggggctatgcggatttaatttagctttcccactgttaagttgcttgcagttccggttctgaacagctttgtgtctactctttccgacagaccacagattgatagcaccaccattactatgctgagactgtgagcatgcacagctctgaagccttttgtatgacaaggatcaggagttcaggatgcaagtccaccatatggattgaatttggtggccgtgtaatttctgtgtcctgcaaaggacgttgctggtttctttacggctgctatgttgctaccttttcagagaaggtattgcaatctatattcgcaaggctttatcagttcataggtatgttcttatcctatcgcccgacaaatattgttctttcatctttcatattattgatgaaacatcttttaattgagccacaatgagattgatgtaaactatcagcatacaattaaatgtagtgcatggagtttcagaccaacatattctaacaaggaatactttaatagaaggttcaagttagacctcatagctctctctcatttgtgctattctaaaatgaaaggaaacgatgtggtttatgtttctttcttgttagacttcataggtctttctcattttgtgctatgatggaattacaaaattgtagatgcaaagttgattaattgggttattcatacttaaatctttttttctttttttttgccattggtaaatggcatgcatcatgcccaccaattaattattagttgagctattgatttttactgtaagtacagaaaaggatggccaatttacatacatttctctcatttttctcaaataataattaagaattgttcggtgttgtgcaaatagactcaaaataataattggaattgtgttcatttgtgccaggcggtgctattgcgtctcttatttctctaccatgagtgaatagaggatatggctactgttgattggaaatagaagatgaagctttgaagatctgttctctatgaacagctaaaattctgtaaacagtgcttgtggtgcatcattctaaaaagaaaggaaacgaatggtga

SEQ ID NO: 54390 - DNA, 2890 bp, Oryza sativa
gtgcaagcgctagaccaaacttggggggtctgtccaaggccttggtgtcgaattcaccagagattgtcaaaaccgacttgggtttaacctcatgctggagaagagcagcaagctttccagtgttgttgagccttgccttcacagctgtctcggggtcaaccttgtacaggccaccaacagtgagagtgttctcatttgttgagagcctgcgggttaattcagcaacaacagaggatttctgcttatcatcaaggtgatatacacctgacactttaacggtgtcacctttgtccgccctgcacatgtttgtgtaatgtatcagtactaacattacaacccaggtcatgacaagttacaatgaagcatgtacttacagaacgattgcagcatgataatctggcttggttacacctatcgcagcactgtacttggtaaattttcctgtagcagtgtcaaacccagcttctgcaccaaaggcaagtccttgagcaccagctgttccagaaaattcaaccacaggagatggcttcatgccaacagcagtggcaaaacttgcattctcatggaagtattgcatctccacctgtcattgaaaactcagctatggatcgttttcaatttaaaaacataacttgacacgataaaattacctttccagaattgtagtcaggcagcttgacacttgtcacaagctttgtggatggaaggacatcaaacacagtcaaagtagtagagatctgcagaaatcatatatttgtgttacagctagacagatgttatggagaggaaaaaatataaatctgagtattccatatcacgaacattagattctgtgtccactttgacatcgacgagagtactcttgtacttgtaaactgagctgacatcaagagtataaagcccccctttcttcacagctgtggaagtgaggccctgacaaataaaggacaaaatacatgagaaccacagcatgcaagtttataaagggcaaacaagcatacataataagttaatattactgaaaagatagggcagtattatcatagcaagtaagatcattatacatgtgacaaaattttgcaacaatggtcattgtgtatgttgaccattcattgtatgaaaatggtggatgggcacatgggggcaaaaaattatatgagaagtaatttacacagcaccatatgcaaaggagttaaatgcaatgcttgtcgtagcttcaagcccacaacaagtaatagcatcatacatgcatgtatgtatggaatgtaactcatctatattccaaaatcaaatatgaaattcattttttccagttaacagtgtctatttcaatgcacccagataaaattataggatgtatagtttctatcaggagagaagggactatggttggcaggtttttacaatatttaccctatcaccaccaatttgcattgatatattcttaacagccttaattacttgaaaataaaaggaagaactggagaagtaaacctttttcaattcaacaagcatttcatactgaacagaatatgcatgtgtgatagcacaatccagctagtcaactgttgcataaacagaatgaatatatagctaccttattttttgggggaggaatttatttagataggcttaaagaatggaaactcagtaatatcacatctcatgagagtggaaggataggcttaaagaatggaaactcagtaatatcacatctcatgagagcggaaggatcttggtagtataacatggtaagcacaacatgacctaaaataataaatccagatcctcatagcagccatatgcttgaaaagaaatgctagcgcaaatgaacactagaaggacaactgcagttacataatttgttatttgttacattgatacatccaatgaaagcatctagtgattgcaatttataacccatcctagaagaagcctgcaactacaaccagaatccttcaaaacggcaatataagaaatgaagttctaaaataaaagaagaaaagcaaacgcattgtgcagaactgttatattcaaccttgaatatcagaatatatcaactagcaagtagaaacacttcttatgttttactatatgtctatatcataccagaagagtgtttgtactggtccactgatacagatgagtttggcaacaatggtaagtggaaatgaggaataaccaaacaaaaattgctgtggcggaaacaaatcatgataacattttacacattcaatgtttccaagagtactggttggcaatgatacaggtggctaaccataacttcaactctctagtttctccaaatcgtagctacaacttatgtttctcctattactccaatcacagcctacacactcctacagaaatactaaaagttctaacgacactgccaccaagatgtcatattacagatcaagcatttatacttcgtaactgttcatcatagacaaacccccaatgatatctctattgcttcagacacatgcagaatcttcattgagtcaggaggggagcagcagcgcctcgaacaccggtgctgactacactacctcctgtagcagaattgaactttatacgatctagctcccccaattaattccctcaaatatacaagtcactgaattgctctacaaaatgaacgatttcccatttcctatcaggctatcacgcagctaacgggcattagcactacatccattcacatgaaaaaacagcaaacacgccgaggaattgcagccacggaaagacctgacaaacccgaaacctaaatagcagcaattaaacaggccatgagcccatgactacagcacgcatcctacccgtcaacaaatcaagactacgcacaaccacaaccacgactagatggcaaagctcgcgggtcaaccac

SEQ ID NO: 54391 - DNA, 7817 bp, Oryza sativa
acgagaaatactagcacgggcagttgcaacctggagtaaccccaacactgcagtcacggcacatgccgccgccgccggtatttcccgggcgacgaattcgacgttccagatttgtttccaagagacgagcaacagttgcaatgccgaacatctggcagagcacgtacgaatcgcaaagacgcaggaagcggcacagctcatgtgcctgagaatgtcttttttttatttcttttaaaccctttcaccttttaattttaaaataaacccttccaaaaacatactcactccatttacttttgatagtcatatttccaaatctgaaaattttatttttgataggcatatttcaatccaacaacctatcctcttaataactttcttggatttaatgcatgactatccattcttacacacatgattggctacatgggcattgagaaatgtaaatattaataaatcgtttgtttacgaggaatgactagtagcatgtttaaatggatgataagtagaattacttatcattggtctgtgtgccaagatgaaatatgactatcaaaagtagatggagggagtaatttcaaatacgaactttttgccacgccaattaatttagtgtggcaaaataacaccgcagtcgatagaaggataatttcaaataagaactttttgccacaccagttaatttagtgtggcaaaataacaccgcagttgttagaaggttcgtatttagaaataagtttataatggattgttcttaaaattaaaaatttataaggttaaacagtaacaaaaatttatgcctgagagcttcttcacgccctcacccaacatgatccccacctacttgccagctccacgcaacagacacgctgtgcgcatgtgccatcacacttccagcaacaccaggtcgcaatacccaccgacaaagcggcgcagttaaccgaagtaaccaaactcaagcagcaaagaaaattctggcgcgtccagttacagtcagatatgcaaggcaaagcgatttttcacagttcattgcaaggatgggttgctgagataacattaccccatctacaataacagggtttgttgcgcagactttcgcgtagatagttgcctatacacaaaagctggggccttttgccaatgtgtagcaaacaaaattgtgcctcccaaatatgaagggaaacacaccacaccggccaaaatcaactttccatattttaaacctgcattgaaactataatgctagttacaggtatcttgtgaggatttcatctttgatgaggtcagatcctgatgtcttcaatgtctgagagaagggtggcaccacccgctgatctttcatcggggaggctaaccactagctggccacaggcgccagctatgtcttgacccatttgctggcgaatagtggttctgatgttgtaaattcctcttaggatcttctggaacttcttcacattatgttcgctgctagtcttgaaattgtttgatgagccaatgggattgaatggtatcagattaacaacctgttagtgatcaagagaggaagcaatcaagagagaattgattcaaaggttccaatatgaggatataacacatattatgaagacaataacaggcaaaccaactgaagatgttaatatatgaaaagtcaaaccactaaaaggaaattctccaaacaaatacaccgtgacccaacagaaagaccatgggtcataaatcataatacaagtgggcagaaattagaatatcaaacaattgaacatccagggtaagtataccgcaaagatgatcaggaaggttttccaaccatttaaaagaatcattaataagataatcaggatgaaatgaagcagaaagaacagaaagtttcttaccgctttaaacatttcaagtaatttaccaagctggtgggcatgctgctcctgatcgttaactccatcaagcatgatgtactcaataaagatggtctgcttgctgtgatcgaacattcaggtgtttattgaaactcaaagctatcggttcttatatttggcactgatggtgatatttagtaatcttattcttacctctcattttgatatgattgcagtgcattcattagctttactaaaggaaaggcccgggcagcaggcattatatgacagcgtatgtcttggtcaggagcgtgcaaggacacagctagatttatattgggaagatcattattgaacttattgatggaatggataatcccaacctgcagtacacaatattaagattcaaagtcacaattactgctgtttcagtcctaacaaaagttcaatctttcagctgcatcaatcccaaggaaaattcaattgctaaactaaatattagcaggatttacaacttaatggatcatatagggacatgcatcataatcacaacgatttactaatgtcaaaacacgagcataaaactgtaaaagatcaagtaaatcagcagcaaagctttcaccagacagaatgataagaaccatgctatactgaaaagtaaatctgaggagtaaatactagaaaggactcaataataggtgggtggaaatatatttttgattcctaagaaatgtatgataatagaaacctgatagaacatctgaaattcattattcatttagaaaggcattgtacaatattaaaacaggatatccttagaatatccaaaagccaactgcaatacttgcaaagttggtgaaactcttttccgtattttccaaaatgtgtttagcatggcacaggagcaagtactaggttgttcagaaggttaaattgaacttttaaaaggttaaatgcaaacacaagatagccttccaacagccatctcaagaacaattattccacatgcaaaatgaggtacttgtgcagttatactcacagtagatacagtaattctcttaggtgaaagctggaatggagagcctatcaagacttggatagcttcaaccaaagcagtatagttgtttaatggctcccccattccctgcatataaagcagaactataaggtaaaactcctctgcaaggtaccaataagcaattcttaaaaacacaaattcaaaattgttatctgctaatttctgtcaaatggaatggcatgactatagaactgggagaacagttcattaataagaacaatttaaactcacaaatatgcaccaaaacaagctgatgtaccatgcattcatgcagtgtggtggttttctaatttctcagatgggaagccatctaagcatctaacccatgtaatggaatacaatacatatcctttctaccttaatgaagtaaagtgggaaaactcacacagcaagcccgtttttcctatggaagacataaaatctagcaaaaacagtacagaataaatatatatatacataggcaatacttcataagcatagcatggcttgccttgccatggcctgtatgaaatccagtgggcagtacaaataaaaccaagcaaacaactgaatgaacagtgtgaggccactaggtctggatgatgaaaacatgatggcactcattgttgcctttttgcacatccagtggactgtgcacgatttccttttgaaaagaaaattcaggcaaattccaacagcttgaaattttatattaccatgaaaacaacattccgaatctgagaataacgggatgcatgaaccaactgctccacaatttctcctgaagacagattgcttttgaagcccatcgttcctgtagcacagaatctacagcccatcttgcatcctacctgtgttaattttagatgcaaggtcagtgtctatcaagtaagccaccagcttcccaaggataacttacgttgtcacaaatatagttgcccacaggacgacaggtcatcagaagaaatattggcaatacatgaagacattaaagaatgattttcacaaaacaacttgccacccaatgtgcaaggcagatatatctacctgtgaggagacacagagggttgagcgcacgccaccaggccgaggcttcccgtcatacttccccaatcgcgtgtcataccgcatgatcactgcttctacagattccccattctaggtcatgaaattgaagaggaataagttgatattagcagaaaaggatcaacgaaaaaaaaatcagacaacagcagtaacaagacaacaaccaaacggaagggcaactgacagttgacaacttgacatgcatttacatgtttgttatcagacaaaagagtaaccaagttcaagtcaaactggagctgcaaaatatactcagagtttaatttatggttggattaaaatttgaaaataacctacctaatacaggacacgaactcattaggtcataacccttacattgaatcttccaagctttgcatcgagagcgcaatgataacctaggaaactataaatggcttcccaagggagagataaaagtgaaaacacatgctagaccaaatccttcgtttctaatgtacagcttacttgagatactcatttaaattcagtccctaaaagagtggcgtgccaattgtgcaagtatgcgtgaggccttctgttcatatccacatgcattcaaatggatttaaaatcaatagagcggacgtttcggaaatacccagagcaaactgcccacatacatcgatgctattaggtgataagtgctagcaggttaacagcggtaaaaaaattacaaaccctaaaacatcttgcagacttctcctgatcccataatcaccattagtactgcatgttcaaaccaccgaaatgtgcaatctacaaaatcccccaagtttgagcatacagcacgaaagtggcacaatctaattcaattcaccttgagtcggataaggagcttggtagtggtgcggtccttggactccgcggcggtggtgagcgtcgacgtggtcggctggaacttctgccgaaggagcgcgtacgcggccgccgggagcgacgggacggcgtccaggtcgccgcacctggggttctgcaacacatacctgcacgcgaagaggaaatcaccccttcagaccaagacgaggtttctatctctcggatgacaaaaaaaaatcgagaggcacagagacggcgagcgcgtagggttcgaggggggcggcggaagggcgcgtacttccagatgagagggatgaagtgaggggagatgccggccgccgcgaactccgcgcggatgtaggcggcgtcgaacacggagcggcgcggcggaggcggcggcggcgacgacgaagaagacgacgacgacgacgccattgggattcgggaggagtggagtggggggaggggatgcggcgggggggttggaacttggaaggctggggcggacgatgcgctgcctccagcagcgtgggttttgggggtttcttgcagttggaaatgcttcgaaatgaaatgctgcccagtaataatatgggctgccaactgaacagctgttgatagttgataagagataaaataaaaaagataaaagataagagtagcggactacagatttatagccagctacagcacagactctaaaacacaatatgtatatgataagtgggataatatattttttttgcggggaaagtaggataatatattaatagtgtagtatgtatttgtagataattattatatgaattgactataatttagagttagtcgttatctatactattaaatttgctcttagtgaagcggagaattaaaaacctgaatataagaagcagtgtaatatataaaaaaaagtatcgactgattgctacatttgcagcgtaaattataatttatttcttcattttattatatttgttgcgttcaactttaatttttttttatcaattaattatatatttgtgcattataatgggccatacaattgaaaataggttaacgcctgaaacatggataaagcataaagcggagtttttttttctgaattgctaaccacttttccttttctttttctttaccgaattttctttttttaggagcagagcaatagcagcttctcttttctcttttcttgtgcgctgcgcgtgaggaagatggagtgggaaggaggacgactattcttctatgttatgagacaaaacacattcaactttaaaaatcacaaatatttaaatataccatgtaatcgaaagatgtgttattgtgggatagatatattcatattaaccaatgctgacaaatatttagaaacatttcctaaaagagacacatgttttgtattacaaaattttaagtattacaactctcaatatcgcatgttaatttatcagccactaaaatttaaattatacaacttaatttatacaattgagtttaagtagttttatttgtcggtctatttttgtgcattgggttttaaactacaaataatatatagagtgaattgcacccacggtacaacaacttagcaggtgggtgcgatatagtgtaagaacttgagaattaaacgtccgagtacaacaacttgacaagtagttgtgttctactacaagaacataacattttttttgagaatttaacaatttattattttggtgcatcaacttggtaagtatatgctagatgagtttttttttacgatgtcaatataccattagatagtaatcttatggatattaccttataatattaaaattaatttttatgaattatattgcacatagtagcacaatttatatccaattacctttaagattttttttttgttttcttcaccttctcaaatatcaatcgaaatataataatttctacatccagtttaattattttaaaatatgataacttgttttaaaatatataacaattaccccattaattattttaactttttttgtttacatttctacaacttatcatatctaccaatcagagttacttgttgggttagtatagaggtgcatgtaaccaatgtgaatccttttgatcatggtggcattttccattcaaatgaacatcgaagctatttgtatgacaagttgaaagccacctttcgctgaagagataagctaatgttttgtataccaaccaaacacactaaagataaagattaaatgtttacgtaaaacgatgtggtattaatatatgattaatttagttttaattattacaaatttaaaaaacagatcaatttaatattttagagcaacttttatatagaaagttttcacacgaaaccgtttagtattcaaaattttatccaacttttgttggagaaaagaacatacctaacacgttgcaaagagaaagaaatggcgaatatgcatatgtatatacgtgggcgcatgtaccatttcaatcgcccagattgcttcaaagtccataaatgatagagagatatctatgtcagactcacagggcatatgtaactaactctatggattttactttttggctcaacaccctgctctcgacgtttgctcgggacgggaggctatgaaatagttgaaagcagatgcaacattaaagaaagtaaatccagtagccttaagtcataccgaacactatgtcctaatagtaagggatttctttcaacccggtggtaagccggtggtacccggagaaaacgttgcccgaaggaagggactaaacccatctgttcaagtagtagccaagtagtaccgaaggagtatctccgagttaaggagtaccaaatacgagaatttccaccttgttgaagatatggtggtgctacccgaagacttaaatgaatagccatcgctgttaagaacaaccgagatccaatgagaatttgcgatcgagctttaagcagtgttttagatgaaaatgaggtctattgagagaat

SEQ ID NO: 54392 - DNA, 10499 bp, Oryza sativa
  unsure (1)..(10499): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaagtcggagtcggagaagaaaaagttgcggtccgcccccgagacgacggagtgctgctggatcccccgcgagacagggggctgctctcagccccccttctgcgcgaccagccccgagggcgccccaagtgcaagggggagcggttgttcctctcgccccccacttcgggccctcgggtagattcggcctcggcctcgggctcgggcccgcccgcagttttggcctcggcctcgggctcagggccgtctccggcctcggcttccgggctgcgacctccctcgtcccccgctcccgggtggcgctccgcatggatccgggtctcagagccgccctcgggagggacgtcaccgccgctatcgctcgcggcgggtcgagtcccggctgaggtgaacccagggtcggactcggtgtgcggcccgtgggccccgccgggaggctgtgaaggccccgcggccctggatcggccaagtccgggccgctctgatcgttcggattttgtcccctgcaaagggtcggacctcgagatccccaggaaggaatctcactacaaaataaccctgatcgcgttaacgaagaaaaagaagaggagggaacaagagaccgagatgagtaaaaagcaccgaagcgggtgccggcagtcgtacctgcggggagggcggttgaaagtccacttcgggggctcaatgaagctcccccgacacggctccgtttggcctatcttccagagccgcttcttcttccgtccggcctcaggcgcagtggggcgcttgtggcccgccgacggtcggtccgccccgcgctcggcgccccctctgtgtgggggagagggcggtcgagattcggacatcttccgcttccctttcgggtcgctggccgagtcgaccccgggtccgcggctcgggccgggtgccctggagctgccacccccgctggggccgcttgtccgactcccgcctgtggtcaacccgccaccacccacgccgatagcgctaccaccggtgccgccccggcgggaccgactcctgctggcgccgatggccgacatcacagccaagatactctcccggtcgcggtcgctacagaggggaaggatcccgtctggaatcagtgtttgctcggcagtgtccacacccagcacccgccgaatcaccgtcttcgcgtcctcctcgccccagtcccagcgctcgcccacatgcgtgcgcatggggtcgttaggtccagtgtactcccacgcgccatgggatcgatcttggagaggcgcgatacggcggcggaagtagtcgccaaagaccattgcccccgtgaggccaaggcttcgcaggcccctgaggcgatcccgcaccgcgccgtactcttcgcccaactccgaaaccgctagccatgtggcggatcgttcgggagggccagcgggaagccgaagtcgcgggtggtccagcagcgcggtgtagaaccagtccttctttctgtcctcccatttctttcggagatggctctcgatgtattgccccgctgtgcctggccggggctagaagtaacatccccccaccaccgcgccttgcagcagctgccggacgaagaaagactggaacagccgcatcgtcggtcgcaccccgatgaacatctcgcacagatgcgcgaagatggccagcgtcatcacggcgttgggtgcgagatgcaaggcatggatctcatataaatccaaaacctcgtggaagaatccagagaatggcgggatcaaccccgccatagcaaaggacaggaggtgcacagatcactccgggtaccgcggccgcggccgcgactcccccgccatcacggcggcgccttccgacatgatcttgcgggggagactaaggtgcctatccgccgtaatgcgcgatgccggaagcactgcgtcaccagcatcttgagccatgatgaccggcggagaaacggtgaggggcttagcgtgcggggtagcgtggagtggcgagaatgttagggcttagggaacgagtttgcgggtgagcagttggcgaaaggaaggaggcaaagtccccgcctccgtatccttttatccttgcctcgcccgcactcgcctcctcgtttcacgccctcacggttgcccccacgattctcgcgcccgcagttgcctaatcgtttcccgcgaccactcatcacgtcgcccactgaatccacgccccgcattcagtgcgcctgtcagcggcacactcgataaagggcgtgcgacggtcacgggcgcaatctaggcgaaccgtcaccagtaccgccacatgcgtggcgggcgagggagtcgaggtgtggtatagccgaccccctaattttcacgccttaagcatcctcatcatcagcgcggtcagtggcgatcaaaccgctgttgtggttgatacgccgacctggccactcggcaacatccgcttaggttccctgccgggcccgcaaccccagcttgggaagtcgtgaggcaccacgtcagaccgacctcaggaggccaatgtccgatatggtgccgggggctactgtcggagatatgggctcgggggtatgcgaagtgtggggaatctaccttcccatcctgccatgtgtccctacagcctggtcctgcccccgcagtccgcgaaccgcaggagcggccgggggggtcggggcctcggggtgccacgtcatgcccctcgggcccttgcaccgctttgccccgaggccctcgcccagccaccatttggcggggggagcgagcgaggtgagggcccaggctgagcctcctttaatgcgtgcaacgccccaactgccccctgtcacatttaatgtagtgggggcagacgtgcggcgtgctaaactgacgcgccatagtcaagaatgaccggtctgtgaccggcctaacgctggtcacgtctgactggaccgacaaccgtgctcccacgtcgcatctgcttctggcggagtagaggtaggtatgacccgtcccatcggagggtcattcggacggcggccaccacaagtcttcacccattaatgagggaatgacagggctgtcccccgtgtcatgcgagggacggcgctgagccccattcaaggacaagctgtggttcaggttccaggcgaaggcacgggtcgagttccggtcaagatagggtgggaccccacccgaaagaagagtaggtagaggcggtgcatgtggtatccccttgagatataaaaggagaaccttgcccaccgagcaaagggacgattctcaactaacttgggctctaggagaagagtgttctcccgagtttaggaacccttgtaactctcaatctaaatcccaaacacaggagtagggtattacgcttctcagcggcccgaacttgtataatttgattgtgtgcgagctagctaggggccttagggatggatacgtttctagaggcgagtttcttcccccggccgaactcacgaaaggggggtttcacgacctcccgctagagaggatcatccctcgacaatctcccaatcacgatgtggttgtgctgcataggttttaaacttttgaggagatgttttctcattgtttacatatcgcatattaattaataatatagattaatatatatcgcatattaattaataatatagattaatatatgatacaagttaaaattcgactactacaagttcaaaaaaaaaactatagttaacggttaaattcttttctttatgttgttgcaacttgtaaaggttaaatttatcttttatgtttgtgaaataatctactgatctatcacatattaatcctatattgttgatttttttcagttttttcataacaatttaaatgatatttaaataataagtgatgtccctaaagagctccttataatcatttcccgtacatcgggaggaggatttgtacagcgtcaggactcacgacaacggcgtgcagaagcagatcacagttgcagcagtttctactgcctggcagcaggataaactcccagcattaacatcacatctaggcatctatattgataatagtttctttttccagggaatgcgcacaaatatgatgcctggaacagatgtcattcaccaatgtgttacatttagctggttactggtcagagaaacaggagggagggagggagggaacatttggaattttttacatggagagaactccacatggaaaatggaaaaaaagaaaaaaactccatcgagacaatttggagaggacttaaagtgttccttcaagagacaaactatgaagtgctctagatagatcgctagtcctcagtacacattttcctcccagaattttcattcctgtcaagcagcaaaacaaaaatgttctaataagctacagtagtaaagaactaaatcacataggcatgctgtcaacactacagtaaagcctataagcaatagactgagatgtaacactgccaaacatctcgtttgagttttatcttttttctctttgttattttcaaaaccggtgtttcctcactactcaaatatgaccaaagtatttaacagcacatgtgattattctgagaaaacggtagacatctcctaagccaagttttcttaaaaccaggtaatttgattcctttgaaccataaactgtttttaatgtcaattaaaacgtaatactatgaagttcattgaagataatctattccagtgaataccatcatattactatcattaaaagaaaagaaacagttggttgaaaggcatttttaggatactcaccccaaaactttgcatcattttcgtcagtggataacagaacctcatggatctgacagtgctctatgactcccaggctccaaaattgattccatcggatcatccatcctacccacagcaacagatgaaggtataaatagatgttggacagattcaatttcagtagttcaaagtacacctcacctctctcaagtaaaaactgattatcaaccaaatacaccagagtacataggctagaggaaaatacaaaatagaagagagagagagagagagagagagagagaggaagaagaagcaattaatctggcataccctgtaagatgtgctggaaattttggtggccagatcatcagcagtggatatattctttcaatatccccatcctcgggacagatttcgtaaaccttggtcatgttctttgcaacgatgtccaataagaatatagaatcatccagctttagaaatgctgacttcccagcgtttgcgattccgagaatactgacatgggcacacgattctccagcctctgtaacggatgcttgaagtatatcatcccttgcaacagaatgagataatgtccatgtaatttgagacaagttgtgagtccacacttgaagttttgtggggtggagacatacgagagtaaactcatcctcgagcttgccttcgcacagatcaacctcatcacaatcttccaattcaatctcatcagtaatattcactttggtcaactccagagtcttgcaatccaacacaatgatgatgctgaagttagtgaggagaaataattttccaaaagcatgaactcctaatggtatgaccagctcggcctgttcatcaggtcctgggaatgaaatagtgtcggacgcacgaccaacccagatgccatcaaccaaatgaaacagataagctatcatgcacttgcatttgtagcctaaagccagtcggtagtactctctcccattaccaccatcctcaggaagaaattcatggaggttgtaggtgaaagaacgatctagccacactttcagaggggtctgtgggtagacagaaatatcagcaggcggaagaagaggactatgcaccgcaagtttcccatagatttcgacaagcacacgcccatttctggaatcccacatgctcaagggcacatcgctccacgcatcgaagtgtcggctggcgcggccgaggagaacacctagctcaggaggatggccttgcagggctacgaagcgagggcaagagagtaccgaggaatcgatgtagaaccccagcgtcggaggggggtggaggctgcggaagcggcggaggaagaccaggtcggaggcgttgcggagccaggacttgcagacgagggaggcgcggactaggcagtggggcaacgcgacgcggacgaggatctcgcggaggaggtcgtcgttgtcgaagacgctggaggtcgccgtagccgtagccgtagccgccatggccgtcaccgttgctgatagggataaccgcgccatcccctccgatgcagcaccatcacccagctccccgacggccattttctcttgaggggaggggaggagagggagtggaggttgacgagggagagacggggaggaggacgacgacgacgaggagtaggaggagaaaggggaaatttcgataccccgccgccgccgccgcgccgcttgatcaaccaggggaaattttcgtttctccgtgcacagtgacttctggaaacttcgggaatcccgcggagacttctggaagcagcaaatagattctggcctcctgtgtcacttggaaaatttacacgcaggaactaggaagtactagtaggagactactagtcattcccaatgaaatacacaaataaaataacaggatcgctaaccatcattcggcagacaatccacctttttaactcttgagaatttcggacaatccgaatgagaaaacatagaaatagaaaaaaaacatgattttgataggaatataagtgtaaaacagatgattgcaatacacaggaaaaacacatgaatggtcgtttgattggactgcaggaaaaatacaggaattagagaagagataaagactcaaaggaaagtttccaagaggttttacctcatgttagaattcctccaaaacttgcatggcattaggcaatccataggaatttcataggattccataagatccattcctttgattcaaagagctatataggaaaaattcctataggaatgaaatcctctaaaattcctatgaatttcctttgaatcaaatggggccttatcattcgtgttccccttttccttcagctctagtgatctactcgtcttctccaacacttgcgacaccttaaattttggtagagacctacgaattagggtctcgagttagggtcagggtgggtagggggaggtggagtttgttagttttaatgggatggcagaaacagcctagtggtgggtggtgggtcaggcatgcagcgaggtgatggcagcgccaccaaagccatttggtcaaaagcgggcgttgggccagtgagcagtacggaaaaagtaaaaggaccaataaggaggcgaaggccggtggtggtggatccgatagcaccgaagatagggaataaggcgatacgggggtagctcgctgccactggcttgacgaaaagaagaggggagggatggggcatgacgaaaagaagaggggagggatggggcaggggggaggaagcccgttgaccggggagggggctgggggctcaccagagccgttgttgccctccggccaagcggtagcgcggtggggtggtagagacgggggatcgggtgagcgacgacgcactgatggtgtgcaaggggaatggaaggaggagaggagttagggttaagggggtgctacacgaatcctaaaacaaatcgaatggtccaggaaacacaagatatatggtgggattttctacacatgttgatgttgacacaaaatctggtgcaacaaaatgaaggcctaggagatctgcgcggtttctgaaacgctgagcagtactcaagggattgcaactattgaaggaagttgtggccgatgcaattgagattattggtgtccccagccccctttgaaacctcgaccccatcagcctgtgcccctgaccgagccaaagtggtgtccctagccccctttgaaaactcgaccccatcggcctgtgcccctgaccaagccaaagtggtgcagccagaccacgtatttttttcgcccaagcgcacactaacatggcatcgctacagtaaaaaaccatgaggtggcgtgctaatgtggtcctcttttcctccctctctcaagcatatatgtatgacatgtgggtccagaatgtcaggaacgaggtatctcgacggaattgcggctatgtgataatttccagcgttaatgttgcagttttctgaaatgtggtgtaaaggttgcagcaaagtgatagtttagtcaataaaagtgtagttttctaaaatttactctaataataagtagaaataatacgtaagatagctagagaatataagcttatataagttgatgtggtttacgataattattaaatagtatatagaatgatgattcaaatgtaaaagtaagctaatgtggctttatgagaaaaaaaagagagagataatttggataatagattaatcatctaaagacaattatgtgcaatatgttcagcaaaacacaattatgtcccagcgagttcaatattatcctacaaatataataaattatacataaaatcaatttaactgatactcaacacatcgtataaaatgaacaccatatataagagtgctttcccaatttcaattgcacgcacgtttgaatgagtcagtttgcggtacttattaatacaactcaaagctttcacttcagtttaacacttcattccagacacaaacgaagtgttttatttaattgttagctgcaattcacagtaacaatgcatcactgcagtaatttacaaccaccatgttagtttatccccatgacatacgaccagcgctgttaccagctcctcctcccttttttccacttgtcatcttaaccagcagttgttggtgcaaatgtcgccctgaaggatcatcctgcatttgcaataagaaaaaaaaaaactctagtcagaagttgattgcaatttaccagtctattctaatatttgctccagtgtggtgataatgaattattagcgacaaaataataactatggtgcatatctcaccctaagacagctgttgaatgtgccatctttcagctgaggaggaaggcaagtctgcagtgcagcgaaacccctgaattgaagagggaaggaaatggacaaacgacattagtgcttctgaaggagaaatatgaaaacataattcggtgacatttaagcgatagaataaacctaggattctctgacatcctgaggtaacaacggataacgtgtttcagcaacctcttggaaggctgatcaaccattgaggtaaccacggttgctaaagcagctcccacagcatagaaccgatcagcattggcacaaacataagctagaccggcgtcatctacgacaattttttcagtgataaaagttgccacctgcatgcatatttgactgaatcagtttacgagagcaatgggtttaaaaattagcagactaagggaccattttcagaacatcaagtatagtttatggtacctatatttggttttaggtctattttttggggggaaataaccgataattggtgatgacaacctagcgtggccgttggttatatgtgctaatttatggtttgtttggttatatataatccagaaaaagcgagccacttaatttaatgtaaagagtattcatatatattaaaattatatagatacaaatatggtatactgagtgagagtagtgtacttcacatattacatgatcaaaaaatagctaagagtactcaaaagtcagtagatggccactagtttgaagcattcaatcaatgaattgatgcaaaactgcatgatcgaccaggcctaaagcacattttgaattgactagtaaaatgcccaagctttgctatgggcagaagaaaaaaaaatcataatatgtcataccaatatatatatatatatatatatatatatatatatatatatatatatatatatatatatatatatatatatattttatcaaataccttactattacttctttacttatttacttatgttattcacttgtttggaccaaacgttggactattccataataatacaaaatatcatacggtaatttataaaaactacaaaagcaatagcaaggttagagatgcaagtgggcagtcccgctacccacataaaaacccatttgctagttcatttcccacatggtagtacaaaattttagaagaaaaaaataaactagaagtgacttaagcgggctaaaaaaacccgcttgcccgccccgcttgcattcctaagtggggtgacagattcactgccaccaccactagaggcttttaaaggagtataggtgactctaggtgaaaaaaaattaaacgtgttccttccattttttttgacgggaaagaatactgaagaactaaaggtggtactccctccgtttcacaatg

SEQ ID NO: 54393 - DNA, 9906 bp, Oryza sativa
  unsure (1)..(9906): unsure at all n locations
atctacaatgacaatttataaataatatagttgttacccactaactataaagttcaacatgcaagtgtgccacatgatcacccactagtaattattatctatagtatcataaatctcattcaaacatatattatttataattttgctgtattttgagaactcaacatgtaagatatgtcaaaccatcctctccacattattttcatattatttaaacatatacatatatttttttctataatgtataacatgtattcactcagatatcctgtagcatggtgcagggtatcaactagttaccttaacaagagcgccaatgacacccaagctggtcaaccgcaagtactcaaattgtttggccttgtcatcagtttccaaaaatgcacataggtacaacggaatgcgggctgaaaaaaaaacaatatcgaaagataggaaacaacaaaatcactaatagcaaacaaacaaaagactaaagtttgtaccatgaattattttactacaaaacgtagtatatgacacccccaactatcaatattggacattttaaccctttagcagtttttgaatggtttttcatacacatgaacgccacataggatgccacatgtactagaggtccatgtaagcccttatgcattatatgggccctgctcatattggctgcctactcgttgctcgttggcatcatgtgacggtacattgatggagtggcggtggcacgttgaaggagtagcggcttagcgacgagcagccgcggcatggggaaggagaagcagggagtagggagcggggagcaggggcaaacggttgcttcgtgtgcccatggaggcggtggtgaggggaaggagtagcggcgagctgctgcttcactcgctcgctcaggcgacatggcggggaaggagcagcagtgagcgattcttgttgtagtagcctaataggtgggacccccacccctcttcttcctcttctgacatggcatctttgtacaggttggatccttcatcatgtccacgcatatcaaaaccaacctaaatctactttagagggtagtgtttggtattgatagttgtggggcaaggggtgttatagctggttttgtaattaggggtgtgttttagataaagacaagaagggtaaaatagacttatttatcccaaaatatatatggaatcataggtatgatatgtataggtattacttttattttgcgaggtatagtaatattacataataatgagtgacatcattgaggttgggaggaagataattaacaaattaccccatcaacatatttcagtttagacatatccatgatctttaccttgtaagaaatgggtcctagtctccgaatgtgaagcaatacactgcgcaatgcaaataaattaaataaaatatgattatcatagtatttggtagatgagaaaaggtagcaatataagtgtacctgaagaagtgctagtgcattgcaaactcggtttgaagcacctaatgacaaagttgggggtgaaagtgcagggtagactactataatctcctgtttgtttgtcagtaataagaaaaagtgatgagtgtttgttataccacacataaataaaagtaagctcagacatcaacaagttgaattagcacagttattgatatgatcatcaactcaacttgtgctaatgttgaattactaagagtggctgacatcaaaaccacctttttggagaagacctcaacaaaaaaaaagatcacgtaaatagtacaacacaacaaaaattactaattacttgtgggatcaagcatgatcatacctggagcagtgaagcaactatgccaaaagaattccacaacagcagagccaggttttgaaacatctctcttttctgaaaaatagtttcaagaagctgcattattcttaggtttttctttccatgatgctgtaatgtgtcaattgcataatatgcaatttaccattacttattcaattaagaacaattacaaaaataatcaacctggcaaatagaaattaattaatatctcaaggtaagaagatctatcaaccctttgagacctcaaggtgtgctttctcacatagattagtattagaaaggttgaggacaagtttctctgctaatgcgatgtgtactgatccttcgctcactaccaggtgacacccaatgtcagagcaagaaagatttttgagccaggcaaacatcactactactatcatttgctacggaggaaaataaagtgtttttttttctgtttcatatagatgtatgcttttataaatatctaggtcttagcttcattggtaacatgtaacattacttccttatagtcttgctctttaagggaaggcatgaagcttagcacgcttggtgggagatgtgcgtgcacaccctcaacattcaatctctatgtcatgttggaatcaacctatttgcttatttcttctctactagtttgatactgagatcctccttagtatggttcattctcttttggcacttccatgggaaagttcccctttccttatgcttttcttttgtttagtttgtaccttttagaagtatgtatgtaatgcacatgcctttttatcatagatagctttgtctttatgtaagaacaagggactttgcaatgtgaataaagtctgttccaataagattttggatgtattttggtttactttacataattgtctatactgcagttaagtctattctacgtagatcttctgagttgtgtacactttttctcaacctagcatcttttacacgtgcaaatgccaaaacccaagaaaaacaacttttggtcggttttccaaaagccattccacctctgcatgtatgtagaagctactagagtaattcccaactcctacccctctccctgttttatttatagcggccagtggaaacatgaatcatgtgaacttcgaacactcaccctcctcctccctccaccctccccccctctcccacacactcctcctgttcccttaggcaatttattgtctcaaccacaattcttgtagttagaatgcctgacactatgtagtagtctaataatctttatgaaaaatatccaaacctagcaaaggggccttactattgtattggttaggttaattggcatttgcagtaatattgtcacatcaatgcatgccatgtcacatattgtccaaaaatttacttaaatattgcatattatcgacaaattttattttattttatacatatttatttaaaaattgagggagaaactaatagttatatatgttggagaatatatctcatatagcatcattagataattcctttcatgcacaaatctgcaataataaataatgaaatgcaaaaaggtgcatcatctcttttcaactgtcatttattcatatcacttgtatttggtggaaaacaactcattagtattttagtaaatcaagttttacgcaacttggagcccataccacttcttcaaataaaaggaatgatgtaatagacaattcccagaaaagatataaattaccttgcgtagctcggaaggagcatgtcgtttgagttctggatctagcaaatcaagaataagacgctcaacaagttcagggtctctagggctaggaacctcactagtcaacatagcaaatatgtgtagactagctatatccaatgaaagaagtgatataaaactctaagtcaaacaatccccaatgcttctacaggaataaaatagaaatatgtgatacataggggcactacagcctttaagtagtgtagatacagatgatgtgcatttacttgtgtcataagaaatcagtagaaactgttccagataaatgcacattatcttgttggtttctttataatctttgatgcatgttactttttctctaaaaagaatccaaagttaaaaactgcagctccacatctgcgatgagtcatgcaaaagataagtattagcggttcataccttttttatgtcattcctatcgtgtgaagcacatgacaaagtgtaagttcggttcctttatttttgttaatatatgaccagatcactaatctttcttcagagtgagacaaaactcacaggaaaataatgattcacattagaaattttcccatgagttatccatcagaatgaaactctcaaggtggtggttgggtgtgggctggctggggattcaagagaggaaagatgttttttttggaaaggaaagaggttagggcatgttcggattataggataggaaaagtgtacaaatttaggaaatgaatctaagtgtaaaacagagtaatgaaaaataaaggaatacaaaagttaataacaagtttcaatcaatctggtgcatcggcccatattcaaagatcatataattgtttaattgatatcttataataatcaatcttgtacttataatatctctatttggtccgatctattaacattggttttaataaagttagaagattctttgctgatgtattctttgctttatttttcaaaattatatcacatccaaatcttcgctgatgtattctttgctttatttttcataacttatatccatctgttatagccgatcgatccgaaattccaacatcagctaggcacatgattatatatcggccttttggccaatctgccaaacgatctaatctttatctatatcttgttagatcaaactaactgacatacctaaaccctaattgataggacatgtactagatgtaagcaaatctctcaggcctctacaatgaattttgcgtcaacaaatttgtgtatgaatacaaaccgtttgaggaactgaaaattctgatgaaaaatacattgtctagaagcttccccaaacataaccttatactccctctatcccctaatataagggaatttgatattttgcttgcaatgtttgaccactcgtcttattaaaaaaattgtgaaaatataaaaaacgaaaagttgtgcttaaagtactagtatactaaagtaagtcacaaataaaataaataataatttcaaaactttttgaataagaccatggtcaaacagtttaagcaaaatatggaaatcccttatattaggggacggagggagtattacagttaatgcgcaacgctaatgccaatgctgacaccgaagcgctcatgtcgatcaccaacgcatatggctgcacaccgaagcccgtcgcctcgccgccggtgcagccgccgcccagtcatcggcgtgcatgaacaagctagctttggtcgaaaaccagcggtgtcaaattgaaaattttcccccaaaattttttaaaaaaaaaggggcccccaaaactgggaaaaaaaaccgggccttttcccaaaattgnatcgattcgattggctcgattttggacggactgccctaatttaatcctgctaatgaaattatttgatcccgttcatataatctgtagttaatctccagatcgatcagtcattttacttcttccgtgcagtcaaatcctatgggggtattggtaataattgtaactctcgaaccctatgggagtagagatggaattgaatttggtgatcattaaagttgatggagcaattgttgcatgtatgcttgtcggttaaacttttcattcctcattcctcttccgacgggagcttttgacgcgtgcatacgacaggaaggatgggggcgtcgggccgccgctcctgagagcaaggctaataatatagccgacttgttggctataaggtttttttagccttctttcaacctacccatataatagttagctctttacaattaatatagggttcacttgtctctctcatatagttttttggttcttgtgtccaagccggctgtaagtttatagcccgcttctcctctctctcctctcttctctcctccaccttagcatttagccggcttatagcctactgctatacttgctctgaggcgtgccgcgtgcgggacagaaggcggcgccccggcggctcttccagatatacgagtagttacttcaaacgagtcattgagggatctgtttttccggattacccctccgtctcaaaatataatagattttgggtaaataggatgcatcatattatgaatctaaacatacacgcagctcgctgtccagatttatattactagaatacgtcacatccatccaaaattacttatattttaggatgagggaaatatcttttcaattactagcaaaagtgcccgtgcgttgccacaggaattgtaaaaaccagaaaattgagaaaaactcgagaaagatttatattatgtaattaattgaaatataaatttccggaaatgtttggtattttttaagtaggtagatatataattaaattagttatataaaattatatagttggatttaattttattgaattatccatgattaattacactatttggaattttattgaaatttctagagtttaatagctaattttgataatacaagcattattttagtatttatttaaataaaaaatcatcctttctctttaggccattttcagctcgctttcatcccttctcctcccctccgtctcaacctgtaggaaagcattcggcctaacaggaagtctaattcggctccccctactcctctcattgccgtgtggcccccaaccaaaagtccaacctaagtgctttgttggaccggccggccagcacgctgcgtagcagtgatgcggcccaaagatggaggctagcccaacacgggatcgatctgagccgttcgtttcgatggatggctcagatcgattttgaatccatcaaaatcgtcggggttaaaaaatccctaaccctaattcatttttccctccctcccctcaccgcaggccgcccctgtcccccaccagcggcgccgctcctctctccgcaccaacgacgctcctcctcccaccgcgagttgccccttccccaccggtggcgcctctccacgcccctcccccaccggcagtgcctctccatgccctcccttctcccgcggtatcgctcccccttcctcccccctatccttcggctcctttaattcctcctcatcggggtgccgctgccatcccgctcctcgccacatccagcaagttggcggcaccccgacggcatggtggctcaggattggctcctccctctccctcccggcatcttcctagcgcaaaggcgagtcagcgacttcccaacgcaaccgcggctactccccagctccctggcggcacagtggcggcttggctgatccccgatgcaatgatgggacggtggaggaggaggtccgtcgaggaggaacggtggcctcccgctcgcccctccatctcctctcatcatctcttgatgttttggatgattttgtgatgattctgatttggatttggatttggatttggattgagattttgtttttggttggacttggattttgattatgtggattttgattctaatagtataaccaattactagctcaaaatcatctatagtcaatctaatagccaattcatacaatagttaagtacaaatacatactacatcattaataattggtcacacatgtcatacacgcagcatcttgtagtctgtgctacagcctatagatggctacaagtttatagctagcccgttacttttttctctcattttttatctccttcatactccctccattccattctaaaatataaggtataaccactcctaacccaaagaccaagaaaataattattaccatcttgtactttggatcataataaaaatataatatatgcatccaatagaattagaaaacatgagagtgggggatttaaaaaagtaataatttaatggagaaggggtcatagttaatagcttacatacacgcatatcttatattatggaacatctaaaaaaagtggctgtgtcttatattatggaatgggaagtatatgtttatagctgatatatagtctgttattgtacatggtctgtaggaaaaaaagtacccatacaaattcctaaaagtgcctcatattaaatacagtaccaagtactgtaaatgaacaactaatggcgagggtgtgaccgtgaacagatatctcgctatagactatatagatatctcgctatagactttatatagaaaggcaatatctagctaaccaattaaagaggaacatttatgaactagaactgcaagattaacacctagggaattgcttgtgagccggattcattagcaagctaagatatggtcaccggattacccattcgggtagtaagccgtcacctggtgaaggcgtcggatgctaccatccagccgcacgtgctcactctctcccacatcgacctccacgccgacgacgtccagaccaccgtcacctgcgtctaccccaaccctgccccctccggcgccggcgatttcgccgccgtcgtcgccaccttcacggccaacctgccgtccttcctcagccacctcttcttcctcaccagccgcatccccaccaacccggcgtccggcccgttagcctttccggctccaaaaggaaaaagtccaatttcactcccttaaatgtcggtcgaatctaatccatgaccctgaaccgtaaaaccggataggacgactccccggactattaaaaccggtgcaatttgactccctcaacggttttggagggcggtttcgttgatgtagcgcatacgtggtggtattgacttggtattccttccacatggcgctgacatggcggttaggtggcactcgaattttaaaaatgtgtaggacccatctgtcattcaaaaaaaattataggacccactggcatgtggggcccacgtgtcatcctctctcttccctccatcctcatccctctctcccttctctctctctctctcctcacgtcggcgtcatggagcctcgactccctgtcgtgggtgtctccacctcgccaccgtcggtgccccggcgtcgtccaccaccgaagacgccgtcttcatccgcccaagccgtcgtcgtcaccacccgagcccagctcgagctcgtcgccgaaccgccgccacgatgcatagccaagtcgtctgcgagggcgccgcctacgaggccgacaccgtcggcgccttcggcaagctctagggcaagcccgccgtcttccgccacgaccgcatgcccatgtggccatgttcgggagaggccgcatcatggccgaaggcgacgagtgggctcgccaccgctgcatcatcgcccctgccttctccgccaccaacctcaacgtaatcaaccaattaattcattctctccatgcacaagaacacgtgcactattctacatgattctaattgatggctacatatgtgcctgttgttgatgatgcaggacacgatcggcgtgatggaggagacgacgtcgaagatgctcggcgagtggagcgacatggtggcgttgggacacagctgcatcgacatcgagaagggcgttgtccggaacgccgccgagatcatcgccaaggccaacttcagcatcgccgccgccgacgccacggtcttccacaaagctgcaggcgatgctgttccactccacgcgcgcgtctcgtcggcgtcccgctcgccagcctcctccatatccgcgccacctacgaggcgtggaaggtgggccgcaagatcgacgcgctcctgctcgacattatcgactcgcggcggcggcgtgaaggcggcggcatgaaggaggtggaggaggtgaccggttggtcgggccccatggacgcggcggtgatggaaaagctcaccaagatggggtgcatgctaaacgaggtgctccggctgtatccgccttcgccgaacgtgcagaggccagcggcgtgcgatgcggaggttgtgcgcggggagaggcgaaatgcggcatggggattagggatttcggcgagccaaggaagggaaggg

SEQ ID NO: 54394 - DNA, 1890 bp, Oryza sativa
tttaatagttcggggagtcatcttatctggttttctggttaaggttttctggttaagggttacagattagattcagcctactttttaagggagtcaaagtggactttttcagctccaaaaccatcaaaaggtaacagtttcttcattccaggccatacagagcacggcccacaagtactgtacatttttctttcagtaaattgttacatggtagatggcaggtagatggattaacaaatcatccaaaaaaatatatagctccggcctagttgattgcatgaaaaaattggcgttgagataccatggccttaattacttggatttaaacttgagtacctagaatcgtttacatagaatgaggtaacctcccaggtactcgtgttcaagggtacagttggcattttccagttccagcacatactgtacattcctcaacattacctgcaacgtgtctcaggcagtacttgatgcgatcattcataacatcctgaaaaacatgtttgcatgcgattagtaaatatgataaaaaaaagaaaacaaatcctgctcagtttgctagacattagctaatagctattgaaaccaaagttagcttgcttgaaatcataagttacatttatgattatgcaagaatttcctgtaaatttcttaaatagaatctttcatctgaacaccccctaatatttatgaaaagaaggcgataaggtaattttggactcattttcatacgatagcatcctcttcaacaccatctaaaagtgatgacaattgagaggataatcaaatggatagcactgagacacctgtactgaatctatttattgaggcaaaatcacactactttctctttatattcagtgaatatagagttttctattaatcgatacagactgcacaacgctttttcaaacagtgtaaggagcacaatcaatcaattgtcagaaaagtagtaaacattatttttagacagcttctataaagagtgcacaatgtaacagtgacacaaataatctagaagaatttatagggaaatcaatgagcacataccaccataagctcatgcaatccaagaggggcagtgacaacataagttatgtttgagtgctccttagatgcttccgcagctaaagcagggatatcctgggtgaaaaatatagtgccaacttgaatgaaatttttcatcttaattgtggagaataatacataaggcaaatacccatctacctaggaaatcattgcaataaatagaaataacctgatgaacttaacacccttaggattgagtactaacaatcttaaataattcaaaggcatacttgtttccagtgtcgtccaggtgaaagaaaatatggactgacaataacacgggacgctccttgttgcacacattttccaaatgcatctttaatagtaggctcagctagctcctgcacacattcatctactataagagtgtaatggaaggtaaagtgacaaaatacacagaccatagagataagaaaatatatttaataataattcattgccccagaagaactagccatacagattaacattacaaaaaagaaggcaattggaagttgaggagtagatagagacacatttgacaatatatacctttcatgaaacaaattaaaaaagcgctcaagttacacttacacctaattatgtgtagtgactatagcacccttgtccatgcaacactgaaagataatgtgcattccattttataatattaacatgctatgcgggggagacaggaccagtgtcgtgcaagtatccatacagattgcttttagaggttagagataagtttagaaacaaattttggttgtcggctctgttcagtcgagctatataaagtcagggtgtcagattggtttcctttaa

SEQ ID NO: 54395 - DNA, 10983 bp, Oryza sativa
  unsure (1)..(10983): unsure at all n locations
ttcactttgcatagaaaaccgaatatgctacatttaatactaagtcacaatcaagcttcatggtttcttattttggactacaagaatatttttcacagaaaaaaaaagcattaaaagaagaggaagtaataaaaaaaggattatctcctatactactgttgctcagctgttatggtcctctacttacagataaaaaaaaaacatattgaggaaaaataattcattttataggtaaagggaatatgtcttttcaatcctttcccatgctaggttttgaccaataaattggccatggctggtactatttccaaagctaagacaaggccatttagtaaagtctaatggcaagatggcaacatcaatgatggcacaatccaacaggaggggacattgcacaagtaatcttggagttacagaaaataaaacaccctatacgattgtacccagctggcgagaagttttgcaatacagacacaaaaggagaatcctatagctactcatattggcatgtgaatgaaaacgtctaatggtatatacaactttgaggtttcatggttaaatacacataaactgtgacgaacaggtagtaacatagccattgaacaaaactggcagatattggaagctatcagaaaactgttacttaataaacatgctcagtggtcagccagaatttctgatttcaaaaaaactataggtcattcagaaacaaactcgaaaattaattaattgatttgtagtattcagtcaaaaaattgtgatacgccacaagactcctactgatgggagtaaagtcggtttgattctccaaagagattctctctaacaagactacataagttgtacttaataaattcaaaatcttcacaaaatacattcgcacataaaagcatgagcaacgaatagtaccatatgagcaggctcaacgatcttgtaaccggtccctcccctgaacatggcaaccaaattatctggcaatattccgagccattaacaaaaaagcttgaagcgcctgaaagaattaccggcattccattacctaacctggaaatggattttttacccccgggccccttgtcaacaatgatcacaccatccttctcaccaacggtgcaactctctccttgggccgtttctgagctgaaaccagaattcggcttggcactcatgactatgtttccaatgttgagtccaattctcggcaacttgacaaagctagcagaattcctgacatcaatgctcctaattccaacaaacaagaggttgtgtgttacggcaagaactagcagaagttaactagcatgaaagaaaaagaatgcatgtcatggagacaaagtcttacttaccatgatgtcagtttgtttgtatgggtcgcacttaagggttggaaggggattgagatagtatgcatagaccaccctccaaaggcccaggagcaccactatgtgattcttgttgaaaataggtgatgacagggcagtggcggatgccgaattccacagctgagtatttggagttatgagatgttaattcattgtatggaacgcatagtgttcgctataacagtagcacacatgacgatacaaatagtagcaacctacaacctcttcgtttttttaaaaaacaaagttgtacagtatccatcaccaatcaagaatgattaccactaatggcagaagcaagttaccacaagagcaaggggggacaggacattttcagaatttcaggcgacttcacctatggattggacggtgggggatggatggattcgttgccttgattcactcaccgcctctggagcacaggggtgagtagcctctctcgctctcaaaagctgcggcgcgccccggtttgctcctcccgcgcgctctgagccgtggttggccgtcaaccccaccgcgtccgccgtccgccgccgggggaacgggagaggagtggttgggaggggagacctcgttaggggatgggcgctggatttgttttgccgcagcagccaatggcgagagaatgacgacgttgtccaaccgagtttcagcgaggagggggtcgcgagccgccgactcaggctcgcctcgcgctcgcacggtcgccgccgctgccttctttcgatggggaaaaacgcgaacagtagggagatagggttaccacttctggggtgaaatttgtatattcgtcgccgtttcggtagaatgccaccatcataataggattcaattaaatgccactctcaagccctcgactattcactgcaataccattttacttttttatttggctattcactgcaataccattttacttttttatttggatttctaaattgttttttcctcaatttatttttttcttggacttctatgcccctggctcagtaggttgaaccggagaggaggggtggcgacttgggacctcgccggtggagtaagagaggcgctgccgccttcaccaacttggccgcaccgcctctcccaccgagctgcctctccactcctcgttgtgtcgcgctgcctcttgtggccagtcgagccgcgcgcctttctcgtccttggcgccaccgccgcaaggacggcagtgtacggcatcctcgcccccgtcaaccgggagatgagcgcgtcggtgggctaggagggtgcgccgccacaagatttctccgagggcgcagccagcgcggttagggaaggcggcggagaacgaggtgagcggtgccggcgctgttggggaagacggccgcgcggatggcgagggaggcagcgcgggtgtgcctcggttggggaaggtggtgccgcaggcgtggctgcccctccctttggtcttctctcctctccctcggctagcgcagcggaacagcaacagaacaatggtggtgggcggcgccggtgtctccaccttttctccgctcgcgctcacgcttgcgtgctcgattcaaccaaatgagagagaccaagaagaaaccaagtccgattcaaccagttgacccatgggcataaacgtacaacaaaaattgtaattgaggaaaattaatttcgaaatgtaaaaaaccacgaaagtggcattgcagcgaatgcgcgcagcttgagagtggcgtttgatcaaatcccattttgacggtggcattctaactaagctagtttttatgggtggcagatatgcaaatttctcactcctgggaggggcgtgcacctcacgtgcgcgaggaggagcaaagtgcattcgatctgtccagttatttttcaatgatctggtcaacccaaatacgagtggaatattcgcttttaaaaccaacccaacctgcttagtcttgaaaccaaataactttaaaaatgggatggcctcaacctggacctagttgttaacatcaaattttggtaagccccaaagtcatcatcggtttagaatcactattggcttcagcatcttggaattggccgatgagaattatcaagtcgccaatagtcgcattcttagtagattcggttaaggaaattaatctattaaaggaagtttatccagaagtgaccgagttcaaggaggatgcggcatggtagtttatctattaattaggaagagttttttattttctttttatctttaggaaagtgtgcttagtgtccgataagaactttatgtttttattttatatttaggaaagtttctttcttgtccaataaggactagtatctacccatggatataaatatgtacacctagggtaattataaactacctctcgatcaatagaactactatcggtgcatcaccaccctcttttccgaggtttttacttatcaccggtggaacttggcacctgatgcgggactgcatcggctttcgatcttcggcgaaggggtaagtcctatgttttaccgaccctggtaattgtatcggctacattggtgtggttcaaggctgcatcgcttcgacctctcaaatcactctggttcggttgatatatttgtctgcctatttatcatatatataagttaatctagtttggtagatttacttgtatcggctgggatctgctttagagtttttgccggtatcagctaaattgctttgccagattagattagctaaggtatccacctctcttaaagtcagtaaaaggcttgattgtttagactttatgtttctttgcatacttcgagtttcatcgaccttaatcgtgcttggaactataaaaactaacctgcctttgattgccaataagggtttcatcggggtttcaaccgatgagttatctggatgttgcatcgtcttctaaggattacacaagttggattcagccaatcgcaataaaggtttcattgtttaactaatcatttggatttaatgacatcggacttccaaccgatgtatgctttaaccatcggatcacttattctatcatattatttttagacgattggtttctattgaattatattattgttatattacattatcattagccgactgtgtttatatctttatttactcaagtatcaaaatatacgggatatatagccgacagttcaagactctattgacatcagttggtatcggcatcggctggaactactccatcggcttgtcagccgatcagctctttggtgatcaacatatttgtctattttgtcaattgcaagatcaaactgataggcacgccagcatctcatcaatattttggatatgcactggagctaagcggatctcctaggccattgtgttcgtcgacttagttcgcgctaacacagatctggcaccatcgggcgagcgtggatttttcgtcaatactagcaaaaccctccaaccaacaagtttaggctctctttgtttaggcttataagttactccttccatttcatattataagtcgttttaattttttttttcagtcaagcttcttcaggtttgagcaagtttataagaaaatttagaaacatctaccacatctgattagttttattaaatataatattgaatatattttgataatttaacactctttaaaatgtgttttgattatttgacatcctggcctactttcattcactcagatggtcccacgtatcatcctcacaagtgtcaattagagcaattgggcaataaaaaaaatgttaaattatcaaatatatttcataagagagatgaaagagagggaggggagacagaggataagaaaagagtggaggaagttaaaacgtggaggtggaggagtttggattatattctatgggtggatttttagtccactaacaatagtaggaggctagacatcttttaaaccgagactaaaaataatttttacaccaaccgggactaaaaattataaaatagcgttggacttttcaactgggcctggcgttggacttttagtctcgattcccattcaaaccaagactaacatggtttttgcaccatccatcaaaagatcacttctccgattaatggtcatggattgacgtggatgaaagagagggccaacaatggtgaaagcgtagactccaacgctgcatcagcatcacggaggaaggcagcagcgcggcgcaattagcgcgtgatcgcatgattagtgcgtgccgtaccgtgtaaaaatactcgaagcattcgtcactactgatcagcggcgaatcctttagcagattcttttcttgtagcctgccttttgttttgttatttccttcctgttttgctcagtctcaagctgcatataatgctctcatgcatagtgatataatcagaagcactcctttcactcacccgagccaaccatggcgaggcaaaccaacggcggcggcagcaacaagaaaccttctactgctgccggcggcgatgcctcaccggacaagcaaaatgcgccgcctcccgaggacaagaagccgccgccggacggcactgcaccgtcgcccaccacccctgccaccggcaataataatccataaggatcctccgccgccgccgccgccgcgacagccggcggcggcgaagggcacgctggacgccttcggccgcgacctcaccgcggaggcggcgaacgccgaccccgtggtggggcgcgaggaggagatcgaccgcgtggtctgcatcctctcccgcaagtccaagaacagcgccgtgctcgtcggcgccgcgggcgtcgggaagacggcgatcgccgagggcctcgcgcagcgcatcgcccgtggcgaggtgtccggcgtcctggagggggcgcgcgtggtggagctcaacgtcgcggcgatgatctccggcacctcgtaccgcggcacgttcgaggagcgcatgacgggggtgatcgccgaggcggaggcggaggccgacgcggccgccgggaaggtggtgctgttcgtggacgagatccacatgctcctcggcgccggccgcgtctcgggcggctgcatcgacgcctccnnnnnnnnnnnnnnnnnnnnnnnnaggggccgcgtccggtgcctcggcgccaccacgcacgacgagtaccatcggtacatggtgagggacgccgcgttcgagcgccggttccagaaggtgcacgtcgcggagcccagcgtggacgacaccgtcgccatcctccgccggctcaagccctcgtaccaggaccaccacgcgtggatatccaggacgccgccctcgtcgccgccgccaagctctccggtcgctacatcccaggtgagagaccattgcgtcgcgcttgatcaccaatcaactctgctcacgatgtgtgcttctcagcgaggcacttcccggacaaggcgatcgacctggtcgacgaggcgtgcgcgacggcgaggctgctgatggatcgccggaagaagaagcaggcgcaggcggcggtggcgcccaaggacgaaaacgtcggccccgaccacatcgcacaggtacgacgcacgccggcgcgcgccaccgcatcgacgtcgcgcgccggcgagacactgaccgcggttgatgcgcatgcgtacgtgcaagtggacgggcatcccggtggcgagcctgggggaggacgagaggaagaagctgctcgagctgccgcagctgctgcaccgtcgcgtgatcgggcaggacgaggcggttggcgccgtcgccgaggcggtggtgcggtcgcggtcgggactcggcaacccgaaccagccgtcgggctccttcctcttcctcggcccgaccggcgtcagcaagacggagctcgccaaggccctcgccgagcagctgttcggcaacgccaagctgctcgtccgcatcgacatgtccgagtacgtcaacgccagctccgtcactcgcctcatcggctccgctccagggtatgtctcgtccgttgcatccgtcagtgccattgctgtgagcttgcatgcccaaggctctaatggcggccgccgtgtgtgatcgcgtcgcatgcgtgcaggacgaacgggtacgacaagggcgggcagctgaccgagctggtgcggtgtcggccatacagcgtggtgctgttcgacgaggtggagaaggcggacgccgccgtgttcaacgtcttcctccagatcctcgacgatgggcggctcaccgacgggcagggccgcaccgtcgacttcaccaacaccatcatcatcatgacctccaacctcggcgcgcagcacctcgccgacgccgccgccgccgacgccagccacaaggacgacgccacggaggccgccgccgccgccgccaagcagcgcgtcctcgccgacgtgcagaggcacttccggccggagctcatcagccggctgacggagatggtggtgttccggccgctgtccggcgagcagctgcggaaggtggcgaggctgcagctccgtggcatggccgcgcgcctcgccgagaagggcatcggcctcgacgtcgccaacgcggcgctcgacgtcgtgctggcgcggtcgagcgaccaggtgcgggcgtacggggcgcggccgatcaagcggtgcctggagaaggacgtgatgacgaggatctccaagatggtggtgcaggaggaggcggacgacgactgctacgtcaccgtcgaggcagaccaggggaaggaggagctcgtgttcaccgtcgacaagcaggcagacgcagaagagaacgacgcggcggcggcgtcgtcttcgtcgtcggcggcggggaagaagaggaagcggaggccgccggcgaggtatctcgtcgtgattgacgacgacgaatagtgaatccaatcctgatcgtactgatcgttgggctatgatttctcacaatttggaactgtgcctcaaaattcagatttctgaattctgatcaatcctcaatgttcttttattaccggttgttaaaattccttgcacatccattcatctggtcattcccgcaaaaatattggccattgtcacgaggtgatgcaagtcttgaactcctggtcccatattgtctaagagcatctccagcagaggtcctaaacacgggggtttctcttccgcacatacgcgctaggaaccggagacggcgcgcactttcctaccgctaacagcgcttagagctctctttttttttcctaactgtgtcgttcttttttttaataaaaactagctgggtggcccgcgcaattgcgcggctaacacccaaacaaaatcatatctatttcagtatgattttacttaagatttattaaatagctatccccgtatttctatttatatagtttttaaaagtcacaccagttactaccccttacttctgtcatatgcttctttatttgcttgctcggtctaccacggcatatggaacctctcaactgctccctcgggataggtaggcccatcccccacccccctttcccgagaggcggccggccgcggactgggatcgctcgttccgtgcttgacttacgagctcgtgtagtaaggcctccgccctatctatatctatggatactgaagtgtggccagctaataacattgattcaattggcattgacataataagaataccactatttctattcattctctttgaaacatttaaaatttggatcttatagttttttgagtttattatctcgttgggtttctttttataatttctagaagtcccgtcaaatgctgccattatactcctctacgacccgtccactgtcttttctttttattatcattgggattttataaatcgaacataattatcgtttgggttcattttttactttttataagtcccgccaaaccgtcagcggctttgccattgtactcctttatggcttgcccgctgcctcccttctttattatcattgagattttaaaatcgaacatgattatcattggttttttactttttagaagttccgaacctttaaaggttggaccttgtagtttttagagtgaccttgtagtttttagagtttattgtctcgttgggtttcattttttataatttttagaagtcccgtcaaacgatgccactatacttctctacagcccatctaccgcctatttttcattgtcattgggattctaaaaatcgaacataacaatcattggaattcattttttattttctagaagtcccaccaaccgtcggcggctctgcaactgtactcctatacacgtcgcacgctgtttctcatttttattgtcattaaaattttaaaaatcgaatatgattatcaatggggtttatttttttttactttcagaagtcctggcaactgctttacccatttgcttcacgatctgcctaccgtcccttcttttaatcatcattaggattcgatttggtgctttactaacagtttttatatgtcgtatcaacctccgccactctactcttttataggcatgttacttaatttatctcgtcatggattttagatggtctttttttcaatagtctttatttttatcatcattttttgttatttataaattttattcctaattgaagtattttttttcttttttaatttcagaatttattttttttcaaattttaattaataccgtatagtgttcttttaatatttttattttttattttttgaagtccagttgtttcaaaattgtattcctatttgaaatctcttttagtttttccaattttggatattattttattttttattatgaattttaattaatgtcgtattgggttcttatatattgggttcttatatggactttcaatattgcttattttaaatcccgaatttcagttgattttaaattatattcctacttgaactcttcgtttctttttgctaatttcagatcttatttttatttttattccgaatattaactaatctcatattgggttcttatatggactcttctctcaatattccttatttttaattacaaatttcggtaatttttaaattatattactacttggactctccttttattttctaatttcggattttattttatttttattttgaatttcgattaatcccgtattgggttcttacatggacacttcttttaatattgcttatttttaattccgaatttcagctatttttgaagtgtatttctacttggactctccttttctttttcaccaattaatataggaatttctagcccccacagcgaacgtggtgcctcctttcaaagctgttttaataatataatacatagatagatagatttgccaccatctgttttttattttgtttagttgactgaaacaaactttcaactcagatttatttcagatttggaaacttttcaactaagatttgaaaactctcaagtctagatttgaacacagatttaaaaattttcaagtcaagatttgaatacattgaacttaaatttaaaaattttaaacttagattttaaaactttcaaatatgatttgaaaattttcnaagtcaagaatttgaaaaaaaaaaccccntttttncaaaaaaaaccttttcccggggaaaaaaacctttttccngaaaaaattttttttaaaaacattcaactaaatatttaaaactttcagctcatatttaaaaactttcatctcagattcaaaaacatt

SEQ ID NO: 54396 - DNA, 4092 bp, Oryza sativa
agaaaaaaaatcaggtccaacagaacccctactaaaggccctaaaatagaaaggcctccaaattatctcctcaagcccctaggcttcgggactttctcgctggcccctattccacgcgcaggagagatctcccaccgccgcgcgctgatctctttttcgcgcgaaaaattttgctagcgccgccgctaaagcctctcctccgcatgcgcgccgcctggatcagcgccctcctctccggctagccacctcctttctcgccgcattcttccctggctggcgacttcctcccctgccggccacctccccacccggtggcctcctccctggcgccctcctgaactactggccacctccctgcagggcagcctcctccctggcggctggcgccctccctctcggctgccagcccgcccgacgccctcctccccagtaaaccacctccacgtccggcacccttctcctcggccggcaatagtcgatggtagtttttttttctttttgcaatggatttgtcgatgcaattagataaggcttgttctttgtggagatttagcttgtcggggagataaattggatgtatgtatttagaaatatttggttggagccaattttttggtctttccaaagataagcatgtgaacatttctattcagttcagatattagtagggaaattatataagataggtggttaattgtgcccgaactgatcgtgtgaatgaattggtgagaaagaatctggtggtgggcactttgttgtattttagtgatcataataaaaatcgataatatcacaactcagcagagaatcagtactataactgaaattggcaggggtgatgcttggatcgagctaatatggttttgggcaaagctcctcccctttctattactgaaaaaaatggatagttcttgatgtagatgtactctgtaaatgaatagttcttgatgtactctgtaaattttggctgcgaatcgatgcttttatcactcttttatcgctactaaaattttacatttccatgtatcggctgcttgcagaatgacaagatgaaacccatgacagtgccatactaattgatatcatctgcattgtcaaactttttaacttttttagcatggtgtaactgcctatttgtgtgcattgaaatctctagactacttacattgcaccttttctgcaacagtgcatatgcatgactttaagatactgtgtcagctgaaatcttgtgatcgtattctagaggatatgggtgtattgctgtttaatttcctgagctacacaattttatttgtaccgatgttagttatatgcaggttcttcgagcagactgttacaaaaagtaaaaaaataagctgctttggggtgctatatggttttctttttaatgcaactttgtagagctctagcataacctgttctaaattctaatgattggaaaattttgctaccattatgcattctaccaacatatattagctagtatctaccatttttcctaagattgattggagaagttgtcaatttatctacttattgcagtgactagattgtgatggcaagtgaaagtgattcctttgtgcgcatgatgtctgaagagacccatgttgaagcatattccttgccaatgcaaaatgaagaccttcatacttcaacaaatggtgcaaaaggaagagccaaaagatcaagcaactttaatcgtacggaggacgttcaactgtgcatttcatggcaaagcattagctcggattctattattggcaatgagcaaccaaggaaggcatattggcaaaggattgcagagcactaccatgctaaccgtgattttgagtctgataggaatgcaaactctcttgagcaccgttggggtaacattcagaaggaagtaagaaagtttcagggctgctacgatcaaattgagcgtcgacatccaagtggcataccacatcaggagcttgtaagttaaattgtttattcatttttattaataacaatcttgtatgtatgtcaactaacacttgaattttgctacaggttcttgaagtcgaggcattgtactcatcgaatgcaccaaagaatagggcatttcagtttaatcattgttggctcaagttgaggaattctccgaagtttcaaactctagaatcccacaagaggccaaggtctaggaagtcttcgaccccaattgagatagctggtgaagaagatgaagaaggagatgatgctaggaagagtacaactcctgatttatcacagccaagtgctaaaaagagaccaatcggtaggaagcaagcaaaggagaagttgaagaatggaggagaagatggaccatacaaagaggcgatgaaagtgttagagtttgtgtcgaatatgtgtacgtagtcggttacagtttaggacttggagttgtactaggtgtaggactagagtatgagtcgaactctgtcctaggatctctcataaatagaggggcgtgcctgttgtaaccgcatggcgacttagcatagcgagagggagcggcagccggcggcgaccggccgtgagtcgttgtaactctgatacgctgtaatatgccggatcggggaggagcgcccgtaatcagtgccccggagatgtaggcctcggctgaactccgttatcaaatatcgtgcctcggtgttgtcatcatgtttggatctcctatggcattttcttccgcgtttggtttccgatgtgatttcggggccggttttataacaagtggtatcagaacctgcgggagatccatggtagaggtacgagggaggtggtccactccgcgacgactacacagggtgtccagggacggacatagacgcaaggtggagcacggcgacgatcagcggaatttgatcggtggaatcggacactttaggcggtggtctgaaccgttcgatggctgcaatcaatagggaaatgaccagacgtggtgctcgggttgatggcggcggaagcgattggcgatccaatcggtgggttggacacttcgggcgggtggctcgaactttctggtgagctactttcaacaggaagacgtgaggcttcacgctcggggttgattgaagctggaggcgatcggcgatctcgatcggtgcaatcgaacactctgggcggggtagcccgggtctttcgatgagctgcgttcgacagggagacggctagacgtagcgctcgggtcgttcggtggctgggaagacggcatgtgatttgtcggcttcggctcgcggctagattgatgggtgatcaatcggaggtcggagtggatttgtttgcgacgaactctgggtggcaggaacacggtttggtgtggtcgttgtgtaggtgctgacgggattcgacgcgggccggctccggtgattggaggcggcggctttcgcggggagcagtggtgtcggttgcttcggggagaagcggcggcgaacctccaaggcggaggcggagacggtcctgtgagcgttggttgttcctgaccggcggggagctcgcaggggcgtcggacggaggtgacaatgacttctggcagagtcgacgcgatatccgacggggagtgcgtcggagtgtgggcagggaacgaaagaggattgggatccggttcggagtgaaccgtttccaggtgggcttaatcggcaattaagaaggaaaaaagggattttttttttgggccggttggtgaagcttgatagtattttgtaggagccaatactgctcacgtgttgttagggtactgttcaccaggagcaaagctgaggactattattacaagtcacagtggtgcatgctaaagaaactgaggcggtttgtgcttggcttgtttgcacgtggaggcgtgttaagtcaagtattggctcggtaggatagcagcacaagggtggctcgacatgtctagcagagtgtgagaaattcccgggcaacagtgggtgaaaatcgttgagggcgtcaacgggctgtttggcagtacaggatatatccagaatctgcggggattgcatgatggggatatatgaaatctacgtcactgaaggagaagagcgaacgctatggtgataatttcttcgggtgattcaaggcaacagt

SEQ ID NO: 54397 - DNA, 5597 bp, Oryza sativa
aacttggatggggtagaatttttcccaggacttgcaagcttttatcctaaggacattgaaggctccgatttgataaaacttgagctccaacttgatacatatattgatgatatgagagaggatgatagattaaaaggcctaaacaacattgatgagctctctatattaagcttgttgaaacaaagaagcaaaagctcttgagttttgactagtattgtaatatccttgcgtcaaaaaaagtactgtaatatccaatttatctgaagactttatgtatgtttgaacaatttacatcttcatttaggtaagatttatacttatttgttattttctactacttgtattgaaccatttagagttatataccatattgtttaccacattttatatcgaatcatattgtattgcattcggatttttttttttggctaggcctaccctgggttcaaatcctgggtccgccactgatcctgtgttcatatgtgcatataattttgtatacgatagatacatattagttgaattggatttctttttaagataatagttcaattggatttaagggcatcaccaatgtatattgtaaaagtgatccatatagatgggacccacataaagaaactttaactatagccatctccacaatgtatatagatacaaggtagcattaggatatgagagagaaatagagatagatagtattatttattccatatgggtaatccatatgcttatagatacctttagttattttcttcatatggactagttgtacaatggtagtaggtagctgaatgaagtataatattgactatggactattgactataacttgtttatgtttttactttgtatacaattatataattagaaatataattagaacccgctacgatgtaacaaacaatatatttattttttttcctctgactaaaatgtttagtcttcggagcaaacgtggtggctctaattcagattcatatatccaatcctgatactaattgaaaattaatcaacatgctcctatcttctatggtcccgatctcttctattaccagccatggaggcgtagacgaacaagcgagacgttgaacactaccttttgagactaacattggatcaataattaaaaaagatgaataccccaccgcattgctgtgaaaaattaagttgcataatatatacaaataagatgtaatatgattatcaaaactaaaacaaattgatacaattttgcagcctaaaaataattgagattgcatagttttataagagaaaaggaagagacaatttgaaccatagatctattattcaaaggctagaaataattagagtgatgtggtttaacgagagaagagagtaatagatcaaaactaaaacaaattgatacaattttgagcctaaaaataattgagattgcatggttttatgagaaaagaaataagagataatttgaaccatagatctatcatccaaaggctagaaataattagcgtgatatggcttaatgagagaagagaaaaatactattaactatacttagtggggaagaactatataagtatataggattcctttatttcctgatgagccacctatatatgttttttaagatgaggtgttggatttggaaagaacggaggggaggagaagagtcatggcacttccattagggcaacctcaatgtatgttgccaaacttgatagtagtgtggggccaagagtgagaggtggtagtggtacatgatagagtccacaatgtatctgtgtaagcactagaaaataagctgggaccctcttaaagaaaagcatctattctcagcatcatgttgttggaaatttggtcataattcggtatattttaatccaaaataacaagataataaacatgatatttacaatgggatttgatccagtggtagtggtgaatgtaatcaacatgagcatgcttaacgtagaataagcatcaacaatcacataataacacaatgttgacattgcgatgaacattaacagtaaaacttttaattgaaataatgtaagaaggttataccccaagaatggtcctccgccggagtttggggcagtattgcctccgttggtgttgacgggagcctccttctctttgtctccactgttgccgttgtctccagtgttcgacatgttggtgaaggtgaagtagatgttgacgaacagtgagtagtcgtgccttgtgctccccaaaaacatgatcgcccgcccgtccgtgcaaacgtcgcagcagcgctggtttcggaggcctactctcccaacgcgtatgcacacactcgttgggatgggattaccgtagcagcaatagcattggaaaatggatgaaagtgtgtctctcttctctcgcgggagatcaaatccattatcattttataagaggaatggaagatgaagagtaagagtcatggaataggaagaggaatagagtaactaattctcatcaattagccatcaaccatcctccactacacaaccatcaaccaacaatcaattaggagtaattgatgtaagttaccaacagaataggaagagtaatagagcaactaattgtcatcaactagccatgaaccatcctccactacacaaccatcaaccatccatcaattaggactaattgatataagttaccaattccctaattccctaatcaaatggattaattctcaaaactattcatcccattgatatcccataaaagaatgaatacacatgaattcctagcataatgagccttagaatttatttgatttaattgatttaaatggatcaattacccaattaaatctaacacatgtgaccctatagtactgtatcaaaattatagtttatttcttattaccggcaatagcactatgacctggttgttgttgttgtttatcacttccacaatgcttcttactaggtagtaggggtctttttcatgtttattacctggttttttatacattgtggatgcccttagaagatctcgagaaggcatgtgggaataaaaaaacaagtcatggataactttaaccagaaaaggaatatcatcgataaaaatttcagagttaagctggaaaaaaaggggtttgcaagaattatgacactatattcttttaattttagtcacttttttccatgtgattactctctcttctctatgtataagattttatgtctcccatctcatttttcaaataggtaataaattatttttcatgtccacctaccacaccaccgttgttagggaggaagagatgatagcgcgggtttgagttgggatggaggaggaagcgcgggtgcagatggagaaatcaaagatgaacgaacaagagaaaggggggattgagttacgaatgactaaaacaaaagtatataattcaaaacaaggttatccaaatattcagaaattaatacttatttaagtgttcaaaagttatttggactgatacttcaaatataatacatgctaataggagtacatagctgagaaccttctaatattatatttacaataaatttaatacgcttggcatgttaattatttgtcatcatgataaataaaagaatgttactacacttcctaccaaatctgttcctcaagaacctatttacaatatataataacatgttataacatttattagatacgagaggttatactcatacgaacgcgcgactctgctgtctagtagatttggatggtaaagattttttccccctccaattaacgaggaaattttaaaaatcgtaaaatgttgtgagaacttctagctttatatattctagattaatttaggggctctaataaattcattcgataattaaaaatatatgatacattatattcatgttggactaaaatggccgttttgaggcctggttaatcttagccactattagcatatccaaacttgccttttgcaactgtatcttcattttcatgcgcaaacggtgttctttttaacaaaaaaaaattgtatagaaaagttgcttgaaacactcatattaatctatttttaaatttctttagataatgcttaatttgtcaaacgctaataactcgttgtgttttacatacgcgtgagagaagagatagggacgaacacagccttaaccgcataattgcatttgcatgcatggctgaccagctgaaggggagggtgggggaactgggaaaactaaagctcgggtcatggcattgcctgatctagaagaaaaggatggactgatctggtcaaatataccgtgtcaatagtgttgttcaaagggatggaattgaaacagcgatatgcatgtaattggctctgtgcgaatgtgtgttcataacaaaatatactatatatatatgcgcatggtcaaattcaagtgggtgtaccgagggtaggcataatagacataattataattaaatatagtagttcgatcctcgaaacaacctgacttagggattaggatccggtgcagtcatagtagagactacaagtttagcagttggaatcatttttcatcattagatcaagacaattaacagctgaaacaaatgctacaggtgtattaaacagtaattgctacagtacatgctacaggaactaactttgtacggtcctttgtgaacagtatttaggaaaaatctagggcgttaatttgtaatccaatggtgtcggtaggactgcttaagtcgcagtggctatagccactgcatgtgatcccctttggtcaacacctctccgaaaaaaaaaagttggtaaaaataagttgcttcgtacttcgtaatttcttaagagtgttgatactaggctctgccttagtacatatccacattttgaaataacctaattctagtgtactccatccgtttcatattataaattatttgactttatataaaaaattagaaatatttaaaatatcaaattagttttattaaatctaatattaatatatgtttataatatgtttgttttgtgttgaaaattctaatatacttttctataaacttggccaaatttaaacaagtttgtcaagaaaaaaaagtcaaatgacttataatatgaaacggagggagtagcatatcaacaacagtgttaatcttgagcggtacatgtctaaaccaagattttgtaccaaagtttctcttagaaatacaaactcttcaatcttactcatcgttctagcttcatagccatttttttatctttggtcattaatttttagaaatttatttagtttggcatcatactatttaattatagtatttatgtttttagatttattacgagaaatatctcataatatattaattaaactacatgaatttttaaaaatcaatggtcaaagcgaagtgagtatagctcaactggttaagttctttatggtggaaccagcccacccagatttaagtattagacttaacacatgtactgctcgtattattcagtggtaggcgacgtatccatcgacaatgagatatctgtagtgacttcgttaattttaagatatgtcagcttagtttttcggagaagctcgatgtatgtgtatatttatagaggtgagtgtatacccattataaacgtatgtgttttt

SEQ ID NO: 54398 - DNA, 2233 bp, Oryza sativa
ccgtcaagttgatacaagaagagttgaacattggcgaccctctttagctacacaaagaacgggagagacctaactagacctaaacctatctactagtggagaaaggagccgaaccccctctcctagacgccgacgactgggtggccaccggagaaggaagggaaggggccaaaagtcaaagctttttttttttgcccaagaagccgcctttcgctaggcatttcgaggtgaagagataaggactaatgccaattgattaggactttacgtcgtccacaactatcattgcacgatataatgtccacagagtgattttcaaggatcaaacctcgtcatcatgccaaaatatggagttagcttagcattttccacaattttattgccaggtatcttaaaaatcatatactattattagaattttttggggattttctatgtttaaattcgaacaatttttatcaaaccctatcgctggtagcttgggaaaccctgctttctacatgtcaacggctttgcatcccggcttcaatttttctaacttttctaaagagccctcgcctgatgatatttaaaattaaattcaggcatacatatcatcactaccatatatatgatagctgttttttttagagaaatatatattagctgttgattttttttttgctagttaacccctaatttgctagattcaatacatatatggtaatgaatctagcaaaactctacaaaattcatgtctcaatctagattttgtttacatgttaatgttcaaaactaaacagtgtttagttgcatacgaggttttaagatgatatacagtgtaatacagtgagaacattctcatgtaaaggggcctgtgggttgtttcatctgggagaagcttcaattcttcatctgttcttgtccctgggttttcattttgtccattactctgttcttatcttcacagaaatagtagtctcctactctccttttcctcacaagctagctaatgttctaaagttgcctgaaaatgacgtgtctgagctttcctcatgtggttttcaattaacagagaaagtcataagcagccctgcaggacatctgaccagattatctttgacttcactgaatttcagaatcaaacgtagcagattccttacagtttcgtgtttacacgaccaagacaatcttcactacttatccgattttttatcctcatgaaaagaattaatctttatatgataatattgggcctgtttgatttggagccaatttttggccaaaaactttagtagtgtcaaaaacttaccttgacaagttttggtattaccaaatttaataatgtagaattcaaactatgaaagaaaccaaacattgttgccaaaattttgggtgggtaaaaattggcttcaattcaaacaagcgcattgtttcaaatattgtcacatagtgaagtctaaactttctcatgaatggttctcttgggcttattcgtttcagcgtttggactgagatttctgggcggcatgcaaaacgagataagttattagtgcatgattaatagagtattaattattataaacttttttttaaaaaaagaaacatctatatagaaaattttttacatagtttatgaatttgggaagtagccatcccaaaaagctatttagaacacacccttagcaagtatagcatatttttttcaaggacatgtcagtataaaatgaaaagaaaaaaaaattccattttactcccttgacttaattcaatgtagagtactgctatacgtatgacccgttgtacgaatagagacatgtaaccatagatcaatcaaaggagagcatgttcatatacactaaaatacagtcttacatgagtcggacatttggatcatatgcatagcaatttccttcaatgtatcgcttaacctgttgtactacttttggttcatttttaccactaaaactattaaaccattgaaatggatcactttactacttattgacatttgtcttttttgttactatttatataagttgtatttaaagctgaaatttcttagacatagatagcaccattatcgaagttgaaatttgttttcatggttgtttgctttaactttaaatttttggtgtttaaatcgggcttatgcgctttcatcctacgcgaagtgagaaaaagaataaaacaatgttgatacgtaagttgtgaatgcatctgtattgtcctaaatttttaatgcgaactatga

SEQ ID NO: 54399 - DNA, 4974 bp, Oryza sativa
  unsure (1)..(4974): unsure at all n locations
tcagaaaacaaaagattatattattcgaagttacgatagtacggcataatgagaagtcaataggcacacgtatgcatgatattatttacctataaaaagattaatggcatatgatataacaagcactacaaatagataattaatggacatgcaggttgaaattgctgcctgagttaatgaaaccgaagctaaattgtctgcaaatcaaataactaaagtctactgtatagacggtacacaacaacttgcaagcaagaacacccaacttttctccctgaaccaaagcctggataacaggtgcatcttcacttggattcactaggcagtagccactggacgttgagttctctacaaggtcaaaccaaactaatcaaactttggcaccatttctccacaaagtttctacatcaacacttctataattgtcaggtacacccagtcctgttcagcacttgagatatttttccttagaacacattaattagagttggacgccgccccaagtgttgaattctgaaactctgaattaatctaccaggagatgagcacacacaggacctagcttttccctgcatgatgattattcaaagaaaaattccatgattccacattactatcacaccaggaatagttcaactgacaagctgcgcagctggactgaaaccttcagctcatgttcatataaaccattctggtaagtacaagctaatgagagaatacattgtccattaacactagagagaagctagctagtgagataacacagaattcagatatgcagcatatggttaagccagtttgcatattgtgtctacagtgtagcctcctctatggcgttcatcttgcagcagccgttgctgctgccggtgacggcaacggcggggaccagtttgcctactccggctttgccggagtgaaggacctaaccctcgacggcacggccatggtcacaccagatggcctactcgagctgaccaatggcaagccgcaggttaaaggccacgcattccatccgacgccgctgcgcttcgaggagttgtcgtcaccagaaggcggggagaagaaggcagcagtgcggtctttctcggcgtcctttgtgttcggcatcgtcactgcctcccctggtgtcggcggccatggcatcgccctcgtcatcaccccaaccaaggacctctcctccgggctcgccagcacatacctgggattcctcaacagatcaagcaacggcgacaacagaaatcacatcttcgcggttgagcttgataccatccagagccccgaattctccgacatcgacgacaaccacgtcggcatcgacatcaatagccttgtgtcttcaaatgcctctgatgccggctactatgatgacaacaccggtgagttcaagagtctaacactggttagtgggaaagccatgcaagtatgggtggactatgacgacgatgctacacagattgacgtgaggcttgctccggtaggaatcaagaagcccatgaagccattggtctctacgagatccaacctctcaacagtgatcaccgatgaagcatatgtgggcttctcagcgtcgataggcacaatgacctcgcaacactacgtgctcggctggagcttcggtgtgggcacgcaagctccggccattgacatggacaagcttcccaagttacctggcagaagaagcaagaagtcttatccgcccaagaccatggtgatagctctaccaatagtctcggtggtgcttgtgattgtcgttgctgctggtgtttttctactgattaagaggaagtttcagagatatgtcgaactgcgtgaagattgggagcttgagtttggagcacatagactgtcatacaaggatttgcttcaggcaacagaacggttcaagaacaagaacttgcttggaattggagggttcgggagggtgtacaaaggagtgcttcctacttctagttcggaggttgctgtgaagagggtatcacacgactcaaggcaaggaataaaggagtttgttgctgaggtagcaagcattggtcgcctccggcaccgcaacctcgtacaactgcttggttactgtcggctcaaagaagaacttcttttggtctacgactatatgccaaatggtagtctcgacaaatatttgtacagccatgatgacaagcctactctgaattgggctcaaaggttccagattataaaaggtattgcatctggcttgctttatcttcacgaggagtgggagcaaattgttatccatcgggacatcaaaccaagcaatgtgctccttgacaacgacatgaatggacggctaggtgatttcgggctcgcaaggctctacaaccgtgacaccgagctacaaacaacagttgttgcaggtacctttggttatatggcccccgaattagcactaaccgggaaggcatcccctcttaccgacgtgttcgcctttggcgcatttctccttgaggtcaccagtgggcgaaggcctgtcgagcaagacatcgaagggcatcgactcctgctgacggactgggtgtttgagaattgcagcaaggaacagatccttgctgttattgacccaagacttaacggcaacattaacattagtgaagcaagtttagtattgaagttagggctcttgtgctcgcacccaatgtctaatgtaaggccaaccatgcgacaagttgtgcagtacctcaacggagatatgcccctcccagagatgtcaccaatgcgctttactttcagcctgtcagcactcatgcagaaccaagggtttgactcgtcgttgaagagtttaggcacgattagtaatctttcaattgggagatgacaatgcaagatgatgcatttctgttcataagtagaatctgtttcttttcaccacattaggtcagagtttattgtagttattcttagctgaagtgcactctctccagccttgagttgagagatttactaatgtgcctatgcatgtttctttcttgtgacaaagtttatcaattccttgtatataaatgctgtaaggcaccgaactgcctgggctcccctctcatattgagaaccacccgcgtatgatcttgtaaaatctggagttagaggagtttaattttttgtttcttcttaattgagtgaattaatccataagaagtcagaactacaagtatagaggatatgtgcaccatcatgttgcaaacaagacttttggccccagctttgaaacttactagcagcttaactagtacgcagtgatgtgatttcacaatctcctatcctattcccatagcccctgaagtcgccgcttccacgctggtgtagttctcagtgccagcgtgtggagggtgttcagctaattcagttatccgcaaatcgatccaagatgtgagggaataaggttcaaggaactggagtatgagttctatataactctttgatcttgtgggctccctagtcccaacgatgctaatcaagactgacggcaaccggcaaatatatatattacngtcattcctatattacatagtttgtttaaacanaatctaaataattagagggccgagcccgttgaaacattgatatctgtccgtggtggtggaggatggtaagaatctgaggtgtgcccgggtgccgcagagaagatcaacaataaaaccgaaaacaacttcgcctaaacacaaatgcgactacatcgtttatatgacactaaatagaccaacaactaaaattaatccgcatgcaaacatgcttagattacctgttcagctcgtcaagcaatatgaaatgaacccaattgtacttccacctcttctacctgttcaccagcctcttccaccgcaacaattccattaccacaagtagttggggttggtggcacatcacccacggttaaaatagctattcaaatctgacaaacaagcgatgaatctcagtcattcaatcggttttgtaccaaataaataggattaatcggaaacatactgcccaatgtcctacctaacctaacctacctctttgagataccttccgtcgctgattttcagccaccaggaaatcagtaatcgagaaccacagctcgcttgctcagctcctcgataggctccttccaccagctcgaatgctcgatgcgacgcagacaccgagcgcacgcagccgcctcccccaccggccgccgcttgcctccaccgctccacgcgcctggctacccagtcgcagcctccccgcgcttctacggactgtggcgcccgcacccccatatgctggccgcccagcggagccctcatcagccaccccccgctggccgcccggccgccggcgggcggcggcggcggccggtcgccaacaaggcgttgccgttgcgctcgctgctggggttgggctcaatcgcacaaggagttggataaggtggtcaaggaaaaagtacactttgactccttaaagtacgctgaattgattcgtaccctttaaccagagaactagacgattcccgaactattgaaatcagtgcaatttaactctctcgtcgattttcgagggtggttttattgacatggtggtagaactaaaaattatatgtaggacccacccacttgtcattaaaaaaatattgggacgcactgacatgtgggtcccacatgtcagtgggtcccataattttttttattgacaagtgggtctcacatatgtttttttaattctaatgccacctaagcgccacgtggaacaaagaccaggtcaatgccgccacatcagtgccatgtcagcaaaactaccctccaaaaccgctaaaggagtcaaattgcactggttttatctagttttctagttaagagatacgaattagattcggcgtacttaagggacctcaagtagactttatccggtggtcaaagctggtcaacactgccctctgggctgggccctagcctagttctgatacatccgggccatcattttgtctactgaaagggctgcaggaat

SEQ ID NO: 54400 - DNA, 7321 bp, Oryza sativa
tcctgcagccctagggggtgtttggatgggctaaaatttgttagtcctgtgtagatactaatttgcagtaataattttataaatgagactaatccgcgagtcaaattttttaagcctaaatttaatctataattaacaaatgtttactgtaacatcacataggttaatcatatattaattaggctcaattgattcgtctcacaaattagtccaaggttatggaatgtgttttttaattaatttatgtttaatactctaaattagtgtccaaacatccgatgtgacaaggactaaattttagtccctgtgaaccaaacagggcctaagcaagctgtaggccatcgctctctcacgcaaacagctcgcatgtgccagtcgaggggtctgtttattcagattctgagaaggaaaaagtacaccgaaggcaaattacaaaagcatctcctaaccacaaaaccggatacaacgcatcccctaacttacaaaaccaatgcaaactaggtccctcggtgtttttgactctggttttgaccgacgtggcagctgactcagcgttggacccacgtgggtcccacatgtcagcctctacttcccctcctctctccacctctcttcctctctctctcctcctctttccatgtcagcctctctttcccctcctctcccttcctcctctctctcacactcatctccctaggtaggtgttggtaattcttacggtcacagataaaatccgcaagcgcacgatatattaatgtagcacttcccctacagagtattccaagggtatcgaatccaagggaacgtatgtagtcagatcttcctccggttcattcaaggacaccaagcaaaggataggccaggatatagatgatttattggtgagaaacaatgtctgggaaagcttaagtttaatcctaacgtaatacttcaggcactggcaacccgttgttcccagatgtcgctctactacgtacccggacagggaggacttaagtgatctcgatagctatcaccacctctacacctacctcaaacgtactatgggatacgcagcaattattggataataatcacctaaacactacgtctaagcaattaatatctacttaagtgtttataactcactaaagtaattactatattttagtccggtatgctatttaggaactaaccaagagataattctcataagataaatctaaattactcaggaagaatattatattgaaatcagagtaataaacagaataaaatatagtacaatagagcctcttataattcagctcaaccttagaagtgtgtgagggagtgaagctccttatatagaggtaggtatgacggttgtacaacgcgaattgtcagaaatgccccgcaaccgccatcaggagatgatcagaaccgtccacgccaaaccccagcctgaacggctgagattttggttcggctgaacctgggctaggcccacctagcctggccttcggcctatctcctccccttgtcctcctctatctatttctcggagtttttggctgagtctttgatattttgatgaagttcacaacccatccttgtatggatacatgtttctcctcactttagtctagatttcctcccaacttcggggtttaatacctgcatacaaatatacaccaacactcatggaatatgtgagattaaacacctatcactatgtttgatgttttattatctgaactttatgcagatgttggcggtatagaatcggcatttaacagccgccaacaaaaccccccacacttcgctctttacttgtccctgagtaaaggttagcgtagaatgaatttctccaagatataattcaggcatataaatcattcacaaccatacctgcaccttcgaactttatcagtagctacttaccatcttgagtaattgataaatggaacgatcttgattccagtccttcttgcttctcctgtcagactcatgggattttatgaattttcgcaaaccagctcttttcctcatattgacttttatctctcaaggatatatattttcttgtggatgctcaccaagacgaagtgtgctagaactcatctctattctaaggctgatatgtggagctcggtagtgataaattgtgacatacctgcatcatatatattgcaaagccaaaaatatggactcaagaagatcatcagtcatactcctaaatcaagggtctttatttgtggtggaaaaatgggaaagtaaaatattttgtggaatgatggaataaagaaatggttctccttttttcctttactttctcctccaattttcttttcttgcatgaatatggaaggggcatggctatatgcacttttttcatcatgctcaatgttttgagagcaagctttatttctctctttatttctctctcttttcttctatagccatgcctttccctccttttctcattttctttttgccaaggatcttctaggagaagaaaacatagtctaaagtaggagttttattgaatggaatttttgtgggaagctaacttccggtgtagaagcttagcttgattaaatatgtggaaatgaaagtggaaatgaccccttgatcatgagaatatgaaagatgtctatcacgagtcacacacatttgacaaagctcaatataatgtcaagcagtcatatgcatgataaggttcatcaatgatatacttgcatatggccttggtaggtataaaatgaagtcaataggaggaatgagcctttaaaacattttttattttgaaaaacaaattcccataaatcatgacaacagtcgcgataattcctttcatctttaatcatctcacatgtagcaatcacttagatgtataaggttccctaaacatggatggttattcataagtacaagtttagctgagaataatgaatatacaagagtaatcataggaagaatttcattagttggaaattttatttttttcaattatgcttgaaccaattgtttctagaattttcagctctagtactataccatgatggagatatacagataatagacgtgcttacctgctcacctgtaaaaaatgagagggattggggccagcactgcaattttatgcagagttcagtgctttccaggtgttcagaaattcagtaattttcagagtatgtgcacgtcagaagatgggatatctcccccacacttattcgaaacctgaactttcttaaacatgaaacaaaaacaaacttggcatacattggggttaacaccaatgagccacattatttatagcaagtacttgcatgattggaaaataaatgaccaagcaaccactactactttattcatgggagaggagacatccaattagcataatactttttctccttccccatctctatgaatgcacgcttaatcttagtgcacaaaccacgactaagggtatcaaaattgtttctaagctcagtaagctctacccctagttccgcgttgcgatccctaagctctatgttctccttgcggagtttcttcacttgaacggcgagtttatggaccgagggctccggcgattttacttcatcttcttgaaactggccgggtgcccttacaattggagggggcgtcaaatgatgcttcaccttcataggtggagggctaagggactccgctgccccctccttctccgatgtcgtcaaaggccggagcaatccttttccatacccactgccgggagttcgcactcctcgaatgcaaaattgctcctccttggtagtggacggagtggcggtaggtgtggtgtatttgtggagcacctcatcccctgccttggtgaatagggtgcccacataccgctcagtgggaggcggagcggccttctcatcgtgttggaaaatacgtcgcatcttcaagagaccgagctcacccattgtcagccgttgcgtaggtgagtccccccggatttttatcttagtaacatggcgaggggagagggatcgcgctgccgaacggggccgagaagggttcggcctaaccagcgagctcgccggccggctccaaatttgctggggagccgggcaccgtcacaaggggttgtgcccacagtgcgtttacccctttcattgtatagttctccaccgggatcaattgatttgccggtgtcggctctctgtctaggttgtaggtggaattggaggatgaggcaatgtatgggatcaaggatttgccagccattggtgagttaagggtggaaattaaggaatttagttaagatggagagggagtttgcaaaggtggaggagaggaggaagaacaggtgttctgagtttgattcgttcgatctacctccgaaagcgcatcacaacaaactacaaacgagcatgggagaccacagtttgaaaatggtccctcccattgactatgcaatttcccatggccgaaaaacttaaccctggagttgaacatcaacactttgtctcctggcttgaatttcttaatttttatccttttatcataacagcacttcgtcctttctttgtatatcttagtgttgtgatatgccttttcactccattcttcaagttcagcgatttgcattttcctccattctcttgctccttcaaagtccatattccagttcctgatggcccaatatgctctatgctcgagttctacagggagtcggcatgacttcccacagactatctgataggaggacaatccaataggtgtcttgtatgctgtccggtatgcccacagtgcatccagcaatttatccttccatcctgttcccattttgttgaccgtcttctgcagaatattcttgatttgtttgtttgaagtttctgcttgaccgctggtctgtggatgataaggtgtggcgacattgtgcttggctcccatgtcttgtaggaggtctcggaaggttttgtcgatgaagtgcgaacctctgtcacttatgaccatcctaggggtaccaaaccttgggaagatgatctctgtgaacatcttcttggcatgctttgcatccgcggcgctggacggcatagcctcaacccacttggatacatagtcgactgccaccagaatgtactcgcagttgcgggatgtcacgcccggaaaatacctttccgaacgctagtgtattaatccccatcccaagaaaagccggggtacaccacaacaaacttgatacaaaaggcacatctttattaattattacaataatatttacattattacaaaggcacgttaggcctgacaacaaaaaaaaaacagcaacggacttgcgggcctacgactctatcttcacaggcactcaactggggtataagccaggactcaacctaaaactttttcttcaaaaagcttctctgactggaggggaaaagattgagcaagaatgagtacaaccaacatactcagaaagccatgctaggaaatgaattataatgcaaaggggaacaaagagttggcataaaagggttcatttttgcgtaaagccaaagttgcaatattttgatgttttgaaagcatagtttaaactcggtcatatatctaagcaatattatcacggttgcgaaaccacgcaaactgccttaaacccaggttaaccacctatccaaagtgccatgaattccatccatcacttagaagaaaaacactaacttggtacattgctaggcttgcccataaccgagggcgcggctattcgaatagttttactctgatcagtgctgtacatctttacccacaggacacaatacttgacttcatgtcagccatgcatcgtgataccgaaaaggcacctgaaaagtcaagatcatgacaagactatccacctagctcaacccaaaacagaaggacccgctaaggtttcgccgcccgccggtccccgacaaggtaaaggttgccggatcccctgagacgagacatgccccctcttgcgccaggtcaaaatcggcctcccctggccccagacctatcataccaatggcgtttgttttgagatgatctagacttctagtcaggccttatccattagacttgtggttgcactgttatgcttcgcaacataggcccgaagaccggtccttatagtggccgaggtgcttctaacaaaaccatgcacctcgcggcccaccaaaaacagatttagaaagttttgaaagagattccaccatatcatggctcaagtagccacctaatcatcattcttacatattttagttgttacccacagtctaatttataaaaagggattctatgttggatctaagcatagataagcccaacctagagcaactagtaagtccatcacatagggagccatactaatcattttatctttttactaaggttgtcaagagcatgggtagcaattcaacaacatggctatataacaaagaacattggaatattaactattaaataaacaatggtgagcacggaataatttataaaagcggtgcatatagaagtaaaacaacatagtttttgcaataatgggattcaatatgttcaaggaatatggtatgacttgccatgctcaaagagaaggtcttctgatgaattgatctacacttcgggaacttctgaaacgacagcagctacatgaacacaaaacaaggctacaaatctaaggaagagacaataacaatacataaaaacaacaaacacaagttctttaagttataacaaaaattaaacaatttaaatgggtcaattaggagctcgtatggccgagaaatgaccattcgaattttaagtgcaattaaagtagatatttctgagttgtttaattattattgttataccgttaaattatgcgcaatgtaacattgctcgagagagaaaggatcgagcaactggcaaccgggactaccacgtgagctgcacacgtgggcaatccacgcggcgaccacacggggaggacgaggagagggcagcgagggaagaggttctcaccacgggcacgacgcggcaagggaacaacaacggcgaccagcgacgaccttggcgcggcgacgacgaacgaaggagggcgacagagacgaacggatcgacgaagagaggacgactctgacgatcttcaggcttgatgaagaggcggacacgacgggtttggcgctgtggacttgacgacgacgacgacgggcgggacttcatcttgacgagaacgacgaccggaggaaggcgaggcgatggggcgacgttcctggggtcttcgggcagtgaggaggcgcggccgacgatgaagacgatgagatgaagccgccggcgctccggcgacgagggagggctgccggaggacaaggatgaagtcgaggtcaccatt

SEQ ID NO: 54401 - DNA, 18763 bp, Oryza sativa
  unsure (1)..(18763): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaaggagaagcacaagcatagcaagcatgatcgctatggccaagctcaccttgggatgatcttcggctccgactccgagtcaagctcaagtgatgaagaaggagttgccacgttcgccgtcaagccttcatcaccaccgagattcttcaactactcaagtgatgaggacgctcccatttgcctcatggcaaaggagtctaaggtaccctctcccctcaactcatttaatgttgatcttgttagtgatgaggaggaagatgttgaggatgaggttatggatgacgagttgttcaaatccataaccaaggaatctataccacacttgagtgagttgcttgggagacttgaggaccaatatgcaactcttgagaggcaagaggctttgctcattcgtgagaaaaagcgatctcatgaactcaagagtgagcttgctaaggagagagagaaaaatgaggctttggtacggctctacaagcaaaccaaagagtctcatgctaatcttgaggtggcgaacgctcaacttcaagagagagtggatggcttggacaaagcatacctctctcttgaagaaaagttcgaaaccttaaagaatagtgtctctctccctagtgagccgtcttgttccaaaattgtcccaagcaatgaatcatgtgtgagatgcaaaaatattgatattgaagcttgtgctactaactctatttctttgagtgctttgcaaaagcaaaatgagaagcttatgtgactctttcacaatggcactacttaagtgccatatgggtagtaaggccctaaaggagtacctaggctatcaaagggacaacttcaaccatgagggtcttgggtatgttcctccaccaaaaggaaaggtggacaagagtgtgatgatcaagaggccccaaggtcttagcaattttattaaggccaaaagtatccttcctaatgattatgcttcacattgttcttttgatgcatcttatgttcttaggaagaatgctagtggtcgtgttgttgctaagtatgtaggcccgaggggcaaaaatgtttccattaagagagttctttgggtgcctaaggcacttgtcactaacatgagaggacccaagcaagtgtgggtacctaaaactagaaattgatctcttgtaggaatctctctccggtggaagaagttgggtgattgatagtggatgcacaaatcacatgaccggagaagaatcaatgttttgctcccttgatctaaatggcacttcgcaagagaacatagtctttggggacaatggaaagggaaaagtaatgggattgggtaagattgcaatctccaatgatctttccatttctaacgtccttttggtaaaatctctaaactataatctcttgtccgtttctcaattatgttccatgggctataattgtctttttaccgatgttgatgtgaccgtatttagaagggatgactcctcggtagtctttaagggtgttctcaagggcaagctttatcttgtggatttttcctcaactaaagccaaacatgagacatgcttagtggctaagtccgacatggggtggctttggcatcggaggctagcccatgttggtatgaggaatcttcacaagcttctaaagcacgatcacatccttgtctaacaaatgtactttttgagaaagatagggtgtgtagcgcgtgtcaagccggaaaacaaattggagctcatcacccggtcaagaacgtaatgacaactacaagaccgttggaacttctacacatggacctcttcgggccaattgcttatctaagcattggaggtaacaaatatggtctcgttattgttgatgacttttcacgcttcacgtgggtgttcttcttgcatgacaagagtgagacacaagcaatcttcaagaagtttgcaaaaagagcccaaaatgagttcgacctcaagatcaagaacattcgaagcgacaacggcaaggagttcaagaacatgtgcatcgagagtttccttgatgaagaaggcatcaagcacgagttctcggctccatattcacctcaacaaaatggagtagccgagaggaagaataggactctcatcgagatggcgaggaccatgttggatgagtacaagacatcggactgtttttgggccgaagccgtcaacaccgcatgccacgccattaaccgcctctatcttcaccgccttcttaagaagactcccgatgagcttcttaccggtaacaaaccaaatgtctcttactttcgtgttttcggtagtaagtgcgacattcttaataagaaggctaggtcctcaaagtttgctcctaaagttgatgaggggttcttgcttgggtatgggtcaaatgaatgcgcataccgcgttttcaacaaaacctccaatattgttgagatcgcgcgtgatgtgacatttgacgaaactaatggctctcaagtagagcaagttgactcacatgtgttaggtgaagaggaggaccctagcgaagcaatcaaaagattggctcttggagacgtgcgtcctagggagccacaacaaggggcctcttcctcaacacaagtggagccacctacatcaacccaagccgacaatccctccacttcaagcttggatcaaggtgaagaaggcgagcaagtgccaccctctccgataaatctagctcacccaagaatccaccaaagtatccaacgagatcaccccaccgacaacatcttaggagacatcaacaagggagtatccactcgttctcgtattgcaaatttttgtgagcattactcgtttgtgtcttctattgaacctctaagggtggaagaagctcttaatgatccagattgggtgatggcgatgcaagaggagttgaacaatttcacccagaatgaagtgtggactttggtggagcgacctcggcaaaatgtgattggcacaaagtggatctttcgcaataagcaagatgaggccggggtcgtaataaggaacaaggcgaggttagtggcgcaagggttcacccaaatcgaaggattagattttggtgaaacttttgcgccggtagctagacttgagtcaattcgcatattgcttgcttttgctactaacctcaattttaagctatatcaaatggatgttaaaagcgccttcctcaacgggcccatcaacgagttggtatacgtggagcaaccaccgggcttcgaggatccgaagtatcccaaccacgtgtacaagctccacaaggcactctacgggcttaagcaagcccctagagcttggtatgagtgttttcacaattttcttgtgaaaaacggctttgagatcgggaaagccgattcaactctttttactaaaagacatgataatgatatttttgtgtgccaaatatatgtcgatgacattatatttggttctactaacaagtcttttagtgaagagtttagtaggatgatgaccaaatgttttgagatgtccatgatgggtgaattaaagtttttcctcggccttcaaatcaagcaactcaaggaaggaaccttcatttgccaaacaaagtatttgaaggacatgctcaagaagtttggaatggagaatgcgaagccaatccacactcccatgccatcaaatggccacctcgacctcaacgagcaaggtaaagacgtcgaccaaaaggtataccgttccatcattggctcactcctttacctttgtgcatctaggcccgatattatgcttagtgtgtgcatgtgtgcaagatttcaagccgctccgaaggagtgtcaccttgtggccgtgaagagaattcttagatatttagtgcacacatctaatcttggtctttggtatcctaagggagcgaggtttgatctcatttgttatgctgatgcggattatgccgggtgcaaagtggataggaaaagcacatcgggtacttgccaattcttgggtaggtcccttgtttcttggtcttccaagaagcaaaactccgtcgccctatccaccgccgaagcggaatacatttcggcggggagttgttgtgctcaacttctttggatgaagcaaaccttgagagactatggcctcaatgtgtccaaaatcctactcctatgcgacaatgagagcgccattaagatagccaataatcccgtacaacattcccgaaccaaacatatagatattcgccaccatttcttgagagaccattccacaagaggcgacatagacatccaacatgtgagaaccgacaaacaattggcggatatcttcaccaagcctctagatgaagctaggttttgtgagttgagaagtgaactaaatatcttggattctcggaatgtggcttgatcttttgcatgcatttgttttcaattactagaataagattgcatgccacatcatgacaaagtgatcattcaattcatgaatgaacactagtcataatctaagtggatagcttgaatctatgtgtacggggatatcttgtctcatgataattcactctcctttgatctttggatcatccatttgacttgtggctattgttttgtgtggttgattgtgtgctagccatgaactcaaatggggcctaaatgttcgaccattcctttctctccaactcccatcaaaagtttgtgaaaaattgaatctcttcaaaattcccggtgcaattcccttaaaaaattcatttccaaaagtttgcaaaatgttttcatcaaaattccagcaaaaatcctccctttttggtgcttagatgccaaagggggagaagatctatccttttatttattatggtcgaacatgagtggttcttatttgtatgagacatgtgtgtttcttaagttagtttaatgctttgtaagtcattattgtttaattatgaatgcttgggatgtaatgtgatatatttgtagatgtgatgaatgtgatgagcaaaatgtgatatatttgttgtcttgtgagcttcaatgtggatgcaaagatttagggggagctctctacttgctttaatgcacacttttaggcggatctccaccaaaatcctaatcttttattacttctaagtatgttgtcatcaatcaccaaaaagggggagattgaaagtgcatctaggacccctcatttattttggtgttaatgacaacacaattagatggtaactaatgctttttgttgagatgtatgcaaggatgaaaaaggagtggatgtcaacacaataagtattgcgacatcttttgtggtaattgtcttctaatccatgtatatcttgtgttcttgagtattaggatgtcgtactattaagagggatgccacatgcatataattggtagaacactagtgctcaaaatcatttatttgaagtgttcctgttttatatctgtcggactatccgatgttgatcagactatccgatgctcagactatccgaaatttcacagaactttgctcactgtcttgggtctgagtgttggctaaaaaatatcggactgtccgatataaggtcggactatccgatacgtcggactatctgaaatttctcaaaacttcactctctgttttgaattgctttttattccttttgagtgagttttaaatcagactatccgatgtaatcggagtattcgatgatccagagactccgaaattcaatggaacttgagtctctgtgagaggatgaaattcttggttcaaaaataacggaatatccgatatgacatcggactatccgatcgatcagattgtccgaaattctccagaattttgttctctgtctctggcctgcttgggggtcaaaaacatcggactatccgatgtcatctcggactttccgaggtggcatgaaaagattctctcccaacggccacattttgggggcttctataaataccccccacctaacccttttctagggttacccaactcatttcattctcattcactttgggttgagcttggtgtttaggtgctttggatctttgagctctttctccctctctcaaatccctcctcgttctttgtgtggtggatcttggtggttgtggatttggtgtttgagggcctagtgtgtgtttcactcgatcttgagcactagggtttgactaagagttgtgtggtgtttgttactcttggaggttgaggactcctagacggctaggtgtcactcccgagccaccgatctacgtgtggttggccgggagaagtttgtgaaggctggatctcgcctccgcaaggaaagagataccccttagtggaaggaggagtgcttagtgcaacctcttgaggaaagggttagcaaagacccggctcttagtgagctcctcaacggagagtagaatcccctcaaggatttgaactccaggaacaacttcgtgaacttcatcattggtgatctcccttcatcctccttttagctttgcttaattgtgccgctatagatctagtcgctgtttgtgctttactcttgtttgtgtgatagatctacttgttgtgcttcattggtggatcagacagtctgatccaacatcagactatctgatatttttggatagtctgactgtggatcagactttccgaccttatttcagttttagcttccgtataaagttttaaattagcctattcaccccccctctaggcctatttgaccctttcaagaagttctcttagcagctgccattagaaggagataggttttttaactcatgatgcatacttaatgatgaaccctaagtttcactcgggatactcaaggctgtagttggcccgatctttccgtgagttgaagataactacgatttgggagaaacgttgacgacccgactacaaccgtacgagacgttgttgtgttgcgccttagcgatcgatacacctctccgtgggttgttgatcttgccggtgcagatcaaccttattcttgcaagcaaatcgaagaaacaaacaagaacaagataaaagcaatctaaattgcaaatagcaattgagtacaaatgataagtttggtgttccgtaatgagcaaaacgacgatttaaccgttcacgggattacccggtaaagtagcaaagctaaactttaatctaaacaaaacccaagaaaccctgaaggggaacctaactatttatggagatgggaggacccaaggtcgtcctccacctggttggggcgcaccccacatgggcctcacttgggccggggtcccaaacgaagttacaagcccataggcccattacaggtgatgcatcaccttgttctatcaattgtagctcactgagatggaatttcgcaatgaggatagatccgttggaaggaggactccgagagatttctataaagtactcacgggccgaaaacggagctcgtatgcagatttggcggccgtttgaagtcagcagtgtagcaggtagccgaatcggattccagctcttggaggacttgatccttatatcatcttgtccatccatgatgtgagcaatggttgtatctgtagtagccatggtcacatcatcctccccttcttcacggaaaaccgttctcggtttttccgtatggtgctcgtcacataggccctgtttgattcagcttaggattattataatttggattattaggagtaagctgaaacaaacagatagcttattacgatagattattacaatctataagctagattactataatatggtaatccactctaaaggtgctttttctagattattgggtggctaacagctaacatacaactaataatccaaagaaacaaacagttaacagcttattccatgtcggtttattataatctaacttatagtaatctggcttaataatctagattacaataatcttaagctgaaacaaacagggccatagtctattcaaaataacttgtttcatccaatcaaaactagagaaactcgaagttgtgtgattagcaataacatgtttctctaaatccgaacaaatgaaaactctatgcaccaaatatattcctctatcattatatacgccaaagatatgaaaaatagcattagttggacatggaaaatcatacttagcaaataatttatcctccaaattattgagctcacaaaaatcatcaaactgaacatagccaaaagtatttaaagaagttatcaatttatgttcctcaacatcattagcaatgtgaacaacatgcttaaaatcagcacacaatgaaacactagaaatagcatgttcattcactagttgtggcagtgatataagtgaagcattatcacacaactcttctttatcacagggaacaacaagtaaatcaacttgtgacaaaggcaaatcagaagtagtttccaccaaaatttgctctagattagtatggatagtggtcaaatgtgactcatcaaaagcacaccaccttgagtaataacagcaccatttaatttaccttctatgccctcttcagataatgtaggtgcatcagtcttctcttcttccttcgtgagcgatggagatggcatctcgatcatattgctcttctcctcatggtgaatgttctgagctccctgcaaaatgtcagtaataggaggcacaagcatagattgtttctcccttgggttctttaaaatattgctctcaacactacaagcaagcatgaacaagtggcctatatgattatatgtcacgttaataagcccagtctgaatatcagaattaagccctctaaaaaatctagtcattgtgctctcattgctttcttttaaaccactataagtggtacaaattttaaagtcatgaaagtactcccacacggctttatcaccttgttttagatgttctaatttctcaaggagagtacgtttataatatgaaaacacaaaatttttcctcatcattgttttgcattcatcccaagtttcaagcttattgccaaaagtataccaccaaaaagatgcagaaccggtacacttattactagcagccttaatcatttgagcattagagaaatcatactcatcaaattgtttgtctactgctagctcccaattaccataagcggcggaatcataattaccatcaaaaacaggcaaattagattctacccttgcaagatcattatcatgtaccttatatgcaaagagagaagaagacgatatatctcattgatggtgaagaagtagatgttgagcatgaccatctcgtttccccttgcacaatcctgccatggttagtagcaaacaagaaacatacacaagaatatgcatgctcctatcaactactaggtagtggcagctgaaatatcacacacactcaatcttttcaccaagctcttacaagttcttaccaaagcaagcggaatagtgacatacaccgactcaaccaagcaccccaatggagtttggatgtatcgatgccttggcaaacacttgctgtttggttgcaatcagatctgtggagctctaggtaggtttaaatatgtagcaaagaaaagcaatggttcaaatcagataatgcaaagttgaataattgttcaaagtcaagtactgtgctggtcctaggctagaacgtactaaagatgcgagcctagacacgaacgataccacaagatagcactagaactaactcaagcacactctgatatatgaaagtaatctcaaagatacaactgattcttctcttttccttcttttttttcctttcttttctttttcttttatttttttggtgcggcttttcttttctttttttatgcacctttctgcctttttttctcttccttccgtttttttgattttttttatcaaaaccgacaaaaggacctcaatgcaagattatagggactcaaatataaatatgaaaatttatagggactcaactgtaaaagtccaaacccaaaattagaactatacaaaaatgaaatgctctcgtcccataggttccgttttgcaaacagatctccaatccgacactctaaaaatttttaccaagctgtctagcatctcacagtatgcattgaaaccgacagggagggagtcggatagatgggaaaccgactgtctcggctgaaagtttggatatctcgcatgaaaggaaacaaaaatcaatctcaacagaaaccgatctaatctaatctaccaaacagacgcccccttccctttttttttcacgcgcaacagcacggccacgggacctggcagaacaacacgccatacaacataaaacctacacgcaactccaaaaccgaccaacaaaaacttgtgaaaactacaaaaatagaaccgtgacggaaagacgattccgttttcgtaggtcccgacaacaacaagcacgcgacgactgtggtataaaatgtgaccagaactcgaaactctaaacgcactagacgctatgaccagcaacacgacatgacgatgcaacacaaaactcaacaacgcaaaaatagaaaagaacaatgcaatggcacaaatatggctaggtacaggatgcaattttttttgtagggcaatttttctcgatataggtaaataaaaaaaaactcaccgagcaacgaaagctttgataccacctgatgaaccctgagttccactcgggacactcaaggctgttgttggcccgatctttcggtgagttgaagttaactacgatttgggagaaacgttgacgacctgactacaaccgtacgagacgttgttgtgttgcgccttagcgatcggtacacctctccgtgggttgttgatcttgccagtgcagatcaaccttattcctgcaagcaaatcgaagaaacatgcaagaacaagataaaagcaatctaaattgcaaataggaattgagtacaaatgataagtttggggttctataacgagcaaaccggcgatctaaccgatcacgggattacccggcaaagtagcaaagctaaactttaatctaaacaaaacccaagaaaccctgaaggggaatctaactatttatggagatgggtggacccgaggtcgtcctccacctagttggggtgcaccccacatgggctccacttgggccggggtcccaaacgaagttacaagcccataggcccattataggtgacgcaacaccttgttctatcaattgcggctcactgagatggagtttcgcaatgaggctggatccgttggaaaaatgactccgagagctttccatgaagtactcacgggtcgaaaacagagctcgtatgcagatttggcggccgtttgaagtcagcagtgtagcaggtggccaaatcggattctagcacttggaggacttgatctttatatcatcttgttcatccattatgtgagcaatggttgtatctgtagtagtcatggtcacatcacttatctttgtcctagattttctttttgaagttgtgtataagcactaatactgagatgtgcacctctgcatcagcataccagagacatgagtgaaatcaatggagtcagaaggtattttgaaatatttgattgagaagacatgcttgagcatcataaggtttatctttatttttcccccaaatgttgcattatatcctcaaagaaaacggtgttatacatgcaaatattgatgatggtattaattaatcatggcttgcatttgacaaacatgaggctaaaaatagttagtactttctggttatgtaaagtccttttccaagagttcaattcttttatccatgaggaataagtattatcatattaatgtgctttatcaaggtggtttgtactagggtcacaagctttaagacttgaaatgctatgttttttttttgcctccatccttttttgtctacacatattctacagagtgcaactagatcaaatcagacttaattatctccaaactccaatagaactgaacaatatgtctatcatgtgatatattgttgatctttgcaacattctgtttaactaatgtgaaattgttaactactttcctcagttgatggcgtataactcttgtccacatctcttccaggtaaaacgcattattcttccccttggtcttggaggtgatgatcaatatgattattattggaattaccttgtgtacattgtttctacttgtgcagaactttttttacattgatatctttaaactttgacactttttttacagtataaaagcaaatactttggttctttaactaaagaaggaacttctatggcctagaaaattcgcaccgtgttgaagataataaatcggcagtactaactccctacacaactgttgtccacaaacctcaatatagagttgtattgatcaaaccagagaaagccatgcatattactagatcttttggtctcaacatggtcatgatgtatgttgccggggaacggtaattgatcatttccgaacccagttcatcctcgtatctctttttcactttttattctacctttacccctgctacccagagaagtattcctgtcaaactcttctcgactatggagcaacctctcttggagctatccgctctaggggcgaattttatgagccatctccttcatcggagccaatttatacaactggctatgaaattcgccccgaactcatcagtatgattagagaaaatcttttttctagctttgatctagaaaatccctaccatcatctgtgagactttgagcaagtctgttcatgccttaagatttgtggtatgagacaagaaactatatggtggaaattgtttctgttctcccttcaagagagagcgaagcaatggtacacctctaccattggatgtgtaaatggtagttgggaaaagttacgagtcagattctgccttgccttcttcccagttactcgtatagctgcccttcgagtagagatccttagtttccagcaaatcaaaaatgaatcaatcagtgcaacctcgtcgagattcactaatttagtgcagtccggaccaaccttgtccatacccgaatatgtactcttgcaacatttccatacgggtttggataaggaatctgcattctatctggacataaccatcggaggatcattcatgcacaaaacaccatcggaaggaaaagtaattttagatcgcattctagaaaatactcccttcatggcacaatctgatgaaccccagctagaggcatccgtgtccaagatagaggaaccttcagcaattgagtcacaatctgagccttccacttccactgacttgattgatgagaaagttcctgagcagccatccgttgagaatgaagaaattcagactccggctcgtgccacaactctgttcagggacggttttgacgaagattatggcaactccctgaactatttcagtaaaaagaaaccactcgtccccttaacgcctactgatcctatggaacttgggttcctcagggaaactgtttgggagctaacatccataatgagcaacgaatggctaagagaggcagagctttcatccgaagtaatttggataaatacccctcccgaatcattccttgccatctggaagggaacgatgttggtattctttacagtccaactgtcggggttaatctcatctctgagtcatttgcattcgcttatttgagcgataaggcagtaaccccgataaacaaattcttcaagcacccgaacggaaatattattgaaggatttaggattatacaagatgtgcctatctgctttgaagatagggaggcagtcttggatttccacgtctttgaaattcaagattttgacattctaatcgggcttctcattgagcaactcctaataaacacgccccggttagatagcctcaagataactttgggagggaatgaattctcagtctcattctcgcgggcaaggttcgccttgaacgactctctcccagagattgagtcagcggaggaggttacagcagttccccctcacgagtctcccaagtcccttttggaagatgaagtccctgacttcatcaaggaagaagcggaaccccgagagactctcgatcttccaatcttggaaccactacctcgacctccgcatgagcttaaacctctacctcaaggcatacgctatgctttcttacacaatgacagagaagcccttgtcataatcagtgacaagctctccgaagacgagactcgacgtcttctgactatgttagaaaagcatcgcgctgttcttggctattcccttcaagatcttagagggattaatcccgcgctttgcacccatcgtatcactattgaccccgagagtaccccctccagggaacctcaacgacggctcaataatgcgatgcgagaagttgtaaagaaagaggtcctgaaactcctgcatgccaggattatttattccataccatacagtgagtgggttagtccggtccaggttgtgccaaagaagggaggaatgacggtcgttgcaaatgctcaaaatgaacttattccgcaacgaaccgtaactggatggagaatgtgcatagattacaggaaacttaacaaggctacaaaaaggatcattttccgctaccctttgtggggacacccaataaagtcatggtgcacccacgaatacgtaactgcccaggatattcagttacgcatgaaatgatataaaagcataaacttcgattatacaatacttaagtcacttagttcacaacacaacataaatacaaaccattacatatatggcctataaagccttatttctacaaacagataaactgctagacttcaccacaggaactgcctgagcgtaggatgacctagtagaaaccatagctgtcccactctaacgggtcaacaggatcttcacaagcatcttcctcctcatgatctgaacccatttatgagtacaaaaggtactcaacaagacattcttatgataataaatacaataattgcaatataaaacatgtagtatcgagagctggaaggtttaaaccctaaccttaacaattatttcatagagcctaacttaataaacatttgatataaacaacactattgaacatttaatttaaacaataataatgagcataaaaatatatatgttacttataaataacttgaatagaacatcaagtaataaataagttaaccatattaattaatagccattttgtttaacttgtgcccataatctggaatcacccatagacacatctccattaaccgggagcacggtgtattcgaatactcaacgactctgcagcgtctacccagctttacccacacgatacccacagctggccaggctgaaaagtaacaaggtgtaatattgctccatatatctctctcccttctgcctagtaagttaaaaggatgctcgggatgttgctcagagtgatccggtccgaggtgtgtgccaacctacctccgcatccacttaccattgttcgttactcgatgagcagcccagaacttcatgggcccatagggcaattctgaactctcggggcccatcgagcccacatatataaatcatataaacatgaaccatgtcactttgcttcacacacttgaaagctaatggccaggacactgaaaggcctgcagaagtttaatcaattggagcaatatacgactaggttcgataactcgatcgtgtggatgggcgaaactatatcattcttattgacacaaggggttgattattatatcaattttaaataagaaataaccataaatatatccatatatccatcacgaccataaacaggtccataaaaccaaacacatgaactctatcgtgtgtaccacccgctcacatgcggtgtcaacaattcttagcatatagccataaatagttccataagcatgtttcatatgcagtaataatatccatattaaatcgatagcatgctaaataattaccaatttgtttaagtgttcctcaaattttatcctaagttggttagactccaaggctcattaaggtgtttataacaacaacagaaaatatagtgcaataatagtaatataattaatttaaaagaattcgtgcagtctatcgtactccaaaggacgagtacgctaccaaaataactctctctatctactgggattaaattgttcaagggagggtgcatgtcttgcaaccttcggactcgatgtagtcgtacaaaccgtctcctcctggcacggagatttcactcgcttcgactatcggaccaacattggcgttttctatttacgcaacaatcatcaccacaataaataacaaaaaaacaaagataaccaaaaacaaatagtatcctaaagtgcaacaatgggtgaaaaggatttaaagaaataattttagggatttttggaatttcggtgaacggtgaaccctatggctaaaattagggtcacaacaacggatactcggattgcaacgaaactaacacggatggattcggaataattctaggagtttggaataggtatcagatttcgattttgaggtcaaacagatgatcaacctgatagaataagaaaaaggatttttctgatttatttttcaacaggaaaataggatttcctgtccttctcgttctctgcacaggagccggtcggcaactccctgacgccggcagtggagatgccggttttgggcaagggggcgccggttttgtgatctagaagccaaggcgattccgtttttgtggtcggcggtgagagaagtgccggtggcgaggctggcggcggcgagcagaaacgggaggcggaggcggccatggcggcagcgactccggcgaactccggggagggcggtggcctggtgagcatcagtaaggcgaggggagtctaggggtggcggcaacttaggctgaggcgtcttggagctgcggcgcaccatgtggccggcggcggccgaacagagcagtggcgacgggaggcggcgccggcgatgttccgacaacggattggatgatgatagagaggggaaagggagtattcagcatggcgaatccaattttaccttcaatttcagaagatttgcgttgtatgcgacgaattttggagctcaatcaatttcagaagatttttccttcggtgatgacgattgagttaacgggagtaggggcggatttgaggaggtgaaagaggttgaaattgcacttcttttgcctctggtcttgagccttctagttgagagacgaaggaaatacgaaggcgggaagctggaggtgttatccggggattcgtccgtcgatcggcctcgtgtgtgtgcgtgcgagcgtgtgggatgcgcgggctggcacgagctgggcgcgagcgcgcgcaagcgcggcgcaatgtggcacgggattggcgcgaggcagcacgagctggctcggcctagccgaatagaggaagaaagaaaaggaaaaacagagaaaggaagaagaaagagaaaaacagagaaaaagggaaaaagaaaagaaaaataatagagaaaaggaaaatttggggaaacttaaaatagatagaatttgaattgatgtcatatttagatggtgcgatatttgggatagatttaaatcggattcaaaggaattatttgagggatgatatgcactttgcgacaaaaattaaacgagaaaagaaacaccggaaacaaacttggaaaataatattttaaataaatgtctaactcgacggttatatttttagagaaccaaagcaaactaattcggttttaaaaagttgtcaaattttagggctgttacacccttcattgatgaaatgttggaacgactggcaaatcattcctttttctgtttccttgatgggtattcctggtatcatcaaatttctatccatccggaggaccaaagtaaggctacattcacatgtccgtacagtacctatgcgtatcgtaggatgtccttcgcactgtgcaacgctcctgcatcccttcaaaggtgtatgatgtctattttcttggacatgatcgaggacattatggaagtcttcatggatgatttctctgtctacggaaataccttcggtcattgtctgcagaatttaaacaaagtcttacaacgataccaagagaaggatcttgtacttaattgggaaaagtgccatttcatggtctatgaagggatagttcttggtcatcgagtgtccgaacgatgaatcaaagttgatcgtgccaaaatcgatgtaatagattagcttcctcctcctatgaacattaaggggatccgcagtttcttgggacatgccggcttttatagaaggttcatcaaggacttctctacaatcacccgacctctgaccaacctcttagctaaggatgctccctttgagtttgatgacgcgtgcctaaaatcctttgaaattctcaaaaaggcactcgtctctgctccaatcattcaacctcccgattggactctgcccttcgagattatgtgtgatgcaagcgatttcgatgttggtgtggtcctgggccaaatcaaggacaaaaagtatcatgcaatctgctacactagcaaaactctaaccggagctcagttgaattatgcaactactaaaaaaaatgctcgcggttgtttttgctatcgataagtttagatcttacttggtgggagctaaggtgatagtttatactgatcatgttgttctaaagtacctgctcactaagaaagatgctaaaccacgtctcttaagatggatt

SEQ ID NO: 54402 - DNA, 743 bp, Oryza sativa
atgcctgctccctgacgccaccatccaagagctacactttccccatctgtagcatctcgggcttgagcatgtcaccgtctctgagggctcacttcacagcatgattgccagctgccctgtcctggaatgcttgctgcttaactgcaaccttggtttccattatcttcggatcaattcccctagccttcgaagcatcggtgcacgcatcatatcctatcgtaatagcattggacaccttcaattacaagaactcatcatcgaggacgcccctcttcttgagaaattgccccatcttgaatcgcgcaatgacctgcatgtatttgataatttccgcgcctaaactgaaggctgtaggctgcctttgtgatccatggtttgtccactccaggttcacgtttggcaccacagttattaaggtaaccatgctctttttttcccctttagaaggcttctaagttggtgtggatgaaatttatgtctgctcttatagatggcctatgcttgttgaagggagttaagtacgaaagtttggcggaggttgtgtgcaatgtgaagattttaggtatccatgtggatatgcttaatgtggataatgttattgacttgatgctgctttccttgcttggataggttatacttcaaggtaactattctttaccaattgtttattgtttcaggctgcccttgtgattaatttattactgctccaccaaaatggttgatttttattctttgtccttttt

SEQ ID NO: 54403 - DNA, 2246 bp, Oryza sativa
ggaaagcattatccgcctattctttgtgtctgtggtagattgctccgtggaggatctgtcgatctgtcatattcagttcaagaacgttgggaatgatatgctctcaatatcctccatatggtctattgacaagaggttccaaactgtaaacctgattacttgagcttatcttggaatctctagaagattatgtggaatgatccacatttccaaatatgcacgagcagttttgcaggttctaaaatttactaattgtttctccaagatggatctgttgaaaaggaggatggaatttgaagatggcctattcttaggtgccagagaataccctgctaatattttatcttatgcttgattgatctatgccatatttcctgaagctatgttgtcatggctatggccgtaaggccgtgtatcaaaaccagccaaaataatagtttggctccatctcggggtgactgccttgcatgttacagtggttatcatccacaatgttacaatggagccgattgtgccatccaaacatgtctgaaatttcagtacatgttttcatgtgtcatgtacaactatgaacagtgataaaagatttatcttagctctatacagaactacaaagaaaatatgtagtaatgtttctctcttccttctgagtcccagtatttcggttgtctgatggatttagaaatcgatatttagacatgcactgcacccatagtttccaagaagcacaaacatgaagaagctagtaccaccaatcggatgggttcatttacaatctcaatcaactaatttgtctgaaccacaaatcttgctctgattatcatgttctatgaaagtttaacatcaataatctacatacacagtgaacaaatgtctgcgacggacatacatcactgaacaatctatactatagtcaactacatgaacatgttttaacacaaacaaattgcatgttcagagactcggtgtaaaagaaaaatggaacctatcaggctaacacactactaaaaaaacagagttagacaacaggggccagctagctgaatgcatgtcgatcatctcccacttgagaagctacttagttggcttatgctcgccatggacgataacgacttagagatggcatatgaatcaagacctcggctttgcgccatggataacatgctgaagctcgtgtgagacgggacgagctcagggaatggtaactgaccatcgaggtactgcatgacttgtcgcatgctcggccttaaatcgggcaatggatgcgagcacaaaagccctagcttcaacactaaactcgcctcatcagtgttatactcaccttcaagtcttggatctaccatatccatgggtagtgtctccctgtccaaatgcgcagatatgagatcaaccaacatgtgtatgcctccttcagtgtctcgctccacaggtttccgtccagtggtaacttcaagaaggaatacaccaaacgcgaacacgtcggttagaggggatgcctttccggttcgagttatctcaggagctagataacctaaggtacccgcaataattgttgtttgcatatcgctgccatggttatacagcttagcgagaccaaagtcacctaacctagcattcatctcgctatcaagtagcacattgcttgctttgatgtctctatggactacaacttgctcccattcctcatgaagatagtataaaccagacgcaatgcccttgataattagaaacctctgagcccaactgaggacgggcatgttgttgtgaccatataaatatttgtcgagactcccatttggcatgtagtcgtaaaccaaaagtaattcatttttaagtcggcagtagccaagcaactgcacaatattccggtgccggaggcgaccaatactgacaacctcggcaacgaactctttcattccctgtctcgattcatgtgacaccctcttcaccgcgacctccaaacgagattttggtaatactcccttgtacaccctcccaaaccctccaacaccgagcaagttcttgttcttgaacctttccgtggctcgacgcaaatccttgtaggggatccgatgcggcccaaactcaacctcccaatcctcacgcaattcaccgtggttgtaccgtttccgcacaagtataacacaggaaaccataaacagcaggagaaccacagagagtatgggtagagctatcaccattgtcttggactgatcagaccgggtcctccttttgggcatcttggg

SEQ ID NO: 54404 - DNA, 5418 bp, Oryza sativa
ggtcctgggtgtcggcggtgacgatgccgaacacgaaagaggacgagaaggaccggaccgccttctcgttcccggtgccgttcgtctttgtcgacggcgtgcggcggagcctcaccggcggcgggtagaacgcgtggcccgtctgctggaccgtgccgttggtgagcttgaggaggccgttcggcgtgatcctggccgcgccgtagagggtcaggttgacgccggcgaagccgttgtacaggaactggccgtcgtcggcgagtccggcgacggccgcaaggcggaggaggagagcgaggcaccacgacacgtactttgttccggtcatgtctgcggcgcggcgcggcgacacgtacgtacttttgttactgtttgatcaatgcaaatgatctactatactgtttatactgtttcagctcaattgtggttcatatcaacgcgtacgttgaattccgaagtcttttgaatttgcctagtcaatctccctactcatatttggtttgaaaaaaaaagaagagaaaaattgagccttgcattcatagcgtgatgaggacgtgtgacttaacgagtgacagaattaacatgatggagatgttcgaaacggtctagtagcttgtatttaactgttcatcttggaccaggctctctcggttattatagtttgattgatatatggctttaatttgggttgttcatggtagcagtagccgacaaagctgatagggaaattcgtggagaaaatggaggcaaattgctttcaatgattcagtgccagtaaagcgaaggtcagctggctctgtgttttgccatggatgtaagcaaaaggtatatacggcgtacgtatatttctgtggacacaatggttacgatgaaatagaacctactgttgcgtcaaaaaatagaacctactgatgccaatctagaaattttgaaagaaatacgggttggtgcatgacctgatcggtatggcatttgagatttatggggatgtgactaattaggatgcatgaacccagacttggagggggcgttatagttttaaaagaaattgttttggacgaaatttttgccaaatttctcgtcataaggaatctggtaacggaaaagttcaactttttttctcttgtcttcaaactctgctcacaatctaatttttcatcctaatatgaaaaaactagttagttatagattgagcacagttctaattgaaatctcaaactgacttcaatatctggtaggagtaattcttacgcacttacacagaagatgaacatatgcttacatgagctgatgagcacacacccatgagtgcaccctcttaacacatcactaagttcctattaaaagtacataattgtgttcttatgacctgggtgaagtcatgtatccatgactccactgcaccactagtgctttcgctagattataaaaaattaaccttaaacatgtctaataaattatcatcctcttttaatttatttgcttaattttgaaattattgtatatggttgaccttcttttctgaactaataattgcttctctaaattgtcaataagttaagaagttaatcatggctctaaaacaatattaagtcaataaattttaatcatggctctaaaacaatattaagtcaataaatttaggctattcatttaatactaacgttgggttgaaatttgaaaatgacaggacactcagactccttacacaccacaaagtttcaatcattattaattattaagttgaacagatgtggtgtagtgataattattgagttgatttaccagcaatgcgactgttttgtaaacgtccattaaattttggatatacctcgttcggcagatatcattggaacaacaaaataattaattacaaatccaaaattcaaatccttcaatcaaattgactaattatatatgtttaattatttctttacttgtcgagcattgcgactattttgtttctagaacacgcaggagatctacgttgcgagtattctacctatcctatgaattggagcgcttgagacaggcaccttaacagcctgccgatggcgtcacaaggcaaaatcaagttatcatctaaagtgccgctcaccaaaaactaagagactcgaatatttttaattccctcgtccgacgattaaattatgagtgaataaaatgaaaccctctctatcagatgttgtaatgttgaatctcaattagcaatagttttagcaagtgattaaatttagctcgatggaatagaaaagcacagacattaattaggtgccactaatagaattttcctaaccaagtaaccaatcaacatagatgcaggcagcatcatgcagcagcaagctagcagcaacacactaggaaggcatcatgcatcagcaacactaaaaaaacaccagcagaaactcagttggatcttgcatagatgctgttgggacatcaagccatgcaactagaaaaaggaaaatccctagaacaatacatccatggggaggtgggggtcccggccggtggctagctgggcagccagcccaccgtgccgtatggggccctccgcctctgaacaaaccaaacatattattgccagtaggaataagtctacttggtctccctcaactcatgcacctagttgaatcgcatccctcaactataaaaccgggtataacccatcctacaactcacaaaaccgttccaaatctactccttggacggtttgggaggcggttttgtcctacgtgccgtctttgactccgttgactagccgagttagcacgcgagccccacatgtcagtgtaaggtatggtcggtgaaaactcatcgagggaagaggaggcaaccactgccatgcggtctacgccgcccacgcccaacgccctcacctcacctcctcttccacccaccggccgccaccatcaacctggctgacggagatgccctcgactaggaccccaaggccaccaacgccgccatcaacccagctgccgaccccaacaccatcaacaccgccatcaacctggccgccgcaaggtcggaggaggagagcgcggggatgaggtggggaggaaggagaggaggcggctgaggaggggcacgggaggggaggcggcggtggtgaggtcggaggagatgccgccactccgccgttcctgttgtcttgaactgtgctgacaccaacaccatcaacaccgccatcaacacgatgagaagggaggagaggaggcggggatgaggagttggtggcgaggagaggtggttcgccgagttcccgtcgccccaccgctccagccgtcctgctactccctccgctcccgtcgtcctgctactccctccgccccaccgctctctccatcttgctcgccgctgagtacaaagactgaggagttgagtaactaccacgtggacccaaaatttctttttatttttatttaggtttgtttttattttagtgccaagtaagcgccacgtcgatgtcgcatgggataaagaccaagtcaacttgccacgtaagtgccacgtaggacgaaaccgcctccaaaaccaccaggggagtcaatttgcaatggttttggaagttaggggacaggttatacctggttttgcggtcgaggggtgcgattcaaccatacgcatgaggtggagggaggcaaagtagacttattccttgccaatactaccttaccaaattatagtaattctataagttttcactttgaaaaattctataaatgctggtaaggttttaaactaaacacatccagcgtcgaaaaaattttgtaataacaaaatgtaccaaaatcgttaaattttagtagagttgaaagtggctataaaatgaacaagcccttaattcaattcagttttgtccgatttgatcaatccaattgagatattagcctaagtcataaattcatgacttttttattgggtttctcatgttgactagtaatgctaatgtttatctataggtttgctatcacaacttataaaatgcacagagaatcaaaatcgagttaaattatataatgaaaacagcagcaaagtatcaaatctactgttcattataatattcgaaggtttacagtttttttaaatgttatatcatagtggtcaacacatccctattgtgtggtttagcccagggacaccacaaaaacatggccttggggaaagacactccataaccgtggatatttgccgatgaacaccatgccatctaaatgaaacttgtcgtgctgacgtggcggtcggtagcccggttttttacgcggtcggaccgaaatgcccctacgccttatcctcatattgcagtttaggatcgaatcgccaccaccaccggcggtagaaccctagctcccgaaacaccaccagtccgccgcctcgctgctggctgtgcccaggcattttcgccgccggaatgcaaggttgacctacggtgatggcttcactatcgcaggaggtggtggaatctgtggtggcggcaacgccggcgacgccaaaatggatgcccaaaggataagtatttttcctctctttgattcgttttccccctctttgattcgtttgggatgcatggtttgttggatctgatttgggggcctgtttttctcctcatttgccgtcgcattgtaggatggatccgaactatgcatgcagagttgtggttagggttgttgcttatgttgagtatatggataacggtagccaagattatcatgtttctagtacacataagtgggtagtagataaagacagtatgcttgatagatttgatgaaggacttggatgatgaaatcatccgtggtagtgcgcaggagcttacaatgactttctaggacaagagagcgggtagggatgtagaaatttcttctgatgttgtgttgttagaggcatttaaccaatactgggatgttaagaagcttccattgcaagtgacagtgagtgaggatatcatgccttgtacccaaattgtgttttgtgtggatgatgaagctgacacaatggttccactgagtatggttttacccacgcaagcaagtcaggctgataatgtacctaccagagatgctaccataaaaaaggtgcccaccaaaaaaagtagcatgtccagggacaaagctacagatcaatcaatgccaaatccagatccatggggtgagtttgatgaggttgagtatgtgggagttagtgatgagatggagaattacaatgagctggtgtcagatgatgaggctaatgatccagattatactcctgatgatgatgatggtgatgaagagaatgctgatccagtagatgatttagaaatcaatgataataggggttgtgagcctctaattcatataactgatgtagacaatccaaggatagaaattggtgttacttttgaggatggactttgttttaagaggtgtataagat

SEQ ID NO: 54405 - DNA, 1003 bp, Oryza sativa
taatgagaagcatagattcagtaggatgtttgttgctttgaagccttgtatagatggatttttgaatgggtgcaggccatatctaggcattgattcaactgtgttaataggcaagtgaagatgacagttggcttcagctattggtatagatggccacaattggatgttcccaatggcctatgctgtttttgaatctgaaacaaagtaaaactggaaatgattcatggtttgtctaaataaggcaattggatctcccaaggcctagtactgtctactaatgcaggcaagggcatagatgctgcagtgacaagggtgttcaacaatggagtagagcatagagagtgcatgaggcatttgtacaataattttcagaaaaggttccatggagaagtatttgaaagaaatctatggccagcttcaagagcatataggaaagatgtttttgacaggcatttcaatatcatgaaggaggcttccccaagatcaatgcaatggattgaagagaatcaccagcatttgtgggcaaggtctaccttctccacatctaagtgtgactatgtcacaaacaacattgcagagacatttaacagttggattaggctagagaagtcactacctgtagttgagctacttgacaaaattaggcagatgatcatggagaggatgtgtacaaggcacaaactatctctcaagctgcaaggcaatatcctgggaaatgtaatgaagcaactccatgacaaaagtaggaatctcaactacaatcgccacaagagtctgccatttgtaggtgaagtcagtggtgcaaacatggacttgacaacatggagacacacagtggacttgaccaaacaggaatgtagctgcaaggaatggcagctaacaggcctcccatgtagacatgacatctctttcattagatccctgagagaagtggatctagaaaactatgtcagcccctactattcagtggccatgttcaggattgcctactccacaattgtgc

SEQ ID NO: 54406 - DNA, 6208 bp, Oryza sativa
ggagaaaaccacacaatagggatatcctataacaaaattttccatagtttaattatattccctttgtccataaatattttatgggattttagctatatgcatacatttgtcgatggagggagtacaaacttgtgtcaaaaaaacagctcctctcttgtctagtactttgtccacaaaatttgtagttatctggaatctacctttagagacgctcctgtttgaaaaaaaaaacactttttcgacagtgtaattttatggtaagacatgcttgcaggttgcagagtcgccgccatctgctgcagctagacaacaacattgtaggagatcgtggccgcgattacacaggtggcataaaacaaaatgctcgaccttaactccataaaacagtaagaccagctgaataatttacatgatgaaacaagtaatgggaatcaatgcaacgccaacattgcatccagtcaatgatacaacagattgtataaacaaagtgctcggccctcagaatccatgctacatcgcctacttacatcgcagctagtcacactacccaaaaacaaaatgagactagaaccaactgaaccaaagctaggattaaacagtagtcgtgggatccacgagagctttccatgtacaaatctggcaaaggaactgtagctctatatagaggcacctgctttgatgaacgtactgaataatatggaaggtccagctaggttgccgaaatagaaaccttgccatcacaggtgaggtcgtgtcgtgttcgtgtgttcttctaaactagggtcgagttgggtggtgtgattccttgtgataagtagtatgccttctcggcatcggccagcctcgtttgaaatatctcccattctttcctacagcgtgctcttacctgagacaaaacgtaccatcgtaagaggaatttatgtgctgtacagagttcatgcgttgggaatatctacaacatttaaaactgcagattacataaggatatgtatttgcttaccccttcccatggtgcttttccattctctgcgttgccctgcaaggtaaagtagtgcaagatcaggttacacagtttcactgagcaaaatgaaggacagtacactaaatagttggctaggggctaacctggtttccaagtgatggcacagcttgatgaacaatccattgagcatcgacgactccaatcttctcatgagcaggctgattaatttcatgtaaaacagaagtgtttaagctcagtgatccatggatgatttggaatagcattcgaagtggaaaatgatatgaaggcggagcacaaaaataattgctgatgatagacttcaaaatttaggtgaattaatgttgttaatcagactaagaacagaagctctgaacttctctcattgctattcggggttcaggagaagtggtttcccactatccaaccacaaaaacaaaaatccaatatatgtagcttcttcccaagaatcccaacccccaccccatttcatggcccactccagccaccccagaatataatcaacccataaagtcagcatcatttttcctaggtcacttcataggaaaagaacaaacaaagagtacctccacacatttccttagagcgaaatcaagaccccatccatggaccaagtcattctgcagaagacagtgtgtaagaataccactgttataaacaatgttaaagttgaacatgtagtgccactccacctgaatcatatgccagacacagcgccatgcatccctagagaacacggttgccatgatttcaacaaatctgcacatcaaattgaatgtaatacagatatttgggcaaagaaatttaaatacacaataaaattctgggcccttagccccttacgctgcacatggtggcagatggggatcagtgcaccagcctggcctctcctcagtaactctgttgaagaaaaaagttactcaagaatcttatataggtggccaacgattaatcattgaataaaaccatatggattcagcggctcacttgtgaacttcttgatcacctcgccgttttgtcatttgccatgtcagtcccttgtcaggttgcaaaccaggctgagagatatctagcccatgcttcctaacaagttcaatatacctgaaaaagagtacaaacataatcgcacccaagtggaacacaaggtcaacagataaaggaacaaaaatgcagttcttacttctctgcattgaaatgctcaacacctaggtcctcatcccagatgaatatgtagtcatatcgggcaacaacatcaggatgcaaaaaccgctttgcataccaccttaggtaaaacaacaagtacatacagtattaagacttcacagcaaaaattcaaatggattcagcacagataacatattaataataacaataacctttacctaccacttagtctgcttcctgacactcacatggatagctcttttagaccactcaaattcatcccattcagtagtccggccatcataatggaatagcatgatagtgaatttatctgaaaactatatgaaaagcttctatgaattcagaagcaataattgcatatttacattaagaaaaagtgactaccagttcaccggaatgcaagattaactgtttatctgttacagggtatagttgattgatgcaccaaatttaagcaatgcaagatgtccgtctcagttacctttttgacagcagcatcaatattagccttctgtgtaattccaactgtaaaagtaacaaggtaccgtggttcgctactcaggtcctgacagtacgaccatatgtttcagattgtatatcatagaagaaaaatgatatagaaaccatctaattcaatgccctactgagcaaagttacaacaaaagaaaccacaaacctcactaggatcaccccacaatctccgtggaaaaagatctgtttcagaaacaacaatgcctggtgggagcctttcagcacctttagggtttgtgggaacataaatctgcagaaagaattgcatgtgactttaaaacaaaataaacaataggaaatgtggtctatgaccagtaaccaactacttttcagttaattactagttgagaagagtcccttgtagtacactaatatcgacaattcaagattcaatcatcgattatcataattttataagatgcaacagaaaacttttaatatagacagaaaaccctgatatcgtccttcatgtaatctttcagcctagaacttcacacattatgcatgagaaacacaggagtggtattaacagaccccacatatcaaaatgtagtccccaacccaactagaatattgcccaactcaactaatacaaacaaccttaaaaagtattagaagtattgatgtgaacgtaccttaggaacttcttcagaggttgaatcggaattgtttttgttatgacgatttgcagatgcccacgcatgatttaacaatgtctgggttgtgatgccagagttcctatcttctatataggagataatactggaagggaagtgaagctgcgaaatgcagtaatgtagaaagtaaagattattttcctaaacaaaatacatgatgagaaaaaacaagagaagcaaacgatctacttcaccttggttatatttactgtagggaaggaaaccccaaacaagtatcccaacataacaccaacaactgccgagaatatgagcctcatcccctcatttgatcttggcgtgctgttgatgatgaatgttcacaattaaattacaatgtgcaaccatgagcaccgtagaaagaaaaagaacacttggttggtgttactagacaagtgggcaacagataaattatcaatcagcgctagaaacggaaaagaaacagttaagaataaacagtagctgcagtatcaaacctacctacggccaatgctattagcaggttttgccatatgaactgcgaatcttcccctctttcttttctactacagttgctgccgaagaaacctgtagagctgcagctgtcgattcacaaaccacagtcacaacgaagcaagataacaacaaatcagtgcttcccaaatagcataagttggttcaaaattcaaacacaatagaaacagctccctaaaatttgaactaatcgttactagtagacaacccgctacaacaagctcattcgagatgcggaccgatgaatctctccccccaagtcgacaatcgccgaccattctcgggaacgcgaaacgcgaccactaaatcactaatctaccgcaacccagcagccgcccccgcacgaaattggacgcggtcccgcgagctagatttgaaattgaccgcgtcgtcgcagcctctacctacgcgcacacagcaaatcgaaccgccccaccccccccccccccccaaacaaaagcttgagaaatcgtaccgacggaaagcgaatcagccgcacacccggacagatctcccccgcagcagcagcaggtcggcaccggcggcggcgcagtacggcggcggggacgaagccgaatcggggggagagacggcgcgcagatgagacgatgattgggagagaggagagattggaggacagcgatggaattgggggggagacggggatgggatttgtatcgcgatgagcagctaggatctggttgtcccacacatgcgccccaatcattcgccgccgcgagaacctctcctccctctctctcctctctctctctctggctaagtaagcgatctgctctcctctcgtctcgcagcttgaaagagtcgagaggagagagggaggtcggcggtcactggcaggtggggtccacctcgagtccaccctgcgctgtcctgtgctgttgtctctctcgcttggtttggtttggtttgcccctgaatgaaaattaaaaagaagaaaagaaaaggagagagagagagaggaatacttgggggaagatgtctgtttgactagcggtaatcttctggttggttagaaggttaggattaggaaagttcctggggctgaacgcagatttgtatgtactatcctgtcctaaaataagtgcagccataaatatacgtgctgagcgttttaatcatccatcttatttaaaaaaattataaaaaatatttaaaaaatagtcacacataaaatactattcatgttttatcatctaataacaataaaaatactaatcataattttttttcaaataagacgaacggtcaaacgttagacatgaacaatgctaaaactgcacttattttggaacggaggaagtactgcgtacatgctcctttgggtatgggtagagaagggacgtgtattatgaaaccgtgtgcagtcgacttgtgtttattgatcttttcaaagtagtactacatcctctagatagggatatttgtcactctaaaaagaataatagggtaatttgttttataaaaaatcacttggtaagctaaacagcacaaccaattttaacactgctcttcatacatctctcgaccgttcgattgaacgacccatgccacttctaacttgtccacacatattgtatttatttcttcacgcggatgcacacggagaaggatggcattagagcaatcacaatataaaaaactagtcatgattttcatatcctccccattacgccgccggctgctcgtcttcctcacagcctctcgtcttcagctctctctgtcaagatctgaggtaagtgcaaagatggtattcctcttccctttctcacctccttcgattttttttggtaggatattggttactctctgactaaggtggtagtgggacaccaaatttatatatgcacatatggctatgtgatggttaatgtgtagtggacaccatattattgttgcatgatctctgcctcatgttaaatttcatccttctgcacttgttttccatgctgcaatgacatgagttaaattgtccttctgcacttgttttattcttgttccttgttcatccatttgtaccgacaaatgcaaacttggtcaaactatttgcaactggtcatttctgatgaatagtgcaaatgtgaaggatgcacgtgatgaatggtgctgatttgtgatgcataaataagaacatattttgtacacttgttcatattttttagggtcacctgggaagaagctagatatgatgaacactgctcctctgttttattcataagaacagatgtaagcatggaagcttttatttatgactgcatatatgatg

SEQ ID NO: 54407 - DNA, 9004 bp, Oryza sativa
aaaaatattttttaaatgatggtctaaaacaaaatattaataataaaaaagtgaggccgaaagtaaaatttactctttcttttactatatattcccaagagcttccacttcccacctatagtattcaaagtaaaaaaaaaaacttcttacgtgctggtcaaccaatccatatagagaggagcgcgagatattgatatagtaaaaaaattactagcacgctaggccaaatgcgctacgtgactagatgacacttagtgtgctgtatttgtctgtatatacttcatatacattcgtataaactttatatatgcatacaaatatatgtatagagaactaaggggccctaattaaccgtgcgcagtggctcaacattgaatttaggtggtgcacaggaaccccttaaactcataattccacacttaaaaacactaaaatatacagttttgcatagaatatttttatattttcagtggtactacaccactcttgttttgacgctagctccgctctaactgcgcatgcgcagatgcagccccgtgcgactggtcactggtgatcacccattagcaccaccacctctggttgccctatattacttgttctttttattatctttaatgtttgcctcgagataatgatgttaacagactcttttttaaaaatattccttcagcagataattatgcaatttaagtactatttccatgattttttcctgagctttttacattttccttttaaatttgaagtcagatgaaatttatcaaaacataccgccggttacccttaacggacccccacggtaattgaggtaaccagccagcggtattgcaaaccctcttgatacatccatctctcgaccgttagatcaacattgaacgactcacgccacctcacacacattgcgcttctttcctcacacgggtgcgccgctgcacggagggtggaattaggtgggactactaactacaaggaccgcatcacaagacaacacggcatgcattaatctcctctacgaaatgtaagtcctttaacattttgtgcaagcttcaagaaagtagcttaaatgactaaggtgtgtacgaatggacaatctggttggtattttcagagaacagaaaacgaaaaaaaaatcatcagcgcttagttaaataagtattaattattataaacttaaaaaaaaagtttacttgattctttttgaatttttttttcgaaaaaacaaactgtttagcaacttggaaaatgtgctaacaaaaaataaaaattataattacaaaaggagcttaattgacccttttcccgattatgcgcagaacatgcacacgcacctcatttatagacccatggacccacaaatgtatctcttaatacaaactcaaagagacctaacttgactaaattcttactatatatatatccacttgtatttattatactgtgttgcaaaagatcacacatttatttggcatgagtgaacataactgaaagaatgcataggtattctagaatgacttatatgtaaaaggcattcatttaagtgtaaaaaatgaaatgacaaatgattttgcattaaaaagaacaatatttgatgcagagacctgttcttatctacactttactaacttctctattccttgtttcatgtgcacgcttttcaaactgttaaatagttttttttaaaaaagaaaatctatagaaagattgcttttaaaaaaacatattaatcctttttattttttagttaatactaaattagtaaagtgctaatgatccactttgttatacgtgtgagaggaaaattgtgttcccattcgtgcaccttcaaatagaaccctagttgggcacttgggcaaaaacgctatgctatctggcttgctcttaaggcaatgctttttttttttcttatcaaatggagctacttgttcgcttactgtgaacaaactttctaaaatatttaacatggtatatttttttttgcaaaatatagatatttctttagaaaatcaaataattttatttttcaagtttacagtagctaatttttaattaatcatacattaattatcttgattattttgcgggtggcttctaaacttacatcgtttgtccaaaaaaaaatgaaactgttgcacaacggtctaaaatgaatttagacaagaggtggagtccagattcatagtaatagaaaatattgtatctcatataaattttgtttattttaggacggagagagtaagctaaataatttttttaaacttctttaatttttagttttaagaataaactttcttatacttatttttaatatctgaacattttgatcagactgtcgtggcaaaataatactgccacactgatctaaatagcatgtcaacgttatttagtcatgctggtctggtgggcgtggcagcgttgtcctaccacgccaccgtggctaatgtggtcggacacaaaattgtcacgttgtgggtggcgtgacagtgtcacgccagacatcctagcatgcataaaagattcggatttggaaaataagttttagaagtatttttttaaaaaatttaaaagttttttaaaaaaactccaagccacaatctccctatcgaacggggctcctatttcccggtacgcgaccagctcataaattagctcacaggcaccatttctttggaagaagaaaattgcacccaactcatcatggtcattgactgttcttgaggttgggccagaaatctactttgattgggctcagcccaagttcaagctaacttggctcctataccaagcagtagggatggcaatgggccaggtcaggcttagtccaagcaagctgaactcgaggcctcgagcttactctgtagctcgcgactcgtgagtgaaagtgtgaaacgtgctcaacctgagcttggctcacgagcaactcattgcctcatttgacagtcaactcatcaatttggaatgaagacgaaccataggagtatgtttcatgtttatggtccgtataatgcactaaccattaagtgtaagatactaatgattttgtcttctagttatctggtctagtcagagttaaataccgtagagcccctacaatacttctttattgggtagcatcattttattccaaaattgtgccttcgttagcagttaatttttcactaggagacagtggcgtattgactgttacaatcactcctaccagttccttttaataaatcagatacatatttctcttgagttaataatattccattagaaatctttgttacctctgtaccaagaaaatagtgcagatctccaagatccttaagtgctaactctttctggagatactgcaataaggctggtactgcatcctttcttaaacttacaataattatatcatcaacataaatgagcagaaacatggttaagtctgctttgttataaaagaataacgatgtatctgccttagatcctctaaaaccaagatcatataacttacttcttagtctggagtactaggccctaggtgcttgcttcaaatcacataaatttttatccagtttgcaaacataatcgggattagaagaattttcataacttggtggctgcttcatatagacttcttcttcaagaactccatgaagaaaggcattctgtatatcaagttgtcttagactccatccccttttgagactgcaacagacaagataattctgatagcagatgccttaacaataggactaaatgtttcctcatagtctatgccatagtgttgcttaaatccctttgcaactagacgtgctttacatctatctaggctaccatcttgtttcctcttaatttaataaacccatttacagtcaataatattcgtgcccttctgaggaggaactaaataccaagttttatttttgaataatgccatatattctgcatccagtgcatctttccagtttttattgctcaaagcttcctgtaaattttgtggctcaccagttgagattgaaaggccccattttactgtaccatcagtgtagaccttctcctttctgattccacacacttgtgcgaggacgaggaggaccatcatcatcatcatcatcatcatcattattctgagctgatgatggatcttctgtggtgctcatcagctcgtgtgaccagaagatcctgacgtggaatctaccgcagcagagtgagacgatgacatgaatgcgccaacgccagactggggtcccgaggacgctgaagaacgtgtgggtgaagacgtggcagcatgcgattgctcgggcggtgaagtcggagctgacggcacggaagaagtaggcgaatgcaacgacaccgatcccgaggacagcatcacggcagacgaggcagattcggtcgccgttcccgcatgttgttgtgaaccactgtcctcattgtcatatgtggctaaatcatcatgtatttgctgtaaaacttcaggattttcatcaaaactttcaggagaattaatcacatgacaacgctgttgttgacccagggatactagtgatgatgcatcgggaagaagattaattttggcgcggagacgtgcactagcatttggatgtaatttggcaaaaggaaatttgttttcatcaaatactacatcgcgagagatataaactctcccagtagaggaatcaaggcacttgaaccctttgtgaaagatgctataaccaaggaacgtgaattctttggaacgaaattggagtttgtgtttattataaggacgtaaatttggcgaacaagagcaaccaaagatacgaagggctgtatagttaggttatttggtaaaaagtttttccaatggagatatgtcatcgagaactctactaggggtgcgattaatcaaatagagtgcagaaagaaaagcttcatctagttaggttatttggtaaaaagtttttccaatggagatatgtcatcgagaactctactaggggtgcgattaatcaaatagagtgcagaaagaaaagcttcatcccaaaattttagtggcataaaagaatgagctaataaagaaagacacacttcaactatgtgacggtgctttctttcagcagacccattctgttggtgagtatgtggacaggaaatatgatgggtggtaccagctttttgaaaaggagtgaagtttttgatattccccaccccagtaagtttgaatggctataattttcctatcaaaaagtctttcaactagttgttgaaaatcatgaaacttctaaaagacatcagacttatacttaagcaaatatatccatgtaaatttgctattatcatcaatgaaactcacataatatttaaaaccaccaacagattgtggagcagcaccccaaacatcagaaaaaattagttccaaaggatatttaggctcactagaagacctaggaaaatgtaattgatgactttttgctcattgacatgcatcacatacaacaattttattggacacatctagacaagacaacttatgacttttaatgaccttttctacgacagtgtaggaagaatgaccaagatgactatgccacctctcgaaggatggcgtgaagactttatttggtgttggcttggcgatgcaggaggaagagcatatagtcctttatgacatcgacccctaagcagagttctcttcgtggctagttccttatacagaaaaatttacgatataattctatgaaggcaaaattatcacaagtaagacgataagctgaaacaagatttttgtttgccttgggagcatagagaacattatcctatatacctatacaaatcatccccactactaggaattctctgcatcttagtgcttccacgccatccttttttctctatccgttggtttctaatcaaacgatcaggatcactgccgcatcacacatccactcgcttctcctcctgccgctgctcgcgcttcacctccgtgggacctccaggcaaagcgctcgcttctcctcccccatcggctgcgcatgccatcagcgggcccgccagctcagctgcgttcgcttctcctcgccccacggcgctgcctcccccattccctgcacgctccagccgcattgcgccgcttctcctcccctcacgcaaggacgagctctttaatttccgctaacagtcacacacttatttactttgcctcttcctcttcccatgttcatgtgcatgtgcatgtgaaagatgcacatgccgatgccggtgattgctgctatataatgacatgctcggtgttgttgctcgctcgctaaatgtctccgtctctctctcaccaattctgattttcatagattaatcgctctaattaatttccttgcagttttgcttgaggttctatttgactttcataatacattcccattatcctttccttttgtctccagtatgtatttgaattaatattttaattattctcttaatttttcgcatgataacataaatttcataattgtttagtgccctgtgttgttgaataatatttgaagccgttttcattttatatgctattagaaacccttttttcattgttggttacacttcttatgatgttgtattttcagctgatctttttagcattagcataatatggttattcctatgtccagcaactttaaaaaggtttttgatactctgtattgttctgtattgtacaggaaacaagaaaggtgggagctttcttcattgaaccactgcacaaataattcctttgacggtacgccattaaaatcctcttttccccttgatcatgtctaccactgtagactgactaagttgttttgcattaattttagtagcggttgctgcaaccttggaattatcttaacttaatagtgagacaagaaaaggaagtgagttgaattgcatatgtttttcaataatttgaactgtgagtttgaaagttcaacacattatgcatattcggttgtgatgttatatttattggagtctctactcctatctgatgttatatttattggagtctcggctcctatctttattcttttattcttttatttgattgaatagaataaaatgaagggtgtaatatcctaactatttctttttttatacttaaaacggtaggagatttgccggatatattagaacgagaaaagaagtagtaaaccagagccttacatatctctattaaaaagaaaaaaaaacatctagggaatatatgaggatttatttacataaaaaaagagagtgactgattgaaggatcatgaaacagacagatccttgattgttctattaggctaatattttccttcgctagaaaagcgacttggaattcattcttcaacaattgttggaaaattcttctattgtgtaccagccatatgttccaccacattgtcaacaaagcacacaatatcctttttttaggtatgaaattacaggagctcactccaccaatctgtgatggtttggatcgcttgctgttgtggggcttggaagttcatccaattgggctttatcctaactatttctacatttatattgtaaacttcatctataggaatgtgctatttgacttaacatgtcactgtggcctgtgggccatgtgatatttcattttaggttgtctggcagcgccgacccaactttcactatgctgtactgtatttttcaagtaaacactacacaaataatttttattcatttgttttaaataagccgacatctcgagtgacaactaaaagtaccgcagcaacgcgcggggtgtattctagtttagatagagattgcgactaggggtcttaacaacagaattgccaatgtgactaattttcatacctgcttcgcttgctgtgtgaatttggtcattgccatggtacttgtcatgcactgttagcttctccaactcgccagtggcgtgatccgttgcaccggtgtcgaggtaccaattggtatctacaccgtatgaaatagcagaacttgcaaacctttcatctagaacaaagttttcatcataacggaaccaacaatcctttactgtatgtcctctcttgtagcagagttggcacttgggcctattgtcgacacctcctggattgccgcgggcaccgctagggttcccacgacctcttccgccgcggttgccgttgccgacgttgttgctgccgccgcgggtacggttgttgctgccgccaccaattgtgttgtgtgactgtcctcggttggctgaggcttgtccttcttctccacgacacagcagtagcctgtgctcaaagcttagaagctgaaaaaaggcctcactgacggtgacttgatctggacgcccgacgatagattggatcacatgttcataatcctcttcgagactggcgatgatgtagctgatgagttcgtcgttgtcgacgaacttgccggagaccacgagctcgtctgccagcgcccgcatcttgccgacgtagttcgccaccgtcatgtctcctttcttcagggtagtgagggagaggcgtgtgttgattcactgcgcccttgttatcgaggagaacatcccctcaatcatgctccatgctgtcgctgccgtggtgcacgcagccaattggatgagcatgtctcttgtcatggaggataggaggtaggagaggacttcctgatcaacagcaattcattcctcataatcggggttgctgacgacgacctccgcatcgccttccttcctcctgatggtggcggccggaacccttgtcgctccggtgaggtgcccttccagcttggcacccctcacagccgctaaaacctgcgccttccatatggcgtggttcgattttcctaacttctccaagaaaaattggccgaccagaggattcccggtatgggtcttcgaggaacttgccacggtgcggctgggagaatggattagattagatctcgctctgataccatgtagaaaaatgacgtgggaagcgttgaacccttctcagggccgcatctctattgatataggtgagaatagccctcgcagtggcgcatacatcgcg

SEQ ID NO: 54408 - DNA, 10575 bp, Oryza sativa
cccccccatcccaatagttctgtcttttgcaatcaagcaaaggaaacgatcgaccacattttgttgggctgccatgagtcccgctagctttggtggctggtattgcaagcatgcacgccgttgggcagccaccattttttccgttacccgatggtgagcaagcagcaagaaagaaagtgaggccaagcaatattgttatcaccctggacatgcggaagcggaacgagcgcaacaactgcgtcttccatcagtagtcacgttcctggaccaaagtgatgcgcgtggccacttacgaggtagcgctcgtgaagcgctttctggccttggtgaatgtgttaatatggtcactcttttgatgccgtgggaaatagccttctgtacccccatccttttccttttttcctttgattctcttttttgtcttttggttttgggttagctttgtgaaattgtgaggcacattactcctgaatcttaatataaacatacacatgacgcatgataaaaaaaaagctacatagattaaacaaaacatgatgcacatgcagatatggatttgttcatgttgagaactacttcctccgtcctaaaatataagtatttttagaatagttccaaatcaaaatctttgtaactttgactattaatagcgaacaaataaaaaagatcaattgcgtaaattgatgttaatagatttatcatcaaataaactatcataatatgcaaaaaattttatttaaaacatattacttttataaatattattgatcaatgtatcatttcaaaaactgtgtcgaaatctaaaaatacatgtattttaggactgagggagtagctggtatgattaattaggagcgagtggattagctgtcagattggtttgttccttcgtagagctagtagcatcaatgtcaattaacaattacagttcataaagctaaatgccactaaagtcaggatgcttgtagattagagcaggtaaaatagcaggctataagccagctgtaaacatattttaagcagataaataaggagagagaagagcagcgggctacagatttatagccagctgtagcacggactccaagacgcagtgtgtatatgacaggtgggaccagatattaatagtgtagtatgtaactattgtatgaataagctattagattggttataaatgaattggagctagtagttggctatactattaaacttgctcttatacatcagctcataaagctacagttcattccccgaaaaaaaaaagctacagttcatgatgctgtctcaggtttcatgcacctttgttatcatgtagctaatgatcttagaagacacatatcgttctcggttttttgttttcattgggtaataaaatggagctaggtacaacgcatcatgctcttattttacaaatgtgcaggcatggtctttagcagcaggaatatgatacttggcttggcgcacaccggggtgggttaggcccgcaatgcagagggatgagaaggagaagaacaggatggatccgataataagagaaaataaaaaaaaacaaagaaagggaatggaaagaagagaaaggtataatctttttgcaattacaagaaagacgcaaatgcacacacctacacataagggtgtaagtggggcgggttgtgccgccaacccattgggtacacatgctcacaccacgaatatgcccggtgtctctgtaacacatgctcgaagggaagaggccaaccgcaaatctcttaccttactgaaaatttatctatttaaagcacatacacatgcgtatgcttaatatttgtcacctctgggatttgaacatggtttagaaaaggaaaaaaaatccaaatgccctactaaactaactttggatgaaagtttgtttatcgccctgaaatttgaaacggatattcaaccacccaaatttttacttatgtaaccctcagattgtttcgcagaatggtttttatctaattgtatataagttcgatgagtttgatcacgtggcctacacattggacatatctatgaaaatctccactaaaatatttctttttccctttattagttctcagttacgaacaagtacaatcataatagtagtatggtaataattgtgtaaggataaattgatgacttactaccgatgatatgttaatatgttatattaattattcaaaattattcgtttaagcttccaaaatatgcaaaactaccattaagaactccttagggggtaatatagattatattgcaaagtttagggggttggatgttaaagtttaggatgttaaactgacttattcaaagtttaagagggtatttggacctttttctgtaaagaaaggttggataatttaacagtttcatattaacactgaagtgggaaagaatatcaccaaagactgtcatacatgacgggtcaaaaatggttttttttctcgtgtaagaagaagagatttggcaaagattgtgaggaaaccaggtcaaaaatattacaactacacgattaattgaaagggaaccgggaaaaaaatcccccgaagaacaaaaacaacttaggtagcacagcaccagaacacaatgaccggaaagaaacccgttactactcattgttgctcagctcatagccaaaaacgaccagcggctccaacttctggtgacgatcttcaacctgaaagcttgacgtcgctgctaacaataaggctgagtttgggaccgcacgggaaaccgtattgccaattaacgtgtgattgattaagtatgcttaaaaatacttgaaaataaattaatataatttttaaagcaactttcctataaaaacacttttgtaaaaaacacaccatttagcaatttaaaaaacgtgcacatgaaaaatgagggaggtgagttgggaaagaagagggaagaacacaacctaattaaggggatgtggccactggccaccacccaatcatagagcgtgatcttcttgacaaagccttcaaggagaacaccacaccaaaagacattgtcaatgctcatccagagcaccggaactaggttttcaagtgaagtaaagagagaaacaacacggctaggaccacaaggagggggaatggtgtcacaggtgtcaccatgtgaagaccgggacaagtctttcgcccaaagctcatcataccaaccacgacctttgctagtaccttctccacaaagataaatgtaaggaggcaagtgtaatcattgccaagcttatcataccagtagcagctccgacttcaccccgaacacataagcacttgacgatgccatagttgatgctacaaccaacattagaggagatggcacgatggatagtatatcagctgcatcctaggctcctagcaatgacggactggtttataaaggagtagagatttttaaaaactacaaaaaatggaacccaaagcgaacagcttcgatttttaaaatccaaataataaacaaaataaggatgacatgcgggccataatgagtaaggtggtagcggttgacgagacttctaaaaattataaaaatataacccaacgatgatcatgtttgattcataaaatcctaatgccaacaaatagaaggggcgaagggcgggtcgtaaatgagtatgtgatggtgtttgacgagacttctaaaaactataaaggggaacccaacgatgatcaagtttgatttttaaatcttaatgacattaaagaggaggggtggtggccgtaccataaaggagtagagtggtaacagttgatcggacttctaaaaactataaaaactaaactccaacgatgatcaggtttggtttttaaaatcccaataccaataaaaaggaggagcagtgggagggctgttaaggagtagggctgttaaggagtaaaggagtaggatgatgaaaattaacttgacttcaaagaattataaaaacggaacccaaaagatgaccatgttcgagtaattctaatgataataaaataaaatggagggcattgggcgggctgttaagagtagggtggtggaaattgacttgacctctaaaaactatgaaaacggaacctcaaaagatgaccatgttcgattaattcttataataataaagagaagggatgataggtggaatataaagaagtaggatggttgcggtcaatggtacgtttaaaactataagaaaatataaatcgatgagataaaaaaaattataaagtcccgaagatgatgaatagaagcggagatgagcaagtagaggaggagcgacagaggagtatagggaggcacgtgtgtaacttttaaaaactaaataattgtaaacttgataatataaggttcattttttaaaaatcacgtacgtgacaatgagttgaatatttaataaatatttttaaaaaatcatatgtaaaaaaaatagataattttatgacggtgttacccctgcaattgcgcgagccaacatactagttggagtttaatttgttatttttgttacaacttataaagttaaattgagtttacacttgcatgtttgagtgatgtattactccctccatcccataatataaaagattttatcttttctactagttccataatataagagattttgctatactacttgtcacatccatcatctctcattcaaatttctacctatttcaacctccaactacccgctcaccacaaccgaaatcacatttaatagggatattgtagtgttttcttttcatcagtaatctttacctaaagggaataatcccttatattatacaatggagggagtacatattaatttattatatcaatttgtcttgaaattttatcataatcatttagttgacatactcactctgtttcaggctacaagacattttgacttttgccaaagtcaaactgctttaagtttgactaactctataaaaaaaaaattttaagaaatttttttttatagagttagtcaaacttaaagtagtttgacttgactaaagttaaaacgtgtattgtaatctaaaatggagggagtaaaataaatgagtggatatttagtttcccagcttgttggctactctctcaaggtgtgatttcaggctttccgcatataaatagggtggtatgcatgtagtacattgtatttgtgcatcagctggccttttgtgacttttgtccatcaatcatacagtcacgctccttcctcggaaatttataatcttcgaatcagagatcgatgtcgcggcggccgtccgtagcaccggagccggctccgcggctggtctgcaatgcaaccacgggtgatctaccggcaggctgcaacctcggcctgctggcccgtatcgaactcctggtgctcttctgctccgccatcctcgcgctcctcgtcttcctcggctcctccaggcgccggagcagcagcgccaccgtccgcctcgtcgtgtggggcgccttcacggtgtcctacccggtggcggcctacaccatcggcctcatgcagtcgtcccctttccaccacgagctcttcgtggtctggtcctgcttcttcctcttcgtcctcgccagctccgactccatcaccgcctacaccctcgccgacatcaagagcccggccaccgtgctgctcaaccgaggcctccaggtcatctacgtctccgtgctcctccactactacgcctccgtgctctccccgaagctcaagatctacctcttcatcgtttggctcgtgagcttggggaagatcgcgttgagcgccctcggctaccggctggcgctgcgctccgacaggttggaggcggacaacaagctcgtcgctgattacatgacctacgagcacgacctgagccggcagggcggcagcgacggagatccggtgaccatggaagggtacaagtacatagtcagaggggaggagacggacgtcatggagctaacggcgccggactacgtcaagaagatcaaggtggacggcgcgcgtgcgctggtgacggtcgagagcgtctggcggtgcaaggggcggttgctgatgggcagctccgtcgccgacgccagcgccgccgcgcgacgggatctttgcctctcctttgccctgttcaagctgctccggcggaggtgcagcaactatcccctggccgagtccggccaacccaagacgagggactttgtcctcaggggcctcctcggacagggaaaagacgacgacgacgacggcgacggcgaccggagatcaagacgagacggcagagctttccgggtgatcgaagtggagctcggcttcctctacgacctgttctacacgaggtatcccttcatctgccacgccgcggtgagcacggcaccgcacctcgccatgtgcgccctcgtgatgaccatcggcgtgctcaccctctcctcccactcgctgcgacactaccaccctactcaccatagaagcatcgaggtcaatggcgtcaacctcgacgtcgccctcaccatgttcatcatagcgctagtcatcgtcctcgaggcgtaccagttcgtcgccgtgctcttctccgactggcagaaggtgaagatgctgtgcaggtacgtcctccggccgtcatggcaggggaacccgttcttcgaggcggtgttgcgcgtgctgtgctactgcggcagtggcgtgtactggaagaagacgatgagccagtactccatcgtccgccacgcctctcctggccacgccgtgaaggactggctgtcgcgggcgactcgccggtggctggacaggctcatgttcaacggcggcaaggcgcgatcggtgaaggtgtcggccgcggtggagagcgcgctcgcgtctgcactgagggatcgcgacgacgatgacggcgtcctcggcggcggcggccgcgccgcgctgcggcaacacaggctagactgggcgtggggaggcgcgacgtggcgcacgtgcgcgcacgccattctcatctggcacatcgccacttgcctctgtgacatgcagatgccggcggcaataacccacaagaagacgcggccgcgagcgagaaaggccgccggcggcggcgacggcgacggcgaccgtgcagtggcgacgagcctgtcgaggtactgcgcttacctggtgtcgtcggcgccggagctgttgccggagcaccagtacaccacccggacgatcgccgaggcggtgctcctcgagctccgggtctgcctccgtggctgcgcgtcggacaaggaggtcttggacaggttgaaggcggtggcggagacggcgaccgcgagctcgccggagagcggcatccatgtgcacggtgcgaggctttggacacagctgatggtgatcccggaccaggagatgacgtggaagctcctggccagggtgtgggcggagctgatgctgttcgtcaccccggcggacaatgcgacggcgcacgtccagcatttgacgatgggcggcgagcacattacccacctctgggcactgctgacacacgctggcatcgtcgaccggcctaattctccgtccccacacccacatccggcgccgtaaattggcaccactgtatatcggtcattatattcctccttattgctgctatatttaattgtgttcctccttattactgttgtattttgtgtccgctgagtacttctgtttttgagttaaatgttcatgtttgttttggtgctcagttagctttaatttggtgtcttagtagagaccttaattctagctcaagcaactttctttaaaggttgttttccacttttactctactagcacttttcgcgctaatgtaatctctttactcatgcttgatctccattgttataaaaactagctaggtggcccatgcaatcgcacgactagtacccatataaaattatctatttttacatatgattttacataaaatttgttaaattgttatctcattatcttacgactttgaaagacaactttatcaatgcccgtgttattaattttatagtttttaaaagccacgtcagttgctacctcttacttcctcatcaccgctccttgcttgcttgatctaccaatgtttctattcatcctccttggaagaacctttaagaataagaccatgcagtttttagagttcattatctcgttgggtttcgttttataatttgtagaagtcctctttattgtcattgagattttaaaagtcgaacatgattatcattggggtttatttttactggttgaaagtccctccttccgttgtgactgttctaattaatggcatgcccattgtccctactcttaatcatcattaggattctatttaaggttttatttatagattttagatgtccaatcaaccgccaccacactactcttatatgggtctgttgtttctcccctcttcaattttacttttgaaaattccatatttttcattccgatcggcggctggatctggctaccttgagatcatggcaaaggagagaggcaaggctacaagttgggactacgagtggacccctgagcccgtttagccactgtggggtggccgctggccgtagaggagaggtcgtgccatcatcaagactgccataaagggaggttaggccatcgttgaggggatcgcctgtcatgcgccactatggggaggctgcccgtagcgtcctcaccggatggggaagagaggatggggatggatcgagagaagagaaagggccgagaagatagagaagagaggatggggatggattgagagaaaagaaagggctaagaaggtagagaagagaggatggggatgatgtcgacaggttgtacccgtctacagtatttgtagagtatgcggatcgttggtgacgacagactatacccgaagacggtatttgtagagtatggaaatcattggtgtcgacggactatacccaaagatggtgtttgtagaatatggggatcgttggaaccaaggtatacgcgagatcggatcaagtagacaatggacaaagatttatactggttcgggccctcaagatgagtaataaccctactccagtttatacgtattatagatggaaataccacacatagtacaatgagggataggatgactagacgaatccgccgactagaagctgtcgagaatggccgacaagatctattcgccaattaaggtgctagcttcctttggattgcttctggatgtggctttggctacggcctgtaattcgatgcccatgcctggatgaggaggtcttgtatttatggcgtagatcatcttcttcttcaagtaggactcggataaataaaccggaatatgggcctaaggaatcctcatcttccccaactagggactctgacaccttctaatccgggaagataattgccaacattatttcccgtatttccttaattgtaggatatcttcctctatactattaggtatatggtattgtcatattccgttaactcatgtatagaaggtatgtcatatccttgacacttacagtcggtactaaggtatatgcgagattatagtaagaagatggtggacaaagatttttatataggtttgaaccccacttattacaggtaatagctctactcttgttagccgaagttggtgtagtcattatatctcaatatcatactgattacaataggagagcaagttagctattctaacgggctgacctaaatccgtcgaatacgtcctagcgagtagatatcagcaactaaggcttatcttactcatggttgttttccaatgtggcattggctatggcttgtattgatcgcgttggcttgtattattgtgtattggttgtcttctcttgtcctctctgctcctctagggtcttatatttataccctcgggtatcctctgtccgaatagaattatggaatcatatatgtatacgatccgactagtctcgcagtgtccaaataggactatttctcttttattatctgaaacaccttacatgcatgtatgaggccttgttctgcaaaaaattttacaatttgaccctttacaaaaactatttttacaaatgaactgtcaccaaaacttatttcaaaaataacccttggcgctgaccaaaagagtcatttttgaaataagttttggcagcagtttatttgtaaaaatagtttttgcaaagggtcaaattgtgaaaatttcagcttgttctgtgtaggacttgatatacggtatatttgtatgtcatgaattgatgtatagaggaaatgccttatctgtaatagtgatagattggtcggtgtcagttgctggtcagataaaaaatccttaacccatcagctcggcttggaccgtttattatggatgccggttaattaaaaaatcggcattgttggttaattaaaaaacttgtactcataggtgctgggtttttaaaaaagtcacaattttatttgcaactagatggataccccgtacattgctgcgggagaattgtgtgataatataatagatatgagttctaaaattttctttcttacctactatacaattttttatgtgtttatctatttttatactttcatcaattatccaaaggttataaatgattaagttgtatggtgtgccttttagaggaagagatgca

SEQ ID NO: 54409 - DNA, 1882 bp, Oryza sativa
ttagcattaactacacttagtgggggataaactttatagatatataggattggtacctatagttgctcaaatgctatatttttatcccgtggaaacaggaaacagttcatagatatcagttttaaatgaaccagtatttatgagccgttaccgatgagaggttttataggtacaccatcctagaatatactaatattttttagttacgattttttagctatgtatatggatatgattattcaagtttatagctaagaattgtaataatttttatgtatatggatatgattatctaagtttgtactaagaattgtaatattttaggatggacggagtagctgttaacttttttttttccaaggaagctgtatctctgaaatctccttgaagttctaccctgcatacgtattgtggagctaaattaagcatttggggaacgaaggcaaaggtaaagaacagttaaaataacggaatgaacacagacaattgtgcgggagattaattaattttatctctcaagggatatcctctcgttccttaggcctgtttagttggcaaaaaaaaaattttgggtgtcacatcggatatttgaccagatgtcggaaggggttttcggacacgaataaaaaaactaatttcataacacgcctggaaaccacgagacgaatcttttgaacctaattaattcgtcattagcacatgtaggttactgtagcacttatggctaatcatggactaattaggctcaaaagatccgtctcacgatttcccccctaactgtgcaattagttttttttaatctatatttaatgctccatgcatgtgtccaaagattcgatgtgatattttcggaaaaacttttggggaactaaatggggccttaatgtatctgaacgttgctattgtaggaggagcatctccagcaggggtcctaaacacagccgctaaacaatttttgagagttgagaaaaaaaatcaggtccaacaaagcccgtactaaaggccctaaaataggaaggcctctaaattatcttctcaagcccccaggcctaggaactttctcgctggcccctattccacatgcgggagagatctcccaccgccgcgcgctgatcttttttcgcacgaaaaattttgctagcaccgccgctaaagcctctcctccgcatgcgcgtcgcctggatcagcgccctcctctccggctgaccacctccttcctcgccgcactcctccatggctggcgacttcctcccctgccggccacctccctacccggtggcctcctccctagcgccctcctgccctactggccacctccctgcagggcagcctcctccctggcggttggcgccctccctctcggctgccagcccgcccgacgccctcctcccctgtaaaccacctccacgtctggcacccttttcctcgccggcaatagtcgaaggtagttttttttctttttccaatggatttgtcgatgcaattagataaggcttgttctttgttgagatttagcttgtgaaagaagagagatggaaggaagtccatctctcttctttcactttagtttctttctctttggcgtcaagcaaatctttctgttataaaaccggccccgaaatcacatcgaaaacaaaacgcggaagaaaacgccataggagatccaaacatgatgacgacaccgaggcacgatatttgataatggagttcagccgaggcctacatctccggggcactgattacgggcgctcctccccgatccagcatattacagcgtatcagagttacaacgactcacggccggtcgccgccggctaccgctccctctcgctatgctaagtcgccatgcggttacaataggcacacccctctatttatgata

SEQ ID NO: 54410 - DNA, 1318 bp, Oryza sativa
gcgtgctgccggcttctttggggggaaggcgggcgacgatgtcgccaaggatggcgtccgggaggttgctgatgtggtcggcgctttcttcgtcctcctccgccgccgccggatgctcctccgcttctccgatctcaggtggtcccgacctcctcctcctcttcgcactccgacccgacgcccccatttcgtcgagcacttgtgtttcactgcttcttcttcgctcctgttggcgcctgtggttctgtccttcgccggaggactcggcggcggcgggcggcgggcggcggcggattgcccgctccctggccgtgtgaccggtctcaacttcctgtcatggcccgtggccggcggcgtgcgatgccgaggtgaagcaggcgacgcgcgggagatgcgaattgacggcgcgagaattagggatttcgggagaaggaggagacttgaggaggggaggaggaagaatctgagaaatgatctaacagagcccagcgtcatgggcccaccaggcccagtaactgcttcatctgccgtcattgttgtcaaccgatgggaatgatgatataaaatggcccgtgctttatggtgggatatatctttgatattagagaaacgatgaaatgatttatagattaaagtattatgaaaataatttaagaatggtgatttagaaaaacggcatcattgctatggcatgaaaagagtttctggtccggatatacaaattatgcagacaaaaggccatgtcgagtgttcgtcgtgaaaaaactttgaatccaggaaacttgcagtttaaatacagtaatctagttttagaatgaaataaattgtagtatacttgcatgttgagtttttgtgtgtttaatgggttgatgtggcatgtttacatgtaggttttaggagcgctaataaatactatgcttgcatattaagttttaggtgttttatgggcattagttttatagaaggaagatatacgccccgttcttttaagatacatattttgttttatattagttttggttaacacgtcctttaaactattgtaaacggtgtattttataaaagtaattgtttatataaaagtcattctaaaatatcagataaatctattttcagtttaaaataattaaattatttccctcattttagtattttacgtgtccagatgtgatttttatggtataaacacggtattcctctggtactccctccgtcccataatataagttattttggacccaaaataacttatattatgggacggagaaagtaataatgaatttgggatggagtgtcacctaaagtttttatattacaa

SEQ ID NO: 54411 - DNA, 871 bp, Oryza sativa
aatgcggttgaggggcccgggcagtggtgtcatggctgtgcaaggaagagagaatgtggggcgcgcagatggtgttcgctgaaatggtgaagataggtgtggaggtggacggagaggtgatgggggatttggtgtatggactagctgcatgaaacttgcaaccaagcagagaaaacatataatttggggccaaatcattgtttccattgcaaacaagagatagatggagcagttcaaagtcactgaatgactgcaaataaacgatcaagcaactcaaaactctgttccttgttggacaggatgcacggactcaagataaaactattcgatctgaatctaccacagacaccatcaagatacaggaacctacaacgacgactacagctattattctatcaaaatgcgccaatatgactcaggcctcaggcagcgccgacctcctgcttctatgctttagctgttcaccttcgtcttgctcttcttcaccttcgccttctcttcctcttcttcgccttcctcttcatcgtcttcctctttatttgcctctgcatctttgttttctttatctccaccttcattgccttcgcgttgcttcttcttgcggtgcaaaaggtccttttgcttcggtgagccctgtgaatgaaaaaggaaaaggaaaaaaaagagtcagatagagattacaaaatggatcaaaaacaaagaatgtgaagaagaagaagaagaagaagaagaagaagaagaatcctcacccagatgaggatgaaggtgaaaaagaccaccacgacagccgccatggcaaaagcaacccgctccttgacaaatactccatccgtttcgaaatgtttgacgccgttgacttttttaaatatgt

SEQ ID NO: 54412 - DNA, 719 bp, Oryza sativa
ttagtctgcccttttttaacaaggtgaatagggatatccacacattattgccgaagataaatttcatccagcacaggatactggaggtggccatggcctcaccttttgtagacgatccttaaaatttgtcccattgacagcaacataatcaatagctgcaggttctgagcccttcagtttgataggccttactgtaccagtgagattgttacagacgctgtagtactgctcatttggaaatatgttctgtttcatacacatacatttgagtacggggaatatcgtcaagaagaaattacactgctaccacttctccacatggtaaaaaattaacttagtacgagcacataactacctctccaatccgaggaaggccatctgattcgattgcagcggtagtgtccctcgaaagattactcttgcaaaagaactccgtaacattatctctactttttgctgataaatcaatgcactcagtctgcagaaagagtacaaaggataaaagaaactaattttaggttttgtcaaacttaaggttcaatctataccaagttagatcatccaatcaagatttttccaaaggtactctctgttggtggatactaaacgtgcatactgagatggcattccgaattgaagaatccaaatctaatgctcaggattattcaaatataaaatatagataggtaaactaattttgatatttggatgcctaggca

SEQ ID NO: 54413 - DNA, 740 bp, Oryza sativa
agtatgagcagatatacctatgactctgagaaattctgcatcacctgatgactgaattgctacccaccatcatctcaagctcctcaatcgagccgccctcatcatccaagatctccatgctcgatgatcggcaagtgaagtagaacacgacactcatcatcgagtcgatgagcatcacgaaggagtacatgaggacaagcaatggcccctcccagagccttgatgagccatcaccatagctcagtgtcttcaccctgtgctcaaacagcccctccacgaaggcgaggccaatggtggatccaagaaagatgagcaagccgacatgcgtctgcccgcgcatcagctgcactgaccggcgcagcgcgctgactccggcgatgtcctcaagaacggcgatgacaccgccgaggttgcacactatgatggtgtgcgcgtacgccacggagaaggcaagaacggtgaggaggccggcgcagacgacgatgtcgggcgggtagagcatgaacttgagcgtggaacacgcggtgacgaggagagcgaggaaggaggagaggcaggcgatgacggcggcgcacgcgagcgcgtacgtggcggcgaggcgcggccacgcgcggcgcgcgaggagggagagctcccgccggcgaggagcggcttgcccgcgtagacggccgcgaccgcgtacgcggcggcggcgcgggcggcgaggaggagcgtgaacgtcgccgggaacgacacgacgg

SEQ ID NO: 54414 - DNA, 5390 bp, Oryza sativa
ttggactcgccgcctccgccgccaaacgcgacgttcctccccggtcagattcaacgcaacggctcgagctccaccaaaccccgtcgcccaatgcgaggctcccgtggccgccctccgagttggttccagtgagcagaggcgagatcttggagagcggcaatggcgtgggaggaggaggaggtcgaggaggaagagaagtttcttggagcagagatcgaggtgggttttttgtgaagggagacggcgacgccgcgagctcgcgaggcgagggggagggtctgactaccgacagttcacatgtggtactgacatttggggcccaccaagttgaggtagtttaggtttgttaggatgacatgcgggtcccaccaagtggaggtagtttatgtcagttaggatgacatgtggggccccctggaaacccatccctccggtacggaaaacgaagcagtccattagcacgtgattaattaattatttgctaatttttttttcaaaaatggatcaatataatttttttaagcaactttcgtatataaactttttacaaaaaaaacacaccgtttagccgtttgaaaagcgtgcgcgcggaaaatgagatgggggagttgggaactcacagtgaagcttccacgggcacgcttgcatatgatttttcttgggttgtgcttctgcaaattcctcttgtcgttggttccattgaagatttgaagttgataatagtgcattgacaatgagttatatgttcgttttgtcaacctactaatgacaatgtgagattgtgattcatgtttgtactattgccatttggtttattggttgacaaagtaggaagaaacaaatactatccatcaccattaagaccattttcgaatgcaaattataggaggacaagcgaaactcaattttgttgaaacgagatccttcgcagtgacatactatcacgcctaacatgtaggatccactttctcatgggaaactcatgagcatatatgtcagcgactctaaggcttcgttcgttcctgggcgatctgggggattgagggagaaaagcatctcgttttctgcacgcacgcttctcaaactaataaacggtgtgttttttacaaaaaaaaatttctataaaaaagttgctttaaaaaatcatattaatccatttttgaagtttaaaatagttaatactcaattaatcatatgctaatgactcatctcgttttacgtatcttcccaatctccccaatccccttctcctcaaacacaccctaaggctacgttcgttcgggtaacattgagggagataacaactcattttccgcgcgcacgctttccaaactactaaacggtgtgttttttacaaaaatttcctatagaaaatttgctttaaaaaatcatattaatctatttttaaaatttaaaataattaatactcaattaatcatgagctaatggctcacctcgttttgcgtatcttcccaatctcctcgatcaccttctcctcaaactcaccctaagtgcataaacttcccaatctcctcaatcaccttttcctcaaactcaccctaagtgcataaactgtattctcctcaatcaccttctcctcaaactcaccctaagggcatgtacaacggtgtgtaataacggtctctcttcgtttccatgtaagtaaaattgatgacgtggaagagagagagtggagtaaagggaaacatggttgctacgcatgacaacgggtcagagtcgactcttaacgtttattaaaggaaattttgttgcatggaggtggagaaaaggaaagaatggtactaaaaaaaatattttggtgcattaatggttaagagtttttgttatcttaactattgtaggagaatagtctctaagtgatatgtattaacaaagagaccattctaagctctacctttatacatgccctaagcgtataaactgtactgtagaggaggataccaataaggtgcattaggacacattatgtcgtaatcgtccgagtcatgatcaaggctcagatcaaattattacgatagtacgtgtttcacgaattatcctctaacttaagtaatgtgtttttagagtcactgacatgttcagtgactcaaagtgatttgactttgagcataggatctcaatcggtgttttgctccacaaaaaactctgaaaccttgttgctatgtgttccctgtactctctccgtcccaaaataaaccaacattatacgtgatgtaatacattctattactacgaatctagacatacacatgtccagattcgtaatattagtatgtgtcacatcacgtatgaggtttgtttattttaggatggaagaggtatacaacaactacagtaacccaggtatattgagttgcatcaatacagagaaaagagggtcaaacaaggccgagcaggaaggaacaaaagcttcgaaaccttcgggcctaatcacttgataatgtaagagagcaaaattaagtatgatggagccaagggaacaaaagctaaggtggcaagttttgtttgattccttgaaaggcccaagtggaaagtggaaaagacaataaggcagcttcgcggcaaaggcaaaagctttatgccttaccagatgaagtgccaatagcccaatatatactttccttgctctgctgtcttgactgacacatctatatgcaaaatggcatgttcctaacttcctttcattgttctaatctaatgacaaaatggaacatgccatgagcttccaaggcatgccatgtacactatgacttgggaatctagggaagatcagaagttgcatcaaccaacaagttttcacagtgtttgcgttgatttcacatagcgaaattctactgtagttaatctgattagatgaatgttattacagggatgagtgtatgaaaccatcttttgcacaacagtacatgtaaaatctttcatgttcgaagatgggcgaccatgccttcgtgagaaaagcaaaagcacaagtcattctaccaagcacccccatacgattgcattgccaactttcacctttactctgctggtagctcgagtagttcgcggataccttcacatacctgcacgggtaattgcatataggttagctataatccagagtactgccaagtatcacctatatagtgagcaactagtttagtttttttacataccaacttgatctgcgcttttatgcttgcgatgagatgagtgtactcatctatctgtctgcaaacatggaaatatacaggattagtatgtgaattttactacagggagtcaggcatcaaataaaacaaaagcgtaaatataaaagggaaaattacagcaccaacatattgacatacaaacaaatgtagccacaggaaacccaaaaaggaaaattagagaaataggaaagaagcccagatcacattcaaaagaaatcgggactaacgacaatatgctgcagtgacaatatcgcagtcgatcctaaacaaaacatagtatctgtcaaattgaaaacctgtaacatagtatctgtcaaattgaaaacctgtgttttatgaacgggaagttgacacatcaaagcagcaaggcacaaagcaatatgattaattgctaaggtctgctaatcttcaactgtaatagtttttgtcccggaaaatatggggttcggtatattagatgatataaaggcaacaaaaaaagtttgccactatacagtacacactatgactatgatctttgaatacatatcatattgatgttgatgcttcagtattattagatccaagtatccagcgcagactgagtcaactatatcctacacctccgtcaaaaaaacaacaacttctagctacgaacctagacataggcagaagttggattttttggggacggagggagcatgcaacatcaacagtggttgccactatacatgagcaagacccagcctgtctacctatatacccacacaggcacacacacacacacacaagaggcctatatatctacggtcaaacatagtatactgcaaaatcagcaattgacaaggaaggcttccagagtagcataattggatccaagttagcataacatcattgaaacagcagtaggaacaaactcatctgagaattgacacatctaagaaaatacagagtaggtatctattggctgaatcagtgaagtgtgaagagtagcagtttagaatgctaagaaatgatacagtgaaaataggtcattttagtaaaattttctgaacttatcaatggagacttggagagtgcgcgcagaatatctgatgcacaccaatagcacccaggatcagcacactaaaatgtcaaataaatacattcctttcgtccttgatgcctgggtaaacgtcaacctccaaaaggatacatatagatacccagggttttataaaaaacctactcaagaatataatatgttcctgagtttatatgtcctctcttgagaagaagaaaaaacaaaacccacattttcaactataaataacattatgaggggaaaaaaaactcaaaccaccttttcaacaataacaaaacaggacatatgaaatatatgctaattgtggatactgtgttaaaagaagcataaagcacatcaaaacttccctcaaccatcaagattcctattcctcaacttctttgacacaaaaaaaaacatgatcttcatagccaattctaagaattgagttaccttgccaaccttgattctcttacagatataaactgcaaagcttcctgccaagtaaattccacatggaaacctagaccaatatccacaaaaatgtgtcttgtatctggcctgcagaagtcaccacaggtacacagtaaggaaccaaaggtaaatctggaaagatcaagaacaataaagaggatatatcacggatatatcactcatgttacagaagggtaagtttttctgcacttcatactgattttctgtaactatccaaactctccagagctaggctaaagaccttgaaatatcaacatgaacaaactccaagtctacttgttatgtagtgtgtcaataaccaagaatattttttttatcagaataaccagtaaaaataaaaatcaataagtttgttatactatgttccatatgctaatactatttttccaaccaggattgtcaccctatttccactatttagatggaaacgacacagtcatgtagaaacaccacattatcccattgccaatggtctatcaactgcatgtgcacttccagaaaatttaacttgaataatgtagtatccagctgttccgatataccgcgtcagtgtatattgttaacacatggtgactcaattcatcagtgaagttatatcaaaactcgttgagtcttatccagaactgaagggctgcaggaat

SEQ ID NO: 54415 - DNA, 1529 bp, Oryza sativa
ccattcttctccaaattttcgatgttccttttcaagtccaagctgagaccatccaaaaaccgaaatcaacggccataataatcagcatcgcatcaacacggtaacccggaatcacaataatcattgaggttttacatacaagattctacgggaagcgaatcttacaaggtcttctgctgctggaacaccttgtcccgctgcgcgatggtgttcacaaggtccggcttcagtctccggtcgacgaagtcctcgaacttcttcaccttctcctgccgcacccgcgcctccgccgcggccatggccatcgcccccgcaacccggattcccctcggcactgttctcgatgagccagacacccccgccttcctcgacggcgagcccaccctctagccgcgacgaccccgtgcggcggagccctcggaagcaagggagagcaagcggaggagcggccgagcagccaggcggcggcggcggaggggttcgagactttgaggctgaagcggtcgccgcctccacgcgaaggagttgggccgcggccgcgccggggacgatgggccacacggaaactttcgaggcccaattggtgggaaactgcttacagtacgagcgttgttgccacgtttgctttgctcctcccgatggtttagtaccacctcgcttgttcagctcgatgaggcggtcgcgcgagctataaaatgagtcgcagggctccgtcacaaagcatacctttctcggccttttggctaagatcaagtgtagtatctgttcttatcagtttaatatctgatatgtgggccatgtgttcacttcgatattaaatttattttttgtgggggagggtccaccacagtggcttgccactggggccctcgcgtgtcgcccaggcgttgcactaccgcccgggcctggcgcaccccaaccaaatcaagtttaaattttgattataagcaaaattgatggcccacctcaactaaattagattcaaactttaacctgaaagttgtactactagtagatttgttgaaataaagggcttgtttggtaccccagggtccacttccatccagttcatccagggtccacttcctctacccagctccacttccatccagttttggttgagctgtggaggtggaaactccagaaggggtggagctagagctgtgtcaaacagactcaaaatatcgatatcgagaaaacacgcttaaaaaaaagattttagtcgcgactaaatgtaaacacaaaccaaattaatctgaaattccaaattaatactccctccgtcccataatataagggattttaagtttttcttacaacgtttgatcactcgtcttattcaaaaaattatcaaattctttcttaataatctgcaattcgtgtgaaatatgtataagatttgaatgcatgctagagatttcaattgaattgggattaaacacatcgctgtcctttcaactcggaccattcagtacaggtggagtgaaaaccagcagcagtcgtcatcgatctcgagcgccacatgaaag

SEQ ID NO: 54416 - DNA, 947 bp, Oryza sativa
tatagagtttaatgacctctgagaataacttagtttccatgtcttggcatgactagatttagtgcccatattttgacatgactaattgatgtcaaacttaatcaattaattaatcgaagttagtttttttttgtccaaaaacaaaatcaaagacagattcctctgcattgagtacaaagaaaagaaataacaaaatgcaagttctgagctaggtactgacctttggcaccatatgcttgctgatcaaatactttatttaagtcaacctgacagcgtacagactgcaccactgtaacaagagcgttgacttcaagaatctgcctttccaaatcctcaagattgtcttctactaagtcaactttattcaatatcacaacatcctgttaaggaaagtttgacgctttctgttattatggttgtttgcattttggaattcatcagcaggacaaatttcagcacagcagaatcaacacaaaggattccaaattttgtagcaaagacaaaatggtacaaatatgataacaccaaggaccaagttaccgaaaatgcaatttgatgaaatgcttcagggaatgatgatgactttttgtgctcatcaatttgcagcctgaaggcttttgcatcaataacctgatcagtaaaaaataaatataagaaaaatgtccaatatacagtccttcaaacttttatccaaagagtaacagtaaggagcaaagaagcaggcacattttccgaacttgtgatacagccagactaacaaataagaacataaggttgaactaaccataacgatagagtaaaatttaattgatgactccaactggtcgtctagccacagaatagggacaagaggtgacaagaggtgcaggatcagccaatcctattgtctctagtaatatgtaatccattctgcagcacatagaatgattcctaacaaattaggataa

SEQ ID NO: 54417 - DNA, 6742 bp, Oryza sativa
acaagctgctcaagtgcttgaaccaggctgtgtttcaccgtgcaacaaacatatccatttgccagctctacccactcttcaacaagcgcgccaccttgccccttattgatcattgctctttcaagtccaatttcctctctgaactcattcaataccactgcaattctcttcccatgttgcgcactcagaatgtagttgactaactgaaaagtgatgcgcgggagataagctatcccataacataccaattaattgaacttacaaactgaaatttcacagaacacttggttaataagtacaggtgctgctaggaaaatggtaaggtgagacatagtagaagcaatgtcaacataagctaaatagtaaatgaccaactgacagaaggactaatggtctgatgttagaattttttttgaacgtaatctgatgttagaatttcaaatcaagatacggaccaagatagatcaaacaaggaattctgttgtgagataagaaatatcctaaaaatatggcttcattctgctaaaaagcacaggataaaattgtaaacacatgtataaatcctaaatatatcatcaactgtgtaaaaggttatccatgaccatgagtacctcagtaacgttaagtttttttgttcaagaaactagtaactcaacagttggggatataacattcaactacaggtcaaaattgatagctaactagctcggtcgacgaatcatttcttatactactacaactacaaataaattgaaaatgagctcctatgagaaacagagccctcgaaacgaaagttctactcacaagaccgctcttaaatagatacggggactgctccaaccaacacagcatgaggcaaactacctaaacttaagaaaaaaaaaacagcaagagctatggcgacaggaaacccgatcggatcaaacttccagtcacaagtgcccccaggctccagtcctccaggaatcttccattgagcaatctcgtgagtcgtatcctacttagcgccagcaatctttcggcctcaattctccgagcagagtgttttccagaagtggcagtgggtgcggaagcggtaaaggcgtagcctacggagaaaacctcaccgtggacttgccggcgccgaggtagacggtgatgagtgatgacggtgacccctataggcgatgacgcggagggaccgggcggcggaggactgtgcagcgtctccggcgaggggagggcactcgtcgtcgttctccatggccgccgccgccgccgccgagagagttcgagaactacggaagggttggtgttttgaggccgtatagaaaaggaaaaagtgcactggaggtccctcaacttgtcatcgggacaatgaaacgtcttcgaaccataaaactagatatgtgaggtccccttaactgtataaaaccggtcacccgaaatcaagaccgtaaaactagatatgtgaggtccccttaactgtataaaaccagtcacccgagatccttcagtggttttgaccccgattttagtctacatggcagctgagccagcatgggacccacatgagccccacatgtcagcgggccacgtcaactctctttcccctttcttttttctcttctttttcttacttattcacagcaacctagttcggaataattaattatttgccactcttacgtgctaaatgatttaccactagatccatatgtcataaacacatgcgggcccacgtatcataatgtggcaaataattaattaccacatttttaaagtggccaaaagttaaatgtccctaggtagttcgctcaccgacgttcatgcgccggcagcctaggctcggcgacggcgacgagcggcaccttccggcgtgtggacagcccgaccagctcctccatgctcacgtcctccgccgccacgcgaacccctgcagcaagctcgccacgcccagcgccaccatcttcttcgccaggttggtcgccggataaatctgccgccctgactcgaacggcagcagctcgaagtgctgcccgtgcacgtccactacgtcgtcgcagctgccggcgccggggaggaagcgctccggcaggaacgcgtcggggcggtcgagccacgacgccgggtcgcgtgcgatggcccacaagttcaccagcacgcgcgtgccggcggggacgtcgtagccagcgaccaccgtgttctccctggcgtggtgcgggacgagcagcggggcgcggtcgagctcgtcggttacgcctgttcatgacgatgaactggaacctcggctgagtattcctactagacaaaaccacccccgaagcaatcagatccctaaatcacaggctcacacggtatcaaaaccccaaccaaaaccctaaacaatcacctcttcacaacgaagagcaatccctccacatccttccgcctctgaaacataaaaaagaaaaagaaaaaacacagcgcatgagtgagctcacaggatcaccaaccaagcaaacaaccgaatcggatccgcgaggagggagggaggagggattgctcactcattggttgaggtcgatgttaggatgtccttgacggcggggtcgaggcgctgcagcacggtgaggttgagcagccgcgtgccctcggcgtccatcgtcaggtttggggtcacctccccccaaacctcaattggatgaactccatcatcatcgtcgtcgtcgttggctgcggctgcggaggcggcgacatgccggcatcccgcgtaggcttgggcggtggcaggcgctggatctgagggagcgcagcaatcaagttgggaatcgcggcaaagagagagatgacgtggacagtatgacatgagggcccacgtgggtcccacgtaggcttaaaaccattgaaggatttcgggtgaccagttttgtatagttaagggaccccgcatatctagttttgtgatttaaggacgtttttttatctcgacaacaagtggagggaccttcggtgtactttttcctatagaaaaccgtatgagaaacccagttgtccgatctacatctgacggctcaaaaaagcccaatctgatggcccaaaatgcctcctcgttaacacttggcccatatcatttgaatcccagtatgaagatttctgtcttctcagactcagtttaggccacacactgacaaatctgaagtctttcaggacaatcatttttttttccttttgagaatcaagagcttaatatgaattaatcaagttacatttgaaattcagtccctaattcttctgggataaactacttcctctaagtttctgttaaattcaatcatatgttcgaaatggagcctcagataagataagagaagtaaatttgtatgttacaaaaattagcattttgatgtgtttgctgaaagcatgcccaaaataaacctaaaaaaatatttctaaaattctgccccagctaccgcacatcgtaggacaatcgctctcccatgcacgaactttttgggatcaacgaaatgggagcccatggtcctcctaacttgtggagagggagaaacatgggattggggtttcttttctaaagaaattttaaaaaatctggattgatggcctactggatccatttttccctaaaaagtctaatatcgtaggatttatattattcttcttctaccttatagttcaccaactatagttctatacaaacctcattcatcatctatctatcctatacatcaccaactgcagtactacaaacctcattcatcatctatcttatatacctatagttcaccaactgtagtcgtacaaacatcaaatctaacagcctatctacgttgcctatttggcacagctccagctccaacaccacggccacctctcttagagctagagtctagctaaacagtttcagcttcatcagaaatgggagtggagttgggtggaacactctcacaaaataaactagagagatgtagttgggtttagactacttcataacttcactccagacctaactgctggagcagaatttaggagttaaaagttctgccaaacagacgaataatgaaagaggtggagctgttggagctctacaaaatgatgcgttctcccaagtcccggccgccccacaccgccgccatccactcctcctcctctctgcgccgcctcccacatccacgtttgagagcgcaggttctccggggtccgcggcggccaagcattgctcccacgggcggccgggccagcgcacaaatccggcggccgaagcagcagcagaaggtcgcggcaaaacctccgcgtcgcgtccccgcaacgagggagcacgcgaccgcgggacgagcagcagccgatcagcccgccgccgcagaaggttgccaacttgccaagacggcagccggcgaggcctcccgctccaccatcctgtccgggtcggcggaccgcggacaggccgtgctgcacgttcttcgcttcgccggccaaggcggccaagcaggtattcctcctctatttcttccgccttactcttctttatctgaatcaccacccagttctttatttctgtcgacaattcttgcgcatctcatgctccgatttagtcgcagcaggaatccaagaattcttccagcgaggcatcccgctccggggctacaccaccggcgaggccgtcctcctcagtggagatgggtagaagacgatcacgccggtaaagcctcctctccccagtccattttcgtccttagcataatatgaaatcgaaagaaagaagaacgaattcacatgctctgcttgcacattttgacgcaccaaaatacctgcattgtttacacccaatttagcaaaatttgtttcatatgaaccacaaattcacattcagcatctgaatcacatctctgtgattgcctggacacctctgttactggcgattgatgttttattcagcttctctgcatgtcattgtcatttggcaatctgccattctgaaacttgaacatttttgtgttcattcaaaaaaaacctgaacattttgtacctttcagaagctagaggttgagtatcgagtgaggagaaaaagatacccaggccgagtttgcttgccagcggcgagctggtggtgcgcacctgcaagtgtggtgtccacaaggagttcagcttccaccattcccactgagattgacaaggtcattgctatctgaaatactcctgtactcgaagctctgagattgagaaggtcattgctgtctgaactacttctttagttgcctgctttgtttaacttggctacatagttgaggtacactgcaaataaaatgctttatatccaataatttgtaggataagaaacacattccagattcacataataataaggatatagaccctccatgcatttgttgattctttttaaacccaagaagtagcaagaagtgacctgatagggcagccgtacggcataaatatatagttctgtttgtggttttgaattatcaacatttataactgataattatcatgcaaactaaaaatttgagaaaaatatgcgcatgctgaatttcttaatgagatcacagtaatcttcctttgaaagaaaaaactattttgaaacatgcatattgcccgcacttgcttttaattactgtgagtttcaggtacaaaaggtcctaaccttcacaatatatattgcccacacccttgtttttcttaaatgaacagtatgtgttgtttgttaattttatctgatcagtatgtattgtttgtcacgtgatacactgagttaagaaagtcattgctagcggtgctgctttttggtagctatatttttctgacttctaagtacaaccatatttttttcagggctgcaagcctgcaacaatgatggatttttttttccattcagacccatatcttagcattcggctggtgtttgtgggtagaaattattgctgaacagttctttaccagcattctctaacagctatttacatgcatagttaaaccatttgtatcaaggaagttttgctaaattttagtaattgttcagttagccttttgcttaccataattccttccaagaaaggcctctgggtgtattcataattcatcctaaaaaaatgagagttccttatttaagtctcaatgtagaagtaaagctacgccttattcagctggctggcttacttttcgctacagaaattgagattaagatgatgcaattgcattctattaccgtctcaataggtttccaatagaccatccaattctatcagttaaagcctattgttatgcctatggtgttatactgtgcatttgttatgattgtgccatttttaatgttcttaacatgtggtcctgcaagggagttgtggccatgccaaatcctaggagacatagagcctagctgcagcggcatagtggtagtgacacaataaatttatgaactgttttcatgctctcccacaggattactaacatccaaaatgatgcttctttcatatttggacatatagcaatggttagaaagctatctggcttcggttatttgcgcaacttaggagtttactgctacttcagctcagaattgttgggtaagatctcataagatagaagttcccctatcattttcatgtaccattgccaccgaatataagcagcctcttctcaatcatggtggactaaatgcctaaagcaaatattatctacatgaagtctctcggtagattttctgaactgcacaacacgacagcatgcttgcttacgccccattgtgttttaa

SEQ ID NO: 54418 - DNA, 6187 bp, Oryza sativa
tcatttcttttgatgggaaaatcatcaaaagatgccttagaacagaacagaaacaaaagattccagttattttatccatcttttcacctattcttgtctttgcctcagtccttttttctggtactgaaagatctctggtgccatattcttttaatatgtaaaatcattagatgcctcattcaaatctgaagatcattcacatcttaatcatattgcagaggatatgatcaagaaatttgtgaatggcttgtcttcctttatccattttccatttattgcacattgcatcatcgcatcctcttttttgtgtacggtcatgttgtagttgattttgctgcctattatgctgattggtttctctacaggtttttgccatttcacctggtggataaagacacagggctatttatctttgacaaatagctatcatagactagcagttgctcaaaaaaaaatttctaaggttgtacattctgttgctggttgaaaactcaatatcagaatggttgaaccatggcattctgaccattctttttctttgggcttattttttattttgacttgctgcattgtggagagtcttgaaaattatttttaagggctggagggtcttgaattgaactaaagaaagcttgaatctttcgctgcacacaccagtgagttttttattggaaagacataattagatatagttttgcattacatgttttattgcttgaattgcactgctgtgatcactgcatttataataatgataactgcatatgttttcttcagtcacccatttgtttgccattattctttctttttgcgcgaatcctaaatagatcataatttttatgtgtactacaataaattttggatggacaatacaagtttgttgttcttttgcacaaccacattgagtttgtgtatatttttcccataggaacacatgggctcccaactagtatgcagaagagggcttccaaaaggtgattatggcctcggattgtctatcctatcatccagagaatttggtcgggaacacgggattgatccatggcgggagcggggagcccttgttgctgacatgaagaagcgtgcaacctaccttcctggagtgctccttttcacatgttaatcgactgtctaatgtagcatcacacaatttggcttgctgtccggagcttttaatgtctttggttctataaccctagaatgtatccgggaagtgccccgttctaatgctagctaatcaatagctgcgattatcctttttttaaaaaaaaaaaaagcatatacatgatcattcggcaatctttgatattacagactttgaagttgatctagccatgtaaatgtacggacgccacgagttcacacaattcggcaggattgaattaattttgctcaagaagtagagcactttctcccttcatttttatttactcacagtgctcatcttgagcggaatctcgatggacatctagagagctgggaagacctggatttagctaggatataactataatataaagattaagactcatcgtactctatcatctaagatgaaaacagttgtgaacttatgcaacctaaatccacagggacacggtgaaacagttcaaatagcgagtgcctgactaccttcacacatacagggaatttgattatttaagcaagcagcagaacaaacatactgagagatcagtccatgcatctctgaaacaaaatgcagtatctaatgtagctcacatcctaatccaagcgaagaggtatcccaaaacctgcagctcatgaaaaaatgacgaacaagggaaatatggccgatcgagtggagcacagagaattgagaaatgctgcaaatcttgggctgttgcccaaccaaaatgaacaacatgcgaacaagttcagagagaaaccaaaacaataatcgtctagctgcatgaaacttgcaactaagcagaaaaaacagataatttggggcacaaaatatagatctcattgcaagcaggcgatagatggagcagttcaaagttactgaatgactgcaaataaacgatccagctgttcaaaactctgtttcttgtggacaggatgcacggactgaagataaaactacctgatctgaatctaccacagacaccatcaagatacaggaacctacgaacgagaacgacaactacagctattattccatcaaaaagcgcctcaggcggatgacctccttcccatactcggcggcggaatgtgaactctggttcatcaacgtcctcctacggttcttggacgcggttgtttccatctccacctccattgccgccgcgttgcctcatctcgcggtgcataaggtccttttgcttcgtgggccctgtgaatgaaaaaggaaaggggaaaaaatagttagatagatagagattacaaaatggatcaaaaacaaggaaggtgaagaaggaggaggatcctcacccagatgaggatgaaggtgaaaaggaccaccatgacggtcgctatggcaaaagcaacccacaccttgacaagtatcttatacctcgagaggcacaagaactgcaagaagtaggaaacggtgcacagagcgaaaccggtcgggacgaagcaagaggccaccttggtgagctgaaacacatcacggggacgcttgaggcagagatggccgatgatcgcaatgtgaaagaagatgacggtggcgaactgaaggcaggtggatgcgtagtcgggggtcatctcccgtctcccagcggtcgggaccgcggaagttggttggtgtgccggcgacgtggtcagccctcggcctgatcagcgacatcttcgctgcacgcccgctgaggctgtaggcgatggcgacggagtagccgagggtggatgcggcgaaggtagaggcgaacacaaatttggtctgccaagaacaacaaaaaaaacaagtagcttgaatcagaagaacgcgagactggctggatgggttatagtgtaacttaccctggccataatgtgattttccatggcgtgatcttgctctgcaggaagagaacaccataagattaacagtggtgatgcaggaaagcgaaacgacatcgagatgaaaaaaagaaaactttttacccatcgcgcgcgcgtccggaccccggagggaggtggagcacgacgccggcgacgaggagcagcagcagcgacgagcccaacccttggacgacccgcgcgtcgcggcggaaaggacgagagggagtgggggtggaggaggaggcggagagggtggaggcggatgaatataaagagcagcgggtgttttgcttttttttgaatgaaacctgagaaagtgttttggctttcgcggtttctttcgccctctgcacgacgaccacctggtctctccctacgactaccctacgactacgagacaggttaggctgacgagcgggacccacagcgaagcgcaggttgcgtgggagggacgcacctcccactgacgagcgggacccacacggagctctgtacccaccctgtctctgttcgggtggaatacaccatacccatgttactctatacttttttgcttttttgaacccttccttgcgcattatgacggttccatttgttcacttgatggtccgatttaaccacgtcgacgcgaacggtcagttgttctgatcgaggcaaagaggaacaacttaagaggtggcaacgggttgggtcgggtagagcgaatccatacctgacttgagaccacatgcccgcaaggtctatgggaaaaaaaatctcatgctcgtgcccatacccgtcgagcgtaggtaccccatcgggcttgcctgctatttgataaaaacaaaacaacgaacacacagaaaatagggaaaccctgtattttattaatcacgattcattaacatgaatgtttacaaatatatgagggctcccgcaggagttcgtcttttgccttcgcgaggaatacttaatagaaaggtatgctgactagagattgcgtgtagtctgctgattcccggcgcctagcaatgaggcggccggttaattacatctacaggagagagcctatggaacacctccaattaagctgcgcttgtgatcgtcgtcttcaaaattgattgctcgccgaaggttgaagttggtgcagagatttaatgataactgtgatataggtggctttgtttcgccgaaacctggtcacaatatattatcaccatgtccatacatgagtcaggtatcataacaaaggggatgacttttgcctcgtcggtgcccatttatatatgccagcctttattagatgtggatatatcgttacttttgcctcattggaacctagtaacatgtatccgttcctatctgtttggacatgttaataatatcatgacaccggcctcataaatactcggccataatttttaacttacaaagatcacgaatagctcccatgtgtgtgcatggtatcaaaatatattttgtaaaacatcggttagattgtccaatcaccaatgaaagttggacatatccagcgccgttgttatcggtatcatagtaacaaatagatgatccaatctccaatgagggccggacatctagttttgagcatagaaaatatatcaaatagtgttcagataatccgatcgccaatgaggaccaaaccagccttataccatcgattgtataaatggagtttgatgataaccgtgcttcggctctcattgatctggctttaatcatcgagatcaagatagattaaaaacatgcagatgttgcgatcgccaataaggaccgaacatctattgtgtttaatctagaaaattaatatttattcaatgtgctcaccatccagcgcaaatatcctgaatggcggtatgttgtcgataaatgactcgacttgatgaaggacgccggctgcggtgtttaattctctccgtagcggcgccggtttgctatcaccgggcgacttcaatctcctctcctgattttcctaatctactaagaagaatgggatgaatgaaaatgggcagatgggtgtctcctgtggcgtcctcggcgtcccccgctctagataggttctgcttcttatataggcagcggcgacggaaacggcctccgaatttccagcgccccgtgctaatcttcgtgataagccgacgcagagacgagccaatccgtcgacgtgtactgcagtctggagataattatgtgattaacatgtctaatgacagtgggccccatatgtttaatcgccacagccaatgaccatgcatgctcacgtaataacgatagcacttgcttatttcttttgttttaatagttccaatcttttgaatcgtatatcggatttaaaatccatttgaaccatcactttctattcaaattatacaacaaaacgagtccaatatcgaatatattcggacaccgtgacatttaaaatttctggacccacatgtcatatagatacgtctcgtatatattcagtaaaattatgctataaataatattctcatataaaattaaatgcccaataatttattatttcttctatgaatttttagcacaaaaattcatcaaacacctgcgccaccaccgccatcgtacactgccgcatgcgcccttggccccgtgcgtcgctgtgtcaccacccgccgcctgctcatgtgcgccgtcgcgtcgccatccaccgctgtgccgccagtcaccgtctgcgcccgtccgctgccagctgccgtgcgcagtggcgccgcgagcctccgccagccgctgcctgcgtccttgtggccaggcactaccacgtcgcgccggcaccgccgctgcgccgtggggattggggtacaagaggggagtggggaattaggttaggattttattagctgactatatatgttgtgtctctagttagtgggccaaatggtttaagagaaaagggtacgaggaacaagagatgagctaaaattagctaatacatatgtatcgaatcaggcatgggttacacttgagcaaaaaacaatacccggttgctgtctgtcacgttctcgggtatgcccacgggcaaaatataacacccatgcccatgctcatcaggccgggtaaattgccatccataggttccccttatcttgtcaccgaattacaaaatcatctcttaaccaaaaaacggggtacatgtgatccctcaacttataaaactaggtcactctgggtc

SEQ ID NO: 54419 - DNA, 1473 bp, Oryza sativa
cggtcgaaagaatagggatgtaaaatagacttattttacctatatatatgtcagcccaaagaggagggacggaaaatagacttattttcactatatatatgtcacagcccaaagtggagggacggaaaatagacttattttcgatatattatgtcacagcccaaagaggagggacgaaaaatagacttatttaaaaaaaggcacgatgggctacctgcgccttcgggccggtccggcacagcccgacggttggtgggccgtgcctaggcgggaggcgcatcccatgggccgtgccggcccggcacgaagtgccgatcgggccgtgccggcccgatggctggtgggccgtgcctggctgtgcttgggcgcaggccgtgccgggcgggccttttggccatctatacacactatttctagctttattttatgcgctgatgaataaggtttttctcctgcttgcagaatttgatgttggcctaatcactgttgatatgtccataaatgttacttatccaaacctgaaacctcacctccatgagctggctgagcttatagctaaagagctggacattgactcccgtcaggtaagggtgacccatagtctgtgctgttgtggtttttctagttttgtttggaggtgatgcgtgagggacactatccttgctattgtttacagctttgcaccatcctatcttgatagcactagcattcttttgaagtgatttgttaaagttgcctcttgagtttgacaggttcgagttatgaatgttacaagccaaggaaactctactctaatcagatgggggatttttccagctggaccttctaattctatgactaatacaacagcaatggtagcatccactcttgcacatatgaggactactttaatctatctgttataaagataattgatttgctgcattgatgtatgattagggtatcatttatcggttgacccaacatcacgtccagttgcctgaaaatcttggcagttatcagttacttgaatggaatgtgcagcctttatccaagaggtaagcaaacaccattataactgccaagattatattgccattaaaagcttgtacagtccatattatcataataagctctgtctttatcattggaattcaactctttcttttcattgaagccctgctttcatcctgatctaaaatgacaaggcaacatcccttcgacatcctttttgcagggaaaaagtagatacatgtcactctacactagcctgtttagagatataccattataaactataaagttctctctcccaaacactattcttatactgatcagtggctttagcgtgtagttgtagtatgcaatggggctgcctggcaaacatggaaaacctgaatatctgtcaaagtgcttaagcaagattctcacatctattaggaaaaatcattttcaccaattcccttgaatatttcttgtgcggcatcgatgcat

SEQ ID NO: 54420 - DNA, 10403 bp, Oryza sativa
  unsure (1)..(10403): unsure at all n locations
ctgcagcccatactgcttggaattttgctagttgttttgctgactttatcggcccttttagtactgattgtctggagaaagaaatttagaggtcaagcggcatatagacctgtggattcagcagttcctgagcaagagctccaaccgctataatttggagtggttcaacggagtaaacatataggcgattctttggtagaaataccgttgtgcgggctgccatgttgcagcgggttcacatccgctgctgggagttgccctttttctttgtatgtaacacaagctacaagcttacagaagaagcacaagattacataacttctcgattcagcacttagagcctctgttcataaactgtctagcgattcagatcaagagcttcctcttgtagcttacagtagaagaaggttttgttcgtgtaatgtagattaagtagaatagagcaaggcacaaaagcacagcagccatggacggaatgttgtattatctagtatctgataagtgctgaggatattcggcttctacagtgttttcacgtttcatttccatgctccttggtaaaaacgtgttctaacttttgttctagctcataactggcaaagagcttttgctttatacccatagaatgcagaaattattattgatctgttgctggaggcatttgcagcccaacatctctggctcgtcaacgtggaacccgcatgtccatcggcttcccgaccgtgaacccgccgtcgatgacgtggttctgcccggtgacgaacttggcctcgtcggacgccaggtagacggccgccctcgccacgtcctccagctccagcaccgcgccatggagctcgctcatccccctctccaccatctccttcagctgctcgtcgctgacccccgggttcatcctcgccagcgaccggaccagcagcggcgtcgcgatggcgtgcggcgagatggcgttcacgcgcacgccggagcgcgccagctcggccgccgccagccgcaccacgcccaccaccgccgccttcgagaggctgtacggcagcgccgcgagcccgccgagcatgcccgtggtgctccccgtgcagaggacgcagccgccgcgccggggcaccatgacgcgcgcggcgtgcttgacggccgccaccgcggaccgcgcgttggccgccatgacgcggtcgaagtccgcgaggtcgagcgacgcgagcggcgcgggcgccgaggagcccgagatgccggcgttgctgtagaggatgtcgaggcggccgtgccgcgccacggcgaggtccaccgccgcggcgatctgcgcctcgtcggtgacgtcgcagcgggtgtacgcggcgtccgggcccagctcggccgcgacggcgcggccgaggtcgtcctgtatatcggccaggatgaccttggcgccgttgcggatgaactcggcggccgtcgccttgccgatgccgctggccgcgccggtgatcaccgcgaccttgccgggtaacctctggcaactcgaggcagtcgagaagtggctgcccaaaccacacagagctcccatagctccgctcttctccctcctgcattgatccatccacatgaccatacatcgaacaagcagcaagggaaactgatcagcttcttgttctttccaagaaacaatcagattcatcgcacgcaggcatcagaagaacgtgctccgtacaagaaacaatctccatggaagctgaacaaggtagaaaatgatatttgataaaaaacaggagagtagaaaatgatcagaaatgagagacctgacaacgagttgcgttgctctcaacatccttcacccacagtgctcttcagtgttcaccttgagaaaacttcagtttctgtggtgcttgcgaccgagctaggtgatgaaatgcaggttgtagtagatcttggcacggttggatcactactgatggatcttggcatatatcggaacgttttcttgtcgacaaaaaaatgctcgtgaaacacctgtatttgaagtccaaaacggagcctagctgctacacgtcagtacaccattgtcagctttcgtctgaactgatgcggcacgtgtaccccacattctatccgatgagatggtggcacgccacctatggcgcgtcgtcgtctgcgctgcttgaggtgtgatcaaattcatttacacacaaacaaaatcagcttctgccggaacgagtcgtcgaaggtttggatcggagctaatcgttattcttttagaatttcaccttcatatatacctcatgtaagctgttgttcggtgttggaaccttgtggagatattttattggttggtggccgtggttttttctcttctgctttgaagagtttttcacgttaaatcttgtgtcttctgtcatttattgttttttatcgtttgtttgactattattttctaacatcggaaactgcttgctccaaattccaaactgtttgtgtacaatttcaggcagtggttgggttgggcgtcgaattggacagcgtccagattggtccagtttgtggaggtggatctgacgaatggttcccgtgggtggtcaacgcaagttttcgtcgcgagacaaatgatcatttttcaagcaatcagctagcattggttcatctgactagctagtcttaagttccgtaattttcattttaatcgcactaactgcgagcagtactccattgaaccagtagaaacttggatgaagcaagttctccaaaagaaaagcatactcgagcccagggcgaagctagaaggaaatagatggtggtgtcacttgtttaatttactctactttagatcaagtttaagctgatgcggatgcctaagtttgtatttagagggtacatacatgatgaaaatagatgaggtatagctaaaaaattttcttgaccaggtttctgggcacccccctaatatatactagctccgcccctgctcgagccagatgatccaggtctggtttagttcccaactttttctttaaacctccaagttttccatcacatcagaactttaattttctatatacataaacttctaacttttccgttacatcgttccaatctcaataaaactttcaattttagcgtgaactaaacacaccctcattctcaattctgttgcttaaaaaaaataatcaaaagtaacttgtgtgtttagttttcaacgcctaaanaaaatttttggggggggcgatttggtgaattgaacgattaatggaaaaattagaaatttgtgttgtaggaaagttttgatgtgataaaaaagttgaaagtttgaagaaaaaatttggaactaaactcggcctagatatcagagcgatatcagagcatactctggacaaagcacaagacatatcttagacagacattcttgttttattccactaagcactaacacttctcaaagaaccgagatcgatcccaacgctatcaatcacactactaccacggatcggctacacatcgtcacagtgccagccatctctcgttgctcacgggcacttgggccgtcggctcttgggggagaccatgtcgcggtagcaggggcactcgtccttgctggcgtacggccccgacggcacgcagccgccgcagtcgtggcagcacatcttgcacagccccatgcaccgcccggccaccttcagcgagcaccgcttctggcacttggcgtcgcacacgctatccgggaccggaaccacgccgccgccgccgtctgcatccatccgcgaaatgttaacaattttagtactcatctcctgccaagatcgctggagatcagtgtgtgtgtgtgagtgaattggatggcaagtttacctgcagcgacggtgagatcctggaacgaggcggcgaccaggagggtggccaggagagccgtggtggcacgaagaggaggaaccctcatcttctcttgatccttttgagctctaacaaacacggtgaggagatgagtgttcaaagcaactgcagcactgctactacactggtgcagtgaatgggctgcagagagttgagagagatgaatgggtgtgatttatggctggtttcaaggaaggttctagctggctggtgaattcattcatcaatagtttcaattcaattcaattcaatggacacacctgccccagtagcttctttggtgtgtgagcaagtgagtgggggaatctcgcagggggagggacggccatgaatcatgaatgccatggcggacaggtggccttgtcgctatgccgcagtgttcacgcgcatcaccggcttgctttcccttttgtcggcctcgtacatgcatagtataccatgggcggttacttgcttttggatcttgtgcttatcagcgtgtgtgtgcccaatggtctatgcaatggactgtaacacagtaacacactactaatactcacgtgcaatgcacgttttttgacaaaatatatcgcccgagtacataattgcactaaaaattttagaaactacaccttctgaagcacaacctatttacccaaaatttataaaacatatcctcatgtaattggaatttgtaacaataaaaataaccattatcagtacatagttatttttagctaaatcaaaaatgcaaaaaaaaaggtatcaaagcaagatattgacttgtcattctcttaacagtcatcaatataaccactctcaggcatactaccagtatgcggaccaaaaccaaataagtaagatcatatagaccttgaaatggggaaacaaaaatattatatatactttggatttatttatgtggttatacgtcaataatatgtcctaacaaattcagatttgaattaagagcacagtcgtggcttcttgttgtgcatagtagaattcgtggcttcttgttgtgcatagtagaatttaatgggcaaatgtgtaatcagattttagatggataggtagtgagctgtccttgtgagactgagcaacaaaattatcccttgtatatgagccacaactatagaaacttcgaaaagataaattactgagtgctaagaagcctgcacaaacaattaattatgcacaaacaagaaggaattatccatgttttatttggcattgcatgtctgcaccagcataaaactatcactgatccttttcacttgttagtcatgatccagcattccagctgctaaggacttacaattagctgataagagaacgtaacaaagccatactattggatcacacgttcaacacataacccgtgttaaccaaacaaatcaagattggctcacttctatgaaaacattatattaacgtaaattatttcaaccaaaaagaaggaatagaaacaaccagtaatctctttaatgcatagtagacaacatcagatgccatggtgtcctcctgatggatttgcttcgacagcctacacgtttttcatgcattttttgtaacctgaaaagaaaagttagataagtttgctagatatgaaaaagtgatataaattgtgatagttaatctacatgttgactaagtttgctaaacatttcagaatctagaacacaccatgtatatttaaggtaacatagttgattaactatagaacatctacaaatagtgcaattcatgcaatagtgttctatgtaaaaatatatggaacatgatcctgacctcagattgtaagtccagaacctctatgctcttactcattgcaagtgcaagcagctaaccaacatattgccgttttttgctttgagtatcttgtaatgaacgtgtgatacaatgcaattaactgctgcaagttggaagtcatgatccaattttaaagaactgcaattgattgataaaatatgtgacaaacggaatacagaacaaatattgaggtgtaaaaaccaatttgagaagtagaccattagcaatatatggatttgagatctatcagacaaatatgaatgtggtacatgttcttattcagtttattacgactttgcaaatgaagggaaatatggtgtgtattacctgtctttgcatacgattatgatgtagagcatcctccgttgtctattgaagtaggccgaggcaagcagatgattgactcgaatacttctagccacacaagtcaaatagctcccacctgacaatatcggtggattatttggagcaacaaataacatcagttctaaaacctgaaaccaaaataaaaaaattctgctactgctgctaacatgtggcatttagtcaaaataaaaagattagccactaagtgtgattggaattttggtactacaaaatcaaacaatgattctttgacaacttattgcttgtattattaagaacctttgataccatcaattttcaatctgctgcagctcctgctacagtatgcaacaaagtttctccaagccaagagtttcagcctagtagaaatcatacatatatatcaatctgaccaggaaaacacatttttttattactgaaatgatttgccaggttggccaaaggattaggcccaccaaatttattaagatttagggagaaacaaagtacaaagtactatgctgtcgaacaaaggtatgaggcaaagcctcagaccacaataaacaactaacactaataaataatcactgcaggataaaaaatgctagccgacttccaaatcgtgatctccttgatgtctccaaataattgctctgtaggtctagacctctgctcaaataccctagcgttctgtctttccagattaaccaacagatcatcatgaacagaaagaatcgaaattatgcagttcaccatataaacatttggtctttgccatgaagaagaggttgtaagccgatgagaaagtaaactggccatcacctgttagctaccaccgaatggagtcgtggctattcctggttgaagctacaccatctgaatttcatcccacaactgaaagaactcaaccattgctctgttggacaaggaactctacaggtctctcacccatcagtgattcaccaaagcctgtgccagcatcaacttggatctgcctacatatgatagaaattagtgttagtgccattgccacgtgctgcaccgtggttggaaaaattgcttgacctttctattccaagcttggcatgccattttagccatagtgcttggccaaagaagtctaaatccagagttgatctgctatagagtgagcaataattaattgagcaagaaagagcctgcatagaatctactacagagttcatcagtgtatgcaaagaaattaacttctcagaaaactactgattgtggtgaaaggataacaataggattgtatccacttgaactgatagctagatcgaatagtgtaaatcaagccatagtgaaagaaaatgatgtacattcagattcagataatccacatagaggactattgggctgaagaagggaatcggaagactcactttcagctgaagcactctacactctgcactctcacctgcaaaagagaggatggcacacgtccgtgagaaccgagtgcgtggtgtgggcagactatgaaccttacaacggcggcaccactggaggcgcggcagagtgccgttggaaggcaggaccacagggccgtgacgggatggtgatacgagccgaaaggcatattcacgggggagtcgactgtgtgcggcagcggagacaggcttcatgacatacagatccacggcgccggcgagggcagggcgcggtggtgtgtggcggcggtagggaggagcggagcgaggagcgcgcggcggagtcagctccgttgggggcaggccacgatggagtgtgtcagcggcggggaggcgcggagcacgctggagtcagtggagcacgctggagcgtcgtgtagtcatcacgcgggggatggggccgaggtcggctccggtcgcggcggtggacctcagcgccggtgccggcggatggggccgaggtcagaaccggccgcggcggctccggctgcagggaagaagcagcggctctggcggtggggatgcggcggcagtccacacggggaagaatcagaggctccggcggcggcagtccatgcggggaggatatccagcgaggatgcggcggcgcagcggcagaacatccggggaggaggaggagctagcgaggaggaagagaagcgaagtcttcgcgtgtggagcgatgtcttcgcgagtggaggaggagtgaagtattcggcgtggcgtggatggatggatcatgcggtggtgaaatcaagcgcgcagatggacggtagagatcgattcgagtgatttggcctgtaggattggagggggacaactgcttctttttatattagtactagtgatcgtgcacgtgcaatgcacttatgatcaatatttgattgaaccatctacctacattgatgtgtagaatgtttaaaatgttttatgtctagttgcacacagttaatcaatgttttatgtctagttgcacacaatgttttaaaatgtttaaaatgttttattgaatcttgaacaacccaattaatcaactttgtataaataatattgtaactccatagtattacaaataagcaagtgctaactgctaaggatctaacaataagaaacaaaaactctaaatggtcatctcttaattcgtatgatccttgttttcaaccattttttatgaacatgaaaaatcctagaacaatactacatgagcaaccaaaactccatttagtgtccatagttctcacaagctccatttatcctttaaggagtgtatgcctgccattctgtcccaaaggaggcttaccttgctccaaaacagatttggtccaccaaattatagttttcacagcgttcagtgtcactgacttcaaataatagagcttcttctccttaatctctagtgatggacgacaacttgcctctcgatcactactattgttagtggacgctaccaattggacaataggactcccaatatcacttctgtcaagagtaccgatccaaccagtttattgcataaaccaacttcaaataccagaaatataatgaatattttcatgattagtttgatccggcacctcaaaaacttccttcataatctacagttaatttccatagtttagttatgagccttcatgttgtctatatcggggatggagattaaatttaagtcatctacattagaagctatgaaatttgataaaaaaaattaggattcctaaggatgatggtaactaaacttattcaagataaggtggcaactggagatttgattataaaatttatattcttgacgaaagctatatataacttaaaccaggtcacaaaaaatgattctttattagcaaaaaatctactcaataagacattagacatactttggcattccaaaatacttagtagtttcttccagattgctacatttatagctaataaggaagacataattcaatacaaatactgagagtgcacaaagtgaactggagaagtaaaatatcatctggtatgaaaacagagttcacattattccagtgctaaaaaatagttcacgcattgtgtgaaaaccataaggaaaagcatttagcaaagttgacaggaaaaaatgttttccccaaacaaaacagtatcaattggggatttaaatccaaagcgtgatcatttacttcgcttcagttattcactttgtttattaaactaatatgcatgaatcaatttcactctgtttgttaaactaatataaaggagtcaccttgcatattattattccttcaagcctcattactcctcattcctttctgttgactcttctcactgcatatgcacctgatctcccttgcacatgtaaaataaattgaccgagccaagtatcaatagcatgaatccaacaaattcttgctatagagctgtatataccgttttccacggctatggtgcaccatatattcagatggaaactaagatctgaactaaattaaaaaagtgtgaacttgcctgtgaacaaattgtacaggcacaatttaaatactttggaaacagaattgtgcaaaaggaaaaatataataacctctccattatggacacctgctctgcaacgggtaattgtctaaccagacagtaaatgcaaaaattggctgagaacatacaaatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54421 - DNA, 2716 bp, Oryza sativa
  unsure (1)..(2716): unsure at all n locations
tgtgaggtcttgctcttctgcttgttctcctcttgttatcagggcctagatcaatcctactgctgcttgtgcctccatagctactgtccgtttcatggccaactgcatactcatcttttctgatgggcagtagaactttggacttctttcgtgcctctgcagcaactcttgaaacttcctccgcgttaagacgagcgagtgcccatgggctaatttttataccacctgaacccttcttcctccttacttcatcttctttcctcttggaagtagaattatgcgatgaaccagcctctgacggaataacatcgaactgaaaagaagttgagtagcacaagatcagctagtggcaaatgccaaatcgaaaaaaaaaaagccatacagtagtatcttttatgatcatgtatacgactcatgatgaaacataaatatgcatttgttgtaatataggactgcaattttacaaacataagaggaagttccaaagacgacaagtctaatatagactaaaaattagcaaggctagctaaacaatcaaatcacttaacttcaattcgcatcagcacatcgcacagctacaaaggctagcagtaagatttttctgtacagacataccgtcacttcgaaaggtatgcagccatttatcatttatcataagattcttcaaggttgttacctgatcttcaagaaataatcttggaggagtacaccatgaaccacgacgtcgtccaccaaaggaacttgtactgctaagtccagtgtaggagcttacacgagacatctgtggactctgctgcccaccaacctcttcttgttcttgctctcttatggcgatgatgtagtcatatgtactaattccctgtatgaagttgagaacatgatggttagattcaacatcgcatcacctcagaatgcaacaatatgacacacactggaaagttaacatttcattgtggatgtccttttaataaattttttctaattcaatacataaatattttttaagtgttcaaagggtatgactgtatgagaatctggtgtacaagctgctctaaaaaattatcaggaatagcaacgtagtacctaatcaatccgtggcattacataaaacgggaatgggttaggagttaccttcttgattagaagaatgtgaaaaaagagaagttgcgcaattggcagcaaagcaactatggctagaatggtacaagatgcctgtatgaacaaagatcaacattttgagcgttcaagaaaaaatgtgaacagagtcaactggttctccaaaggaaaggtgaaatagctagaatttgaaagtagaacagccaaacgcaccaccacaataacataaggcaccacagagaagctgcttccaagctttgacacaatttgaatggagaattcctttcgctcaacaaagcagaacactagcaccaatactccaactgctgattgtaggataagctggcccaaagtgcacaaatcatgtagacctgtcaatggtcaactaggatgaaaaggaccaggaataaaatgctctatgcggtaaccatgaccaaatttatatgcatgcaaaagactttaagtgtagctgatgctgggactatggtaaacattatagactaatgacaacaagattagagcactatgcagcactcctatccatacaatcttataagagtaattgtagctgattgaacatgagcttaccaagaatagggaagaagtcatcagaataaaaaacctcatatagtttctttttccaatgcaattgttgagccactgttgagattgaggagaaaaggagagttactaaatactcgctaatggatgaataagaaatgatctgtttcaggataaccttaccctgcagtgatgatcaaaaccatcaacacatttgtcacaaactctgcagtgcttactgtacttcaatacctataaaaaattagcagcatattaaagagttgagttgacagaagaaaagcataactcaagtactcaacagctagaaatacaagaagcatacctcaacttcacagaggctgcagaaaaacattccttcctcactggcttgctgctcagaccattcccgtggttggcagcaggaaaaaacaagatagagagggtagaaaataatgagaaaaacagaggaagttgaactgcagcaagatgggttattgtctttgtagcgagttgttgacttttcactagcagctgcaaactcatgttcttgcttttctccagttccctctacttgcaaccctgaatctgaaatgccatgtctgaattccttcggatgcttgtgtttgccgcttccatacaatcttaggtacttctttgatttcaagacacctgggtcagctgggtctgttgcagcacaccagatgtacatgaagaagacaaatgaaacctgaaaggagccaaaatacacatttctatcataaaggtgttaagtaaatgcatacattgaccataatggaataaagtaaattcatgcagggttttgcacttttgctaagtgtcattattttcttttaaaagggcatacgtgctcaagctcgccatttggccacaacagagtgcctgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54422 - DNA, 2100 bp, Oryza sativa
ttatcaactatagttgtggtaaagaagagtaaaatgtcacaaaatgaacaaggtaaactacgaaaccaaagtcagctaatccatcagcgtcgctggggaatttgaatgacgcatgcaagaattgagtccaccagtctagagtaaccgacataaacaacactttggatgtattcatagtttaataaattatctacgaactatatacataacatacatattgaacccttaaggtcagtttgtctagtaggaggttttgctgtctaaccgtgtaaacatcaggcctatgcgatgcagctaaactattatcaagctacaagtgatgatcctccagacttaaaagtgtacactgttctgtaactacatgacacatttggtacgacaatgcaacgaaacctcttctgcagtgaaaaaataatcacggggtcctgataattttaattgcttcccctccacttctcatgtcactcattaaagcaatttgatgcagaagttgggcaatcctctgcaaaaggcaaaacaaggatctaatgagagaacatcaatgcataaactgtcttgtgaatatttactgttgctcaatgcacgcctgaacataatactacgtagcttacatgacacaagactaacatctatatatatgagtacaaagatatactacttttctccaatttagacaagattttttgtgttttgaacataatttccccatgtaaaaacattgcctcataagacgatgactaaaaaattgttgagaactaatgcatattgtaataattagaaatgcaaaacactaaagggcaaagacaaattagagcaagaaactatccaatttatatttttagaattcaagtacaatgtgcagcatccaatttctttcactcaacctaatgcatgaaaagtataacaaattgatggattttcaattcaaggttacttgacaatggtacaccatcagtacttacaataacaagaagtagccaaattaacattctccaacttcaagtaacagtatcagtatgtgaaaagaacatcaagaggatacaacatgttatggcgaaactatcaaaagccactaatttaaagaacatcaagaggaatcggacaagtgaaaagaacatcattgatgggtttcctaacactctaatggtgaaactatcaaaagacactgctggtactactgttacagcatgacagcagtaaaacaaaacatttccataatatctcaaatcttctctatgatcaccacaaagagttataactcattcactgaactgtatactgaaattccagtgatacatgtaactaaacagaatagcaagtagcaactgtacaaatgttgccaattactgatcgtattccctaaaaagttgaaaccttaactataggaaaaccaaatatttaaccctgttctcattctgtatgttccgaatcaacctctgcgatgatagaacatgatactcgcttactgaaccgtatacccaaattccagtgatacaacatgtaactgtacaaattttgccaattacagatcgtattccctaaaaaatgatcatcttaacttcagaaaaaaaaatcaattcttgatgaccacagtaacaagctcgaattatcacatcgttgtttaacttctaaagttccgatagatattgcgcacggatcatacttggaagatgtagttgaatatctacaagacatctaaaacccacatgttcctcgcctcatcacccaattctctagcgtaattgttcatgataccagaataccgacgatgaaattaaaccagaaaacctatagaattatatagagattcaaaccttatccttctcctgcgagagcagcacgagcaggtccctctccctcctgtcccgccggcgcgcgtagagcagcgctcccaccacaacggccgcgcccgccgccgaccacacggcgggcctcaccgcggggcacccgcacgtcccgtgcaccatcagcccctcccgcacggccccgaccccggccgcccacgctcgcctcgcaaccgcgcggcacctcccccacccccacagccactccccatcacccaattcatcatcatcatcacatcatcctcctcgccgtcgt

SEQ ID NO: 54423 - DNA, 1300 bp, Oryza sativa
aacgccttattcagggatttgattcttacatgtttttaatttactttccatagaattcatcgcagctgcaagaacttctggagtacagtaaatcagtaccacctaatccagtatttctaccttgtgcatttgtgagcaaggatccagtttccctggctaaggtattcttccattagatgaactataagaatagagttttttttttaactgcagttaacatttagaaaacactagaaaacacgcgtggctttgccatgcgcgagtgaatatattacatgaaagattggttccccattgaacattgacaccaatacttaatattcacgttagtgcacatcatattacaaataatctgaatatgtgcttaaaagaaaggtacaggagagaattatcacactgaaatggattctaaaactcctaccatacataaaactgaattatgctgccttcagatagactcatacattgctaaagatcagcttaactaatgtcgctatattatcattttgaagcttggaaaacatatctcagattcatcctaatagttgataatacatgcacaagcctcctccggtcctcctgctatcaccctgaatcattacaaatgcgcacggaactgttttaacagctctatgaaccaataacgaactaagcaggtgttctgtaaacaaatgaaagcagaaaatatgcatatataccagctactacccctatccaaaaatgtagctatttctagcacagtaacttatcctaaaatgaagctatttctctacctacactctcctctcaaccaatcacaactatagagttctcttcatgcagagcaagatcacgccatggaaggtcacatcatgaccaaggcgagttattcttctttcttgctgctataacccatccaggcagtctcggcgttttctgattcaagctacttgttgtttttttgttcttggcagaccaaatttgtgttcgcatctactttcgtcacttccaccctcggctactccgtcgccatcgcctacagcctcagcgggcgtgcagcgaagatgtcgctgatcaggccaaggcctgaccacgtcgccggcaccccaaccaacttccacggtcccgaccgctgggagaccggagatgaccccgactacgcatccacctggcttcagttcacccccgtcatcttctttcacatcgcgatcattggccatctctgcctcaagcgtccccgtgatgtgtttcaacttaccaaagtggcctcttgcttcgttccgaccgggttcgctctatgcaccctttcctacttcttgca

SEQ ID NO: 54424 - DNA, 8298 bp, Oryza sativa
  unsure (1)..(8298): unsure at all n locations
taccggtgctcggcctgcttgatcaccttctcggcgacatcgggcatcttgcagacggagcagacgacgtcggtgatgaaggtcagcgtgtgggggtgttaagaattggttgggctgtaaatgggctgggttgctatgtttccaatcagggcccaagtcagctcatgatgcatcacatatcaacagcagagcacgtgaggactatcgaacagaacagaacaggcaacggcggcggctggcctcaaggcagctggacgaacggcggccgtgacctagcagcactctaaagagacatacacttgtactacggaagagggagatattatgcgcaggaaggcgaaatggctaccgggcgaacgttcgccaacttataatctcgcgaatcactcggaaaggaggattagaggacgtgtgatggagcgatatccgttcttcctttctaattttccttttatttacccgattttccgggtaatatttccttctttttagatttccttttttttccctagtcctttctatagttttattaacggaaacttttctatatcaattattcacgtggaaactttccacatataaactttacgtatataaaagttcaatatatagactttttatataaaaaaatctttatatggagttaaaactttatatataaaagatttatatctagaaagttcatatatataaaatctatatgtagaaagttttcacggaaataattttttaaacaattctgcatatgaactttatatagaatttatatatgcaactagaaagtttggtttataaatttcaatgaaaataaaaaaaaaatatgttaatcaacgctggatatttttggaaaaaaacagaaccttattatcaaagcaaacctcgtaaccgaaaaaggagaaagtacgtgtagatttggttttttaacagaagatcaacgctaatcatgattaggggcgtaattagacgtattaggcatggagaacgatggaaacttatcggttcgtgagattgtcttgtcgcgaacattcgtgggctagacccacccgcaggaaggcggaggaaaacaagaaagaaattgctagactcgtagctcttgaggggcttgagcttatatacagatgaaagtgagaagaaaaagttctcaagtaaaatgtatgcaacattcttttagagattccatccacttttttcccggcatatacttcaacgtttcaccgaagttccatataattaagaagattaacagcacgaaacgtagcaggcaaaaacagagaattgagttaattaattaactaaccccaaccaaacaacagagagaatagtagatcctggatcactgctaaaaatgtatccagataaggtgcaacagcattttatcttgttgcagtcaattcacaccagaatcgatcgaagcaaattagaggcaatcccatactggcaacccaacaaaatctcatgaacagtaaaaactcggtcgagcaaagagaaatatttgcaaaaccgaatctcttggattggaatactagatatcttaaaggtgctagattaaccggcctcccagcgatttggctactgttgaccaaccgccttgcgacacgttgctgttggctgggcgtcttgcgggccgtccgattctgcgtctgggcttcatccatccgtccgtgcctccctgttggtcgtccttgccgaggcgtcgatttggtggccgctgagcctcccacgtcgcccattcctcctctctcgccgtctcgcgcaatcgcactcgcacacacgcgccgcctgaattaaatttaaaaatatactgttcattcaatttttttcccataaatatccgggatacaaaactttttgtgtaaatataccgtcgatctcgcacaaccgttgcgtgaaaccgaggtgggtgtgacgccatgggcggtatctcgcggcgaaggcacgagagcgcgcggtttcgcgcaatggaagagcgagaccggggggnctttttgaancagacagcgaaactgtccaccggctccatcaattagtgcttaattacttaattagcaattaactaataataattatcaactaattatcctaattaataattaattaattgctatcaagataattagtccctaattgaatcagcatggcaccggtctcgctcagtgcttgcgcgagaccgttctgtctcgctgtaccattttccgcgagaccgcgcggtctcgcgccttcgtcacgcgataccgtccacgacgttattccccgtcattctcgcgcaacggttgtgcgagatcgacgctatatttacgcaaaaaattttacatcctaaatatttataagaaaaaattgaataaacagtatattttcaaatttaattccgcgccgcctcacctcctccctcgcgcgcaccgcctcgcccttctcctctcctcgcatgtgccgtcatcgccgccgtcgccgcagctccacgctcttctagccatcttcgctgcgctggaagatccagccacccggacaagagtggtgctggccgtcgcttccctcttcccccctttcatctccaatcgcccaccgcttccctctccttcacgctctccactccgcttggtgcccgatctggttcgagggcggctggagctgatggtctaggcctccccaccggtggatctggctgcccttgcttcgggctccggcatcggggatggtgctcgtgctccctcgacttctccgtgcacccctaaccctatcctctgcacaatgcggtggcggcgggagggcgggtgaggcgcatgtcaaatccaccaccggtgctcccctctttattctctttccctctgtggcggcggtgacgggggacctacgggggcagcggaacccgtcgcgcatccgccgccgatgcccctccccttagggcggcgtcggaccggccgccggcgcgggactgtcgtctgccctcccctgcctcgcgcgagtccatggacatcgcatagccacgggagccaagggcgatacatccaaagaacagctggtatgccaggtacgtgcatcactgcgtctcctctggttcgagggctgtctaagctgatggtctaggcctccccaccggtggatttggctacccttgctccgggctctggcgccggggatggtgctcgtgctccctctcgacttgtccgtacaccctttaccctatcctctgcacgatgcggtggcggcgggagggcggagagaagcagctatgccgcattagctcttcgctggtttcagaaactcaacttgttccaggtatagttccaggtgctccgtgctcgtcaggactgaaagagattatagatcttatttggtgattcgcaggtatgataggctttctcccacttttgttttcctgtcatgacatagaattagtgaagagaaaaataatgcatggcggataaatgattgcaacttgcaaggcagcatgctgaacatgcacagctcagctctctcttgcctaggaaattcttggactaggagatgtgtttacggtgcagttggcacatgcgttcagttgtcaacgcacctaaactcttcacctttcgtctggatcaaatgaaggattgaaaatatgtgactcttcctatcttaattccatcggttggctagctccttctagccaacatatttttaaaaaaaaaaaattcttggactggcgttcccagccttgagtacactgaatcgcatagaaagtactcatctcatattttcatgtcatgtagcatcaaatcctctctatgactttatggatctacggtttttgtttaggtttcctgttggtacttaattagagttgtttcttgcatattttacttcagattcagtcaagatttgaagagatcttatgtgataattaacaggtctgatgaccttgctcccagttttgtttttgtgtaatccgtttactgaaaagtaatgcatggtggatgaattgttgcaagaaagcatgctaaatacgcactgtactgtgcagaagttctgcagtgcaggacattcctgccgctagtcgtgccttggacagccagagctctcgaattctcagccttaagtacattggatcacatacaaggtactcacctcatgccatgtatcatcaatcctctttatggacctggagttaggtgcaccttatcagcttaagctctcaaggttggcctgctcctcatcagctttctatcttctatatatgctgtgcatgttaatttcgatggtttgtctcgtgcaggtctggcttcttggagtccatatgggcctcgtgccattctctctttgcactgaggtctgctgagcgcctggatgcttatagcatactctctctctctctctctacttgtcaacactgaaatatgttttctcgggacctgacgagccccaagactatgatcttacgaattccaatgaattttgggatgaaattcgcaggggactggtgggcctttctgccccgactcaagtttctgttagccttttactctttatactcatcctgttgattgtgctgacatgcttagcctcttcacaccaggttgacaaggattctttagtgaggaagcaggctttgtacatcttgagaatatcacttgacatctttccctcatctgagaatgatgccgctcagcaatgctccaggaggaggtccgccgctctgcctgctcaagacaaaccaaatactgcaatgacaaagagagaggtgggctcagaaagaggctagatcccttggcatcagagaaacgagccaatcagatgaaaactgctcaagtcgtaagaccggtcgaaagttttcctgttactctatgagatgcttcaggagtatggaacacatttagttgaggcggcttagacgcaccaggtcagttggttcctatgtgcttttttttaagacctgtatatctgtatatctaagtgtcaacgcaatatataccaggaacagcattcatagcacgcaatgaagtaaccacatgcacgttcgattagatgggttgataaatttaactattattcccaggtaatgctgctttttgagtccaaaccgataaatgactgaataatcctatttgttgatgttagccattctcagctcatatgttgtgttatcctactttattactctctccgtcccataatataagggattttgagattttgtttgtattgtttgaccactcgtcttattcaaaaattttgtgcaaatataaaaaaggaaaaattgtgcttaaagtactttggataataaagtaagtcataaaaaaaataataattccaaaattttttgaataagacgagtggtcaaacagtgaaagcaaaaactcgaaatcccttatattatgggacggtgggagtagtacattatttgttcccttttggttcatgcgttttgccttgggtttgatctttagctaccccagcttgcttgggactaaaggcttatgcaaatttttgtccgtgattattacctcctatcaagttttatccttgggcaggcgtttcactatttatgtttgcctcttctgaaacattgaatttgaagttgaaattctaaaggatgctagactgccacatcaaaaatttacaattttcgtctattttnnccccccttggntngcccccaaacccaaaaaagttgatcatgagtgcgctacaaagggtgattatacttgatttgttaccttgttcaatacacctgagttgctcttacttctttgaaaaggaaaaagtgagatactaagaagaaacttagcatcatgagattcttattcttgtttgcaccgttctcttctaagttctaattcttttatactactcctaggagttacattgaacttctcatccttaccctgctctagggtttgatgtgtgctcacatagtatacttatagtgatttatatgtatcattgctaaacaatacccatatgatggtgtaattcaaaggtttgatataaatcttggttgcccactaaataactaatatgatttctttataaaacattaacaaatcacaactgccttggtcttatgttattctagagcacaaacactttttttagggtttagtatgtcacaggagcatggcaaaacgatggtgatgcgtaccaataatcattcctgttcttacaaatttccatatattcttcttttatattcattctatttggtttgatgttctgactgttcgattaagactgctttgtaaagaaattattatgtgagttatattttccaacgtaggtacagccctttcatgtttgcacgaccaagcagccattcatgctactgtgcttcttttgtggattgaaataggataagaaggatatgactacacagctagtggtaaaccatctaccactccatctatgagagacattatccacctatacttcaaatacaattttctcttaaactattcatccgatctacgatccgattgcaccgttgtgtttgtaacaattaaatctttataacaagatctcacatgattatattctgatgaaaaattataaattactttttaatatatctaaattacttttagatttcactaaattacttcttagacatgtaaaagtaaattcaatgaagtctaaagtagtaacttataacaaaaagaaagtaactttaatgaatgttttttttaattggatgtgactacacggtagtggtagctagtttgtactccatctagtatctcctttcaacttgaaaaatataatagtatcttcttttctcattctacatgaaaaacaaaaacaaaaggaaaaaacaatcgatgattaaacagatttatagagagttacttttgaaccatgcaaaagttacttccaattaacattgaagttacttttaaaaattgttaaacttatgtgtgttgatctgtgctgattaaatttaatttctagataaagtcatatttttatacgaatgtacttataatgtcgtgacaaaattacttccgttttattttaagttacttttataatatatgtaaattacttttagagactattaaatttacatttatatgtctaagaagtaatttagtcaactctataagtaacttatatatatatatatgataaaagtaaattacatatataataaaagtaatttacaaatataaacattttttcatcgtaatataatcatgtaagatcttgttgtgaagatttaattgtaacgaacacaatggtgtaatcggattgtaaatcgaataagtaatttgagagaaaactttgtttgaagaggaaaaagacgtacacgtatattaaaaaagcatgcatgtagtaccatgttgtttgaagatgaaaatgacgtacatgtatattaaaaaagcatgcatgtagtaccatgtagtagctggacttctccacatttctccgtatttaggcgtcgctagttaaggtaaaatcgagaggcctctccaaatagattttacgggataagaagcttgcacatggacttatagtggggtcagtactgtatgaatgggttcttactacaattattttcccccctctgtgtcttattttatgtatattggtgctctatgaaataatataatgtaccatgtaatcgataaatcatcattgacatatcaaagtgcatctatgtatgcgctatatttctctaatctttcctgtaatatttattgttctctctaatgttttttttttgccacgcagcgtagcgcgcgaacccattctagtatagtaatcccacctaggatccaacatggctacgatggagtgggcagagtaatcgagagagagggcaagcatagtattagcagtaatctgtaagaagattaattagcacaccaaggaaagacacaggaacaattaatagtacgagtagtagcaaaatattcgcttgcatcaaacgatccagtagttcaacgattgaaaaggatacaccggtgcatagatgcacgaacgcaaggtacgcaacgccagccgattcgatctgaacctactagagaacctacacctgaagatgccaggatcgacatgctgttccctcatcactccagagttacatggataataaagctagaacactaaaatactgatagacgatagacacctatgtctgatgataactaaggacccgaaagttagctaggaaactactgaagaaccactagaactggacgatacatggtaggccctccgcaccgcacgtcacctcttgacgctttgtccaaccacagaacctcgagctcctcttcttggcggcaacgcgcggacgtagagacgacctactactcggaggcagtcaagcca

SEQ ID NO: 54425 - DNA, 1859 bp, Oryza sativa
tctgagaaaagaaacatatagtatataacatgtgagattcagacgatcgagaaaaaaaccaatctcagaagacacgtaaccgaacttattaccagcatcattgagagattgatcccgacaaagatgacccccgcgatgcagaaggttatccactcgctcctccatatgccataactgattttcgaaacatacaacaaaaattgatgagtatgagataaacaggaagtaaatagctaggaacgagaacaaaaggttggtaccgcgttgtgtgcatggactggacaaagtatacaaaggtggacgccaggaggcaagcaggcatgaaccaacgaaagagaatcgtcagccttggaaaaccgccgactcccctcaccatcgtaagatgaagaacaagcacaaggtgaaccatgcccaccgtcacgaatgagaggcacatgaagctgacccccatgaacgtggcgagcccagctggagatgggggtggagccccatatccatgtggggtagccgtccggccgctaaggctgttcccgatgagaagcgagtacatcataagcgccacgaggaagatcggattcaggagggtcttttcctaaaatggaaaaaagaaacaagaaacaaccattatcagggaacgaagaaataagggcaaaacgaaaatcaacaagacaaaagatgatagatcgattgatccaataaaacgaaccatcagcatcacccttgcaccccggttctcgtctaaatcatgaaaagaaaataagaattagttagtaacaggagaaacttgttaaagaatgaaacctagattagtcccacgagcgaaaatacagaggaaaccaacaagaaagatatagaagacgacgaggcgatgaacacgccactgggatgaggtgaagagaaacaaaaagtgaaagagaaaaacgcgaccggatcaacagagttacaaggaacagtttccgaggaaaccaacaagaaagatatagaagatgcatgatgaggcgatgaacacgccactgccatgaggtgaaaagaaataaaaagtgaaagagaaaaacgcgaccggatcaaaagagtaacaagaaacagtttccgcgcgcgaagagaaatgaaaaaaaaagagagaaaaaaaaacacgagagaaagatcagagaagcgatcaagaacacgagaaacgtggcacatgtaaccacagcgcgagcaaagcaggtgcatctagctctacccggaggagagacatgcataccgagattgatctcgggatgctgctgctgctgcggaagatccatggctcggccgggcagacgagtggtgtggctagaggtaagcaatggcgagataggtagtattttagataggatgagggaatattatataggctccccagtgtctctagctttggttttaagcgttgctgatcgtccgattgggaaacgatacaatctaagggtggtgggtgagtgagttattccactttgtctatttgtgccacaagagaaaagcagaattcaaaccgtttcaaacgctggaaagtgggttagccaggcttgctgcctccagtccaacgggtcggcccgtggcccaagcccacgtaagcagtcctctacagtgaaagatgaaaagaatatcgccttttttcctttgggaccgcctattcatcactcgggtgatttttgagaaaaaatcacccagatttttttcttctcttggatttgcatccaacggactacaaaataaaataactaatacaaatttacttacacaatatttttatcaaaattacagtgcacttacatgtcatatcaactaaatttacatatgtaattttagttatataggactgtaattttatatttgaaata

SEQ ID NO: 54426 - DNA, 3765 bp, Oryza sativa
  unsure (1)..(3765): unsure at all n locations
caaatgcatcgcgtgctgcggcggtgcgggtgctggccacggacccggatccaagcggcgtggcgtgtgtgcgatgtgatgtgaacggggaacgagtgcgggcgtggtcgtgtggggcagtgagtggaccgggattggagttagcaatcagggttaggcatgatgatgggctgctgggctgttcgtgggcttctatgccttgtgcaaagatcatgtggcaaaaaaacgtcaaatgtacgtcaaatgtggaaaaaaatcacgcgggagatgtttagcaaaatcgttttcgttttatttaaaaaaactttatcagccggcccataatgacgaatatagagcacttaatgttctccaataaaaaaacaactaaaacagtactattggtagtactaattattgtgcatatactaagtagtagtaaaaataaaaatttctctatgagggaggaaggaaagaagcgatttttgtggtgggtgagaaacgccgagagagatgcttggtcaaggaggacgctctacctgcaacagtggtaaggctgcaaaagaatgagagacgtttggctgcccactagggaccactaccatatggagacaattaggagtacgagtcgcatactcgtataggaccactgctaagggtggatgtcgagctggctcggctcggtctggctcgttagaataacgagctagctcggctcggctcgttatcttaatgagctagaaaactagctcggctcggctcgtcaacaagctcgagccagctcgttaagctcgcgagctagggcaagagacgtagccggcgagcacggggaggaggggaggagcttaacggcggaggaaatgagctctagctcgccggcgaccataggaaggagctcaacagtggaggggatgaactctacgcagctccgccagcacttggaggggacgagctcgagctcgccggcagcgtcgggtgctgggggcgggcgccagcggcagtgggcgctggatcgctgggggagaggcggagatcggcagcggtgggcgctcgatctcccggcggcggcgggcgtggggggattggcggagaccggtggcggcgggcgcccgatctaacatcggcgggcactggcgggggagaggaggagaccgtcggcgacgggagctggcgggggagaggaggagaccggcagcggcgggagctggcgggggagaggcagataccggcggcgacgggcgctcgatctcccggcggcggcggtggctgggggagagtggggaattgagtgaggactagggtttgcagtgtcttgggcttgggcctttttgttgtattgggcttttgggctgtgatggagtcctagctcattaaggctcacgagctagctcgagctggctcgttattctgacaagctaaaatgtcagctcggcttcggttagaanaattcaaacgagccgagcnncgagccgagccccacagcagagnctaacgagtcacgagctttctatctacccctaaccactaccactactctagacgccaacacataaaagcattttagcatgtcgagtccggcgcggcacggctgtggtgcaccgtgggaggggacgacgacgtgccagcgttacgatgttgggcgaccctgtcgatgttggagtatgttagtgatgttggagtacgtttgtgtcgcgccgcgcgggtgcatgggtgatcgatcctcctgccgccacgtggaagatgttagagtttgtgtcgaatatgtgtacgtagtcggttacagtttaggacttggagttgtactaggtataggactagagtaagagtcggactctgtcctacgatctctcataaatagaggggcgtgcctgttgtaaccgcatgacgacttagcatagcgagagggagcagctgccggcggcgaccggccgtgagtcgttgtaactctgatacgctgtatatgctgaatcggggaggagcgcccgtaatcagtgccccggagatgtaggcctcggctgaactccgttatcaaatatcgtgcctcggtgtcgtcatcgtgtttggatctcctatggcgttttcttccgcgtttggtttccaatgtgatttcggggccagttttataacaagtggtatcaaagcctgcgggagatccatggtagaggtacgagagaggtgctccacgctgcgacgaatacacagggtgtccagggacagacatggacgcaaagtggagcacggcggcgatcaacggaattttgatcagtggaatcggacacttcaggcggcggtctaaaccgttcgatggctacttcaatagggagatgaccagacgtggtgctcgggttggtggcggcggaagcgattggcgaatcaatcggtgggtcagacacttcgggcaggtggctcgaactttctggtgagctactctcgacagggagacgtgcggccgcacgctcgggttgattgaagctggaggcgatcggcgttctcgatcggtggaatcgaacactctgggccgggtgtcccgggtctttcgatgagttgcgttcgacagggagacggctagacgtagcgctcgggtcgttcggcggctgggaagacggcatgtgatttgtcggcttcggctcgcgactatattgacaggtggtcaatcggaggtcggagcgggttgcgggctcgaggtggagccgcaacggtggcgcatgccacgcgtggatgctagaggctgttttggatgtgtcttcgacaaggtgtgcaacagaattgcttcgagggcggcgtacgtgcggatcgggctgaggacgaccagatcggcaaattgggctgactgtatcgtggaaatgtcagttcaaccgagaggctttgcacaatcgtatgcattggttacaaactgatggcatgcgtcattagcggagttggccggaagtgcagaagcgaaggtgcagaagccgtgagatacgttaaggcttggaagtccatgtcgcgatggtgtgcgtgcaccgcacgttgagaccaggctagcggcattgatagaagcaacgccaagaggaagcaggctcgggaggagtcatggttgcacaggactccaatcaggacggagccacagtgttggagttgaacacggacaggagttgtatcctgttcgttcacggcggcgtttgtggcaagtagtccaggagaggaggcctagttggacacacacgaaagggaaaaggaagagggtttcggtttggacttaaaatcggacaacaaattcccaggactcagcaacaggaattaatccacgggattgcagatattccaatcgaaccaaatcatcaaagcaaaaggagatcggactgggacctcttggcggcagtgatttggggcgacgaacgtcgggtggcaggagcatgacttggtgtagtcgttgtgcaggtgccggcgagttcgatgcgggccggctccggtgaggaggcggcggttaccggctagttcagatcggaggtagcggtgactctgttggaacatgcagcggtgcagctgcttgcaggagaggcgacacggcgttatcggtgagcagagacagcgtggtcgccgtggtgtactcggtggtggcagttggagttttcaccgacaaagaaagcagtgtctgggtcggttttggttgcaacccggtactgttcacggtggtactgttcatggctcgacactgttcatgattcatgttgacagtgtgttccgattggttgaatctgatttgaatagggtaattcaaaaagtcccgggcaacaacgggtgaaa

SEQ ID NO: 54427 - DNA, 1098 bp, Oryza sativa
catagcgagaggtagcggctgccggcggcgaccggccgtgagtcgttgtaactctgatacgctgtatatgctggatcggggaggagcgcccgtaatcagtgccccggagatgtaggcctcggctgaactccgttattaaatatcgtgcctcggtgtcgtcatcgtgtttggatctcctatggtattttcttccgcgtttggtttccaatgtgattttggggccagttttataaccaaacatgattggaggcgagagtgagacgagacgagacacatgattggattcttggccttcctctccggagttactagtcagggttggctcgctgctactcgatctcatcaactatcttttggattcagcttttagaaagtacaagatcaactttaaaagaagaataactttattcccctttgaaaacaaaacacacagaaaccacttgatattctcctcaatactcgtcctagtaataattacaggcactcctatagtcctatgtaggattagtactaagtactccagtagttaacttaaactcgcttactggtagtattaggtgccgacattggatttttttttcacacctggatgttggaatatgttgctatcactctactatgatatggccagttcgtattcattaacgtataattaattaagttttaattattacatattttgaaattgatttatttactattttaaaactatatatatatatatatatatatatatacacacgaaacatactgtttaacactttaaaaatttagctaactaaaaactaagggaaaaataatctgcatctatatgttctttgcgcgcgcgcgctctatctcttgtctgtcctcgtgaatgagaactggtcaattgcaagtttgtcccgtagtagtatatgttgcccagttctgtgcttttgctttcctctcgtactacctccttcccaaaaataagtgcagccgtagatattcgtgcccaacgtttgatcgtccgtcttatttaaaaaatttatgaaaattttgaaaatatttagtcacacataaagtactattcacgttttatcatctaatagcaataaaaatagtaatcataaaaaa

SEQ ID NO: 54428 - DNA, 1961 bp, Oryza sativa
tattgatcttgactgtaccctctggatttgttcgtggttgctcccggaacatcaaaccagtcgcactcaaacaacaagacttctttgtcgttggggaaatcaagggcgatgatttttttaatcactccgtaccagtccatgccttcgccctgaacaacaacaccactgttctgtgtggttaggtttttctctacattggttgtgcggaagagaaatccattgatggagcacctgttagctacatgaactcgatgatctggaccacgagatagagaatatacatcttcatctgtttttccatctgcatgaagaatgttcatctgcactcagaaaaatttcgatcatatgatcagtcacattttcaattagtttgatgaaattaataaaaaaacactcactttatgctcaaaccatgatacaaattgttccttgtgccttttatcaacattacccctgttgggttttttttcaatttctccatatgctcactgcaacaacattgaaaatattagcagaatgatgagttccttagtcactctgcactcataacagacataaatatatcttactttacccatggcatggcctcatcacatttggatattatgtagtgcctcatcctatgcaagtctgaataagatgcagtctcgatatgaaatttgttcttactgtactgcatgctcccaaaaatacttaggccagcaggtggtgcactgacttggctattttcttgacgttctggcctattcacctttgtactaacatctttgaagaaccgagcacagaaagtaaggcactcctccgatatatatccctttgctattgatccttctggacacgctttgttcctcacatagcctttaagggtacataggtacctctcaatgggatacatccatctataacaaacagggcctccaattctagcctccaaagcaatatgaactggtaagtgcatcataatatcaaaaaatgatggagggaatatcatctcaagccgacaaagggtctctccaatcgaattgcatagtttttcaatttcagtcacctcaagctcctttgaacatagttcgttaaaaaacctgctgagctcgattaatgggatcacaacatcttcaggcaaaatatggcgtaccaccaatggtaaaaatttttgtaataaaacatggtagtcatgacttttaagtccactaaccttccaaccattttcatcaacacatctcctgatatttgaggcataaccatctggcatcttgacatgttgtagaaatctgcacagaatttccttttgacttggacttaacgtgtacaaggctgccggcaaagtgtattttcctatatggaccaataaattttgatccttcctaatacccaattcttgcaaatcaagtcgagccttctcactatccttagatttacctgttaaatcaagtaaagtacctagcaagctctcacatatgttcttctcagtatgcatcacatctagattatgccgtataagcaatgattcccagtatggaagataaaaaaaaatactcttcttcctcctgttgtgccatctagtatcttcatctcgttgcttcctcttccttgacgtcatgccaaatttgacttgctcaaaactctcgtactgcttcaatacttcgtcaccattgagtgccactggaggccccctcatttcaaccttgttattgaagctaaccttgttctttcgccacctgtggtatgaagccaaaaagcggcgatggcctatatagagtgcttcttgccgtattttaaccacaagtattcagtatcattgtgcaataaggacacgcaaacttgccttttgtgctccaacctgataacatggcatacacaggaaaaccgtttattgtctagagcagatttgcacgtagcgtaaaattctttttcaccttggcatcccatgtttcaactccttcagtccacaactgtttaag

SEQ ID NO: 54429 - DNA, 13517 bp, Oryza sativa
gcatcgacatcatccaataagattgtttcaagcacaaccaaggaggcagattataaggaattaggatcaccgaccatgtagtgtaagtcacattcaacatcccaaatggattgaagccgtctgatgcaagtccaagcctaacattgcatggatcagatgcaaaccgatccctgaacttttcatctacgtgcttccatgccaatgagtttgctgggtgccgcactttcccatcatcaaccaattcttccttgtgccaacgcatataggtcgatgtggtctcattcatatataatctttgaagtcgaggaataagtggaaaatacctaagtattttacgaggacgaaggcctttttctttgctcctccaatgccactcccttccccgagttctcctgaatctatatttttccacctactctccccacatgtgggacatgtgttcatcttatcatactctccacgaagtaacacacaatcattgacacaagcatgaatcttttggtagtccaacctaagatcttggagtaccttacgaactttatccaaagtatttgggacacaatgtccctcagggagcaaaagacagaataagtgaagtatttgctccatggcattgttgctgatactatacatgcacttaatctgaaatagcctgacaatgaaagataccttggtagcctccttgcaccctgggtataattctttccaagcttcttccattaatctaaaaaaattctttgctaactcattttaattacatagatatatagaaaataaagaatcaacagttttcattgcactcgtgatcgaagaggtacctgaatatatataaatatagggatcgattcggacggcgtcgagatatcgagttgggagatagggacagggtgtggtctcgccagcgtcgagtgcttcagcgtcgccggcgattgtgtaagatataatagggtcgtcggcgccagctagtctatgatcatggttatctatctatcgactactaagggtagggttaatcgtacctgtttttttacacgattcaacccatctagttggccgggtcgacttaattacgtaattcatgaccccgacccgagccacaatgatgtaaacaacttaaagtttaacaatacaaaggcccatgaacaatctgcaggtggcaccaccaatctcacttattgcaacgattcgttaaactatagcaatgacaaaatatttttgcgagagaaccttgttagttgcaacgatttccggtgtttgttgcaatatctaagaatgattgcaatgatttaggtttgcgttgcaatacctatattctaatttgcaacgattcaggtttacgttgcaatacctactgactcatttgcaaaatgtagtttcgtgttgctatatacatgactctaataacaacgctccaaattcgttgcggcatggataactattgcaacgataacaaaaagcgcggcaatattgtcaccctacttacaacgcaaatttattcgttgcgatacttcctacttattgcaacaaaaacaaattacaatcgcaacactacgcaattagtggtaatatgcccccctatcgcaaccaaattagacttcggtagcaataacccctatgtattgcaacgaaaaccacgttgttgcccaaaattttgtggcattagcccgaaaaccttgtagtgagtgtatcacagggtttcaatttactggcatgaatttgtaccatggaagaacaagttgaggaactcctaatagatgatttgcaacagaacagagaattgacagcttgagttgaagaatttatgtccatattgacatcatcctccatctttccttgccttgtttggagttgcacaaaaggaaaagccatccggacaacatttctagttagaattgcactgttgtcaaccttccatgtagccataatcaatggtaggagtaccaaaatatgaagccatctctcatcatcacaaaaacactcatgtttaatcttaccatttgctagtcccaatgtgcagtgtgtttggcattcaattcttgtcactacagaaaaccttgtcttgagaggataactgacaagatcatgtaattgccttgcattgtagttagttggtaccttgccaactgaaatttgcagcgcatgcaaaatgttcccagcacccaacttgaataggctcatcagattaagacagctcagtcactaataatatttcacattcccttgctttaaatttagccaaatttgccttctctaatttacaaatgtgtgtgaattagtcaggaggtgcataatatcattcctattaggtggaggccatggtggtttccaatatactcttttcaaatttctttcaaaaaatatactcttttccaaaagaaattgaatacggaccaaggtacatgccacacctccaccttctagtcactccagctgaccaaggaggtggccatggatttctctcagtatgctctatcagcggcctcttatcactactggggcatttcaacgaacacgtgttgagcattggtgtatccagctttatgtcggtgactgttcttgatgagaaattctccactggctgaacagatgatggaacaaccttagatatacccatcatggtctggaacgcgagcacaacttggttagagtctcccttgatgtcaaggcccaacgtcgaacacttggtgtgcatctctttggaacaactggggtgctaatgttgatggtatcgatggtaccatcagccaatacaaactccctggaggctacagcagtggtggcacacgtaagcaccacatccacgataagatcaggcttgatgtcggagctagaacatagcgttgaacacttggtgggcgtgaccttggggaggtccttggtgacaatgtagggagcttggtccatgtcctttctgtctcctagctcccaggtagctgtcagataaagcacctcaccaatgagacttgaattcgttgccacccaactgatgttgttgttgggtcattccatcaaacagttggtgggcgctggaggaggtggtgccatgggtgttggagatgatgcacccttgatgatagcggtggttgccctgatagctacaatcatttcctcgaaagccttgctcctacgaacctcgatctcctccaacttttgaaatatctgattgatcttttcctcttgcatgcacttggcctccatttattcaaacttctccaatatccaatctagagcatcgtctagccatttttcctctttgttcatggtggaattaatgggaatagggtcagatatcctctgatcttccttggacatctcaggttggctaggcattccatcgaacatgttgtgggcattggtgccatgagcaccacccttgcccaaatctggcaaccacttgcatggggcgttgctgcaatactcccccatcgactccatgctagaaatcccacgaatcgacagctctgataccagattgttagcaacccgaatccctaattcgaatcacaacaatattcactcaactctcagtgtttgatggtggaattgaagaagaagaagaagaagaagaagaagaagaagaagaagaagaagaagaagaagctgctaaggagacaagtactagaagtttctatgatagaggagaagaggaaggatagagagatcgacgaggtttgaccgaaccaagctaccgccaccgttcgtctagccgccgaggccagccgccgccgttgcatgtttcttcgatgtcctcctcatcctctacagctgtatatatattgatgttggccaatcttccttgacattaactaagagtgctttcttgggctgggcttgaagagtggttaaactagctcatatgcacttagctaggcaggcccattgcaggatcccaacacgggagcgtatcctatgcacacaggcctttgcgtgtacacaccgtgtacaccaactaaaaattatcataaaaaaatctaaaaaaattcatacatgtacttctaatagtattacatctatgtgcaaagtcacatcttcaaattcattctacataaagagtaacaaaaaaataaaattctgacaaaattataaccttaaaactgtcagattttttttttcgttatggataaaatataatgaatttgaagttaagattttaaccctaagtataatactattgaaaatacatgtatgaatttttctagattttttagtgacatttgttagttggtgtgcatgtgtgtacatgtgagagcatgtgtgcataggatatattgcctcttaagagcaaggtttataatacaacccgctgccagctccaaaaaaaataaccatgtcatctatagtaagtagtatagctaatatctacaatagaaacactgtaacacaattattttactatcttcgggggacccaccatcttctcttatctcattctcttcttcctcctaccccatccgtccgttcctgtgtttgtcttcccatcgggtgagggagatggagatgggcatacggtcgtacaggagacgctagtggctgtgtagaacgagggcatccatacggcggacacgggagacgtcaacagttgggccgaacgacggcggctgtgaggatacgcctgagaggaacgggacgaagctggtgggctgatgaccctgtagataacgcgggagacaaagacagctaggttgtgcgacggatgcgggatgagagcagtggcggcgacgggatgagagcagcagcaacgtcgatggcggcgggacgagagctacggcaacggcggccgcaggggcgagggccatgaccgaggtggacgcaagtcatggtgacggcgcaacggcagtggccggggtggacaacggacacagctgcggcggttgcaggcgacgagatggctgcggccgcggtggacgagagccacggccgaggatgcaagcaatggcgacggggatggccggggtggaccagagccacaactgcgcggacgtgggtggcgatgatggctgcgactgcggtggacgagagccacgactgaggatgcaagcgacggcacgacggcgagggccacagggggatgagggcgacggtggcaggcggcagccacagggggatgaggatgacgacgcgacgatgccagtcgagccggacgagggcagttggtcgacgtaggcggacgacggcggtggccgcaagtgacggcggcggcgccagaggacgatggtggcggacgcaggcaacgaccgtggtgacgagggcgccgtcccgacggacgcgtgcgaagtgggtatgcaggcccacgacctcgggtcatgcgtagagccgggcgacaaattcgttctctctctccccctactctctcctccactccacgtcaccgaaaaattttaagtggaacccctatcgccagttattatacctgctctaacacaggggtagacgatcgaggttgcggttgaccacttccacaatatttgcgccacggctgtggcccaaagccagaggaggtagaggaggcggacgggtgccgggcggtccttccgaagccctctgacggtattggggcttttaactatttgctacttatagatttgacaattaactatttgccacacctatctcaatgacatgtgggtccatatgtgtctatgacatgtgggttcagtggcaaatagttaattgccacgtctaaaagtggcatatagttcaatatctcacggtattgcgcccgtcgatgtcgtccgcgtggccgtgatgaagagaggagcagccgagcaggacgacactgcggcggcgcgttcacggacacgtgacacgtcttcacgacttcaatccggcgtccgagatgtacgtatgtgtacacagcacacgtaaggcaaccatgctcttttcttgaaacttgacggcatacaatacaaccgtactctatatactgcttctgtatatactacggagtgtatgaatatggttcttttaagtcaaactcaaatggttttttccatctctttactgcctctagattaatctgttactctagcacagtcatccaaccgatctctagctatgctgtaaaatcattgtcatgattaatattattaatattatgtgataaataattggctttgaaaaatgatttattcgatgaattggttttgaaaagatatatagatgttggtgtgagtatatttgactaatgtgggtcaggttgtgatatatgtactcaagaacggttgttttgtctgattgtgtgcaggtgacttgaggttagctttggtcaatgcatggtgaggacagggactatgcttggggaggagtagaggtctagtgtggtcgggataccatgtgagaatgtgactagagttaggattcttggaggtcaaattcggtcaacggtggggatcgggactagactcagggaggagttgagatccagacggtcaaggatgccgggtgacgaagttggatacgagatgacatacggtggatggataccgtgtgggagagatcttcgtaatgggcttcacgaggtgtgcgcggtgttcgcgaaggaaattggttgagaaattggtgaggaggatatggtgctacagtactcgatgtactgtagcgatggtactgtatgtctgtatcatgcagtatgggcatgtgtgcgtagtgtgtctgcatatacgtgtggtattcatgcatgtctgttgatacatgtgtgttggctcggtggatgtggcaagccgagtcggctcaggagcaggtcgtcaggaggatggcctacatgtgcagcggcggcagtagacgaggtgaagcaggctcggctagactgatgtcgtgacaaggtcagatttggtgggaatccgactggttttctgcggcaggtatagatggccatctgggccgcccggcacggcacggcccaagcccggccgtgcctgggccgaggcttgtcgggccggcacggcccgaccgatgcaccgggccgtgccgtgccagcccacgggcggcatacacggcccaggcacggcccaatactagtcgggccgtgccgggccggcccgaaggcacgatgggctattgtgctgcctcacagaaagagtttatatttggtccctcaactctgtgggctgtgtttaaatggctggaaataagtctatttttgatccctcaactctgtgggctgtgtttaaatggctggaaataagtctatttttggtccctcaactctgtgggttgtgtttaaatggctggaaaataagtctattttgtatacctattttcttgggccatgccttatacgattatataagtctattttttgtccctatattttttttatttgatcgggccgtgccgggccggcccaccgtgccgagggtgcagcccaggcacggcccggctgtcgggccgggccggcacgggcacgaccctagtcgggccgagccgtgcttgggccgggccaaaattgcgggcttcgtgccgggccgtgggcctcgggccatatggccatctatagcggcaggtgtggccgcaggttttaggtgatttggtaattgaggttagagtctaagtggaactaggaattatattcctattttgtgtaggatgttgtcggtataaatagagagagaggctatgccttgagggtaagccaagtttgaaagattagagagggtttcatgagaaacttgtaagaggtgttgtggctgcaccttgtgaacaatatacttgaacaataaatatcatatttaatcatcaaggcatagacgatctattccagttttgtaagttttacgtttatgtttggttttggcattagcttgtgattgttcgttttgctacgattttgttcaagttaatctattcaaaatctttctaatactttatagatcagatttggaaagttttggtgattgattcttgttagatttgaatttgtttaagttttaggtttagtttagatttgctaaaattccgagacagctgactttcgaggatgttttctcttaaaccgtttattactttgcaaatccctccggtggaattgttccttggtttgtctagtttattctgtcaagtttgcaattcgatccaacggttggtttaagagaaatcaagtttttacagaagcattatcaggctgtttttagggctaacggtcactgccgagtgacctgcagtcagaccggctaggctcggtcagaacgactctagtaggtcggatagtgtcgaaacatgaattcggcaataataaaagggggtagcgtacgagacctaaagtggatggatgcagagacaaaggatttagacaggttcaggccctctcaatgagaggtaataccctactcctgtttggggatttgaatccgccgggtgtagtatagatctgacgatcaggttgtctcatgccctctagagggcctcctgcccaccttatatagaatggggggcaggattacaagatagaaaccttatccaatacggtatcggtttcctaactctactttacaatcttatcaaaccaggactttaggccgttccgtaatatacaaggaaacgtaatacccaagtcatgatctgttacatatttcatatatataagttatcccctataactagtcggataaccatgccgtgtgggtatggggtacccataatctccacagtagcccctgagaccttcacagtcgaaaatataatcttctctcgaactagattactccaaagccgagtgcttcaatcatcttcgccatggtctcccgggtacttttaccaaatttgaagactgtggagggctgaaaaataaagtcaggtgcatcgaatagatgcacctaataggtgtagcccccgactatgtggttaattgaaccacccaaacatatagtcaaggaataaataatctaaccaaccgagtggttttgataattgtaatcaaccaagtgacttgatatcaacatatagcatatgcggtgtgaatccccgaataatatgatccaagtgatataccgactgcttggcaaaatataatgcgtacaacctaaagttgacaacatttttgaaagttcacatagcaaaacaactataaagaagcttgaatgctgtgaataaagaaatttccaaagtattgggcatacgccatgcgcacactgcttaacagatgtgcttaagtccctaaaagacacatggtttcaccacacccggaaatatatggcatatgtggtgtaaaatccgagtaaataaactcataaaggatttaccaaccgcctggaaaatgaccataatatataatcagcctaagccataatattggtcaataaaaatacacacttacgtggcaaaaagcaatgatattgtatccaatcaattgcttaaaaacccaaacagcaccttgacttatataaaaaagtcagcgggacagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccaagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagcctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaggcgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtatgctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttattgcccaactcgtctaaaccgaaatatttgaagttgttgaagtagaatgtctgttccgaagcaaagatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactgtagcttcttgtcgtcgaatagtcattacttgattgaaggtatgtgttgaagatgtccaagtagaaatcctgaatattggagagccacttgttgtagtaaaataacatggcattgcatgccgagatgtcgaggttcacaaagacgtcgtggttggtgaagtagtaaaacttgcgaagtagcagcaatagagtttgccggtgccgaagataataaatatgaagtcgctctaccatgatgacaaagttgcatcgccgtgatgaagtgaacacgagtcggcggcaacagaagcaaactggtagtgaagacgcagttgtgaagataaaagcaccagtcgacggcggcataacacgagtcggcggcagaaaacgatgatgtccatcagtagtggtagctgtataaaccagacgtagaggcgagggcactagtcaacagcagacgagatgaccggcggtgaagaagataaggctaatcaacactggtagaatcatgtagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcggcggcggatgcggcaagccggtcggtgaagacgtagacgcccaacaacggcggcataaaggccagccgtgcaggcggaaacaccagtcggcggcggcgaagcaagccggtcggtgaagacgtagacgcccaacaacagcggcataaaggccagccgtgcaggcgaaaacaccagtcggcggcggacgaggcggccggtcggtgaagacgtatacgcccaacaacggcggcataataggccaaccgtgcaggcgaaaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagttgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcggaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcagcgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtagtgtgaccaaccgaccgtataggcgaggacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggtaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaaccccta

SEQ ID NO: 54430 - DNA, 4078 bp, Oryza sativa
aatggggggcaggattacaagatagaaaccttatccaatacggtatcggtttcctaactctactttacaatcttatcaaaccaggactttaggccgttccgtaatatacaaggaaacgtaatacccaagtcatgatctgttacatatttcatatatataagttatcccctataactagtcggataaccatgccgtgtgggtatggggtacccataatctccacagatagactggattacgtgtgttccattggtttttaaggttggggtgtgttttgatctattaagattcaattatttgacttccgctgatgtaatctaccattcaacatctctctcatagacttggttacttgtgttcgatccaacatataccacgtgaaacaaccacccaatactatgagcaccaaggcagtgtgccatgtcgtcgtcgacatcgagctccaagacgtagcccgcggcggcactgctgctactactaccaactgctgcgcggtgtgtgtggagccattagagtgggtggcgatcgggccatgcggccaccgctgtgtttgcgcgagatgcattgtccaggtccgcttcgtcagcgaggacaggcgctgtcacgtgtgcagagccccctgtcctctcgtcgtcgtcatcaaggggcactgcatcaacggcgccgatatcctcgctgagctgccatcatcaccgtccatgataactagacagggtagagtggacaacttctggttcaacgtcgacacggcggcctacttcgccgatgagcagcaattcaaggtggcgaggattgcttgcgttaaaaagtccttttataagcccaaggtacgtcctttaaattgttgttgagatagtaattaatgaaagattaatcactaattaatctttgtttagcacttctgctaactaataatatggaaaagttaatcacttcgatttgtggtcttgttatacaaaatatacgataaataaatgaaatttatgaacctttacagtataataaacgccattactgcacatcctttacaaaataaataaaataaattttccgaatctttaatttacaaattacaaatacacaaaggttatctaatttatgcgtggccaaacttcatgacattatttttttttgtctgtttgtaggagtggtggtatttcctactcgtctatgttccttttatgtttgcaggagaagccataggcgcgacgtgtgctggaagaacgagtcatatgtggttgaaagtgataatctatctcgtgtcaacatgtgttgcactgttgtttgctagttatttttggttcatggcacggttttcaagtcaggctgtaaaatcatgagtatactagtacatatacgtgcaatgcacgtttttctctatatattactattaggatgcaaaataatcaccttcaaaaataagtatattcctataaaatcataggagaaaggtatattttaatattttttttcctcaattctgtatgcgtcattcaaattccccagcgacgctgatggtttagctgactttggtttcgtagtttaccttgttcattttgtggcattttactcttctttaccaactatagttgatattggtgtaataaggagcaaattggtatggccaagggaatcattttttagcacggtatggccaaggaactggtcgaggaagattggtttagcattcagaagcctgaacacgtaggaactcaggtctttctgaaactgatacattctgctttccactgatgtcagtatcctattatcctatatacgttgtggtgctgatggattagttgatttttgatttcttagtttaccttgttcattttgtgatatttcactctattgtttctcaattatactattatagttgttctgtgcgacaaaagattcatgcagaaaagatcgaattatttgcgtagaaaaatagaaactcgaaggattctagaacgtcatacagtaaaaaaatgaacggtaagtcagattgattctactgaaagtcatatggtaaaaatatgattctactaaaagtcatttggtaaaaacatgaacagtaaaaatatgaacgtcataaggtaaaaacatgaacgtcatacgtagcaccggaactgaaagcttttgctactcagtaatattcccgtaggatgacctacaaatcaattactagcaatcaaccaatcgtgcaatgagcatagccatatgtacgatgactaccctctctacccattaacaagcaagaaagtctttctagtttctacgaacaactgggcaactggcgagcgtagtaacgaggtctttgaggcagggtactggtagcagagacacaagattcacataccagcagcaccaacgaatcacaagctaaccagaaaaaaccgcatgtatcgctctaagtttctttggaggtgacccggcatcccttggagtgatccagctccagcagcaaagcgacgatcacaccgggactcgtcttcccctgaaccttagtggatcaagcttgcaaaattgtgtaacacaaggcaccaacccaatagagaccaagagacttatgaatctacgacgacaagcagggagtttaagcacatccggtggtgacttatagccgtaccgaagtcacaagagggtggtggaatatccaaccgaaggtggggttcttttgcaggtaaacagcagcagttggccagaagcctctgtgatgaaaattcagaagcacacacagtcagattcggatacagactccaggtgttccatttcacaatgcacatgacctagagacaggtgattattatgatcatgtttcagaatggaaacaccatagagtttactgacctgaagagcttgacgaagccgtatgcctctgccagcatgccaaagaacggccaaccaataaggaccaggaagaagccaattccaaaagcaatcgagccctgtacaatgaggtagatttttcatatcataatggacctctaatagaactgggaactgaaatagcacagtcttcatgatgaatggagtttgcaatggtacagaccttgtgattcttaggcttggtgaagaactgcacggttgacttcggtccaatggtcagtgaaacaccagacacaaacagaatctgcaacatggcatacgcacaccaattagtgatcaggatgaggttacagtgaagcatcaatcaggattcagccattcaggaaagtgaatcttacgtttcctattgcaaggaaccccttgtcaaacagcatgatgatcccaagaaacgagaacagaactccgaacccagataagcccagcccaatctctgttgaaaacaaaagtgatgaaatggttgagctagtgagatgcatacacattgtacaatacgtcaatacctcacagttgcaagaaaaaaatgtaaaaagttaaattaggcaggtaaattgaagaacgtgtattgtattatttagctactattagatggacctcctgttcaaaaacatgacgcgttgcgaatttgatataaaacatatgaaatgataaactgacaatatgctatctcagctatggacgaccatgaccgaaatttcatctagttctgaaaatatcgacacctgaaactttcccaacctgaatagatttcaagttgctaaccggaacttatttgctcagaaatttaacttcggtgtgcagagaggcagtgctaattatttgccatatacaatagtagcacaacaaattgcttctacttaaaaaaaacagtaatggaaaattcaccacagtccacagtaaccaaggacattatgtttgtaaacaaaacttgaagcgaaactccggaaatttggcgaggtttgtctcaccaaacaaacaccgattaccggtgatttgaacccaggagtcacagattcgatcggacatagtttttttttttcagcattttaaactatcaaacacgaccaatcatgctgcaaaaatgacagcatttcgcaaggctatcgacaggggaacagattagcgcatgatcgagcacgcaaagctacaaggagacacgcggcatatgcatcttccaccaaacaactcgtagagaacagcgggaaaa

SEQ ID NO: 54431 - DNA, 7750 bp, Oryza sativa
cgagtgacttgctcgtgaagtttaggaccaggattagagatttcttaggcctgaggcattttgcgattgatcgatgagggcacctggccaatggcttcagtccacgtggaccactttcttttttttttgcttgtttggaggacgacccttttcccacgtgtgcttagctccggcaatggaatctgggtgatggactatcttcgtttatgcttatgcttatcattcaaaatttgaatttttaactttaaatttaaagctgattttaaggtttttttcatcgaagtttatttttcagtctttatttttagatcgctgagaacacatatataaaagttttatttacaaattactttccgtttataaatatgtcgtttcgctaaaataagcgaaacggtggctccgctgaaatctaaagtaacacctgaactgtcacctctaatgattagtaacagcgacagaagagtcgaccaatttggttttcgttcacggtcaccgggagatactccctcccccaaaatactccctaaaaaaatagagctatatattcgtattttatggataaagcagaaaaaatacaatataataactcgggaaataaacagtcacgccaagcgtctacaacacgaacacccaatactaggaataaacaggttgcaacatccaaacgcactattctccatccacgtgaagtactaagtactcttttcgtccccatatataataacctagaataaaattggttaggacatatcctaagttgctatattttgaaatgaagggagtagatggtagttatgtgcctaatacaggcttatttcatttaatccctttatgaggtaataacaagccctttgagagttaccacggaggtaaccactgcagtaagtggaatagctaatgcaaatatgcaattgtcttgttttatcatgagctcacacttgtggaaaaacatggcagaaatgaccggaatgccattcaacacaacataacaactgaagatttcaagtgttatatcttgctcagcacagctgagaacttttagaggccttcaggcatccagatcagcacctttaaatgagcaatgagagattggtgactgaaggacagatgtgaccaaaaatgtgtttttcagagtaatatatatatatatgcactgcataaatctaaaaatagccaaaccaaaagaacgcacacagctatttgagctaccaaacatgtgaagtgagaacaacttcgacatgactgctggcatttttccttttcctttttttctttcttcttttcaaataccatgttcttcatgaatatgacacagcaccaggtaggcaggtagtacaatgaaagaatggaccttcaagtaaatataagcagtgcatgcaaataagatgtagccatcatcagtatttacaggtgctgatactacatactagtcccattgcagcaaacaattctttaagcaatgcaactgcttgaaagtctatcagaatatcatgaaaatggataccctacactcctacagacagggaaaattcataatatcaagtaatttaactcagatcatccaaagtaaatacaagcagaataaataccattgtgctttatggactctagctgaaattcataacagatagtcaggcccacagaattggttccttttccaatctagtaatgcaatctaggtccatgtggtgaaattcattttgctggtggtacgttccacatttcagacagcacaaaaatgggtgaaaagaatagcagagggtaaaaaaaaagagatggcaaactgtagttttcatccaggacaaaccataagcccaaaactgtcttataatttcaaatcctcattatgtaatctaactttgcaaatgagagtaacaatcccctggagagagaaatgtactatgccttcatgtccttgcagtttgatattcttcattgaaatgccacccgctgcatagcttaacatccaatgctcgttgaatcaacttcgataaacacctcttccaatttatgaaggaccacgtaacttgttataagatttcataggcctgtttagatcattaagattgaactaggtagttccctttcttctgctaccagtctacaactacagatccagataccaaaccaaatcatagtaagaagtaagaactggcagagttcaagtacccaggtttaaattaaatgcacaataatactgcatactcctggaactctggaaccactagtattacatttcaactgcattcagctaaataatcagaacatatgagctcatgcaaccatgcacaaacagattcaagaatagccttatacatatcacatatgcgagggcaaacatgcacctatgatatagcttaaacatttgtaacaaggtaccaggttcaagtaacaaacatcaattcatcatctcaagcacacattcctaatacttatataaaggtactagtgatcataagcggaggaaatcatgaataatctccaaggaaatgccaaaatagcagcagttctttggtggatctaagcgcagggccaaaccaaacaccttactcctccgctggagcaggagcagcagcagcctccgactcggacgcggccccctccgcgggcgccgccgctgccggagacggagcggcgcgggacttggcgagctcgaggaggcggcggctgacctccttggagtacgcctgcagcacctcgatcccgtcctcgacggaggccggggcggcggcggcggacgacgactcggtgacggcggcgtaggcctcggcctcgaccgcggcggcggcgcgcccggcctcggcctccgggacggccccgtagcgctgggagaggatgctgggcgcgaccagcgtctgcacgaggcggcgcaccacggcgtcccgcgtgcgctgcgacgggggccagatgctgagcgacgggagcagcgcctccgcggccttggcggctggtgccgcggaagctgcggcggcggcggagcctccctccgcggccgacgcgtgctggctcccctcggcggcggcggcgctgggggcgtctccgccatggctgcgggtaagtgggagatggagaggggagagatctgtggcgtggagaggggagagaccgagagagagaaaagaggctgtgccggtcggagacttggagggtggggttcgatttggttcgcttcgcttctagaagatctccggaaggtgaacgcgcatttcgagatgggcttaagttgggccatggatgggatgggcctggcccaatatgcagaccttacaggaagaaaggaagcccagtatcatgccaggctggacttgggctgatactaccttgaactgtgctactactccctccgtctcatcttaagtctagtttcaaatttccgtgttcaatctttgatcgtccgtcttatttaaatttttttaaaaaacaagttacacataaaatattactcatattttatcatctaataacaataaaaatactagtctaaaaaatctcaaataagatcaaatgttggatatggaaattcacaactgcgcttaaaatcggatggagggagtacacttttcttctctctctcgttttccaatagcattggttttttctttgatcacgtatacttttgtgttgtttccgttggaggcagcccaaaagaattatcggtctatcaagtggagtgtagttcaaaggagacccaaactttgcaataccgtagctccctgatctgccgttttactgttgttcggtttcattaggaaggacacttagttaaccttcatttcaataaggatggctctttgctctcagttcttatcattcggcgatgtaacgggatttaatcccatcaactttgtccttgctttataaaagtttatgtgtttcaaaaaagaaaaagaagataatgcagcattggcaagctgaaaaccccagtgattctcaatgcattatctccactgataatgcaacagtgacataccgtcactctaatcacgtactactactacaagcataataagattcagcaaacaaaacttgtgacaggaccaggcattcatgtgttcctgtctcctctccgctctccagcagcagtggacacaatccaacacgcacaagtgcacaaaacaactcccagcgttagctgcccgatgcaaatggaaagctgagccctcggtgcagcaagcagaggaactgcccgtgctggttgtttggttcggtaaaagttgagaaaaaagaagctgcaggcaatggcagggcaaaatggccatggcagtgcagcagcatgcagggcataggctttggagctcaaggcctttctcttgtggaaagccgtgtcccctgtttcccgggccaattcacctgctcccaattactactaatcatctgtcgctaacctccaattctgcactaactaacccccttctaaaagtaatgacacgccaaaaaggttgcgtcatttgggactcagatgcctcaatttctgaagattaatgtatatgatcagtttgttactagccaatttctgaagcttagcgtgtatatgttctttgtgtttttcagaatgtgacagaaagaagaagcagatgaaatgatgaatcttctgctactgtgtttctttctttctctgcttctgattttttttcaaagatggcactgctactgctaggagtagcatgcagtttgtcttttcgagtcatgcggtgcaaagttgacaaaatggcaaatgattgtgcattagctcctacacctcatcactagggcagaaaagggcttttcacctttgaatttttttgactgttgctctaatcaccattactaatcttcaatgtgccaatgtgagcaccactttgccaagttgttaagcttaaacatcccagtaataaaactctctctctgctgctgctctctaatcagtaaccagtagtacactggtagtagtacttcagttctgatagatagactgatactgctactctgcattagaagattcagacaagtgcagcttctctgatagatacagtaaactctgtccctccatgcaggagatggccagccaaaggctactgctcctcctcgccgtcctgctcctgacattgctcgccgcgacgacggcggtcgtcgggggacacggcggtgacgacgtcgccggcgccgaagaagcgaagccgccggacgacgacggggcggcggcgaagctcgacgtgcgggcgaggaggtggccgcggttcccggcgacggacgggcagctggtccgtggcagcgcgcggcgagtgcccaactcgtcggaccctctccacaaccgctgatgtgattacggcattctctgccgattgccactctgttcttagcgtttcttgcgttagattctccatgttttttgtcataacatcggttatgatgtagatcatggcactatgtttgttcagagaattgaaatgcgtatagaagtacatgattttgatttttttttatctagcttcgattggcacctcgagtgtttgtaatcagaaattaatcaagatttttgcgtgttttgtccgcttttgcattcgattttctttgatgaactgaactgccctgacatggtggagcccacatgtaagtctccatccttcctctatcactgcgtcaaaacgtcgaacaccttgcgcgcgccaccgccaccgcaaccgccgccgcaatgtccgtcaccgccggggtcgccctcgccgtcgccgacgcggtgtgggcggagatcaggtccgcgggccaagcctccgacgagcacctatccatgtgagtaaaaccaagcgcccgccgcctcgctccctcctcttccttgacctcggttgcttcgaaacagcctcgaggccttgttcggcaagaacatggtgcgcgcctgcaagatcctcgacgagggcggcgtccgccgcgtcaccggcgcgcccagcggccgctcgctcttccttgtcagctcccccatctctcgattcctcctgttcttcttcgtgtcacagccaaaagtgagtgagtgaggatttgcctgacctagggttttgcgtctcggcgattcaggtgatgggggagtcgaggaggaaggaggagtacatctgcttcccagagcacctctgcacctgctactccttcttctacgacatcgtcggccgcggcgagcagctctgcgtaagtgtggcattctgacctgctgctgttactgcatctgaatccgtacatctttcaatcaggcacactgaatttcatggacacaagaaacggataacctataaacacaaaagaaacatggcaccattgcaattgcaattatcagctactactgaagtactgagtactgaaatgctttttttttactgttttattttgactggttactgaaatgcttgttgatctcttttgcatagtaattgctttaattttgtttcttcatggcgctattacaattgcaactatcagcccgcggctactgaatattgagatgcttgttgatctctttttcatggactagttgcttttgtttcttcatatggtgctatcgcagttgcaattatcagctcgtgactactgagtactggaatgcttgttgatctctcttttcatggagtaattgcttttgtttcttcatcgcgctattgcaattgcaattatcggctcgtgactactgagtattgagatgttcgttgatctctttttcatggactaattgctttttttttcttcagtgcaagcaccagttagcagcccgacttgcggaggccgtcagtaagcaccaggacattgaggtaaccgatgaggagttggcccacatgcttgctaaactctgaaagtttcagaatttcggtacttcagcaatgcacatgaagtttgggacgaattgatttttaagaaggattctaacactagtaccgttgtgcaaaatgactgatctcagtgcaaagaactgaatgatgcttgctatataatatcagctagatgagttatcctcgaatattaggcgttctcatgtagctgacaggtataatgtgaggcgtcatggttttatcattttgttgttatgcttgttgttgtattgaatgttaattagcttcaagaatgaggggaaatgtgtgatattcttcattcttgtgaagagatttataaatttgttcctttgttactgagttaccctgttgccctcctttttagttactatcttatcttattttagacaaattgttccttctctctagtattgctttagtaacaggggaaatatgaaaaggtattacacaatgccgcgtgattatgaacttttagttttttctaacaatattacacgtattgagaattctgactgtatggatcttcatgaatagatatcataataacaacatacgtagtacaaagatatgaatgctaaatcaggagatcctaattgtccaagtcttaggccacaggtttcacagtacttaagcaagtacgttgtactagttagtttcagaattgaacatttcatgcaaacaacatttacgactagcttaagaataaatactgatgataataaatactagtacaaagtataaataacattttgatggccgtctatgattttataaatcctggatacaatagcgctgcaatccgcagctcttttatatttgctactaattgattagcttcgatacaatttaaaaaccatataatatccaagcatctaaactagatagctttaaagagtatgtgacatattttggtctgtttattcttatgcctttcttttttaaaa

SEQ ID NO: 54432 - DNA, 9121 bp, Oryza sativa
aaaaaggatgcttgttcttcagctttcagcagaggattttaatgctatgcacttgattctcagcaatgaaagaatatggattcttcatctttccgtgtacactttcatcagtatgtcgctgaataacaatttcgttctttcacattccttttcatgggtacatttatatgctaggaagaaagaaaaaaagaaagaaaggcaggagctccgccagtgccactagaatccatgtcattactagtcacagcagtactatggtatacacaagagtggaggtatcagccattgtatgatcaatataactggtgttgtgataggctcctaatatcaactctgatagtgcagagcattctgtcaattttcttgtgaaagatgataatttattgaccggaatgcatgatgtgcatatacagtttggcttacctgaagaacaacagtaatgacctttcatgatactctgtcctgttcatctgcagttttactttgctcctcctgatcaggcataacaaccaaaaaaccaagtactggtatccatgattgctgcttctgctaggctaaaagtaacaactgaaaacaagccacgggattcgatattagcatcgcaatttttgtgaatatgaacatgtattatttcctaacatattcttcttggcactccaaaaaagatcaaaataaattgctggtgtttaatccggccaattgcatggagacattctgaagtaaaatcacatcgaaagactgaatttgcaaccaacaaaatggacagcagtggcgatgaacaaaacccaaacctaacccaaccatggccgatagtgcgttagacggctgggctcccgttcctcgcatgggccatataatgggctttcgtgatggatgatgggccaaacaagcctaaataggacaggcagcagcgtgcagcgagtagcgaagcagcgctagttttagtaccacctcgccaattcgagccgcagccaggcgggaggaacgctataaaatagggcgaggttgcaccattgtaacccatatctttctcagccttttggctatttggctattggctaagggtgtgattagttcgcgaaaagaaaatattaaacgtgggaactaaacaagattaactgttctcatcagtttaactaatatctgatgtgtgggccatatgctcacttcgatattaaatttattatttgtgggggagggcttcgatattaaatttattatttgtgggggagggctcatcacagtggcaagcccttgccactggggccctcgcgcgtcgctcaggcgttgcactgctgcccgggcctggcgcacccaaccaaaataagttgaaatttatttaatttaactagcaaatatgaaatatgactgctttacaacgggatttcgttgcactctattattatatgtttttatctttttagtgcaaaagaaaaaagataaaaggcatatgtaatttttagtgcaaaaggaaaaaggtaaaaggcagcaatggaaaagaaacacgcaccttgtagtatcgaaataaaatatgttcgaattttagaaataatttaatatttaaggaaataataattattttgacatgaaaaaatctactgaatctattgagtgattaaataattgattataatttcctagcaattttaaatggcttaaaatagttccaaacaaatttttgtagattttttaaaaattaaatcagttgctctgaaaaataaactgattagggccttagtaagtttccgggacaacttgagggaccaaaactgaacttatctgtgcgaagcgttcacatgtcccaattgtgtggcggcccgggaacggcagcccgatgcgggagaattcgcagccgtccgatctgatcgacggtcacgattgatccgtacatatgtataaaaagccgtcaaccctaaccctaaccctaaatcatttcccctcccccctctctctctcacgactgcatcggcggcgcgcgcggcgccttttcccctccgccgctccccctctccctccccaccggctacgccattccccttccgccgctccccctctccctccccactgccgccgccgctccccttccccctccctcaaccggcgccgccgctccccttcccctcccctcatcggcggggacgttccacctccctctctccctcccgtctcttctcccttcggcggcggtggaaacggccgatggccgcggtggtggcggcggcggcggtagctcgctccgccccctctcgccttcctcccacagcggatccgtcggcgtcgacatagaggcggtgggccggacggcgtggaggcggccggcaggagacttctccccctctctctctgtgcggcggctgcgggagggccggtgacggtggtggcgggtcggacccagacggcgtggaggcggccggccggacctcgtctccgccagatccggcggcactgtggccaggacggcgtggaggcggcgggccaggcgtcgcctcctccagatccggtggcatgggggcgctcggcccgacggggcgagagggcggcgtggaggcgggcggtgatggcgtcggcggccgccgatttttttttttttttgcaattttttccatcgttattgctaacctaatcggattatgtcggtgatataggtccggggtatcaagtttagagggaggaggctgcccccaatgccacgtggccctcccccgagaggagtcaggcccgaggtggggtggcggccactccttccccaaagactagtcagaggaggctgccccccgatgccacatggtcctccccgaggggagtcaggcccgaggttggatggcggccactccttcccagagactggatggaggaggctgcactccaatgccacgtggccctcccccgaggggggtcgggcccgagatagggcggcggccactccctggccgagactagagggagaaggccgccccaggctccacgtggctctcccccgaggggggatcgggcccgaggtcgggcggcggacgccccctcacgtgactaggggtcgggctcccccgaccacctctctaggtcaccacgtatggtgggttaggtgtccgcctctaggtgcccacctacccgcatttatggcgtcccgagcggtcgcgccacgccgtgcggcgtgcagtgcactcaaccggtctgtgaccggtcgaatgaccgatgggactggctagtgcgcctgtgcgctgctcgtgtgtcaggcggcgtgtagcctgacatgtcccatcaaatagtgatggtgagaggttctcatcctcttatcccagccggagtcggtcctcccgctctggtcaaagcaaggctcccgtttcccggtgtaataggagcccagaagtcttcacccattaaatggtgactgacaggggcacccctcgtgtcaggcggcaagatttgacaggcccaatcatcaagacgacgtgtgcttagcttcccaaccacagagacaagacatgcatttaatgcaaagattataatacttctccaccggagctaggttaggttgttgtgcccatgtggtaaccccttgaggtataaaaggagggccaggcctagtggtggagggggaacttccgagcgaactagcgcttgggtctcgcaaccccaagcacttgtgttctacattcaatcaatcatgcacaggagtagggcattacgcttcttagcggcccgaacctgtataaacctcttttgtctcatcgtcttgggggggctaaccccctcaagatcacacagctctgctcaccaagccctcgaatctcacccgctgcccccggccgaactcacaaaggggggcctcacggttccctgatggaggagttcattctccgacatctggcgcgccaggtaggggacacgttcgtgatttttgaggttctttcgagcgccggcgtggtgagtgtcgcgccgccgctactggggaaggcgcagtatcctcaggagtgtcgcgccaccccaggcagggggcaaggccccccacatccccaccaggtaagcttggctaccaggtctttgtggcgagtcttcggaatgtccgagggcccccaaagctccagccctgcctcaccgagaaatacgacgatggcaccgaccccttcgagtccctccagatctgcacgacgatcatagaggcggcgtggggtgacgaccgggtcaaggcgagtttcttccccattccctccagggccaagcgcggggatcgctcatgaacctgccacttgcctcggtctactcctgggaggactcttgcagttgagctccgggtgccgtcgaagcccagaaccccctgtgctggctcttccgtagcggctagctttggtcccgctggctggctacggtgcccggcccggctcaactaatcgtcctttcaagcttcaagtattttcagtttttcaattcatcagcttaatatagcttgaagtcttatatttattttccccctgttcttttctcatggccctgcgacgctcgcgtgttacgcatttgtttgctccctcggtggtaagagcccaacctctctcccatgtacatgaacgattcttcgctaagtgtgggggctaagttttctagccttatcctagccttaagttgagccccgggtgccgtcgacgcccgggaccccctgtgctggctcttccgtagcggttggctttggtctcgccggctggctacgatacccggcctggctcaactgtggacggggattgctggctctagagttttcggctctcacactcatgcgaaagtaattgtccatatagaaggaaaagagattggaaggaggccaccgaaagaaaagagcaaacagaatgtgtagcgtggggacataggctcgtgggaacctgatctcgtttgctaagtggtcacaggcttcccaagatggttcggaacccatggtggggggccctcttcgagctaaggaaaataagttcacaacctaaggtacgggctagcgagtcgccctcaggctgggatgaaaaaggcacatgggtcctagtgccagcaaagaaagaataagagatcgggcccacatatcatcagactagaaaagtggcgtcaaccctgaccacctggggaaggttttggtcagggctaacgccgggggctactgtcgatgatatgggcccaggggtatcaagtttagagggaggaggctaccccccgatgccacgtggcccttctcccgagaggagtcaggcccgaggtggggtgcgggccactccttccccaaagactagtcggaggagggtgcccccggatgccacgtagccctcccccgaggggagtcaggcttgaggtaggacggcggccactccttcccagagactggatggaggagactgccctccaaatgccacgtggccctctcccgaggggggtcggtaccgaggtaggcgggcggccactccctggccgagactagagggagaaggccgccccaggcgccacgtggctcccccccgagggggatcgggcccgaggtcgggcggcggccgccccctcccgtgactagggtcgggctcccccgaccccctctctaggtcaccacgtacggtgggttagatgtccgtctccaggtgcccacttacccgcatttatggcgtcccgagcggtcgcgccacgccacatttaatgcggcgtgcagtgcactcaaccggtctgtgaccggtcaaatgaccgatgggactggctagtgcgcctgtgcgctgctcgtgtgtcaggcgacgtgcagcctgacatgtcccatcaaatagtgatggtgagaggttcttatcctcttatcccagccggagtcagtcctcccgctctggtcaaagcaagactcccgtttcccggtgtaataggagcccagaagtcttcacccattaaatggtgactgacaggggcacccctcgtgtcaggcggcaagatttgacaggccccataatcaagacgacgtgtgcttggcttgccaaccacagagacaagacatgcatttaatgcaaagattataatacttctccaccggagctaggttaggttgttgggcccatgtggtaaccccttgaggtataaaaggaggtccaggcctagtggtggaggggggacttccgagcgaactggcgcttgggtctcgcaaccccaaacacttgtgttctacattcaatcaatcatgcacaggagtagggtattacgcttcttagcggcccgaatctgtataaacctcttttttctcatcgtcttgggggggctaacccccctcaagatcacacagctccgctcaccaagccctcgaatctcacccgctgcctccggccgaactcacaaaggggggcctcacggttccctggtggaggagttcattctccgacagattgcatatggacgaaaaatcggatgaaattagacgtgacgaccggaaaaatacgaatatttatattagttatagataacagcattttgaacacttgcttgttcaaaattttaattttttttagttgattcgccttgggcctttgtctccgtattcgaaactttcgaacttctgcagttacatgggctttgggccgagtaggtcggcccatgtttacgaccggtcaccatttatttcaagctcgctctctctttgctgcagctatcgcacaagcttctagcttcgatagctgttcagataaatgataaacaaacgccttcttaaaaaaaattgataaataccataatattctactccctccattttataatccgtttgactatttttacaaacttcttcaacttcgaccaaattcatagaaaaataaagtaacattttttttacaaaacaaacatattatcaaaatatattcattttttagtataataaaactaatttagtgttgtaaatgttgctaactttttataaatttaatcaaattaaaaaactttgactaagaaaaaaattaaacgacttatagtataaaacggaagagtagtattctatatttttttgtcttaaaaaatgataaacgccttgatattttagtattctatcctcttttgtgtgctactgttacagtgctctcatcttccattgttgttcttgctcttccattttgaaacattgagacctgaatgcctgataaaatatttgataatttttcgtgggagctcatgtctcacctattccttgtccctctgtgactcgatcagcttgttcttatgctttcaccaacggattctaatgctatgcgcagtatgcactttgcctcacagcagtagaagaatagattcttgaatgaaccaatcaaagaatgcgtcatttttattagaatcctctgtcagagtgtcactagaatccatgtcttcacaattcacaactagcagtggtgctatatgacatgcacaataatagagctaccagccattgtatggtcaattcaaccggtgtcctgcaatctacgggagcaagtgtcttgcgtgtaatttcgctgtgaaacagcttttatcgatgagttgaacttcatattctaaatcattcaaaacggtagcctatgccctatggataatcgtaattatgaattccttcatgatagattgatatccaagttggcattcgtttgtcgttccaactatatattaacattgttgttatggttctcaatcattatattaaagactaactatagttcaaacattttcctcttcaacatgcatgagtttgttcgcttctgaaattacctcaccatagaaaacatatgacaaaaaaactgaagatcatatttgccaaaatgcatacttaaatatatataatgaactatctgtacactacaaacttataaccgcaggctcaagtcaagatcttcctccgtgcgcttcttctgctcctgagagcttgctttgaagctcccaggccagactgaccctctaccatgttcaaccgcaaaaggcacccagctgctactcatctggcctccatggaatttcgccacgacaacaccatcagcagaagaatagccacggttcaccttcaggatcgtggcgtgagggttaaccctcatgtggtgaagaaacgacgacggtgcagtcggggagagcccaaccatgagatgctgctgctggaagccgtgcgacttcctcggcgcgcacctctccctcttgtgggcgttctggtgcccacccagcgcctgcgagctgaagaacttcctcatgcagtagttgcaggagaaggttctatgcggcgccgccacggccggcttcggattcgactcgggaagcttacctgcttctgctgtcagtgcatcgacgacacccagctttagccatggaatcgaggtggtgtgatcatcctcggcagctcggtttgctgccttgtgttgcaccacttcaggtgatctctccattcctgtctctctttgtgtgtgtgtattaggagtagaagaaagagtggattgctctcaaggtttgtgctattgtggtagcttcttctttgctataaaaagaagctgggggtgtgtgcaagtggcaataattcaaggggaaagagcaagtgatcagcagtttgaagtggaccaggatattctagtttgcacacctatctatacttttttttgttttgagaaacctatacttcttttttttttttttttgcctagctagctatcaattttcctatagtggtggccagcatgctcccctcttaacaaagattttcttatttatacctgttctaccctttttttttctagttcttgatatttgataagagtaaatatttcataaggtgtgcctctcatgtatactgtccggttacaataaagttcagtttcttgtccagctcatccctgcatcctcatcaagtctgaacctgctttggataacagttctgtacctctctatccagtactacagttcagtatcctcatacagttccatggtttgtcattttcctgttcttttgcaccaatcatatgggaagctactgtttgtgtgtctgtagtgtccttgtcaatagaagtacaagaatatatgtatagaaagaaggacatcctttaactgaacaaaaaaaaagtcacataaagaaaccttgacttcaattctgttatgcgttgcaagtgaagttgtcttcctcttttgc

SEQ ID NO: 54433 - DNA, 3819 bp, Oryza sativa
aaaaccttgacttcaattctgttatgcgttgcaagtgaagttgtcttcctcttttgcttttaattggcaaaacagcatgcttactgaagagttctatggcctatgggcgcatttttctaaaaaaatcatatctgatttctgaacttatctgaagcattgtctctttttgtctcttcaggctcaagcgtagacgcctcacgttttctaattaaaacgagtactactaaagataagcctacatcatcagtggctttcagatgacttcaggtgagtgcagctgccactagtcctcctcctgtaacctgttagccataatgccattagcattggaccaaattgctgagcccaaaacagaaaggttaattactgctcagaaattaaaccgattaaagtggatgatgcactcacagccacaatgattgtgcttatttttatgcagtgatttggaggcctcttttggttgtctgtacgtgaagctcacttcagagtgagacaactggaaactatgtgttcccctcgcgagccctacaacgaagtcgaccgcatcagagagggggaaaaataatggaaattctgatgctgattgtgccttagtggattggtgactcgtatactctggcagcctgatccggaaatggagccacagcattgaagcgacaacccgtcaacttttttcgtttcatcgactctgaatttcttaaacgtccgttcgtctaaaagtctctaaccccaggtaggcaaggcaggtgatcacggctatcaaatcggcgttgttatacgtagctttcgtccctgttcgctcgttttttttgcctctactgcagttcagcagtggccttggtctcatcatctttgtgcaagttggcatgtatcggaccaggaattttcagttcagcagtgttcccacagaatacgtcttggtgcgttcttcttccaaggaactaattcttatcacgtcgtaggcttttgccatttcggcatatcgtcagctgtctcgaccaatcaatcgatctgacccatttgtgctgcaaaattcctgctgtggactctatatgactcattgagtccatattgaatacgatcatattgtttccttcgtcatattggatcagtattagttattacagagatgatgcatggtcgatgacttcatctcaaacggaaaatggacaataactgataaaagatgatggctgatgactgtatatggtttcctcgatgaaaattcaaatctacctgtattctgaaactttatccacttcagtgccgcctcaaaaaggctaactaaaaaacgttcgcgtgcggtaaactcgtgcgaacgcccgtgcattttaaccgggtggtctgctttttctgtaagtttatatatacttaagaaaattgtattggtggtataaaaacttgttaggtgggtacaatttagtatataaacttgtaaaacgctcatttcagtatatgaatttgtctacttcatgtgaacaaggaccaaaataacttgtgaatgttaattttacgaagttgatgttaattaggatgtgacgtgtatatatgtagtaaaaattcataagagcatctccaacaaactctctattagcctatccaagccaaattttagctattcaagacaaaaaaggagctccaacaaactggccaacaggatggccaagccatctggctggccaaactcgctcgctggctggctagatttggccagccaaaacgcctctccaaacggtgggcccacgtgctattcctttggcgcagtcgtcgtcgccgggtcgtcgtcgaggtcatcgtcgcgagccgccgccgccgtcgccatccccgccccgagctccgccgtcgcctcgtcgagcagaggttggcaaggcaagcggccgcctctagatccggcggggagagggagcacaggcgccgccgccttctgcctccccgcgccgcgccgccgcctgccgcctcccctccccgcgccgccgcctgccatctcccctccccgcaccgcgccgccgcttgccgcctccccaacgatgggaaggaaagaaagggaaaagaaagaaagagaaggaagaagggggtagagataaagaggaagaagagtagtagaggctgacatgtgggtccgttgttattttggagaggattaatagagagtctgttggagtgacgatttagtttgattagccaaatcagatggagagttggctatataggggtgtttggagagtacgatttagagaggctgttggatatgctcacatgcaatgtttataaatttgatctctgctttatccttcattatagaaatgatggttttcatatatttctaacatttatatcattgctccttttttaaaatttttctactatcactttatcatattctattttttattgaagaggtgtatatctaatagtaaccttctcatatatatgtttacacagtatcctaattagccactaaatcaataagattagccatgtagtgtcctttttaccttcctccacacgcaccagacaagttcatgcaccaaaaaagcgttttacaatttcgtgcactagattgtacccacctgacaagttcgtgttccggcgatgcaatttactctatacttaattaaagtttatatgcatcgacagcttatacagcgaaagtttatatgtccgatttggattcaaatatttttacatagaactcccatataaagaatttctataagttattatgtacattggtcaggccgatacatgttcacgtgtctagccaacatgcgaacattatgtctattattagaccaacccgtattggtatcacatgctaccggtcgtgttggccgtctctatagaaccacttgtgtcactaactcgctaccactattaactattggtttgcctttgtcttggagtatttttgattgatcggttatatagtcctaagtcagattattatccataggatatcttatatgtatcaaaattaaaaggatgtacaatgcattttttattcaatagaagtccaaagagttttgataaggggatttattcatttcataaaggcttcgacgatgggggtttttcattttttgagcaaaaagataaaagaccagatatatacgaactacaattacaaatgtaataactactataccaacccaaatcatgatcttaaccaatttgaatttggttttctcgtgaaaatcaccacttgcaaagttgagaaccataaaaagcaatattgtaataagaagaggaaaaaaaaggaaccacaagagattaatacacaaattgttgaagcggccctcccgctacctggcatcttgttgtaatttattcaaaacagtccttgttgttctataaaatacaatgtgaagaagacaaaaatttgtttttagggtttgcgctataaacataatgagtacaagggtgcttttgcaaagcattattatctaaccgaaccatcagatcccccttcctggcctcccccctcggccgcaaggtcaccgcctccgtcccgccctcctcagccctcgcatcacggtggcgtcagagccgacgctgacgctagtatcctccttcccccttcttcttcgcctcaccctattcctcctttgggttgatggtctagcaagcaatcctcctgctcgatcattagatatggggtagtaccagtggtggtaggctagtagcagtagaaagtatgggtccaaaggagggagcggcagccaagacgaggcggtggcgagggtggtgctgcggtgatggtgacccttccctccccaaccttggtgatggggacaaccctaggcgacgacagctgtcggg

SEQ ID NO: 54434 - DNA, 2478 bp, Oryza sativa
cggtttcaccctggcgtcgtttaagagatctcgcttttgttgcatgtccaacgttcgatctttcagtcttcaacgacgttcttaaatgttgccattcggtctgctcatggtaggagttgatattcttctctctctctctcgccctctccttcggcaacccttctacgtggtgatagttgagagcctgtgggggatcttttggttggaattggctttggcaggtcgtttgtgactccttcgtagggctagcagcgtccggtcacatatagcagaggcccgactcgatgctagttccttttttggggagtgtgtgcaggtgctgttaacatgtgttggtgttgctttggtgttcttttttcttttccttattgttgtctcttaaggtggtaatcttataaatttttttcactatattaatatgaaacttgcaccgtccgatgcctttaaaaaagagactgtctatccatttgtcgggtgatttctagtaaaaaatcacccagattttttctacccttagatttatatccaacggactacaaaagaaaataataaatacatatttacttacacaatatttttatcaaaattacagtgcacttacatatcatatcaactgaatttacaaatgtaattttagttatataggactgtaattttatattttaaataaaataactagcgatttcgctagaaatctgtcgtgtgatttttttcccggtgatttcacggatttgctgaccgcacgatggtggaggctgcatgcgtggtcagccggtcgggatgatcttgttcgcactgtgctcgtccctttgggcatgatgagtggagacgatcgccggacgggacgaccttctctgcacttgaatcttgtgcgtaaatctgaaccaagccaaagctaggatcccacactagattacaccaccatgcggccatgcctaacaaatctaccatcgctagaaacctattctattcaattttttttatatatttgctgataaatttttttctagaaatttgacagatgtaattacaataaaatcatagtgtaattacactgcaacttgtatataattacactgtaacttatatgtaactaaaactatatttgtaaattcagttgatatgatatgtaagtgcactgtaattttgataaaactaaagtgtaagtaaatatgtatttgttattttctttaaaatataaaattacagtcctatataactaaaattacatttgtaaattcagttgatttgacatgtaagtgcactgtaatttttataaaaataaagtgtaagtaaatatgtatttgttattttctttaaaatataaaattacagtcctatataactaaaattacatttgtaaattcagttgatatgacatataagtatttaaaatataaaattacagtcctatataactaaaattacatatgtaaatttagttgatatgatatgtaagtgcactataattttgataaaaatattgaataagtaaatttgtattagttattttattttgtagtccgttggatataaatctaagtgtaaaaaaaatctgggtgatttcttgttaaaaatcacccgacaaatgtgtaggcaatcccaataactaatacatatttacttacacaatatttttatcaaaattacagtgtaattaaatatcatatcaactgaatttataaatataattttagttatatagaactgtaattttatattttaaagaaaataaataatacatacttacttgcataacatttgtatcaaaattacagtgcacttacctatcatatcaactaaatttataaatataattttagttatataggactgtaattttataactaaacatcatgcgaattaaacgaagagaagaaagaaacaagaataaacctggtggtgaagagaacgcggtggccgccggcggagagtcgtcgtcgtcctcggcggagacagggacagagaacgcagcgtcatagccatgccgatttaccgatcgatcgatggaacatggaagggaccgtacgtacatctatacgttgcgtgtataactaaaattcgagtgatttccagaaaaaaatctgtcgcgtgatgtttagcaaaatcgaaaaaaaaaatattggcggctcgctcaaccctggcccgtttctccatcattggggtcaacctgggctgcaggtcttcggaggttgggcctcgttacgaactccatccaaccactgtggcaggtgggcttctccgccaccgcccctctcgagcgtcacatgggccgcctctccgtcatcctccacacgcgcggcctgcgccgttcaccgaatgtgccgagaccccgtactgaaattcctgcgcgccgccaacccccttcgttcacgacgagcagaacgagacaacgagtcagcatcgacggtacgaacatcgcacgcacagagacccaatcggtgctatactcctatagtacaatttgctccctctcaa

SEQ ID NO: 54435 - DNA, 21246 bp, Oryza sativa
ccatcgttaggtagagagtagtagaggagacctctctttacgtcggactagtgaatatgggcgcgcagaaaggtgcgtcgtcgcatgtgcccgtgtctcttatccacggccctctttacgcatgcatgcacactctggtcgtgtcggcctctgtacatgtcgccgcccccctgctgtgctaaactccactctgatccacgcaatgcaaaacgcaagtgcatgcatggtactacttggtaccaactccctcctttagtttcttctcgccttttgattttctgcatggactgcagagctagtagaagatgatgatcattgccggggatggtcactgactgactgtgtcgattgatagatcgatcgatcgatctcattgcgtgtgtgtgtgtgtgtggatcgagttttatctgcgcatgcaatcatctactactaataataggctagacgtacaccttcgacagtgagagtagatctccggttcacctcatcctcaatcaaatccaaaaagggagatctagtcgtaagacatgccgggcctcaccaccaaatcgtgcattggatagcacaaatgctttgtgtcgacgcattcggtggcaagcagaacattccagggagggttttgccgcgtgcgcttactgtttgggtgcgccccggcccacaggttaactcaccgagacaaccacaagtactctccatttcgcccatacgtatatgcttcaagcatggtgtacattttcttggtctctctttgttctttcaacttaatttggacatatatatgtatactcatttggactagtgcagtagttagtactactattttactagtatattgtactgtgcagtgtgaacagtgacagcaagtagattatccagtacggcaaggtcgtctaaagacgactgaataagtatctttcagtggaattgaacaggataccctcaaggatttatgcttagctagctgccaaggaatgaacaagcgtgctaattaattagtcacaggagtctgacgatgcttccactgtacacagtctacagaaaaagttgtccgacgtcgtacatttgtaccatgtaactagccaggcaatttctatcgctttctagctaggtttcaaaaatttctatcgctttctgacgacgaattttccccatggttaaccagcggcacgacgacaagtgtctgatgaagcaatgtcgacgaacgacgcatcgttcgtcaaattcgaattaactacatgctagtgtggagggagcgtgcggtgctgtctttttctatttctgcatgcatatatatggtcgcgatcgataatgacatcgttaagcgtattatatggggttagatagttactatttggtccaaaatctcgcttcgaaaacaaagttatcttggttgtcaatttgtcattgtgtaattgttcgtgccaaaccatatgatcagtcaaagtggacttcaccaatcaccggcttggttggtaagcctgattactctgaactactcgcatggttacctcgctatttctaacttgggattgccgtcgagtcaatcacgaaatgcgcatatcgctaagcatgcgagatgtgcagttagacatgaagtgctagtggtatgcattttcaatctgcataggttttcctcgagatgtttggattagatttgtaatcttcttcagaataatctttctgaagagaaggatctacatacagaatttcccgtgttattccttattcgttatcaggatgactttgacacgccgataaaaaaaatcgcactcatctcagtcatgggagaggaggaattacggttagacatttctagagtctagactcagctttcggtgcagactaacctttttttgtcaaatataacgctcgatctagcaaccataccaacagcaaatatattccattgtaacaggaaatggtagcttaatagaaaggctagctcaagctgcttgacatggaaaacgggaagtaacttcgtacgagaacttttgctgtcaagtccaaattaattccttccccgggttaatgatgctccaattaaacaatttccacatgctcaggacatatggatcgaatcatcaccacggatcacaaccgaggcttcgtttgctgatgcgggggtagataatgttcttttctttttgacggtcccaaatgattctacctgtaacaaaaggttaacaagtctgcacacgaccaaagtccaaagcggcagcaggagcagcggtacctaacaccatgcaaaacacaacacacggcctcccttttcttttctccactttgcagtatatttttttgacagcaaacgacgctttacagtcttacagaggccagtggcaggggcaaagcaaaggaggagctgccaaaacgaccgtcatgatcacgagctagagggtcaccgggtcgtcgtcccccgagaaattccggggcatcggcagcacgggcgtgcgtggacaaaaagggtctaacaaacgtctgttctctcccccttctggttcacgtgacagaaaccaacccccgctttgcgcccgtctcggcgtctcccctgtccagccaaaggggaagcttcccggcacttgctccgtctccggccggcacgcagccgcaacacgcaccaccagcgtcgccacagctctagctcctccccttccactgccaaccccgcacgccgcacggtcagaaacaggctaaccctctcgtctcggtgtgtggtggtgtacgtacgcgatcggttgcacgcgcgcgcgcgcgcggaggcggacgcggtgcagccaacccaacgacgagatcggcggtctcgcgcgcgcgcggcgcaccacgccacgctcacgcaacgcactctgcattattcgacccggcccgtaatcaatcatgcagaagcgagggcggcaaccgcgcgggagtggcggtgcacgtcaaaaccacctgctgcttgcgcgcacgagccgcgtgcgcggggggcgccggccggcaggcaggcaggcgggggcctgatcagccgacggggtatcttctcgaacgacagggcggcgagaggcgggagccatgccatattccattgcgcagttgcgaataaaaatgtgcgggcagggcggtgattcgaagtttcctttaacgcgaaccggatcccggccggatcatgcagcacacacacacaacctcgcgcggcgagtgagcgagtgattggcacaaagaatatctgactgactgccatcccatcccatcccacccatccaggcaggcaggcagggatggccagtcccgtcgacctatcatctcctctccccccctgaccatgttacaacttgcgacggcttcacgtggccgccagcccgtaacctgaggtgaactctagtctaatccctctcccagcacacggccggcggtcgctctctcactagctagctaaccttccccaaccacaaagattcattgaatgcggctgcctcgctcgctcgctcgctctcgccgcccgccggccaggttagccgcgcacgcgcgccatcagcggctggcgcgcggccgttccgtgattccgtcgcgatcggttgggtgcgcgcgcccgtcgcgtcccaagggaaagtttggtatcgcctttcccgaatcagccgagctcgtggcccgcttacgtacgtgcgcctgtgacctgtctgcccgcgccgtgtgcgctgcatctatccatcggtcggctcgatccgtcctccgtttcgcgtggtagtatgcccgtggcgcacggaattccgtgtcgagctaaaagcggctcgacaaaggcttgcgcgcgagaaagtcggggataaggcctggctttcactcgctcgctcggccagtattagctggctgcctaagctcctccctctccccttgcaaacgaaacggacaggccatgttcgagaagaggcaggcaaagaggcgacagggattttgccttcgattcagcagttcgcagaggcgcgggctctgctaaattcgggcagcgtttctgccgtgctcgcctctgcctctctctctctcatcagagaatctatcgccgatagcaacgcgaaacagatcaagcccgatactagtaatttgttaatcgcgtccgttagtctacgcttccggccgaccttacaccaacccgacgaccaagttgcacgagacatacaccgtccacgcatctgtcaatgaactactactagtaactactaccgcgtggtgaagtgaaagggtgaaactgctcgggtcggcttggcttggcttcggccagctagccgccacgtctccgccggttttaagtgtgagatccgacgtggaggccccggccgcccccaccgtgccggccgttgtccacctcccgacgggacaccgggccccgccgttgccgcgccgtggaccgacagccactgacgtcaccccatgtccttcttctcggctagctcttctcctcctcgcccgtgaccagcagctcgcctcgccctctataaatacccggccattcgaaggcgttccgactcaggccacacaccaccaacacaaaacatttccttgtccctcgccttcctcgcctcgcctcggctctcacacgacgcctcttcctctcgctactactagctcaagctaagctagcaagagcattccttgggctttttttcttgttcggggttgagaggcaatggcggtgatgactgatgtgtcgaccaccgggacggcactccggaccccggcggcgggggcggtgaaggagggcgacgtcgagaagctccggttcatcgacgagatgaccaccaacgtcgacgccgtgcaggagcgcgtcctgggggagatcctcggccgcaacgccggcacggagtacctgaccaagtgcggcctcgacggcgccaccgaccgcgccgccttccgggccaaggttccggtggtgtcgtacgacgacctgcagccgtacatccagcgcattgcgaacggggaccgctcgccgatcctgtccacccaccccgtctccgagttcctcaccagctccggcacgtcggccggcgagcgcaagctgatgcccaccatcatggacgagctcggccgccgtcagctgctctacagcctcctcatgccggtcatgaacttgtaagttgatactactcctatcattgtctcattctgatagcacacacacgtacaagaagcagatgatgattaatggccatgaatcattgcataggtatgtgcctgggcttgacaaggggaaggggctctacttcctgttcgtcaagtcggagacgaagacgccgggaggcctgacggcgaggcccgtgctgacgagctactacaagagcgaccacttcaagaaccggccgtacgacccgtaccacaactacacgagcccgacggcggccatcctctgcgccgacgcgttccagagcatgtacgcgcagatggtgtgcggcctgtgccagcgcaacgacgtgctgcgcctcggcgccgtgttcgcctccggcctcctccgggccatccgcttcctccagctcaactgggagcagctcgccgacgacatcgagtccggcgagctcacccctcgcgtcaccgacccgtcggtgcgcgaggctgtcgccgccatcctcctcccggaccccgagctcgccaagctcatccgcgccgagtgctccaagggcgactgggccggcatcatcacccgcgtgtggccgaacaccaagtacctcgacgtcatcgtcaccggcgcgatggcgcagtacatcccgaccctggagttctacagcggcgggcttcccatggcgtgcaccatgtacgcgtcatccgagtgctacttcggcctcaacctccgccccatgtgcgacccctccgaggtgtcctacaccatcatgcctaacatgggctacttcgagttcctccccgtggacgagaccggcgcggcttcgggcgacgccacccagctcgtggacctcgcccgcgtggaggtggggcgcgagtacgagctggtgatcaccacctacgccgggctgaaccggtaccgcgtcggcgacgtcgctccgcgtgacggggttccacaacgcggcgccgcagttcaggttcgtgcgccgcaagaacgtgctcctctccatcgagtccgacaagaccgacgaggccgagctgcagcgcgccgtggagcgcgcgtcggcgctgctccgcccgcacggcgcgtccgtggtggagtacaccagccaagcgtgcaccaagcgcatcccgggccactacgtcatctactgggagctcctgaccaagggcgccggcgccacggtggtggacgcggacacgctgggcaggtgctgcctcgagatggaggaggcgctgaacacggtgtacaggcagagccgcgtcgcggacggctcgattgggccgctcgagatccgggtcgtccgcccgggcacattcgaggagctcatggactacgccatctcccgcggcgcgtccatcaaccagtacaaggtgccacgctgcgtcacgttcccgcccatcgtcgagctgctcgactcgcgcgtcgtgtccagccacttcagcccggcgctcccacactggactccggcgcgacggtccgaatagtcggtcaaatccccacctcgtcgttggaccgtgtccaagaatctgaagtagtagaagccggatgcctccacctaaaaacacttatctgttatttttggaattaattttgatggttgctgtcaactctgtcagttagtggcaagagggtacctctgatgtgagggagagaactgcagaacgaacggaagaaagtgttgatgtaagaggttaccactagtagtactgtttgtctgtatcaggaatgtgattataatttaacctgtcctccaaaaccgtacgagtcctgcgcaagatcttgttccaattattggccagacctggacagcttttaggctgtgttcggcacagcactttcagtgggcgctacagtgttttgcccccgcgcacgcttttcaaactactacacggtgtactttttttcaaaaagtttctatacaaaagttgcttaaaaaaatcaaattaatccatttttgaaaaaaaaattaactaatacttaattaatcatgtgttaatgaaccgttccgttttccgtgttactgtagcgcggtgggaaaacgtccaaacgaacgcagcctaagcgtagcgatcagttgcatttcctgattctcctgcctgtagcctttccatttttgctgaaccatttcattgaaggttttcatgggagtttgttgtagcttctatgttgggagattcaagcaaaggagggtaaatttgccgcattattagctcatgaccgtataaggatgagactggattgctttcggcttctcgccatctctcaacaactactgctttcaccttaaaaaattcttgaagtgcatttgattatagtcttttaaattattagcgcaagtgtcgagtagataatcttttctctgagatgttgacacttgattaaactaaccaggctagcttaaaaaaagtgaactgctgaataatgccagaccgaagcacgatcctgcacacggctcggtcgtcaggtctttgctgagtgctgcaaacggaccaacatactttcctgactgtaccatcatgcttttgcgtgtgttcttctttctcttgctttcctgttttccacaagtccaaaagcaaaacagtttcgcctctcttatgtcaaaagcgagggcgttattcgcaatgtagtttgcaagtcgtgtgcagtatcgcgtagaggcttcaaattctgctattggttcaaagtttgcggatgggtcatgaccgagaaaaatagacgcatcccattctttgtttgccatatcgccagcgtctaacttcttgccgtctttgttggagcaatgcagacatgcacctgcatgtaacaaggcctaaatgacgagttgttttttagagagagcccaaatgtcgagttgacaactagtgctggtctgaaaaaagggcgtagcgctgatatactgaacagacaatttgacttgtaaactgaacttccgtgcgatagggccgtaagcctacctgcaaatcttatcgcaaaaaagatcactatccattccatcgcacaggaggaagcagaacaagagtacaggactgcaagtgtatgttgcgtccacttgtaacgtgcccgagtattttttgactctccaagaacaaaacacaaagtcaaagctttagactcctctccgaatccggtgcgtcccgctcgttcatccacacgtatcacggccgctgttacgagatctttgaccccgccacgctgcgcaccagacgatccggtaagatctgctcgtgatttggtgggcggaagacgcctacagtaaaaaagcgctcgcgattcggcagtacaacgtctcctgcccacccgagccgcactgtcccgtcccgtccccgggtcaaccacctcccccgcgcgcaccacgacgttggaccttgcgtgttggtgttggcggtggtggtggattgggctggttggcttccacgatggcggcacgcggtgcaggtcaaggaggccggggtccgaggattcaacggctgctcgcccgtctcgcgcctcacacgcacgcgcgcccgtgcgctgcgtcggaaacgtggccgtgtggccgagacacagccacacagggggcgggttcccttgccggagtcccgcgcgcgcgccgctcgggctacctacctaggcgggggcggcaacgagcgattgcgtgcgggccgcggcgaggttttgcaggagggcgggcgggggcgcggggcgacgtgccgtggtacggccgtgcccgtgcgtgctggcggccgctgcgcctttgaccgttggtctgtgccgcgccgcgccagcttggtcgctggggcctgcacagctgcactgtcactcatgcgagcggcatgcgatggttgactagcacgaatcgtgcgggtgttgcaatcggagaagcagacaagaaccggcgctttgcgtgggaaattcgtccccagggattcatggacacgtcgaagatgtatagtaggtcggccgtcaaccgaggcacggcttgatgacaaactagagacaagttgcttgctcaggtgagagtgtgataaacaataaggtcgtcgctgactgcactttgtatgcgtgtactaggggttcagcctctcagaatgttttgctacaacacgtgattgccccttacagttagggtaaagcgttgagttcgttctaatcaatctgcatgcctctatgtgcacttgtgcattggtgaaagtgataaactgagctggatactaggaactccgggagagtttgccagggtgttggacaggaacgcgtgcaaggaggtgccgctgttcccgaggagcaaaagaaaggctcacattgctgctggtgcccgcttggcaagcaaagtagagagcgaggcacacacgcacgcacgacggcgcgagacggtccggaaacgctgcgggggcgcgtggttcatgtgggctcggccggtcaagggagagccgaggcaatccagctcgtcgcgctgcctgcctgactcctcgtcatgaggtcgcctcctcccgtgtttccctcgtacgggaaactcgatccggtggtcgccagcggtggcttccatgaatccatgctcctgtcttcgtggcggcccgcggttttccgatattgcagcaattgaaatgcctcgtgcagcgagggcccgagcgtaactacagggtatcagcaatagggaacggccgaacggggaggcaggggccgagcaaaaattcaaagtccacactccactacgggcccaattcaagaaggccaccactgttttaggtcgactgagccacctagttgccactcgactcatgggctagagccctaaagaaaacgggaacatcgtctacgtcgcaaaaaaaagtacaccaaatgtcccttatcttctcactaaattacaaaatcgtctctcaaccgaaaaactagatatatgacatccttaaacttacaaaaccggatcactttaggtccttaggtggttttaaacccggttttatccaacgtgagccccacatatcagcgactatttcccctccccctctctcttcctctttcactctcctctatctctctttctctctctctctccctctccactctttctcctcgccgcaaagcttgtggcgaagacaggtggcaatggcgctcggtggccaacgttgcggagacggtgtgcggcagccgccggtgagcgccgtggccgcctttccaccacgaacccgctgctgtagccttttcaccgactagcgggggcgtgggcaactgcggtgtcaccgacgcagcagggaggagggccggcggagaccgttggcggcaagtgaagaggagctgagcgacggcggcgtggcatcaacaacgcaacaaggaggaggggctgacggagagaagcctaccggcggcggcggtggcgtctctgacatggcggggaggatcactagtgaggcaggcgcaactggctccctgccactcctatccccgcttccccgccaaccggctctcgagctcccaattcacaggctcggtgccgctgccgctgacgtcgagctcatctctgtcggccgccattcttccacaatgccatgttgtcgccgcgcaggtgctgagcttcctctagtcttctctcccctcaaactgtccgcactaccgccgccaccggcgttcttgggagccacccgccgccggcccacagccgccagagtcgcgcgcccttctctgcccttcctccccgcacacaagaatgagaggaagaagagagaaaagaaataagaagtgatctgacaagtgggtcccacctttttgttattttattttttttggatcgaataaccacataagcgctaggtcaatacacgtgggatgaagacttaatcaaaggaggcgccacgtcaattaaaacaggcgacaatatcactgagggacctcgtttgcactggttttgtaagttgagggatatgttgtatctggttttttattgagagacgattttgtaattcggtggcaagatgggacctccggtatactttttcctctacgtcgcatcatgacatgtcgcaacgtggtgtgaaccggtgagcgtgcgtcctgtggcgaccgccgatccgtgagaatgcgcatcgcggggtcacgcctcgcgggcttttccttggcggctacaggctactgctgcgtaaacacgataggtggctccaggtctatttggtttccacacatcgaatgtttggatactaatttaaagtattaaacatacactaattacaaaacccatttcataaccttggactaattcgcgagacgaatcttttgagtctaattacgctatgattttgacaatgcgatgctacagtaaacttttgataattatggattaagtaggcttaaaaaattcgtttcgcggattagctctcatttatgaaattagtttttttattagtctatatttaatactccaaattagcgtccaaacatccgatgtgacatgggctaaaaagtttttgccccatctaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctaaactctcaatgttcatcgactcatgcacacaattgtagactgtagtacatgtttcaggcatttttcggatgacatttttcacaggccctatgacgaaaatgctaatgcgcgactgaccgcgcgcgcgccctcccgcgcggcgaggcacgtggcgcgcgtggagagggccgcggtggcggcagcgcgcagggtggggcccgcgcgattttttttcctttttcctgtttcgttttttctttctcgttttttgcagttttcctttttttttccttttcggtttttcataacatatacgtatacaaacttttatacaaacgtctacaaagtttgtatacatacgtataaaaactttgtatacgctatatataaagtttgtatacacgtatgtatataaagtttgtatacttgtatatgtatacacatgatgtgttttatggttttttcaattttttaatatgtacgtatacaaagtttgcacatgttgtatacaaagtttgtatatgtgtatattttttatacataaaaaatatatacatataaaaaccaaaaaacacagtagtactaatagtagtataacagtagtactagtagtattattatagcagtagtagtagtactgtagtactactagtactagggggcaccgcgcgggggcagcggcacgcggtcagtcgcgcattagcgctccccgccctatgatgttgcttcctgtgctggcccatgctgcatagcatttttaggctttacttgggccgaaacaaatcacagtccatattaagatggaaaaggcccagtttcactcccctcaactataggtcaaatattgttcagattcctcaatgataaaaccgtgtataacgtgtccttcaactattaaaatccgtgaaaaatgactccctccgttgtattaatatggttttcgatgacgtgatatctacatggtgcattgacctagttttcattttacatgactcttgtatcttgtatggataatggtcaaagttgatgaagacatcatgctcgccccaacgcgaccccatcgagtttgagctccatgaaaagagaggcagcggaggtggcgatcgatgagccatatcgagatcaaactcacctacccatccacatggaggcaacgccctgggtcgttgccaccatccatctttgtctttacctattggaccactagaacatgtcgtccttcaggccaactttgtcttcctttgtttcgactggtccagtttcgtcctctctctaaatcgacaaggagatgaagagcagaagaggcattctgtcggtcgttgctcctctaccatggatggaaagggagtaaggaggaggaagaaatggatgataacaatgcttgccaacagggaattggagtccaccttaacatccgatttgtgtgtgcccgccactgccctgctgcctcacctcaacctctcattgccgttctgccgtcaagaaaataagggatagcggaaggggtagggaaggaaggagagaggaggacatgtgggctccactccatttcttaatttatgtgatgattgacatttcatgtggatgctatgtctgcgagaaacaccatcaatattaccgaccaagtcgttcttcactgatattaatagtttgagaagtgttatatcggttccagggatacaatcagattcaacgttgaggcaggcgcattaaaccttttcccattaagatggcgctgcctacgcagctgggcttctgcgtggtgtaaggcgtgtaggccttgattgggccgaagcaaatctcaccgtaacatgttagccacagaatgcatccccatcccaagcctctcagggcgcaggctccggcgaacccaaccctagtccggtagcccccgacgccgccccaccgcgccgacgccgcgcatcctccccgcggccctcggaggcatctcctcgcccgtcgtccctcggcgcctcgccatcgccggcggtctgcctccgctgctcggcggctcgcccgacgcacccacgagtatcttccccttccctggcgtaaaagaaaatctcccgtctcgtctcctccgctctttgcgccgtctcgctgctgaacaggggaggggcggcgatctccatctgccgagcagagcaggagaggggatcctggtgagcatccacatcctctatctgattcatctctctctctcccagcgggactacttttgtctggaatttgcttgcgtgcgttcgttaaccctagcttctcttctagatctggaagaggctcttctcttaatttcagagccttaaccttaatacaagtaacagtttatttgttccccgaaaagtttgcgattcaactgaaccccatgtcccaagttggttcgcccctgacaaaaaactgtacacagaagaatgtaaaaaataggtcgcagctatgattatatggcaatgttgacatgatttctcagaatccttcaacagtggaattgttagattagttttgatgaattcccgcagaaataacgccataaacagtaaggcacgcactggcaatgagagctttggttcccacgttttgaaatcgtctactagatgcggacacttgattgcgttgtgtaaaaaacctcttttcccttctaatatatttacgtgcaatccttttgcgtgttcgcgaaaaaaaaattaatactagatgcggacacaacaatgtccacttcaatgtcgtgctttcttcttcagggatcatcatatttaatgtgaaacagtatgtacagtggtggaaactgtcaatgctgaaatgattgtcctcatgatctaatgtttagccagccagtacaaggattggatttgcactttctgttaaaagcttctagcattaattttgttaaaagctttaaccacaatattctgatttttctacaaatttggttttagttatactttggtcggttgcaagtaccaaacaggattatatgaaaaatatattgaaaatcgttgtacagaaactgatttcatagtccaggaaacaaccaaacaacgtttatgactaggcactgttttccttccttgctaaaacatgcttctcatttgtaaagttagaatatattgtattgattttgcctcaatgttttaaatagtggtaagcggtgcaatgtggtcattccaccttgtagagcttatgcggaaagtggccttttaagcggttttaaagtcgtataccaagacagattattgacatctgatccatctttatttatttatggataatgaacgtaggcttaaaggatcagtaaagaggaaagactcatgaagaaccaactaccaaagaggacccaaggatgaccaaaatttaagtcactgactcaatgtaatgaagcaaaaacataaatgcagtaaattagcaataaagatgttgtgattcacacattatatatattataggttccaaacttctgatcacaccatcatagttcatagaggatagagcaaatagcaaatactaatggcactatggcagaacacaaaagggtacctaagccataaggccaaattgcctacacggtaagcaggccacatatccgaatatgtggcccgcttaaccttgtaaatgcaccgtacagcaataatcggcaaggtctgatgacctgttacgcttatacggccgcataagcggtctgtgtggctgctttttaaaacattgttttgccttcatatttttacgagttactgcaattacttagaacttgcagaccattttttttaccaattgattcatattatctcagagaagctaaatactcctaggacttatatattctcaacttttccgatcttcacttgaccttttggctttgggctgtacttttgtaatgtgctattgccgtattatggtattagtttatttctttatttgtccatgctttctattttggaaacaatggtacatcaataaattccatagacatgctagttataacgtgatctgtacctctatatataaaacataatacttagctccttttaactttggttctaatcctacatttctccaggtcatcatttgttgaaaaatggccacagaagatacttctcacatttctggtagttctgagtcaacaattccattgctagaacagcttgctgaagtatttggcaagctgaaatctcacacagaaacatccttgcaattgcaaaacggcatcaattgggaagatatcaaagcacatttcctgaaccttgagaagtcgtacaaaagtaagtgcgatgaacttgcagagaagcagaaggcattagaagaaaagaaagctgaatcctgtaggcttattgcagagaaggaagctaatgtttctgcaaaagagcgtgctttcctgaaccagtttcaggagctaagggatacagctgtctctgccctttcagaggtgcgacaaaaatataaggtggagcttgctggtatacttgatgccaatggaagcaaagataaaaaggtaagaacctcaaccaatgacatgaatgcgttgtgtgcttcagaggagaatacaactgctagtgggctgggtgaaccatctgaagcttcacctgttgatgttaagccacgtcctgtattgaagcaactatgtgagcagatggatacagcaggccttctgaaatttctttcagaaaattggaaaaaactttctagccttcgtgatgaactttctgctgcactaagatgtgctactgaccctgcacgctttgtgcttggttccttggagggtttcttcccatctgaccatactagttcacctgggaataaacagattattctccaaggccagcgtagaagctgcattattttgatggaagctataacacctgcactagctacgaaggagccaggtgacaaccacccttggagctctgaaattagggagctggccaaggcgattgcagaagagtggaagagtaagctagctgaggttgacctcgatgcttctgatggctactcattggaagcacaggcattcctgcagcttcttacaacatttaatgttgattcggtgcttgacgaggatgaactatgcaagcttgtagttgccgtctctcgtcgcaagcagactgctgagctttgtcgctccctttgtcttaatgagagaataccaggttggtatcccctcagaatgccacaaggcgttcacatcccttaaaccagaccacagccattcctgatttattactaagccacagagctttctagggaattgaaaccttcctgctttatgtgaaaacctggtaatttgcataagtttggaaatttattatccttctgttgacaatattttgcttatattatcaaggaattggttaatagacacaggcaaattgatgcagttcaatttatacatgcctttgggctttctgagagcttccctcctgcacctctgctgaagacatatgtggaggaattaaaagattcacttggcaataatggggatggcaacgcggcttctctgaaggtatggtctttccaccatgtttgagatggggataatttcccaatgtttaggtcacagttcatccactgtactgtttcaccaaggaagtatactattaagcgtagtgcaaatggaccagcaatttgtgagtagtcatacaaacaaaacaattgaagtcaggaatcattgttgcaaggttggttattgctgcgaggattattggattgaattcatcttgcttcgcagatggaaatttactttcaacatccactgtttagtgcttatgactgtaatgcagtgcggacttgtttggttgactgtcaactgcttttctacttgatagtactattgaacattgtagattattgtatattacttcgtacttgaatgatttcatatctgtttcccaatcttcttttctggttttacatttatgtttgtatcctttttcaggatgacccaaagactcgggaactacttgcattgagggctgtaataaaatgcattgaagagtataagcttcagaaggactatcctcttggacctctccagaagcgtgttgctgagctaaaatctaagggtgagaaaaggccattggaagctgggcgccataatgcaaagaagcctcgcactttcggcaattcagctgctcgcaggccaccaaatcctgttggttcagctggtcgcagaccttcaggcccggctggtacttggcagcggccccctccaccaatgccttcctatcctgatcgatatggacatgcagatcggtaccattacactgcaccctctgcaacatatgatcctcctgcttatgcttcttacagcgaaccatacagtgcctcaaagccataccagtacacaccaggctcagtagctcctgcatcatacaactcgaatcagttcaaagtagcttatggtggacctggtgccccgccaacagcaggcggctacggaagctacaacgatgcagcagggcagtctacttcgagtagctattcgggttattctggttaccacccttcactaccaaggttataacttgcatttgctatgctacgctggttatgataaagcacaatctggctatcaatctcgttcagagttcagaccccagatgtaacctttagatatactctagtggattttgtagctgtaactggtgtagatcttgatcttccaaggctggtcgtgtgagaagccggtcgattttagagactttttttttgtcctgctacatgtatccagttgaatactgttgcgtgtacctaacctgttttgaatattctccatgttcagtcttctgtgactaactactaagattggctccattttaattcgccctctgggctctggcgcttttgagtagtagaatatttttttccccttacctttctgaactaatctcttgctttgcaaactgcaatttccttgtacagcttaagatgcaagcctttctgattactttgcagagcctacaatcttgcacgatttaaggatgcaaagatatgagctagataagcatggaacgcatgagcagaagcacgttttttaggatgatgagacgaactctttcacaaatcgcatgtctggtggcctccatgtggggcccacacgcaccccgctcgtctcgtcaacgccactctcctcttccactccaatctcactaggaaaacaaaaaaccgccacttgcgcaaaaaggaatacagctatacgcatcgggatgatctgagccaccgacaggtgggacccacgcgaggccgcccccacctgtcagccggtgccacgcccccgaggcatctcccacacagtgacaaaaaatatactaatcccggacctgcgtgaaccggccggcgacgcgagaattaccggattacccctcgccttctcctccaacaagtcgtcgccctctcgggctcgctcagctctcttccccttccttcctcctcctcggctcggcgcgacgagtcctcgccatggcgagtcgccggtcgcgtcggctcggctcgctcgtgcccttcgccgccgcggtggtcctcctcctcctcatcgcttccgccgccgccgccgccgcgggatcccccgatcgggccggccccgcgcggccgccgctggtgctcccgctcacgctcgcctaccccaacgccacccgcctccccgcctcctcggccaggcgcggcctcggcgatggacacaaccccaacgcccgcatgcgcctccacgatgatctcctcaccaacgggtcggtacagttcgttttttgccctccgctctctctctctcgataatttcccccaaatttttttttcttgggggggttgcgtggttggatctgaggctggatgtcgccgcgtgttgttcgtgctggtttaggtattacacgacgaggctgtacatcgggacgccttcgcaggagttcgcgctgatcgtggactccgggagcaccgtcacctacgttccctgcgccacctgcgagcagtgcggcaaccaccaggtcggcctggattcgtcaaattctctgcttacctgtttgaattgtgtgtgacgatcggtttaattaggattggtgatggtcgcgtgtatggatattggattcccatatgtcaaactgtcgcttgaccattcaggttggacaattgactccagtgcaaatgatacatttttgtcgggcttgggtgtgtgcatagacatttattgttccaaaattcaaagtcttggaaaatacacgtttccatttggataggttcggaagttccagctatacgatgtggataaagtgtatggtacgcaaagagcacctccacaacctgcagggtatattaaaactaaccgagcgacgatgatgtagcttctttttttctcaattgtgaatgcctcagaatttaatagaggtcaacatccaacaaagcccatgccaatcttggtcacaaccaacaagaattactatttgtttgatagccatcattttagccaaattttgcaccattttgttttcaaaccattggcgttcctggttgtcaacagttagtcgattcttctttgttttttctccatgccaaatgagtcccatgtctttcctgagtgctgacaattatcaggcaatagatttgggaagtgtattggattgtttatggcaaagcagtggaaacaatttgtattaacaccaattttcctaccaagtaaacccactgccatgtccagaatacacatctggtattgctatgcaatttgatgtttgttgctcccttatcgttctctgaattttgggctttagattcaaacgtcacatagaaaacatatccatatgaaaaggcaaatatgttactgtatttttcacttctttctgctacatacccagccttttcttgggcaactgtttgcatggttagtcaggccactgttctcttgtagtcctgtataatctgagtagtttggaaatcttccatcagttgtagattgctactattgctgataagtaatagaggagtccacaactaatgggaagcccataacctgattctaaaaagaactgttcttgtcacttgcatagttgcatctttttgacacaattgtatcattcttatcataacttgtgatttttctagattctagatggcaccattgttgtaccatcctcttattctatgtcatgtttgcagagtgaatcacctaacatcattgaggcacatgtaaaagtttaagcatttatactatttaatttatattaatgtgtgtacaaacagtgtgacaatattttggcatgatttctccaatgcgatgtatatcttacgtgataaaaaaagttaagatgtgtatttgatcatacccattgagaaaatcacctttttcccacttgaagtttcctttttaactatctagaaatcaactttctctagtatacactaaagtttggcatgttgtaggatcc

SEQ ID NO: 54436 - DNA, 1718 bp, Oryza sativa
ttactcctactttgcaacacctggttttgcatgtgtacgagccaatctgtttggcaccttttctgctatcttggttgtcgcattgcagattcttttcattttgtttttattcagctcttcattgtcattcctgaaaatggaaatctttaaaatggacactcctggaaaagtatgctggaataattatgtttttaatggataggtgacaaataaagtaaattctctgaagaaaatccgtggcccagatccaaattataaagacatctgctttgcaggtgctggaaggtaactcttgcaccatgataacaatttctaccccctttgttttcatcatcaatgttcttatcttatcactttaccttcaggaacgtctcccaattatcagaggtatttccagatgttgacatggtatttggaaatgggcagaagctttcgctttcacctgaaaactatttgttccgggtatgagaaattccaagcttagacctgttctgatgaattatgacaccccattacttttttgctttgcctgttgttgagttcatgttttgtcttctcttctttccggtttcaaaataaagcattcgaaggttgaaggggcttattgcttgggtgtgtttcagaatggaaaagatccgacaacactattagggggtaagatcttcaactcttggtctcttacgaggaacttcaagaaaatttccattggacttcttttatttatatcatctgactacactatctctactttattcgcatataacttgttactagtgtatgctgaataacatttgcacctgtactatgagtctttgaccagcttatacactcgcgtctgctggaaacttgagtagaaaaccaagtaactctctttgtagaaaatactactatataacaatggtctccttatctttttcagcataaccagctgatgcacttttcaatattttttagatataatctgaggtaacttttgtgtcagtgtagcttgttccttcatcactatggcaatttcttggctgcacttattcaatttcgtaatccaatagtttacgtgtgcaagtatgcaatgattggtgtgtaatccgaaaaccatggctgtgaaataccaacattgtttatcattttatgaatataagaatgcataaaccctctatttttttcatagataacaaacatgcaattatctgtgaacaatccaaaaacaagcatccttaagagttattcctgatttcagaaaatttgaggttagaagcaaagtgttcatggaattatcagttaaaactctaaaagtggttgagcctacaaaggaggcattctctttattaattgccggttgcaagccaacatacggtattgtaccaagaaattttttttctgccaacagtataatagaccttggctgcttgttgtatttatgcactcttttgtctctaaaaggaaagtatggtgtttttgttctcttctctatcccttaaagagtcaagcagatcaatctttagagagatttatacttttcttatattaattttgaccttttatttgatttatagacagtctacatgaatgttctaatagtttgcatggctctatgtactttgaaaccttgcccgctttgagtgtctaaagaataatgatcttactggcaggaattgttgtccgtaatactcttgtaacctatgaccgtcacaatgagaagattggcttttggaaaacta

SEQ ID NO: 54437 - DNA, 3173 bp, Oryza sativa
  unsure (1)..(3173): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaatgggcataatcaatcttaaactgataaaaattgcctgatgatatcagcgatgtaacaatgacactagttcattcaaaatgcaaatcacatctcctttatcaataaatcccgtgtatacatttccccaagggcacaacaaatcaacaatcccggcacagcaattttgaataacaatctaaacacatgacactataaaagttcccgtgtatacacttccccaagggcacaacaaatcaacaatcccggcacagcagttttgaataacaatctcaaacacaacacgaaatcatttacgtcatttcagctcttcttttctagatgaatttacagtttcagtataaattttcctacaagtcatgtaccaacaatgcaatccaaatacacccgtgttgatctgaacacatcatcaagctgttaccaggagccgagtgccattcaaaacatgcaaacaaagtgtaatgcatattggggcgataaccatagacttatcagtcatgtattgcatcgcgcgcagtccgctatccatcactgtgttgccacccttcttcgccccagcgtgcattttccacagtgcgaactcaaggaacgacctcactgtctcaaatgtaactctaccagtaacatcaagcacaaacttcctgttgcttggaactgccaatgtgctcgacactgtctcgacccacccttccccagcaccattgctgccactgccaaccgatttataattggcattggacataacatggtgagtggccttcaccatagtctccactgccccgttgcataccgaaacaagcaattctttaaccttagcatcatggcttgcattggtaaggccttggaatagctgatcataggtattgatgtggattgtcttgtcaacgaacacccccacggctgtgctcacgaacacctcaacccaattactaatcgccttctggccctttccagtggcaatcaagttgacccacttcatcggcgaggaggtctccccgggagtcgaagaggcggagtagatagcagctacgagatggcgggcgaagctcccggcgatggcagccgcaaggcgctccccggactccgagaagagcctgtcgacgaggcgatcggagagggccacgccaccgccggagccgggcccggagtcggatccgactccgcggagtatcccggcggtgatggcctccgagatcgcggagacggtcgcggagacctcgggggacgcggcgagcttggccagctgcgtgacgctgcgggggagctcgtccgagccggagcggacgaagtctgagaggtcggaggccaccaaggccgccgcgtcggcggaggccgcggcggcgtctaggaaggccgcgaccgcgccggccagccgccgaggcggcggcggcgggccgccacggccgggtggtggtagatcttgtacgccgccgaacanccgcctgccgccccgcccgccgcgaggaggatccagcgccggcggcggtgggagaaggcacaggcggctgtccatggcggcggcggctcgccggagctagggtttcggattggttcgtgtggtgcggtgcgcgtaccgtgccggtctccctctctctggttttttttcttttttttttggccctttttttttcccttcgcgtgtttttcgtggggactccggcgagcgaccggcggataatggcgatggggaattgtggggcctacacggagttggttgagtttgtggtccgcacgaagaaatctcgcgtaatccgaacgggatttgtagcccacgtgaggcctatattaaaacaggccggaactggatcatagcccacgtgcgtaccaaattaagatgggctgattgtagcatacgtgcggtctgtgtttagtaggcccggaaaggtatagtcggctacgtgcggcctatcctaagatgggccggaagttgaatgcagcccatgtttgttgggtctaaacggtgttgtaggctgtagcacacatgtttattgggtctgaaccgtcgattgtaccatacttagttcactttcaatcccttatctcgagttttaatcacatccctgaatcgcaatactagatacgtgttcctcgacttgcaaaaccaaagcaccttagggtccttaggtcctaaaacagtattgtgttcggttttcgctgacatgaagaatctattatattattaaagaaatagaaaaaagagcctccacgttcgctctcatggcctagaaattctcacattaatcggagaaaaagaaaaggcagagtgcatatagaaatacaatttagaaatagttgaaattcgtaattaaaaaataaggaatattagaagaggagactagagtccatatagaaatacaatttagaaatagttgaaattcggaattaaaaaaaaggaatactagaagtagagtatatagtccatatagaaatacaattagaaaataactgaaatttgaaattaaaaataagggatattagaagtagagtatagagtccatatataaatacaattaggaaataatagaaatttaaaattaaaaataaggaatatttgaagtagattatagattccatatagaaatacaattaagaaaaaaaattcgaaattaaaaaataaggaatattggaagtagagtatagagtccatattggaatttaaaactaactaaaatttggaataaacataataaaattaaaagtagagtttagagtccgtataaaaatatcatttacaaataactaaaattcaaaattaagaaaaacatgggaataagagtttaaagtcaatataggaatacaatttagaagtaactgaaattcgaaattaaaaattaaagaatattgaaagatgagtagagcccacgttgaaattcaattagaataataaaattcaaaaataaaaataaataatattggcacaagagcatagagtctatatagaaatacaatttccagaaaatcggcattataaaaatatattaaa

SEQ ID NO: 54438 - DNA, 4258 bp, Oryza sativa
acaccagtttacaagttgagagacacatcagttcgaatgattttaaggtggacataaagtgaacctattcctagcatacttgaggactacattcagtgggctaaacgcgattaaaacatatgtggcggtccaattagggcgcctttggaatggagagttgttttataaactagaaatgcgagcgcggcgccacgccgcgcacgctaacacttgcgtaggtagaagtgtacgtaatcaagttcagttagaccttacgctatggtatattatatgtatattaatttgattgaacaacacagtatgatatggggcttttttgtttaacagaaattgggaaagattttttttatgaagtaagggcaggtgaaaatggggcagtttgaaaaagcaaatggtaacatgtgatgtaaggacaacagagattggtcaaaaaagcagagtttagttgtaaatgggtttgataacgagaaccaataggtttattatgcagaacgtatattaaataaaattgcaacgagtaattaatatttgtctaatggtttgtgcatttatccatgatgctaatagagacaaacttagagccaacctaaggttcagctcagcctgtgaagagtacaattcaccagcctatgtacgtgttgaaaagttattttatcggtgggctattagttctgggctttacgcttaagttaactttgcctttccgggtttagatacgtatgtcaatgagtggagatgatataatgaagaggaaggtgtgtttcgtgtggaattagccgagtagatatctaaaattcttcactaaacagttgcaagggcaggtagcatgtctgtaaaacagagaatgcaacacttggcgagcatgcaaattgtttacatggattaaaaaaacgcacagttaaaatggttagtgtacaggttgcaagtaaacagagtcggcttatacggatgcattttatttgttcatagtataagttgtttatcatataatcaacaacatacttattaatgcctaatttgcttgcataaaaagaggatttgatgcagaaaatatgcttccttagctgggagatgagtcttcttgtaaactttgacactctccaccggcttctgtggcccaccaagattatataaatagtgaatagtgtactgttaccgtcataattcatgctacatgtatgacgtgtgtctcatgaaacatggagaggcccggtacgtgtcagtgaattgtttacgaccctatagcctcgttgcagttgcttatatatatgaccgtgtttagttccaaaatattactactgctactactattgaagtagtatcaatagctaaagcagtagtgaactctgtagcgttctatatccatatagacgacgactactactgctactactatcgaagtagtatcaatgtatcgcctccggaaaaaagagggttgctgccatttctttggtttcttctccccctgatcccctcctccggagaatcttctgatttagtataacaagttaattacaaggcaatgaaatagagttaattccctgttagcaatatcttacccgaggcgacaattcacctggtaggtaaaatagggactaaagatcaatcaaatagaagtcttgttcaagcttttaaacaacctttaataaggccagtcccttaaaaacggaaatgaaacagacatgtgaaacaatgaggatgcaaaggagccatttcaacaaaggtacaccaatgagctccttccacttcaacaaagcaaaaaaaaaaaaggaatctttcagatagcaaagaaacaaaaaaaaactccttggaggaggatcacaacatgaactggatcagtagttcatccatttttttgtaggaagtaaacaaattcagctagagcatacaacatagttctgaattttcttacacgtcgtactatattatccccaaaattaagcatagtaagcacgtactaaacacatctatacagtaggtaggctcgggttaaagatgtaccagtggatagcaaacattctatatatgctacagagctcgcctatgtcactctttcatcctcttcttgtcaaacatttgtaggctaaaaaataaacaaaaaaaacactgcattattgttacgtctaatatagacgaatctttggatcacctctagatcgaacaattatttaggcacaccatggataacaatcatttaggcagaactcatagaagttttttaaaaaatgtaactcttcaaattttgtatatcatgttaagtgcctcttgagaaaaataaaagatagagcctaaatacctgcagtgaaagtaaatagtactgcattgttttgcattactatcagatgcatgataatacgttatgtatatgtgtcttagtttggccatgtgacctaaatgaccctcgtttagcctatcttctaaaaataagcaaatcttataccctacagttttgtaagtagtggaattagaatacatcgcaatatagtcatatagtttacttcagcatctaattaatggatggcttaatctggcacatactctggtaagtacagtattcttccttgattatataaaggttgttccattatgcaagaaaggaagcaaaacaaataaatacatagacttgcaattcctaaatatagttgaagcagagtatgcacaaccaaggcaaacaattgaacactactattgctattgctccattgtcaaccaatttgtccagaacatttcacagccagacacacaaaaggcaaaccagtttgatagtatatccctgcatgcttttgctcaccttctgttttgggaaccagaccttgatcttctgcttgggctcgatgttggcgaggatggataactcgcagagtaactgctggcggcgagagaatctgggcttggggcactcggcgtacacccgctccagcgcctccacctgacccggcgtgtagtgcacgtacttgccggagtccatcccggccttgtcgtacccgctgccgtcactgccgctgccgctccgcatcgggcatcgccaccgctgccgccatcctccactccggccaccaccaccaccaaagtttcccccttcgccaccttcaacacaacaacaacctgagagatttcgagcaaaagtgaaatcatccggagaggatgaggagaaaaaataacctgacatgtgagagggggaaacgaaagaaagaaagaagaaagagaaggaagggagaaatcgatagatggttgtgcgattgcaagcttgcttcctcctctcctctccgtcaggggatgcgtcgacctcggcggcgacggtcatggtgttccacgtagagaggagaggtcgagagttgagaggggaacggttgggaagctgcggaggagaggacggagaggcaacgcggcgacgggggaagacgtacggcagtcctgcgcaggcggccggtccgacgccgccatgagggaagggcatcggcggcagacgcgcagccggctctgccgccaacgtaggtaccctcgccactgccgccacaagggaagggagggggcacgacggcggatccgccggcgtcgggcgccggatctgccctccccccgccaccaccgccgccgccggcctaagtggagggagaacaaggagggaaggagaaccggtggcggattcagcgggcgtccctccacccgccgccgccgtcaccacaagtggatggagaaggaggaggggagcaccggcggcagctcgggcgggtgccgcctcctccctccccccgtggacgcaaccacaaggtcgaggaggccatcatggtagaggagggcagcacaggaggcatggtggagggcggcaatgttgtcgtccccttgctccgtcgtctttgtaaacgccggcgccgtccttgcccccggccgggaggaggaggccgcatggattggccggggatggggatggcggattggccgggaggaggattgggcagagagatgttgcgtgttggggatgggttggcagcagagaaagaggagggattggattaggatctgtttttttagaatgccctcgtactttttgggattacagcgctgtccctaaaatccgaattttctcttcttcacattgtatttcatataaaggtaaggcttttttagtaaaaattagaataaggatgaatctccaggaggactgcttcgttgtttcctagaggattgagagtttttttgaaaaaacgcatagagcatacgtgccttgcatgcacggcataaacatccaacacccggt

SEQ ID NO: 54439 - DNA, 3799 bp, Oryza sativa
tatcagctatccaaacactttgtaaatttctgtcttttctatgtctgccggatttatttgacatctcacttctacaaattttcctatttacgtatttctaaaatccaccccctatgtttcaaatgagccattgggcagccgacgtttggctcatatttagatgttgccgttgactaatgatgaagccgaactagtgtactttgactaatgataggtgcattccagaatgaagtccactgctccactgtgctacataaatttagctacagtttggccgttaattttctacaatttggcacttaattggattaggcgtactcaattggcaagctgcagtcctgctttcaattcagacgtggccataccaagctggtggcgctgttttttgtttaacgaactggtgtatgcttacgtgggggatttggatagatgagtgcgtaacgtgacaggtgaattattaaaccatacgctaaaagggaaaaaaaaactaagttaagctaacttttgcgtgacatatagcaattccgaaaatactattcagtttcttgcatttgcccctgttttgcagcagcaaaaatagcaattacgactcacgaattctcaacaaaaatcatatttacaaacgcaaaatcccaaagtttgaatggctactagacctccagagaagaccattaatggcgatgaacaccgtcgcgagcacgaccggcgggcagcagctcaggccaaggccgccaccttcctgtgacagtgagcgatcctcccgccgacgccgccgacgcagctctggctcctggggtagtgcatcacgccggcgtcgccgaactcctcgcacggcgcgtcctcgtcgatccgcgccatggagatccccgacgccatgctctggctcctggccacggcccgcgcctcccgctcctgctccgcggcgcgcctctgcgacgccgcgcggatcagctcccggaggtcgtcgtcggcgccgccgccgaaccgcgagtccgacccgaagctgttgctcctcatcgaggcggcggcggaggacggcacgaacaccgggtagccgaacgcggcgtccgccggcacgcagcgcgcgcaccccgtcatcccccgcacgtacatgtcccgcgccctccccagcgccctcgccggcgccctccacagccagctcagcctgctcctccccctgctcatggtggtgtttgggttgggttgggttgaagacgatggaatttggttggagacgtggagctctcaccggtggagggtagggctgcctcttatacaatggccttgtttatggatggggaaaaaatttggattttgtgttacatcggatatacggatacacatttaaaatattaaacgtagtttaataacaaaataaatcatagattctgccaggtaactgcgagatgaatttattaaacctaattaatatgttattagcaaatgtttattgtaacgtcacattgtcaaatcatgacgcaattaagcttaaaagattcgtttcgtaatttacacgtaaattatgtaattgattttttttcacatttaatattctatgtatatgtctaaacatttaatgtgatgagtgaaaaaatttttgttttgtgaaaacagggtcaaaacaacggtgggtgcggaagaagagaagaggagacgggacgggaggggcgtcggcggcggtgggcgaaaactgcgtaggaaaggggagaattgagaaagacctgtgtgcgcgcgcgcgcccaccactcactctcgtgctcctgttatccttctagatggcggcgcgtgagtcacagagtcagagacaactgtgtgacgtggcatccggtacacagttcgtgacagaattttacatgccctggtcggacggaggaaggttggattgggttgctgattggttttacagttgttgttactgctagccttgaaagtttcagtggaattagtacacacaaatcatcatcagtttcatcgcactactgtgcagtagaggagttgctatcatggctggaccgctggagcgggccgtcgccttttacaaatattttcatcctgcgtggtgcgccaactggtagtaaaatatagaaatactaccaatctcgctttttttgttagaaaacgggattcctgcttgcttgtttaaatcttggcaggcagcaaacctatccatcagcctcgacaaggaaatttgaagaaactactcgatgccgtacgtaccttcatttcaaaatcataaaataatattgtgctacaagtgataacaaaataaataatatttaataagataaataattaaacgctgtaggaaaatctaccacgtcatatagtattttggaatagaaaactcatcacttcagttgattcagttgggcaaacgcgcgcgagtgccgcgcgccgccggtggcgacggagccgcggtgagcgaacgcccgcccgacgacgctcgaaaccggcggcgcgggttccagccccaagagccgcgtaggagcacgtctctgcagtccaaagacacaacgtggcaatggaagcttcgatgcgatcagaggttcggtttgaattcgatacgtgcaattttagtacttacttccgttctaaaataagtgtatctataaatatccgtatttagcgtttttactatccgtcttatttgaaaaatttataaaaaatattaaaaaaattagtcacaaataaagtactatttatgttttatcatataataacaataaaaatactaattataatttttttttaaataagacaaacggtcaaacgttaaatatgaatagtgctaaaactacacttattttgggacggtagtagtagcacgtaaaactgcgtaggacggctttttttggttctggatgacggcggagtcgccggggtgagtcaccgccgtgctgtcggttggttcaacgaagcgtgagatcgacaggatgcagcagcagctgaatgatttgcaggggcgcaggcacctttcagctgacgggagcgtcattaactgttgaaccggcgtggactggtgactggtacgatgacagagacggccgtgtttatgtgcttccgtagctcgatcggattgacaggaggggatttcttgactttctcgataatactggacgtttctgctggagacagtttttcttccgatcaattcagacggaagaacaccatgcataagcccccgtcgctcacacggatgcgctagttccatttacaattttttttataacactgactcacctaatacctgttcaaaattcgaaatataataaggttttgtattgttcggtcatgacgatgtccaactcattccatcaaggggggtacaccttttgaaatggacagaatcacacacttcctagtggctaaactttccccaaaacttgtggtgaccaaattgatcgaaaagaaatgagagccaagttacaccttttctcgggaaaagtataattaatgggatggtgtagttctgtatgcatgacttcacccaccaggattttaatattgatgcctacaaatattgcgcacatgtaggtgtgattctaacatgtaattagtgagattagagatgtaccgcaggtttttatatccctctgagtatatgttaggagcgtattcacaggggtgtgaatgtggtgttacttatgtagtggtgtacgctcgcgtatgtgactgcgtataatataaaaagagttacacattttcccattttcattatacgcagacacatatgcgaagaaatactcttttcgtaagaagaaaggcaagaaacaggggcggagggctcgctagggcaagg

SEQ ID NO: 54440 - DNA, 2171 bp, Oryza sativa
accccaccgccttcaggtcccaccactgtcaccgcctccccctcccagcggccgtgccgccgcgcaggagggtccatgtctcctgcgacgcgcggaggacgggcggcggtgtcggtggcggtggggtgaagcgctaggccatacctgctggaaccggcaaggccaagaagcaggtcgtgttcttagacgccgcgccaccggtctcgcagcggggcggcggcggcggcggggagggggagggggagggggagggggaggggaaggtggcgaggaggaaggagaacgccgcgttggggttggttaggaggttgacgaagaggacgctgtcgctgctctccaacctcccgctcgccatctccgagatgttcgccattgccgcgctcatggccttaggtgattcgctgcttatttgatactacttcgaattcgctagcttagcttctccggaatggattgcccatttgccagtatgtgattgctgtttttttttattcatgattgtgattgcaatttgcaatttgcgatttgcaattgcaggcacggtgattgatcaaggggaggcgccgagctactacttcgagaagttccccgaggacaacccggtgttcgggttcatcacgtggaggtggatcctcactcccgggttcgatcacatgttctcctcgccggtgttcctcggcctcctcgcgctgctcgcggcgtcgctcatggcctgcacttacaccactcaaatccccattgtcaaggttgccagaaggtagaaatggccattttctgatgtgcaggttttctcttcttgataatgatagtttgtctgatcagaattcagaacatgagttatacttgtagataattgcaagcgctgatcaattgtttcttgcagatggtcgttcatgcattcagcaggaagcatccggaagcaagaatttgcggagtcacttccccgcgcatccatccaggatttaggagttatattgatgggttatggatatgaggtgattttagtcacattctgtgcatttcatttgctccgatatgcatttaaatcatgtgtgtttgatgtgtgtttcaggtattcactaagggtccatctctgtatgctttcaaaggactggctggtcggtttgcgcctatcggtgtgcacatagctatgattttcatcatggcaggtgccacgcttagcgcaacagggagctttaaaggatcggtggatgtaccccaagggttgaactttgtaatcggagatgtgatgaaacctaaaggagttctctcttttgtgcctgatgtttttaatactgaagtccatgtcaatcggttctacatggagtactatgatagtggagaggtagtcaattttgcccagcatttcatatgcttgtgtgatgtcagatttacatgtggcaaatatttttggctttccaggtttcacaattctatagcgatctttcacttttcgaccttgatggcaaagaggtcatgaggaagactatcaaagtgaacgaccccttgaggtatggtggggtcacaatctaccaaaccgattggggattttcagcattgcaagtaaagaaaaatggtgaaggtcctttcaatttggccatggcccccttgaaattgaatggtgataagaagttatttggaacattgttgccacttgaaaactccggttcttccaatgtcaaaggaatgtaagttttaacacttcccctgtttggagctaaatgataaactggacacattccctataagctattaacttcttctcttgatggcttgtagatcgatgcttgctcgagatctgcagtctattgtgttgtatgatcaagagggtaagtttgtgggggttcgtcggccaagctcaaaactaccgattgaaatagatggtaacgaaatagttattgaagatgccatcggtagcaccggtctcgatcttaaggtcagtgctcctgataaattgttttgaatttgcagaaattttgtacatgtttgatatatcattaaacgtgccttgtatttatttcccttgccatcagactgatccaggaattcctattgtgtatgctggatttggtgcactcatgttaacgacctgcattagttatctttcacattctcaggtgtgtgcatatggcacttcctatgattatttttgaaatataagtattgtaaaa

SEQ ID NO: 54441 - DNA, 2644 bp, Oryza sativa
ccgccccaccaccgccgcccgttcgtcgtcgtcggggagaaggcagggcgagctgcacaggatcttccagcacttcgacagggacaacgacggcaagatctccggcgccgagctgagcgcgttcttcgcgtccatgggcgacgagatgccggcgccgtcgccgggcggcggcggcgccgccgccggctacatgctcgacttcgccggattcgttgccctgatggagagaggtgacagccaagaagaggacctgaggagcgccttcgaggtgttcaacgccgtcgagtccgccggccggatcacggcgaggggcctgcagagggtgctcgcgcagctcggtgacgagcggtcggtcgccgactgcgaggccatgatcagggcctacgacgtcgacggcgacggcggcctcgacttccatgagttccagaggatgatgagctaagtccatggaatgcctcagcttgaagctgctacagcgagtgagtgactcagcgaggtgtttttcagtttcagagtcctgagaaaattatactgctactataggttgttgataagtctgctgcatccagatgacacattgcagattgtttacagggcagaagagttcttcagagctcttttgcttgcctggagcaaatttgttgttgtcatcttgagttgtttggtgtgccacacacttaatccagtgtatcagtaaagttacagttgatttccttctttcaaaagaaaagaaacagttacagttgatttcttggcttcacctgtatttgttcaggaataaatcgtcgagatcgtgcacccttttcttattatccaaaaacactgaaatattctaaaatatagccggatagatccaatatattcttaaaatagacaatttgcacacactcctcccccccccccccccaaaaaaaaaaaacaccaaaaaaattcaatatgccaaccaccacagttaaatttattagatttgttacaaaaatattggtattaactcctagaggatagccagtgagctaaaaagaaaacaaaagaacagacaaacaacaaatagataggacagacaaataacaatttttttttcaatcactcactccgctcacccttttgagttttgattggttatgcaataccatttgaaatacaatgagaccatggtttcatcatctggaaatgacagataacaatatgccgacataacaaggaaatgtaccaactttattttcacatagtataattcgattgggtaactgtaaattaagtaaaattcaaatatgaaggttgtttttctttcaaattttagagggcacatctcagggaaatctttacagttgcattgtaaacattgagtttgtacatgaatccatattacagtaaaaaaaaagctactattgcacaatgctgcaatattcattgcagtgcaacaaactgatgtcatgatagtaacaagcagataagaaattctgcaaccagaattcagagagcttcacttatatttgataaaatgaagcatcagaagcacaacgcgcacatattctcaagccttgcaagataagtactaatttacatccccattttgttttcatttcctggggttctccctaacagcaaaccgagtaagacattacccattatctaaaaagtaagacattaccactactttctcagtgatattctacatgaaaaaagatgacaattttttcttgcagtctataaccacttgagacctcaactccgacccggctgagattgattcccttgttcaacataaggccgcacgaaagtcctcttccaccacacctcaaaggccttctgcagattggggcagctatccccaaccttcaagaagctcccgagccatgaaagcaatatcgtctgctgatcctcgagcgggagtgtcaagatagtacgcccgatcccttcctcgacaactttgcggtcaaatgacctgcagccatgctgtaaccagttgtagtcatccatgagaggctgcagccagacatccaagagaagcttccttgtgtcctttgaagggagcatgtctcctttcccaattgccacaaagagccttgctgtgacgcagctgacaagatggcgcgacttggttggtaacttggagtgaagctcagccaactcaccctggttagaccacatgactgcaaactcaccagcagcattcctgtcggccaaaatctcagttaaccaaaggagattatctgcttctagagcaatttgtcgaaaaactggctctttaaggtctaaggattgctcagcaaaatcgtcggcagtcgcttgtcgaaacaaggtcaacaaggattccaggcaattctggcaagagctgtagagagtctcagcatagatatccacagatgtactggtacagctgctattctccttcagaagcttcagcaccagggatttcatttcgcggcgccctctatcctcgccgctcttcaagactaattctatgatatgcacaaatgtgtcatttggtgggcttgttaggtcagagcataccctcttcagtattgggctaacaccataattcccactttgcagatgctgaacagatgataccacattctcctcttcttccccgacccaagggacggcttccaagtactctaagcaagacgggctgcaggaa

SEQ ID NO: 54442 - DNA, 1780 bp, Oryza sativa
atggcagcctgcctggcttgattttgttccaaccccccaccaactggtatggcaagatatatttatcagttgtgggctctattcagagtttgtcaacttgtagttattaagtgacatattgaagtatatgggtatagaagacataaaagaccatatccctttgatgtaacaacatgaaacagacatgcatataatacatgcaatgcttcttttttacattaaagattattaattacaagtggtagtaaataacaatagcttctagggaatatttctgttggatagacataaaagactgacattaacgacaacttaagtagattgtatatcaaaaagcttgtagaaatttcaaaagttgtaatacagggaaggctattttgatatatgactaatactgtagtaagctagatgataagtaaaattaaattctgacagaatggtaaaagttgggaccgtacccccttttcattttgcatattagcttagagagttgaaaaaggaaaattgatgactatatggattttcagtaaactgagaaaataaacagaaccaatatttaactgcagcaaaccttcaagatccgaagaacgcgtggaacactttgcttgataagcctctgcttggcatcattgcagtacatcaatccaactgtctcaacatagatctccacatcctcacaatcaggcacctccatgcttgacattggggattgtcttgagagcttatcagcaaaccaggtactattttctgcaaggatgttcctgtgaacactcatctttacagcaacaccatccttgccatacaacacaaccttgagatcactcatctcaagttgaccaaatccaacagatatcttatgctgcttctgtggtctatcattcgctaccttcggtggattgggtgttgaattttccgctggcgcgcacttctgttcatccgaattgattctagaccttgtcggagttgaatgcgctcttctctctgatgaaatggtaggcgccctctgaaccgaagaggcctttgatgcaagaggagatgcaccccctttaggctttgcctgctgattttggttcttcattgtcttttggagcacggcctgcgacgggcagcaccagaatccttctggtgttacagcaatggggacatttctgatctttgttgctcgggcatcaaggctcccaaccttgaactctgtcatgttgccttaggaagcttacggccaatgacttgtctgatattaactgtagaactagcacttgttcatatacctgagcagcaatccataagagcaaaattagtgaactcaagttttaagcaactagctaaaatggtcatgatagtgaatgtatgtaattaaacaagaagagctgacaatttagagtatctactgtatgagcaggaagcaaaccatatagaacatacataattttcagttaagccaccttttcctaacctgcatctcagatactgcagtttctaagttaaatccaaatattaggaaattcataagcttggaacctaacatgaacgaccacaaataccaaaatttgcagagcctgaaaacaggacgctctatcttcagcgaattggaacggcgaccaatgaaaatcacaccttatagagcggccaaattcaacataattcacaactcacaagcaaacagtcctaacttttcttaataaactaacaaaggcaagaacactgaagtgcaaacaggaaaatgaccaaaggagctaacaataacatacctctgactgaagaggcactgagcacaatcctc

SEQ ID NO: 54443 - DNA, 5214 bp, Oryza sativa
cacatcatttctttctcccccacagttgaaaaaggagagagagagagagagagagagagagagagagagagagagagagagagagagagagagagagagagagagagagagagagagagagagagacgaaggcaaggcaaagaaaagaggcagcaaggggaaagcaatggaaggaaaagggcacaaagcagcttcctttgagctttaccagacgagtggtgtcctccctttaaccatccaagctaccacaccggccatcatggcgagcttctcctctctgaaatctctcttctcttagcttttctttcttcttctccagctctctcctctagcttctttgcttcttctccccctttatccctcttggctctgggtgctctctctctgtctctctgttcctgtttgtacaggcagcagcacagagcacagacgctagtggctggcgacttggctcttcttcgtcctcctctgctcgcatcagacacctcactggctaactctaacagtgccctaacttaaccaggagtaaaaaaaaaaacttatctttaccagtatatctccattggttcttgtgaagaggagctcctcctctcctctctctgtctctcaaggggtgtgacaggtggggcccgtagtcagggtgagatctactccactcttggatgctgcgatcgttctgtttttaccaccagcctcggcgcttggatcatccgagctggaagaagggtaatttatctggcagtttgtttcgccccaaaaagctttttgatcatcacatgcacgtttcgatcttaccattaccatgatggattatacatatattcacttggtttttactgaaagtaatactactggtagcacatcaagattattatttttctgttactttaagcatgtatacatggatgcatctgaataaaagaatcttgcaatcaaattaacctcgaagcatgtcggcatgttgcttcagaagaactcatcatcagcaagacacgttctttcttgcataatcttagtgtagtactattatgcatgcccaaccccctccgtaccaaaaaaaacaaaccctgatttccgtgtacaacgtttgaccgtccgtcttatttaaaaaattatataaaaaattaaaaagacaagttacgcataaaatattaatcatgttttatcatctaacaacaatgaaaatacgaattataaaaaaatttcatataagacggacagtcaaagttggacacggaaacctagagtttgctttttttttaaggacggatggagtaggtgctagcaccctggagcaaacaggatacttaactgtgagcattagggaacagtatagtacttaactgtgagagtgagcattaagaacaggtacaatagcaggctataagccagctgcaaacatattttaaggagataaataaggagagagaagggcagcgggctacagatttgtagccagctgtagcacggacttcaagacgcagtgtgtgtatgacatgtgggaccaagtattgatagtgtagtatgtaactattgtatgaatgagctattagattgactatatatagatgaattggagctagtggttggctattctattaaacttgctcttagggagaaagatttgaactttgtcttgagttgtgtgggacataatcctagtagggagcagcaggacaggacaatgacaaggcaaaaacctgcaagagaccaagaaatccaagatgccatcggagttggcaagcagccagtgtatgtactatgctggcttgtaccgtttgcttgacctgacaccagtaacatttgcttttggagtttttgagctttggtgacattcacaagcatactcctgtgaatgcatggaattcgaggtatatactctggtttcggaacacaggtccaaaaaacttgctaaaactgaggaggaattgggggtgtgcagagtggagtagaatgcaatgcacgggttgcatgtctttggaattagaatctactagtagctaggaaatgttagttttgaccgtaattttgcacggttctacaacccggtgtgtactcaaaatcagatagaattagcaattgttcgtgcgagtttgtttcgcggtttgcagatcgaaattggcattggcttgttacgagtgtcagcgtcgatgcttctgttcagttaaagatatgtggttcaaatgcgttcgagaaaaaaaaatgtggttcaaatctgtaccgctctttccctctctttttttttttaacttttctttcctttttcttttcctttccgttgttcaaattgaacagcagaaggtagcgccttgactcgatgcttttgacctctcagatcagctactatggccggtcatgttcagtgatcgtaataatttctgccctggttttcgatcgactttgtgtgtgaacacggttcgttgcagctacaaattgccatgcccttttgctttagagaaaagtcggtgatcagatcagctaatcaaagtggaaaactagctttcctctggtaagtgcagatattagagtccagttagttggggtggaacgggaccgatttgatcgacctaggttcaggaaaagcactacggagtactagctggagtattaccttggttgttggtctgaactgtatctgctcaacgttgaaccaaccaactattgatttattttccttatcctcccagagctccagtagtccagtgccattgacacgttccgtgctgcttcagtgcttggtactagcagattgtgttatgagagactatgtaacggtgtatcatggtaatggaataattgacatcaacataataggtatcgaatataatatcgagggtaccaaatatgatacaccgtagatattagatccggtacctatgtatcatgctgacatcagcattgtactttcgataacaaacatgatatcttgtatatactaggtctcgtttttagagattatgataaagttagcatggtacatgatatctggtagatatcagatctgatatttgggtatcatcttaccgttctgtgatattcaatattgtgatcgtgtttgcgcacgacatgttacttagctcgtggggtctcatcacgtttgtgcatgggcgcagcggggctggcgtagcggcgtggcgtggagtggcgtttgccgcgcgttggagaggagggggagcgcccacatgtgatgtggggcgcgcgcggcgcgggcgatggaaagcagcagccgggccgcgcccgcgcgcacggcacgggcgcacgaatgcatgattttcgcggtgcgcccgcgttggcgctttgctccccctctcgtctactacccgtcccgcgtccgcgtgtgccgcgccgcgccacgcggccggcgaggcgaggccgcaaggcgactcgaggtacgcgcgcgtgacgcgggcgctggcgctgtgggctgtgctcgatcgactttcctcgttctcgtggtcgcgaaaaaacacacgtactgacgtacgggggttttgacgcacgcgcgcgtgcttcccggccggctgcgttgtcgctcgctcgtggtttgttgggttcgtgtgcttggcgtgaaggtctctgtcaagtggcgtgccacattgtcgtggtttgttttccatccaatagtttcgtgtagacgcaacccgttggactgttagcttcgtggcaacagctaatcccatcgagtcgttgcaagtaggcacgcgcgcctttgctccatggtgatactcttgataacacgaaacgtaacagaagcccaacacagatccattgtcgtctagtccggttaggatatctggctttcacccagacgacccgggttcaaatcccggcaatggaacaattttttttgttttttttttggtttcacactcacgggcttcagtctgacgctgtacaaaggcccacttcgggatgcagtgggcttcctcagagggcccatattcacccttttcatgccgttctattcggttgcgtttggtctgccgtatggcagtggtgggatgaaaacgagaaaatggacatttagccatgttcaaaacacggtttggctataatgccatcacgaaaacacgtttcgctaaaatgccaatatgaagcgtgtgctcaccgccactttgccattttagcccttttgtgcattttcgaaatcattttcgctcctccttcggatgacaagacaaaattgcccttcatgtcctccgccgccgccgttgagggagaggagctcgtcctcgccggtcatctccatgtccaccacgagcagctcaccgtcttcctcctcgtcctcctccatggatggcgtctagagcagcgctatatgggatagcctagacggtgaggtggccggcgagtcctccgacatcttcccctccctggacctcgccacctccgccgactacctcgccgcggtcaacgacgacatctctgaggtcacttcgccgcggtcgacgatggcggctaggatttcgaagcggccccatggcctcgccggcgacggaagtgaaggggtagccccatggcctcgccagtgacggaggcgaagggggatgcgatggagaggcaacagcagctgctggcgagccttgccggcgaaggaggcggagagggacgctgtggagaggcggcagcagctgctagcgagctggagcgcaagcctccgctgccacgaggccacctcggcgaccttgcctccgcctttgtggtgccgtatggcggtggcgggcaggggcagcctccacccgcccgacctcgaggatgccgccgccgccgccgccgccgcttcgtctacaagcaccgccgagtcctccacctcgacgacctcgcctccgcctcgtcgagcatcccggccatcgacattggcacgctggtgggggtgggggttcggcatcccggccatcgtcatggccgtcaccatcgtcagcttcttcgtcggcggacagggcgtcgtcgtcggcggtgtggaggtcgtgtatctcccttcgctgcggcgttgccatgcccgcgtcgccatcgttgccgccgccgccgccatgtgttcgctcgccgcctcctccatttcagccacgtagaccacctcgccgcgctcgttgtcttcctcccatgaactggatcgatcctcttttagccggcgagcaagggcaatttggtcccatcaagctacattccaaccaaaatgcaattgaaatgcacaaaatggccaacatggccaagtgg

SEQ ID NO: 54444 - DNA, 2028 bp, Oryza sativa
tgcgtacttgatggaggttgtgcaaacttcttgttctgttactcagatgattaatctagtcttgcactcttgcatgcttaggatgctctcagggtatgccttgattggcaccatttgcttcagtgcttcacattgtcgaaaataacgaatactggttgtccactccacatagaggttttaacgatgataatgcatatagtgtctttgatcattttatcgaggattaaactattcgatgatgcagatatattaactacagtcaaaattgaatattctattaaaataattagtctcctaaactacacctaacattgatattgatcaaattacggttttgggcataagttttaaattattgtgaactatctataaattgtggtcacatagaccaaaacactagctttcaagtttacactaatggcctggaattggtgtaatggtgtgcacaagcatacaatatcttttgtgaatctctctgctcaaacattaaaaatccgcaggagtatttgcaaggaaatccaatgtggatggagtactgcaaggtacccctggtgaccctagggttcgagaacagctacgacgtcttcgtcaaagttcacgggggtggtctctcgggccaagcccaggccatttgcctcggcgtcgcccgtgcactggtgaagatcagcaccgcaaacaaagttactctgaggggagaaggtttgctgacaagagacacccgtatagttgaaaggaagaaggctggtcttaagaaggcacgcaagcgcccgcagttctcaaagcgttagagtatgcacaaccttgttgttagactcatttaaaagttttacattccacagtttgtattggcccttctctgttattttctgtgcaaattatgtgctcctcaccacagacttgtaatcttcgttctctgtaagcaattttattgaggtcacaaaaggcaattatcttgaaatcattcctgatatctgatgagaacagctgctcaactttacatcctcatatagtcacataagacaattataaaggtcttgaattctgaatgcagagtaggagtattttttatacttctttttagccaattaccatgttggaaatgcctttttgtagggaaactagatagaaaatggcggctctaccataaagatcaaatgcaaatatgcacaattctgtcaagcatgctctatcttgtccatctgtgaagttgtctcgaattgtttcaaatccaaaaagaaccataaattttgcttcctcctctcaagtcgtaagtcgtaaatggtaactgcatccgtgtcgccgaagctataaaagcgatcggaaataatcagaaacgttttccttttgttttcataaaaagggggtaaacgtatttaaaaaattcatacttataaaattaactatttagtgttaacttcaacgtgaatggtaaaactttctaaaataaaatcttatatgcgcgaatgagaggtgtataagtgttactccctccgttttaggttataagatgaattccttcaaattgaccaagtttatagaaaaactagtaatattttcgatccaagataaatttattataaaactatgattaattattaatttaataaaattaatttggtaatgtaaatattattatatttgtctataaactttattaaacttggagcagtttgactttaatcaaaatcaaaacatcttataacctgaaacgaagggagtatttatcaagagagttgttgattatgtttagccatgtggctttaaagtggggtctaagaataagtttaaactaaaatgataaattgaacaactaatatgaacatattaaaacgtataaactgagccactttagatattcaaaaaaaaatccgttgcttttttcacccctactcaaaacgacagatccgtacaaagcccgaccgagccattccgactcgcgctgggcgaaaccggttagccccagccgctcgagcccaccaccggaggcggcccgtctggttctccccggagccccgagctccgctccgt

SEQ ID NO: 54445 - DNA, 2943 bp, Oryza sativa
catggattcagcaggcagttcaaaaggttgacctatttgggaatctccggatctatgcttattttcaactccccgaagcatttcgtcgcttgctacgcccttcctcgtctctgggtacctaggtatccaccgcaagcctttcctcttttgaacctcgccattaacgttaaggctatgccatcctaaggtgctactaaatggaaggatcttatcaacgtccatgaatgcgaaatcatagatcgaactgccgaattggcaaaattcggtgctatcatagtatccgctaagttcacgggctggagataagcggactcgaaccgctgacatccgccacagggtaaaccaccgcctctcaggcctccccgacgggttctaccatagaggccaacgatagacaataactcccccccgaacacagcttacaactttcatcgttgtttttggtgaattatcagtgtgcagatgaatttcatccactgctattgaagaagcttttagagggatatcttgtcttgtcggactaagagctcttatctctttcttttcccacggtaactagagattgaataatagaagcctgattcaataatagaagccagattcaatatcataagaaaatagagattgtagcgtagagtcaggctatcccatgtttgcaataacagctttgggatctttcctgttaatgatgaatagcttgcctcaacagagaatcagaattctttttattcggtataacaaccttaaaaacgaatcgatctagatgccccgctcttgccatctttgatggaattgaatcatcaactgacttacttgaggaataaaaaaatctgcagcacgggtccaataatttgatcgatacgccctgtacttttttcttcaattgtagaaaccccgggatgagaagtagtaggattggttctcataattaaaaaaaaaggaatttatagaaatttttcttttattcttgttgaataatgccaaatcaacaccaaaaaaatatccaaaaatccaacaaaagtcaaaaggaaatgaattagttaattcattattcaatgaataatttcgatacctctgagtgcatttagacttgatttcgttcaatgaaagcgaactagcgggcagaattcctctgagtgcaattcccaagcaaggtcacccacttaagtatggtaccgcgcttccctgtacatatagaatccttcctttgcctgaaacaattccaccaaccaaatcaagccagccgggtatcctaggagacaggggaaaaagcactttacaaatcactcgctgggtcgggggatgcttataagaaatcagtagctggggttgtgcttgttgttcattccttcactctggaagtacgcactcattatagcaaaacaacccactaaactccctgctgttcactccattccctactagattatttgagacagtagctgtgaactactcccctccctctttgagagggacgaaaagactctttccattcttcaagctactaacttccactaatacattcaagcacgaagtttcctccaactattggtaatagttgcatcgagatattcgtagagactagctatagactttgtgagtcagtgtgctcattaattacccaattaattcaccaggacagtaaggatggagctgctcattccacgattgacaaagctagaacgagctctctcttacttagaaagagtctcacatacctggtagaagtgtgcattttacctatacccatacctcttctatctatgctccaagcatgatagcaattgcattaagctattggtgcttctttctcacccggcccgagatgggtgttgaaggcacgtgtagtttaacaacttccttacgttgacgcatatcatcatggggaatcgagtgagttcttcggatcgacggacaagaggaccttttcattcatctcacctatcctacgcagatttataatctaattaaagaaaagaaactcttgcttttagaaatgaatttcacatttctctacgcaagccaaggaatctgtctacaactggtacttcacatgccttagaagtagatttgaatgagaatgaatgaaatgagtaaacgttactaggaaggtgaactcgctatcaaactacagcctgcgctagtggctcaatccgttgcttgttgggttgaacatattctttttctttgacggatagcttctcggctcttgcctggcctggagttgaagaaggaactggtagcacttgaatcagaggaagatcggaatagcagacgagttgcagcttttagtattgttcacagcttggatgcctttatgccaattttcccgtgtttatggaaagcccgtctttttggcagaatatagccccactaggttcttttgttctcgaataagcagctctagaagctctcgcatgcgttagactgactacgccttctatctttctttgtattttattctaagcgtggtaaggatattgaattaatggcatggaacatatttgctagcccctatagttggatgttgctcctatctagcgagaggggtggcataggagccgtctataggtccccaaacgaggcggcaccaaggagagaccagagacaaccctgctagtgaatggactacataaccatcgagaccggtgaaagaaaaaaaattgaaaaccctagtgttccgctcttttcaaagttgccaggaaactaagagaaccggagaatcaaaacctgtgaagatgcacaagcaggtaagcctagccggagtaaatattactgtactacacgggaaaaatgcgatcaacttgagtgcaatgagatatttctccttcggtctttcaaaaactgagatatttttttccctttgatccctccaattaatacacagcgaatttcactttccatctcacaccaaaaccacggtcgcaaactgaccacggcaca

SEQ ID NO: 54446 - DNA, 6461 bp, Oryza sativa
cagttgcagataggcccaaaaggctagcgcattttgttggtgtgcgtagccaacccgcgcgcgcgcgcgtctccggtccggggagcgaggcgtacgtacgtacgtggggcgcggagtggccgcgcgcgccgttgctgcccctcgtcacgggggtagggggacgcgcggacaagcctcggcagcggggagccggacgcggagatcacgtggcggcatgggcgtcctaaggctttttgacgtatagtagaggaggtagcctgtgccattgatggatgagagtacgtaggagtactttgctaaagtagtagtagctgggttcagcgaacgctgcgcggtttcgtttctgtgcgtggattcgtcaccgtcggttacgcataggacaagctgcgtccaaggaatagaatagagtggtggagtcactctcttagctcgatcgctaacatatggattcataaattggcgtggctgcatatggaacgcagctagcaagcgtacagacttatatggaagccagcatatattagtagtatcaaacagatggatcgcgccgattgcccatgcatcatgcatgtaactcaagcgactggctagcttatccataggtctgccgcaaactcatgcacatatggtccgtggaacagaaatacagatcaggccagtccaaactccaaagttcaaagtccaaacatggggggtgtccggttggggagcaaaaactcgcgtcaagaaggacgccaaaaaaaggcgcggcacgcaccggcaccattttccaggcccatgcatgcatgcatgatgcaccgatgcgcgcagtcacgcactagacggtcgatcaatccgtgcagagcgccagagataacgtacttaaattatcccggtacaaacgactaaacgagtaaacgacgaatactaccctacgacgcccaggccacggagtgtacagaccgccaccggcgtccgcattcggtttttggctagcactcgcagcagaggcccgggttgttgggtcactgcgcgcgtggcgccgtgcatgcgcgcgacgaaacgatcggtggtgatcgacccatcatctgccttgtcccaaccgggcgccggccacgtacgtatatacgcccccaccccgttggcgcacgacgcacgcgcacatgccgcccggcacgcagggccgcggtgcccggctcgcggggcgccacccgcgccgcacgactgcccacccggtcccttcccctgccggccggcccaaccaatcccccgtgcccgcgcgcaccaaaccgaccatcccgacggcgaatcgcgtggtgtgtcgcgcgcgcgcgcggctagctctcggacgatcgcgctcgcggagtcgcgggggttcggccagtttccgcgaacgttcgctcggcggagggcggagagtagatcctgtccaccgttgcgtggaccggaggcgggccgcgggggaggcaggcggaatcttggggcggccagtcggcacgcacgtctcaacgtggcccagatgcgatccgggggggaggactagtttactcgcggccgtacggtgccgcacctgtacgcttgtactcctacgtgactgaacgaccaggaaacggaatgtgttgttggcctttggttctgaggagagaacggccggggaagctgcagagatcgagtcgatttggatcgccgacgcccgttgatccgtagagaacgatcggttgaaattggtagaggaagaagcacggaaattacaacagcacatgtacagctagaggagagtaggagacagggttttttttcttggttgacccttcatacaaatgccgtgcaaaatattcacaaaacccaaccctgcatcaagctagagtatttaaaccgttcccgtccaatgctcaatacgactatgtacatatttctcgtacaaatcacattgaaaaaaacaaatctagaattgaatgtggcacattctaatataatgaatatagatagagatatattcaaattcgtagtattatgatgtgtcacatataacactaatttgattttttatgggactggagagagcaggtaatactccagtattggtcaagttcctttctgtactgaggtgtacacttggaactaacagactggctgcctgcctgcatgcgaacaaggaactagcaagccgctccgctagctagttgcaaacgattttggactactcattggattgcgtctgctctgttttcatgatgtttgagaggccacttgcgttctcagatgcggccaaattcggttgctctcgtgaacgctcgtaccgttgtccgccaggtgctcgccggccggccggcctccattaactctgaactgacctgtgccccctctcgccctggtcacaaacgtgttgcacagttgcacgcaataatgtccaaaatgcatcattgcacacacaaacatttcgcaaaagaacatacagtagtttacatcactgtaaacatgttcgtaagctcttgcaaagagtcaacaaaaatctgtcatccatgatctgacaagcacccgatctagaaaataagcttgggcaagtacacagccctaaacatcatcatcattgtactactagttaacgtgcaaccaaaccgaagttgtgaactgcagtagtactgtagtagttatccagctaaagcaggctgtggtgcgtgcaaaccagtcaatccaacccctagattttggatgcatcgaaccgtccaagaacgagacagtctggtcccaggggcagcaacatgcaaccatttgttcttgttgcattgcaaaaccgaattcaattataatcgcttttcttgcagaattcatagcacaggctggaaaaggccggccagattgggaggcagccgtgacacatagattcagagaatgcctctcgaccagaaaggagaaccacgtgttgtattccctgaattccgatctgatcctgtcgtaacatggcgctcataatgcgttcgtaagttccagttgcaatggcactcgagtagacaggaagcatttttggccctagcagggtgtatttgccgggaaccagcatgagccaataattagtagggatggataaactgaacaagaaggttggccgactctgccttttagttttagtgtgattactgattaggttggtgattctcgaatcatttttatgtgttaaatatcagtagtatatcctgaaaaatgatggtgagcattagactatatgaagcacagagatttcactttatacctacaatatatatgcatcctttaaagtacatcatagaatatgctgtccatttttctgaacacgtttcaagattaaaagaaacaagaagctccgggcctagggaaccatgaagtaacccactattttttttagtgaatatcgaattctaaatttagaagtgtaatcagggtaagcttatgcctcatcctggttgggaaggttatggtagtttcagtcattggaattactctgttcctatatatatagtccttatcctttttgttattgcgttatgatagagggaaagagaaaagaaataatagaaattgggccatgtttcccgagagaggctgccttctctcaggtcagcagttttataattatagttgactgctcaatgacgatctgaccgctctactcactcgtctacgctccgaccattcagtcaaaatcgaaaaaaaaaaatgtttccttgaaaaagtctaagaaatagtagtagtagtcaagaagtgcacttttcgatttatagggatccctatctttatctctatccacgatgcctatcttctgttttatattgatagaaggttgctgaacagagaacatgcacggatcgatccaccagaagaagaatctggcccgtgcgtaggtctaatacaggcccatgcagatgattactatagatgggccacttagcgcgaagaaccgaaggcctgatgttttgggcctatatggcccttcagcaaatttggcccatgaaatctagatattttattccaccaggagtcatgcaaagagatccctggagtagtttggattgctaccaattgtaggctgtagcgatcaggattttttatattttagccctcgtgtttctctccctcccctactgcctctcttccgccggcggcgagccggcgacggctcacggctgccttccgcggcgtcgccgaacggcagtcttatcgccgtgccgcttctctgaatctccgcccatcacctcctttccttaagcgggaagcactacgtctccgagtagagggcgcggggaagcgcccatggtcgccacgccgtcgcggtctccatcggccacggcaatgaacgttgctgctatggccaccggagcctggtactgaagcgcaccattgaactgacgaggtgatccgtgatcagcgcctcaagagccttccctggtttggcggatgaatctctggcgggtgcattctgggcccgcaacttgctcgacgaaatgccgaccacgtgtttcattcctctgtggctctgtctgacgcaacatggttaccaagatcaagccgttggcaccaattagagccgaaatgatcgaggtaatatttcagtttctttgccaggttcatcgtgactttatttctaatcaatttagaagactagatcagattaacatagatggacaagaactgcattgtggatttgtggtaggttcagaaattgatgatcatgtattcatgtggagtgtaacttcaccactcttcattcagacccacaatgactaaaattacaaaataaatagactttccaagctatagtgctatgcacatacggtatccaaatccatgactgattgtggagtcatactggagttagggcgtaatccagaatcagcaatcagcagtggtcaccgggaggcgatgaaccagaggttgaagagtgaggaagcggccgttaggaaccaggacaagaaagccatcatcgccgacagctgatacctcccacagaatctgggagagcagtgagatccatggaattggagcagaagatcgatgaccgccgcacttgagctggcagctgctagtgaaagtattgccaggacctgaaaaagattgcacgcaaagttcttgatctctatctgatttttacaagagagggtgaaatataaagcttaatgagaaccacaaggagatgtgctctttctacatacccagtctccgatgacgacaatgaccatgacacctggtacccgaagagggcaccctacaagtatggagtacacgtcgatcatggcgagtgtacagctccaggggatcaccaagcccattattgtaactaggaagctaccaagtttacaacaaattcagcataagtaactagaggacatgaagagtttcaagggatggagcctgcagcagtagcattgagcagagtgggttgaatttggttgtgctgccaatttgattgcagaggtatgtaaggagttaaggacaaatttgcatcataaaaccagatggctgatcagctaaacatgtctagtgatcactggggatatggcttaaacctctagaactatggccatgcagtccatgtctgaacaaaagtaggagaaatccaaacggtggcacgctcaggcgagcacttaccagaaggcagtatagctgaagaactcgacgccgacggacatgaacagcagggacgccgacgagaagacggcctgcccgacgcggaggccgaggctgccggcgctcccgacggcgccggcccccgccctctcccggttctccatcccccggcggcgccttcacaccgccggctcatgacatccttgcttcctcggcgagtccaccgtcgccgccggccagctctgcgtggaattcttggccggtgcaacggagatgctgagtgaggctagaggaagacgaagacgaaaaggcagggaaaaaaaaagagggggacaagatgaaaaggccggggctttgggtggatggatacggtggcacgggaggtggagctgattcttgattcttcgtttcttccctttcctctcgagagctctccttcctctctttctcgtcgctgcttgtcatggttactgcttttgacttcgagtaattctcctcctcacgtcgctgtctccacctggatcagaacagattcttccttttgttttgtgcagagcccgactcggagtggcactctagcagctgaaatggcacgatctaattgcactcttgtacgctgaccacgacatctggggagctaccaagcttggcacgtaacgtaaccgtgtgcatttcgactttccggtaatctttttctctattcagtttgatcgatcgtgttcactgattgcagctgcgataatccaatggacaattgattctctcctcttctcttctggcgtgttgcatacgagtggttttggatgatcactgttccacttataggatcgaatcataagaactaagccatcagagggggggtgaatggttggtatacccaa

SEQ ID NO: 54447 - DNA, 2532 bp, Oryza sativa
caaatatacaaccagcaattcagatgatttataagtaactaaatttgaaataataataataataataaagactatgaaaagaaaaaaccatctacaacacaacatgtgattaattaaaatttaaaaaataaattatgaaattagaaaaataaaaacaaaagtttaagaaagaatacgatttatgaataacaaaagttcaaaataaaaaaaatattaaaagaacaacccataacacaacaatggtaaataacaataaagagggagggataacgggtgagccgtaaataaataaatagggtgtagcggttgatgggatattttaaaacaataaaaatataaatgacgattagattcaattttaaaaatctcaatgacgattaagagaaacagcagcgagcaagccgtcaaggagcgcagtcgtgacgtttgactggacttctaaaaagaaaaaaaacaacgataatcataatatcatatttgactttttaaattccaatgacaactaagaggagacatcgggtggattgtagaacagtacaatgacgacatttgatgtaacttctaaaaatataaatatgtcaatcgacaagacaatgaactaaaaaactataagatctaaatatgaaagtttcaaagaggatgaataaaagttgtgacaggtcgggcaatcaaataaatgagtggtaaaaaagtaaggggtgacgacttattgacttttaaaaactaacccgatgataataagattcaggccctctttgtttaggcttaggcttattggcctagacttttaagtcagcttattggcttatatgatttataagctagtggatttaatatcctaagtttagtggtggagtcatacatctatctcatataagccaaaaaagcttctccaacctagcttttggcttaatagtgttagagtggcttatggcttcaaaaaagccaaatgaaaaagctgcttgtttgttttagtttagacttttcgacttataagttggcttataagcctaaacaaagagggcctcaatcttttaagatcggctagatggctatttaacaaatttaaataaaaccatgcttaaaaatatataattctggatgggtgctagccgcgcaacaaataaaggggtgacaaaggagtaagggtagtaacaggtgtgacttctaaaaactataaacccggggatgataatgttcgatctttgaaagtcctaaaacaacgagatagatatttaataaattttaagtagaatcatgtgaaaaattagataattttgtgggtgctagccacgcaattgcgcgggccacccagctagttattaaaatttaaaacatcttctacatataaagttttcacacgaaacgcaccgttaccctactactggtgcggaagttatgtgacaattttgacaggttcagcaataatcagcgttgagcaatagaaaatggatgagttgccgttgcatattcaggtgtgcacgattaaaaaacaaaagcaaaaaattgcagacagtgagaatctttcgttctttcaccgtagggcccggcagttgagtgcggtagtaggatgtgtgtattggtgggccgtgtgggcaactgggcgtggtctccacatgcggaatgggttacctctctcaggctctcaccaaccagatcaacgtcggaaataatttttaactttcaatttcttaaataatactctctccatcctaaaatataagcatttttaacttagtctccgagatgctactttgatcaacgatatctataaaagtaaaatattttaaataaaagaagttgcatattatgatagtttgtttaatgataaatctagtaacatcaattttacatgattgatctttttttttctattaatagtcaaagttataaatatttgacttgacactataataaaaatgcttatatcttgggacggagggagtacgatgtttgcagtgagaaaatcacaattatataaaagtaaattcaattatcaatcaatgatattatttttatcaaacaaaactcaacttattattaattaagtatctatagagttcaaatttaaaaatatgtacgtgcattattgagtggatcggaaggagtacagaagagcctcggccttgaactcgggcgtcactgcacctaccgaccaacgcaacacgcgaacatcccgcccgcacatccttcttctgtcactctgatcacacatggacctcgtgggagatcggaaaatatatatagtcgttggatacaaaatccgttaaatctttgagctaatttcttattacaaagtgctgttggttgatatgtagcctcgccagctacctctgcgtttgttgttattcattttgagagttggcaccagagttgacaaactccattataaccactcagttcttttttttaagatcaaagggcgagagcccttccgtttccattaatagaaatgagatagtagctaccacaaactggaaaaacgaaaaaaaaaaactgtctgatagtcctgactatcctaaaagttgagaa

SEQ ID NO: 54448 - DNA, 1065 bp, Oryza sativa
gcgacaccctagatccggccttcgcgcgccgctcgccgtcggccaccccgcgccccgctcgctgtccgccaccgcgagagaaccaacgacgggagagaaaggacgtaggagagcggatccagcgccgatgaggaggacgacgacgagtggcgggggaaagagggagagattgacgacgggacagagaggcgccgtgcgaagggagatagagggagagaacggtgacgagagtgagggaggattgctgcggtgggaaaaagagaagggtagtatagaaaaataccgaccgtgggctttttggttgggacacccactgtgagcttgagttccttcatccagatgcctaagattttaaagagcctacctagattattctccattgggagataagtgtccctacgagtaccctcagttaggctttgttgtagatgcccttttagggcccctttgatttgtaggaaaaatgtaggaattttggaggattttaatcctatggaaaaaaaatcctatgaatgcctttgaaacaaagaattgaatcatatccaatcctttaaaattcctatggaatgggtaatcatatgcacattttggaggaaagttagcaagaggtataacctcttggaacatttcctctaagtctatctctctcatctgatttctacgtttttcctgtggtccaatatcaaacagccattcctgtgttttgcaattctctgttttacaattgtattcctgtcagaatcctgtgcttttcctattcctttattttttcattcctactattcggaggagccctaagacaccggccagcggagcggtcttcggcaggtcaaccagtaaggtggtgattgggctcaccaccttttacgcccagtgcgtgcgtgctacacgctccggagtctgcacccatcttccccacgtgcgcgcccatcgccgggccaccggaaagccaccgccggccatcccgccgccgcgcgatccatcacccggaccagcttcacacccgcgtaaaataataaacaatcaaagccccacgttttcccactcgccccacgttgaatagac

SEQ ID NO: 54449 - DNA, 9543 bp, Oryza sativa
gcgtgttaatgagtgaggttcactcccgaacacaccctagctatcctggtaagaacaaggaagctccagtgctaatgaagcaagcggatatttagattagcgccataaagttggattaagattccagggagtcggcgatggtgatggctattatcttgttcattgtcaccctgttctgttatcacttattagccatatggagcaggtgtgcaaattatttgtgactaatgctgagaatcaaacttgatgcataaatactgcatacaattgtagatagccaacaaactttgttcgcggtggcggctatcttagcacttgtgtgaggtcgcattactatgcattaatggctattgtttagagatgaaagtggatggagaaaccgaaagtgatcggtgtgatggtgcccaagcgagactaagtattgttttattttctcaatgttgaacggtcgccttgtccactatcaaaatcccgattgtgcgtgttgaactagcccgtgtgttgtgtgcatgctggcatgctgccacactcaaatagtcataggactggagatggacacttcaacgtactaacaggttacaaggggtgtgtttagttcacgtcaaaattgaaagttaagttaaaattagaacgatgtgataaaaaagttgaaagtttatgtgtagaaaagttttgatgcgatgaaaaagttaaaagtttgaagaaaaaatttagaactaaactcggcgaaggataaccaaagttgtcgcgccagcatttgtacggtcctgaggaccaccaccattcctgtgcgtaagtaaattatactacgtagtactgaataccgatccattatgtaaaagcaggtttaatagtatagctaactactagctccaaatcatctataatcaatgtaatagctaattcatacaatagttgcttactatactattaatacctggtcctgcctgtcatacacacattacgtcttggagtccgtgttgcagcgggctacagatctgtagcccgctgctcttatctctctttttttatctctttacaatatgtttacagttggcttatagcctgctattgtaactgctctaaaatactccacccgtcaacctgaccgacctagctatatgaccctgacccaataaagaggccaaaagatggcttattggggaaataagctaaacgacttaattacaaacaaaaaataatttacaaataaaacttttatatacgtattattaatgatataaatgcaaatactgaaaaataaattttgatgaaaaaaattcttaaaatcaatttcaaatttaaggttgaaaatttaaattttagctgataagcataagcgaaaaaaaggcaagaaaaccccagataatcaaccttgagtaaaatagaagcgggctaacaactatcctgacagtactgagtataaaacagatgcacatgcattcttacctccacaatagtttttgctcggaatctttatggacttgcaaatttcctgtgggcatggagttcgcaatctttcatctggctcggcggcttgacgatcagcacatccacaaaactgcacccggcccaactccctcagctatgcaaaagggataagacatgaagaatacacttcctagtcacagatgcatacagagcttaaaaaagatgcaatcattctttaccttagttgcctgaggcgatccaaaatgggcaggcaaatgggcatcaccttcgcgattgccttgccaacagtgtatctttttggtagctactttcccataaagcggtgcgcactagcacaacactgattcttccaccacatcaaaatcaatcgaaccaaaatgcaaaacggcagttgctcccggatggaaacaccccttggagcttggaattccacaatctgcttattgcacatggcaagctacagcctacagaacgccaccaactgaattgacatatatctaacgttttgttaacacagttatcagtcacataaacgttccagctaatcaattgtaggttcaagtacaatcatacccttacaatatagccggataacaggatcttaaaaaaaataagtacaatcaagccacgagttcagcaagaaaactggaattacacttttgtcgctttacctaaaccatttgatactcatcaccttcctggagacttcttgcacaacccctcaaccctcatgctaaaagttcaacatcctcaatcctaaatagtgctcatgatagcaacctcacctatcaaatcgtgcaaaaaggactttattagccaaccaaaagttgcaaatggaaaggaggggattgcaatcagggtcgacatacttagcaacagaacaaaagagggggcagtggatgctaaggaaaccatacttcaactaaatagctattttagttaattgacctagcataccgctacaaaagtatcaacaaattactattggcgagtggttagcttctgtctttgattgctgcccaggaccattctaagattattatttttttaattattgtaggcttcagtgatgcaaaggcataaaagaggtactataacattgcggtatggaccaacatgtttctacctagatccaaaagtaccttagtttaacatgtggaataatgtgctactggtccactacagctaccatatcaaggtcttgttattgccacgacagtggtctaataacaatcaagattgtgaaaaccatttacaaattgtactgatagttacaacaatggccggccctgaccctgatgttgactaatttcatgaatcacaatattgtaacaaattgcgtccaaggtcaatagtggctgcctatctgtcaaaagccagttataaaccaggaaacctcgacctttttcttgcaacactatagtatccgaacgatgtagtttcttgcaacagaaaaactcagtcgagatacaaaatacatgaaaaactttcatgatagattgtcttgggctacaaacttttcattccaaaatgttcaaacaattttttttccatagaagactataaataattttaagatgcctataaataatggtgcaaagaaaagacagaacatttcagcagatattatgctatggaatataggtatctaacaagaaaaatcatcctacgccaaaagtgtttataatagagaatatcttgtgacgtatctctgattaagtgcatcaaatcatctttagttttaactataagctcatgctggagcttaaattgttgatgacataattaatataggtttgctggtttatgatgcatgtagtctacaggggcattttggtttattggatgcaaatgatggcataaagcgtttaaggtggtgtgacatttccttagcaaatcttttgcactcaaattttaaaaattaaatatttgaacttgtatgctaataaaacaccataatcacatagtacggataatactgccttcttcaatacaaatttgacttactagataggtcttcaagtctagaaaatagagaggtcaggtggtggtccatatactgatttccaggacaatggaatagtccatccattggacccatttcctgaaaattcacagcaggatttgtaaacacaggattccaaaatctgatcacagaatattgaatatcgatattcctaaagaaggaaagtaaggcaaattaccaacggttaatagatgaaaaactaataaacttgatatatagatgtaccatggaactgttcagggccttgagcaacaagtttgcatgctgcctcagccaactggaaagattctggcatattgtccccttctgagcagtagcatagtacacaagtaactttcaagcctttagcctgtaataaaataatgtcattaaacatattacaacagtgacctctaatggtaaaaacaaatcaatcaaaccttgcaggcagagaatagtgctgcaaatggcaagctcgagtagtaatcatttatcgtcatctcctcaggatcaccagtcatatcttctgaaagatgaccaccttcaactaggctagcaagacacttccacctttgctgagatggatcgtattcctcaagcttcttccagcctaagttctcacatttcggatcagaaccgtcctcgttgcaacttgaaaggtaatatacttgcatatcactaatagataaaacaattaatgagaatgagacgcaatcctaatcctaatcataaaagacaggatatgtgaagctatacatttcaattacctggatgcatcaattatccttctcttgcctgaatctaaacttgaaaggataacaacatggtctttttcaatgctgcttataaaattagcaacattttttgcaaatgaaaccaccatcccctgaaccagtataaaaggtttaaaggtgtcacaactcatgaaaaaaatcatcaattataggtgcagactgcagacaacttataggacttcaccaactaccaaaattccaaacaaagagtgaaaggcccaagcatcgcctgcaactctagtctcacccccatcgtacctctttaaagaaaaggtcaatagatcaataactatattttctctaaatcatttcagaataacaaatgtgctatgtaaatttagttcacaaggaacaaatatccaagggacagatgttagtctaggaaatgtaatgtgtgatgtacaaaaaagaaagggaagctgattctataatttcaaacaaatggagtacaattttgatattataatatcaaatacaatagagctcaatattgttctttatgcattcttgaaagaaccctgaagcatgtgcaacaaagctcacaagattctgtaactacatgaatcataatcacccacgtaagcaagtgaaaagtatctttaagtactctttgagatttataaagttaaaaccgaaaatatgtggcaaataggtaaaatcaacatactgtaataattggggaccgttgctgtatgaaggccagcctatgggatggagattcataagctgtaaagagaaaagagacagaaggtgacaaagtaagtagacattatatttcaattattattcacacactaagtagtgccattgctgaagaacaatatgcgtggctgaatcttaaggtattttttttaatttcttgtgccgattattctcttagacctgaacaaggcatttcatcaagtagctggtgtgcagaggaggaattgttcatgccggactataacacatttcatcgaacagttggtgtgcataatagaaggatttaaagtacgaacacacccaatcaccagttcaccacccctaacacaatccaatccatcaagcgtcctgctagcatagcacagcagagcaaaggacagagcacccaaccttccagcgcgagcgcgagatcaccgacggcgtcggggccgaaggcgtcgttgccggcgcagggcagcacggacggctcgtcgaggtacgccacccgcctcgcgcgcgacgaagacaccagcaggtcgacggcgagctgccccacgttgccgatcgagagcgccggctgcagccccccaaaaaaaggatcaccaacccgcgtcatgagccatggaggcaaagctattcaaaccggagagaggagagaggtttagggcgacccggaccatgaggagggtggagcagtcgggcgagaaggactccccctcaacgacggcgtgctccatcgcggcggcggcggcgctggatcccttcaaaacttgggcgagaagttgaagggctcgagtgggctagctatggaggcaggcagcggatgggagaaagacgagaagaaatacgccgcttttgttgcgtagaggagagtggagacggagagaattcgatttcgttgtgggctcaaattgggccgtgattttagttgcgggctttgggagttaaatgggccggattggaggtagcctggacttcctggcccattaattaaaatcagacgtatccaatcggtgcagtgcaggtcgtttggtaaaccggacagttattactgaacggtttacgtgaaccttgataatagttactccatggacacaacccaccctataagctcttcgtttcttggatactcaggccagctacttgattacagagcttcttggatagcacgttactcatcatgcccaggattagatcattcaaacaaaaattcaaagaagatcctaatactttctttccaacaagatttacatacagaagccactgagaattggttgacaagggcaaacgttcaaggttcaagtaaagagtagtccccgccaaaaaagaaagaagaaaagaaagagtaaagagtagtcacgggctcacggcaatagcaagccagttgagaaatcagatgggacatcagacaaaaagttatcagaaccagcactagtgctgcatatattaaccaatgaatcgactccaaatttgaaggattacaacccatatgatacaattgatgcaaaatagcaaggcaaagtggttatatacagagagtatatctactatatacacggtacacgcttccatcaatccattttaccggcgaaagcccagcggccagtgagcggcgtcaggcaggggcgaagcggtccatgagcatgcacacggtggcctcggagtcggagaggaggatgctgctgtccctcgtcctcgtcgtgatctcctgcacaacaccatcaccaaccttactcttgcagctctccccttcgctctgagctcgctggccgaccccggcgtcggccgccggtgccgccccccggcccatcttggcgaactcccccagccaaactccaaccaggcccgccattgattaatgattagtctgttcctctctgcctctccgagctagctgagtgaattcactagcttcgcacacacactccaaagaaaagctcagttgagtagtagtacttgactggttgcttcgttggctaaccgcgcggcgttggggctctacttatacgcgtactccggctccggcaaccgtggggagacgggaagacgaagctacgtgtctagttgttgcgatatgtgagagcggagcgggaggaggaatagtcgaggaaagctgcgtgtggtttcggcgccgtgcgcacggccgcgcccgcctctcttattggcgttttgtccgcttcgggctggaggaggaccacgccacgcgcggcgccatgtgacgcgcacggcacggcgcgacgcgggtctgattcgagggaggcttgggggccatcgtgtggctggtgggtgcccgagcgagcagcgcgcggggaatcagcgtggatataccaccggttgggctcccgcgatccggcgagcggatgcggagatgccgcggtgggatgctaaaccgacggggcgtggagtggtatttgatccgggggatcaaaccggatcggatcgtactactgtgcttcgtgaggtgcaggaacgccatgtcgtggtcgcgcacctcgttgttgtggactgtgttggagtaacggtgtgccaaaactgcgggagcattggagaacatcgatccatggtattggtaaatggtaatggtatggccgatagtttcagaatcaccgaggcacgtgaaattgtactagtatttgtgattttgtgcacctttgcaactgttgcgacacaaggtttgcacgtttttaactcaacgttggttaactaccacgagctgacgataatgtttttactcccccacaaggaatataattttttcctcttctttacttcttcaccatctgtaatggctcaccgctggcacagtcggtaccctgtaccctgaatcccttttttcataatgaatggaagatttagggactgtttagttgatgaaatgaaaattttttaatgtcacatcggacatttgaccggatatcggaaggggttttcggacacgaatgaaaaaattaattttataactcgcctggaaaccgcgagacggatcttttgagactaattaatccgtcattagcacatatgtgttactgtaacacttatggttaatcatggtctaattaggctcaaaagattcgtatcgcggtttacacgcaaactgtgcaattagtttttttatttatatttaatgctatatatgtccaaaaattcgatatgatgtttttttttgtaaaagttttttttttaactaaacaggtcctaggtggagaatctctcccctcctatgattattccaaaaaaaaaatttctactcccccgatttactcagcttcatcgtagagatcagatcttttgtatgtcagttgtcgatcagcttctggatctgagtttctgaattatgatacgtgttggtgttggtcagtaacagtaaaggaggcaaatatctttcctggaagtgaagcgagatatttcacacgtatcaacaagtagaacactcaaatcaaaatatctggttttcaagaaaaagatgaaaatatctgatttaaccgagtggtggcgatgaattatagaatccccttcactcgaatcgtctcatgatcgtgtacttcgaacccgctaaaccatcatatctcgattgaagaaaagtgggctttcgctacagagacttccaggattcagacagtactgcagtgatatttcagaagatttacacaaaaatcacacgagaccgtcgaaatcaccaggttcagattcatagctaaaggtatagtagctattttacgatggagagagtgccctgtaacgccaagctaagcctactctactggccgaagcaatcgatcaggatggacaagaaagcgtcttcttggatcacgctcgccggcgcgccaccaacggcagcggcctgctgcttcttggcagccgtttccacggccgcgccgtcaggcttgttctggccgtcgtcagaacgagccgtgcagcctcgcttcgaagccaccgtcgtcctgaacgcctgcgcgccgctgacccggatcctctcccgttccaccgtccaaatgtctaccaggctcgacatcgatcccgatcgatccgatcgccgatcgaccacagtttcttcagaactcagagcagagatcaaacaaggtggattgatgaaagcaaagatcgaacagagtctggagaggcgtttgtatgacgaccgggacaatttatagggttttttttgcagctagcacactgatgtgctgatgtcagggctgctgggacctagcagaataacaattggaacctagtgacgccattcttggcacacaggattgaagcaggtcagccatctggatgtcgttcttgccgctttaatttagacagtgcaacgcccaccggggccgcggtctgaaagccggcagggacgcgggggaggagctatctgagacacgcgcgcgatcttgataggaggacgagctagctagctgcgcggtgggcgcgcggtttcgtgcccatgccggcggtgagcgggaaattccggtgggtggagtcgtcgtgttaccgtgggctcgtgacggcgacggcgacgacagatgcatcctggactgttctgccacgtcgccatcccgcgtactactgaatctgactccccctgcaagccaacgcttttgcttactgggctgcaggaat

SEQ ID NO: 54450 - DNA, 1828 bp, Oryza sativa
cgtgcaacatgcgcaaataaccttacgatgctaataatcgctcatttggctatatattcattggcaggggtcggagatgtagaccatttcattatataaacaacatgttaataatcgctcatatttttcttaccctaataatcaacgagtttagcagtggaatatgcacacgaagagccgcgcgcgcggtcaccgttaaataaatgcaaatgcatgaagtagagattaataagttctgaagctgacacaggattgaacatgaacagaccttgtgggaatggttggagcaggaggcgatggcactactgccagtggagcagttgctgttgacgtcgtcgtcgcgcagaggaagtaggcagcagcggaactagtcgctgcggcaggcggcgcaggggagctacagatcccaaccatgtcgtcacatgccggcatcatcggtagcaccaccccaccaccaccaccaccaccatttcctcctcctccagctgccgcctccatggccacctccattcctgcctgctgctgcagctgcgcctctcctgcaaatgcgcgcgcaatggtcaatttaagccgccgcgtgcagtgcattcttagttgatgtagaggcgagatgcacttgatagtttagtgcaaatgaatgtatgcaggtttaatttctaacatgcgcacattttttttaaaaaatatatttggaggaacgtctctccctcaaaatctctttttttcttttttaggcagaggctggaagtcgtttcagtacattagaataaatcaccggggtcactgcatatatgtttagcttagttacagctggtatgtatatatacttctcaatcaatggatgatatgctttttttctaatggaaataaattgagctacatgaatacctgaggcaatgtgggatgatctgtctgtgctcttcactgtcctatacatctgcataccagtagatgagtgagtgatcaatgaggtgcatgtcttgtgttgcatgatccaaatggcttgtataattaattacatatgctaaggtggtaactagtttaaaggatatatatctggcttgtcctggttaggctagatgccgtttgtttgtcacttagtacttgacccagggattcaccagagacaaagtacacatgtagttaccaatagtaagaacacccataaaagtggtggaaaaaacaaaaagaagccatcatgcaacaagattcaccatcttctttcccttgcatggtggtagcaatagtagcttcccttttatcacctctccactctttctttctttctttcttttttctcttttttctcttctttttccaagtgatacacgtacctggaggtgactcttgacatgcgccagtgtcagatccttcacgttcatcagctccagcaccgacttcggcgtcgctcctgcagatcgatcgatcatcgccaagaacgagctcgtgagaattgagcacgcaaaacaatggagtaatcaatcgatcaatctcactatctcaggcaaaaggaaaagaaaatgtagctgcacgaattcagatcacattacgagaggacacagtgatggtgagataaggtagagctagctaggcgcttactctcgtggccgccgaggagctcgacggcgtgcacgaagcgggcgtggagcgcggtggtccatcgcatccgcggcgcgcggacgctccgcttcgagcccgccggcagctgggacgccctggccgccgcgcgcttgaacggcgcgcacccctgcggctgcaggtggtggtcgccatggcggccgccgccggcgtccgcgtgcgccggcgtcgtcggcccgagccccaggct

SEQ ID NO: 54451 - DNA, 2084 bp, Oryza sativa
catcattcagagaagtttaatgcaacaatatcctaacagcctaacaaccagatatatgttacagatgggatgacagtagcaagaacagcttcgatatgttacaaatgcatataactatgcaagaatagcctaacagccagataatcagcataagctgctccaaaacaacaaattaaaatggggtcactctgactgagaaggcaaagataagtttacctcaaattagtattcattagctagcctttcaaccatccttgatagtcatccatatgcatgtcagtagttaaatattatctgaaagaaacggaaatagatcaactggcagaggaagctcgccatttgtagaaagaactagcgtctaatttgttcagctagcatagaaattgggggatttgtagagtatccaagaacacacccaaaaaaaacttctggtaagaggtctaacaaggaaaataaaaatagatttagtgatgcatcaacttaaatagaacaagaaaacaaagtgaaacagcatgcatgcccactatccaaacaaaatactagtacacaaagagcatctaactaatgatccaatagctcatgatttttgatggggttaaagctagatgcatccttggacaaggatttagccacaggaaccacaggagacgccggaatcggttgactgcaagctcagatctggatgcaagagaaggaaagggtgacttctgcttagcactaaactgagtaaaatagatgaggcggcagtgactaccgagaatggggtggaaggggacagccgacgcctgctctccccacgacatgttgacctcgacgacgtggggtggtgtggacggcggaccgcttacctcacgaacggatctggcgtcgctgaagctaggactgcaggatctggagcacccaaactcgggatggttggatccgcgacctctgagttcagggtgtccggatctggagcccccgagttcatggttgctgggaccgtcagggggagggtgggggatgtagaagctcgtcgtcgaccggagataagcggcgatggacggaggggcttgtcgatggcgttgggcagcggtgtggtgccccgttcgccgatggtcctgacaccggcgttgtcttcgtctttggctcgatacgacccggatctggcgtggtggaggcgggaaggaggcggcgacccggatctagagtggtggaggcatggcggcgaccgtgggcagtgggtgaaggaggcggcgaccgtgggcggtgggcgaaggaggcagcgacccgtaggcggtgggcgaaggagccgatgacggggcggcggagagacggcggcggcgacaatggggcggagggcgaaggaggcggcgacctttggaggtgggcgaaggaggccggcggtcggtgggaggaagagaagagagactgagaggaggaggagagagactgagcaggtggcggtgggccccatgggtggtgggtgggggttccttttttatatgtcaaaattgatcacctttgacgggcgcaaacttaaaatcagtgacgagccagaagtcatatccgtcacaggtgacggcccatcacccgtgacgggttgtaactccctggcccgtcacaaatgaggtcataccaatgatgggttagaagtcaaactcgtcactatcttacctgtgacggcttaaaattccggtccgtcacaggtaaggtgatacctgtgacgggccatggccagatggctcaccgatgacggtaaacctaacgacccgtcaaaggtgacggtcatctgtgaccaatttataaacccatcactggtgtgccatcacagatgtagggttctggcgttgtggttcttttacaataggattaatctctggaaaaaggcataatatataagtacatagaatgatctttttttagtaatgcatatatgcagtattaaaaaacaatatagcattggtaccttatactggaaatcctagatcaattatcaatatggcaaagtacatcttaagagaaattgtttatgttttaatttcagtgactggcccatcaaattatttaccgcggcctctatatccaatcgaatagagcaattc

SEQ ID NO: 54452 - DNA, 5360 bp, Oryza sativa
caaattaaacatggtagggactagatcaagaatcctagccaaccagagctacgcattgtgtgccgcagagatgaccgggtagcttttgatctgaaggcagagagagaggggtctctgcagggtgtgcaggaccagcgagggtgtaaaatgtgctgacagacacctctcttttggatgtgcacatattcagcaaagcagaggtataatgcccccaagagagccctcttgggatctttccgtattcatgaaaggaagaggggtatgtgacgatggaagacgctagctgcaggccgaaatgaatgtggcggaatgcgacaacacgatatgggtggcactgctgctagagagagtgtgacatgatagtgatatatccatcaggacaacatccatgcaggcagcatcgatctcaagcggtggtcaggtcgatcagaaattgatcgagcagcaaatttgtaaaaatctgcaaattttacacgctgtttaattatgattagatttgcttatacaatactgaattgctgttaccgatctgatcactagctagctagcataaggtaaacagtaattaacttatgtacgtacgtacgagcagtacatatgagtggctgtgccgatcgaatcagcacgcacgtgtggctgtcacgtgagagcaagggtgagcaatttgggataatagattatatggatctcttagcgctagctgcagctagctaggaaggagcagtagtaaacaagaatggcaggtggccatcaaaggctgtacagctcctccgatacattccgatctcgtcgtcgccttcatctcgcacaaacaattaaaccctaaataatccgtggaccaatcaatcgctcggcacgaccaagttaaaaattaaattaaccccatggcctcgatcgaaaggacgacgagccgcatgcatgcagatcgatgcgagctagtgaattgaatgaacagcgaagaattaaagagagagagaaaaaagaattatgtacggcgattccgaccgcggcgcacgtaccggttgtagttaacgacgcgacgacgacggcatgagatgggaacaagcaggaagaacttctcgaggcgctaaacaaatcggaaaggggaattccgattccgggcctgtttgatgcgtcccgtagctcccggtcagcgcctaatgcggcgtgttcctcgcataaagcatgccccggctttttcgatctctagctacatagctctctctgctgctgctaattcccatgcaatgccgagttaatgtgctgctacttctaccgtctgtttgtgcgtgccttgatcttggtccggggtgctatcgcgaactagtttaatcgctgtcgtgagttggtaatcctgtctgtcttaccaccacactgtgtggtgctcatgtgccatggggtcactcactcactcactcactgtctgattatttttttctccctcgcggcaatggtggtcaggggattcagttgattgcttgctagatggtgagacctgagatgtgcatgatatgatgtgcgtacgtacgcggcagagaggcaataactatatatggggatcaagatgtctggagcaaatggcatcattcccatgtcttagcttagcttagaccaaaagtcactaccactgaaaaagcgctacagggaattgcggggccaatcagagctgattgagcctgcctactgcgtgcctaagcgctctagctagctactaacagtgaaattaattgtcctctctttttttttctctctgaagaggagcgttgtagcagaaagactaacatgcatacatggtggcttctctgatgacaatcccgctgatagtacatcagtactaataataatcctgtagtactactctgcttcttcagtgctagctgcatggtcgtgggactcactggctcaggcatgcacgtctaactcggtctaactcaccaatatctagtgtcggggcagttgcccagtccatggccccgatcgtatctctaccttagtggaaacaccgaaactggagagagaaaacaacaaacaccaacaccaaataaccaccttcttttgcaatccggatagatcgctaatcgatcgatcggaatgtcaagtgtgtggccgtgtttgtttggttcgtcatgagtgccctcgagactacttgggcatgcactttgcagatcaccccgtgctgtcctgcatgcatcccggtgtgcgccccacacgacttattttctctttgcgtgcatgcattggcaatcgtcgttccatgtagtcgatcatgcatgtgtgtgtacatctacatactggtccgtcgttcgcacgtacgtacgcttccaatattcttcaatattcatggatcgatcatagagtgtgtgtggacctcgatcgtgttgagttatgatccaaattcatttgcacacgtataaagatcagtttcggacgaagcgaagcggaggtttcatcttcatatatatactttttgtaagccgtcgttcggcgttgtaaccttcactccgatatagtgaagatatttgccggttagcgctcgtagttttttctctcctattttgaaagggttttcatgttaaattttgtgttttctatatgatttatctattattttttatcgtttatttgcctatcgttttctagcagatccatcggaacatgcatgtacatttgtggtctcccctactgatcgatcgatgcggtgccttacctttcttccaaaggcgggcgcggcagctgggttggccgggccgtggcgtacgtggtcggtgctagctgggcagtgggcaccgaccgcgacgcccgcgcggcctaaagctgccgttgccgctgccgcgctcgctgcaattcgtcgcggtggccgtccgcctgcatgattgggattggctctcgcggcgcgcgggccgcggcccagcttagcctactccctcccccactgcacgcggccgtacgtggcccacggcgcgcgcggacgagtccacgcgacttttcggtggaaatcgccgccttttccacgcgaccattggtgttttttctccttcccgtctgccggtggtggcctggccgaatggccgatctatcgtggatttgtgagagaaccgtgatgatccgtatcgatggatccatgatgagttcttcgctgccgatcgatcggtctctgatctatggatggagcggtagccagttccgttgtcagtttgataaaaagcgaggcaaagaagcagcaggtgtgtcaacagagaccaccgggctttgttgggtctcgtcggcatatgcacgcagtgcctgcgttttgcgacaacgagccacttccaaggataaacggccaattgctgcgacgagatgacctccatcgtcgtcaggtgtcccggaacagagaggcacgatgcacacggaatggaggacgtggtacatgttagtaccttttttttttcccggtgatatatatgcttttatatatcgaggctctggtcagactgtagtcagtcagagaaaaatagtggtgttcatgctttaggaatactaaagtctgtctctgtcatgggaaaactgatttatcgaagtgattttttaaggacatgttagattacagcatatgtacttttttactttaactaggaaggtagcccgcgcattcgctcgggtatgtttcgtacactaagctggagacacttataagagagaaatattaatcagagaacatctgccataatttctctataaattgttttgtcggcattaattacttttataattctctaacctatgagctttatcctatatcatattttagtaatatctacaagtaattatttataatcttcttcatcatttgaaaaaaaggtagaattattttctttacaaaacatgtcaacaaaagataaaagtaaggtgtttttctctttttttaattgcatatatattatcatggtttaatagaggagaattgggtgggacatgaagctccactaaatgtatgggtttatatagcctaatataactgatgtattttgagaggtgatccatctataaacatttcatgtagagtaggtcaaagcctccacacaacttaatatggatactataatgataaaatataattgtgcagtattagttttgaaatgttatagtattcatattactatagcatgaatacacgcttgttttttatataagacagatataatgataagaaataatggttccacaggtttaaaaggcataggagtattccaaaaatgtagcttaaaaattatgtttgttttaatattcaatatcattgcaaagtgagtgtagctcaaatggttaggtttcttgtagtggaaaatgccaccgggttcaagtcctaaactttgacatgggtgctcgcatttacgattaattattctttcattggtaggtgacgtatccatcgacagcgagatgtccgtggtgatttctttaatctcaaaatatgttgtctaatcttttggagatactcaaagggggtaagctatgtgtttgtgagttcataggggtgagtgtgcgtccattaagttgtgagcgcttacgtttgttgtgtgtttctaaaaaaaacattcatagtggtaggctatgtgtttatgcattcatatgggtaagtgtgcatgttttgtgagtgcctgtgtttgtaatatgtttctaaaaaatatccaacattattgattgtttttcttttagtttgagagctaaacaatatgaaggggacgggtggtgttgtgcgcatgtgagggcgaggaggaggtggaagagattttatttttgtaatttttctaaataatttaaagtgatagccgatgaaggggtgtttcattttttttaaaagaatttctaagatactttctttgttttataggacgtggcacatggcgatttaagattatgtttaagaaatagatttatagttaaaaataatggatttttttagaatcttaggacatgatagctgctcgggagggagtttaattgattttggttatatacaatgatttagtataacataatatatatttttaattaatttttgattgttaggatattatttttttaaagatagatattatgggtcctagttttgagttatatatttttataaatacatttaattttagatctattagaaaatactttgggtgttgtattttctaattaaaccacttagattgttttaaattgttctacttgaagtacatgttattaatcagaaggtttaaaaatctactttatattttcttcaaaatgtatgaatcgatgaacaatagttagtccgtagaatatatatgacacaaagtaataaatttctttaatattatacttaacttggatctttagttttaaattttata

SEQ ID NO: 54453 - DNA, 741 bp, Oryza sativa
cagtattgcattgagataggaatggaaggtgtattgtcaacgagaatcattattgctgtggtcggtgtggtgacattggagcatcaatggagtaccttgttttgttaggtccatctagatcacgttggtacataccattttccataccggtcaaatcaaggatgaacataaactaacaagcaaagattcttctaaccggtcattttcgatgcttgaacccaatcatgagtttcaggtaggtcatttatctataactaattaaccggtcacatctactgccatgtggtgatgctacacagacatgtgccactctcagttcctaatgtaagctttccatgagaggcacatggaagctttgcaattgtttttttctccttcattattgagtggtaccaagatttcagatttcttgctccccgaaacgtggtatgatctctcttcagatctcaatatccactgaaaagaaatatgcaaatctgggcatttgatgaaaacatgatcaccgaaaatcatttaggactgaatgatcttccctatttttagatacttccccccttctctgaaatacaaggagaagtcactgaccaactgaaatgtctactgaatctgaattcttcacaagtcactcactgcttcactgcattcagtttactcttccctgtcagcttctgaagacctgcaagccagcaaagactggattttttgagtgaaagactgaaatctcactcgtcaggtcaaggg

SEQ ID NO: 54454 - DNA, 1088 bp, Oryza sativa
ctcaaacttatccaaatttccagatttcaagacaaagcacttgcaaccaaaaacacgcaaatgtgaaactttgggttgatgtccaaatcgaagttcataagaagtttttccaagtttagacctcaagaaaacccgatttaaaatataacaagctgtgttaattgcctcagtccaaaattttctaggagttttatattcatccaacatcgttctagccatctcaacaaaaacacaatttttcctttcaacaacaccgttttgttgtggaacacgaggagaagaaaattcatgttcaagacctctttcattgcaaaattgttcaaatgaagcatttttaaactcaccaccattatcacttcgaattcttttcaaagaaccaggaaattcaagctccaattgaagaaacaaaccacgaaagtgtttaaaagcttcgtccttagttgccataaagaaaacccaagaatatcgagaaaaatcgtcaacaataaccaacacataccactttgctccaatagattgcactttagctggaccaacagtgtccatatgtaatagctgtcccggtgcatccgtcatcacagaaacaataggagcatgtgaagtagaaaccatcttagcatgacgacacggtgtacaaaccaaatcaagatctttgttaagtttaggcaaaccacggacaagatccaaaccacttaacctagagagatgatcaaaaccaacatgtccaagtctacgatgccaaaacatcacatctttatcaaacttagcaaccaaacatgttatcataggtgaaacaggattttcaaaatcagctttaaacacttttccatagcgagaaatattcaacacagaatcaccacaagaatcaaaaactttacttctagttttcttaaagtgaacctcaaaattttcatcaacaatttgtgaaactgaaagcaaattgtactttaagtcctcaaccaaagctacattcttcaattcaaaattttcatttaccttaaccaaacctgtagcgagaacggcacttgtagcagcatcaccaaagataatcgattcagtcttagatgccttctttagggaggagaacc

SEQ ID NO: 54455 - DNA, 5077 bp, Oryza sativa
attcctgcagcccacgataattagacacattagtagaattagaagatttagcagacacaagcaacaataggagattttgcatgcacaacattggattttgaagaagatgcattcatagtagacatgataccagcagatttaaacacagttttattagtatcaggtttaaccaaaatctcaccacttctagcaccaacacctaacacaacaggaggatgtctagaattatgagcagaaggattaaaacctaaaccacgattatgtgtgctaacctttgattgatccaaaatcatgttgaggttctttttaccatcagaaaatcttaacaaagaatttttcaaataagagacctctttttccaaattagcataattttcacaatctaccatgacacctttgctttgacgacatttagggcaagaaagcacttcattgtttttcacaacatcttccatgtactcaacacgacctaaagcatctttcaatttcaacttattcaaattacatgttgagcaatccaaaacatcatgaggttgttttaactttttagcagaaatcatgttaaacatcaaactagcatgaaaagcaacttgatatttttgcaacaactttttagttaaaaacaattcatccaaagtgcgtgtatgcaagtcaaaactacaagcaagagaagatctattttttaaatcatgtgcagcattaacatatctaatttttgaaatctcattcattaaaacctcacaattttcacaatcatcatcattaggaataagagattttaatatatcaatttcagatttaagagattcaatgataaattcctgttttctatatatcttctcacacttcttattttttgcactcaaaatattaatagcttcctcaaaagcactcacctcattatcttcatactctgtgtcagattcaccacgcgccatgaagcaaacatcggagatgttgtttcccttatcatcatctcctctttcaccatctacatcacttagtggctcgaaggcggcgcaaacttgttgaaaagccttcctaagattctccatcttcctccctttgtatgaacccttcgacttgttgttgttggacttgttgttgttgatcttctcaccatctttgtcttctcttttgcctctcccaagcttaggacaatgcgaacgaagatgatcaattgaaccacattcaaagcaacgatttggaccacctcttttcctgttcctggcattattcatagctcgagcaattctgttagcaaccaaaaccaaatcctcctcgatttgttcgagttgatcatcggatgtggcattaaaaatagcaagaaaagaagacttagaatcaacttttcgagaaagaacattcatctcatgtgttttcaattttgtataaagtgaatcaaagtcaaagtagacatgttaacagattcctgaatagatgtaactttcatctcccaaatagacatgttaagaccattcaaaaagtggcgagaaatcttagattgtggataattagcatcataagaagaatcaacagatctaagatcactcaaaattttattaaaccgagaaatatagtcatccaaagcttctccaggtttcatctcaaatttattatactcctttttgaaaagatcacgacgaagttctttaatattatttgtttcttgatgaaaattacacagagcagttcaaatctcatgagcagtttgaagatgagcaatacgattataatccgaacgagaaatacgactcaaaagaatattgcgagctttgcaattttgttcaaaagcagttttttcagcagcagtattaatagcttcaggaatcacataaggatgagaaaattttctccaaatatcataatctttagccattatataagattgcatcctactacaccaatgagaaaaatccgttccatcgaaaacatgaagcttagttgaaaacctagcgggagtagccatggcaaaaactctagatcgataaaaatccaaagaagaaaacaaggctccgataccacttgtaggaactaagccaagcagaggggggggtgaatggttggtatacccaaaaaccaaaaacttttagcggaactaaaagttaccctcgaaatcgacggatcacggtctgaccaaagttgtcctgccggtttgaccgcctggttgccgtcggtctgaccgcggttatatctccggtccgaccgctgagatcagctgctgctcgctgtcgccgccgccggtctgaccgccgtgctcccgccggtttgaccgccgaaacccggtaaacacaaatcgaagaactcttaaagtagatgatgactttattgattctctctgtgtttacaaagtgcaccaacagcactccttacaaaaatttcgactaaactcgaaaccctaactcaaaactcaactcaattgctctcaaaagcgataccgggaagcctcacgctccccctcgatttatacatgaggtaggcagcctaaagccacgaaccaaactcatactaagagtcctaaacaccttaggaaactctctagtacaagaaagaaactttacataaccagtcgtcttatccccaagccgactcccggtccatcaccgcaaatactctcccgagacatcgagtcacctacacatggaacaaacaaagaaaccatattccgagaccaagctatctccaacttgactcattagcagcaaacaatagtattacatacgtacagtatccatctagaagtcataatcatgaaataaactcggatatccaaataaacaacccgaaatcgaaaccgacacagtgtcggcctgttagaccgcgggctgcgccggtctgaccgcgcaatacacgccggtctgaccagctaccagagcctggtctgaccggtcacataaaataacgaatcctgcaatcacatgtgaaatccaatcatctccgaaaccacttcgtgaataaattccaaacaacaaaaccaataatctccaatgcccaattgttcatcacaaaataataatcaaaaacacctttgattttacaccactagcagtgaagaataatgcctgaaaaagggcgggaggatagcagccgggaagaaggggaatgtgctgtgtttcccaccttgtgtggtcgcgccgcgatgaggaaagaaaaaaaaaggcagagaacttgaaacgacggcagcgagcaagccaggtgtgacactagctagtggcgtccacagtttctactgtagcatacgtgatacatccaaccacaccccactggccccaaatatgatcagaagtagcattggatattcacacaactgcatagcattattgttcagaagtagtagtggggataatcacataagagaacttggataaaagctctttaaatttacagaaggcaacagagatgaatttattgacgcttgtacactcagaacgacgaaacacgggctgatagcaaagctacaacaaacgaaaatgccaagaaaacgtgcatcaggaggcaggaggtccaaacatacattatccatctcctcaaaacgatactaccagatcaccagataccaaatcaccgtacaagacatgtacacaagaacgaacagcgatcggagctggatggtgtagagaagcgctgaagcggtggcgcctacagaaagttcagcaccagggcccagacagggtagatgaagagcaagaggatgccaatgctgttggacactccgttgcccttcctgaaggcgttcctgaatccacctgacgccctgatgtgctcttgaagcaggtagcatccaatgatgaggcatatgaagatgccaactaagtcgcctcggaaggtgctcgcaaacaggttcggggcaacagcaatgagaaggatcacagcaccaggcagctctaaccaatctaatcaacatgacaaagcattgttgtgagacccatgtgaatttttgtcaggctatcaaacaacattctagaaagtagacatcaaatgataccagggaaatggcgaggaaagaagagacgaaggatgacagcaatgatcgcaatccattttccaatttctcccctgcaatttacgcatttagcgataagaattttttttttgaaacctagagataagaaaatttgtttgatatatctatatgtgatgttgtaaactttaatacaacagaatagaacataactattttgtaagtatttacaactatatccctagtcctccaaccagaacgcaaagtatgaaaaactagcttcagcagcatataacttgctttcatcttatgcttataaaaaagctataacctttttaataaaaaaatcctcaattcttcaaaacttatgtttaccaagattatcattcagcccctaatcccatgatgccaattgtcagtttactaatacatctttcatgttttgtgggctaagaaatgcagccagcgtgtcagggtatttgcatatatacctcaacagagagaacagcccaccaggcagtgtaaagaaaatgtaagggaccaagagagcggtcagcatgttggtcttccagtttgtcctatccaatatcaggaggtacctgcagtagaagagaacagagggggttcagtcaaatactcaaatgcacaaatgacaactgatgagtgacatttataaggaccgttctcaggttaaatgtacacagaaagttctaaagtcatggtcttgaaagtaaatactgaagactgagcgaaatcatcaagtttactgagggtggtgcagcaccactggcatatgaagcatattctgatattcagaaagcacaacttccatggacggtcctaataattacaactacaactccatgtgcagcagttatctgctcttcctaaagtacagtatgccaatatcatcgtatcactcatatcacatcacaaattcacagtccagcgcacagtcactagttcattacactgcatacaatgccaaaaatacttaatatgcagaaattaggctgtaggatcctacaaactgctcaacacagcatagttctgtaattgtacaatcgtatctcgacttcctgctcacctgttaaaaagatataacttgtgaatcga

SEQ ID NO: 54456 - DNA, 2943 bp, Oryza sativa
aattcctgcagcccaatttggcgcaaatttccaaaatttctgagctatctctagttttcgaacagaaatcaaatatgccagctacagggtgcgtctctcatgcagtcacggatatcaggtagaacagtagtactaccaattaatcatatccccaaaatggcgtacatttattctcagtactaacggagctagcaacacaccaactatcgatcctccatgcccgtgtcggcgtgtcccgatcagcaacacaaggagcttttgagcccccaaaaaatggcgagatcggagatccccttttggaaccaaagctcactcttggtcctctgcaaagagacaccgaaacgaacaaacaaaggacatggagggggggtgttttgggtgactcacacggcggcgaagaaggcgagccacttgaggaaggtggtgccgaacccgaggccgccgccgaggacgagcgcgtggttggcgagcttccgcgccgccacgcccagctcctgcaggtcggcgtcgatcagcgccgcctgcgccgcctcccctcccgccgcgtccgtcttcatcgccaggtacgacatgaaccccttccccatctcccacgctgcagatcgctcgcaaccctagctagcctcctccacctctccctctctctctcgcttcgtcttctccgcgcgcggatcaaatcaaagcaagctctcgctggcgattgggtaaaatttgactaaattgggtttggttgtgtggatgagtatgtgtacaggtggggaactaggtggcgctcgctcgatctggacggttcccgggggggacgtcgtgggacacgtggagggctccaggtcctacagtatttctgcatgcatgcattattctactcctcactgtttttgacttggctatgattagataatttagatcttgtttagcactaacaaatactaatccatttttagcacattaattaattgccttttgtttgtataaactggatagtaatgcagtattaataccggtatattccccttttcttcgcttcctgccagaatgccagttgtcactccctatgagcatatgagcaaagagcacgtggccctacgattaattaagttttgatgtagacttggttttcttttttatgttttggcgattatttcatactgaaatgctgataatcctatcgatgtgattaattaagcatttactaacaaatgttaacatttctttgaaactgtgtagccgacgtgtcagccacgtgctccacacaccttgcacataaaaacagtcatacagaatcgttttgcatgcctaatcgtggccaaatgggatggataaacaaaaaaaaaaagaaaatcaataatgcaacatcggccagataagacaagctgaaaaagacggtaacaggctgaccattctcatcctaattaaccaatgaaactaattcagcttatcaaccgatcataattagccaagtcgaaacactaatttaatttcaggcgtcgctgtctccccctttatttctggatcaatctgccagctcgtccatggcgtccgggccaatctccccatgatcgtgtcgctggctagctcgatgtgagagacgaccaaacccccaacggtcttgccgaattcgcaactactagtgtccgtccgtgtgtggctgcgtggtggcacgtcggcatgcagagttacagagagagctccgctgacaagcacgtagctgatactgtagatagctgaccgtgttcgttttgtacacgtcgtttcagttatctgaagcctgctttgtctgtacacggccggcgtacgtaaagttcgtcatgttttcgtctcgaaccgacaccttttgtacgttttttttttccttttttctttcgagaacagagcattatgtacgttaacggaaaaacgaggaagagacagaaaatacttatgggtttattgggctagaagttactatgggctcattgggtgcttatagactatattgggctaaaatatacatatgggcttatttgcacgaaactgaaagtctctctattctagtccagtccagtaggcaacagcttacaactgtgggtcggcccaataaacgggcccggttacatatggaccgggcgcgtaaacctcatcgtctttctccctcgctcgcgcggctgcggttgcgtcttccgcttccgaccgcgacccactcccaccattaccgtcggattcggagattgctccgccactccggcgccccacacatcgccggcgaaaatgctaatatctcctatgctcgccgcgccgccccctcctgcagccgctgcaagcccgcgctgccgcggcttcctcccggcagctgcggcgacggggagtcgacgccaccggggagggtgccgcttgcttcgccgctccgcacctcccagggtcggcgccgtcacgagcaccgtacgaacgcggcgtgaagagggccgcctcgaccgtgacgagctccggaggctgtgccaggagcctaacccggaggcagccgttaacctgctcgacgaaatgctcgtgcgaggcggcgctggcgcattggccgacctcgcgccggaggagcaagccgcggttctccaggcctgcggagaggcgcggtcgctggcgtcgctcaggcgagcgcaccgattgctgtccaagtccctgcccgggatcgccacgcccatcctgcacatgatctccacgctgtactgcaagctcggcgcccgcggcgacgcgcggcgagcactcgagggagcgtcgaggccgcgggggaaggatcatgagcaggagcaggagcacggcgacgaggcgaagaggcgggaggcgtacgagaaggtgcgggagctgcacgaggagatacgcgcggcggggtacgtgccggacacccgctacgtgctgcacgacatcgacgaggacgccaaggcccgcgcgctcatgtaccacagcgagcgcctc

SEQ ID NO: 54457 - DNA, 6441 bp, Oryza sativa
tgaattccttcactacggttgtacattgttactgctactggatcatgtcagtgatgaagaaatgatgattcactttgcttagccaacgtatgacttgatgcattggccatccagatggcactgagcaattgtgcaccgctacaattcaatgatcaaacatggtaaaactcaatatctcccaaggaaaacccctccattttccacaaatctaagtaaagaatcaacacgagaaaacaagtggaagctatgatgtgcaagggagaagaatttcaggggctctgctcgattcgtggccggcgaggccgcgccaccaccgtgcgctgctgtgactggcacacctgcgccgggaacttgcacccgaaccgcttcgtcaccattgatccccaccgtccttccatcgccggcgttgctcctctctcccctggcgtgctgccgccgccacgccggtccatcttctcaatggctttcctcatgcttgtgcactcacgctccagctcctgcacccggtttcgcatgctgtccatgtccagcctcagcatttggttcccccttgtcgccacccgccatgttccaccggcatcgctgtcgccttcttcctccccttgaccagctgctccaccttcgttcgccatgattgtccttgcaatggcgcgacgcagctggagctgctcgaagaagagcacctgcaccaccgtccgcagcggcagccgctcgttctgcgccgcgtgcgtgcatgcctctagcgtcagcttgcggccgtcgacgacaccgctcaccttctccttctcttcttccctcaatccaggatgagcctaagaacagaacaaaacaatcactgctaagtaatggcattgtgttgtaaagaggtagaacactcgttgtcagtgttggtttaccttgagatagatgtcgacggcacggtagaggccgtcgtcgtagacgcgggcgccgtccggcaatgcccaggcgaggtcacagaatttgtccggcttcaggttggcatctgcggcgatctcgcccaggtaggcatccatcagcctcccaacggcgagcatggctcgtcggctggcctctctgcccggtgtctccagctcgctgccgtcgtcgttgccgtcgtcggcgtctcggccttcgaggaagtagcgcacgatgcgctcgacgcactccacgtcgtagagcgtctcgacgaggtaggagtagctcgggatgagcaggtcgtcgagggccgcgtcggggagcctcgcggctatgcgccgctcgagcatgtcacgggcggattccgacgcctgtaggatgctcgtcgtgcgcaggaggccgaagaggacgcgcgccgtcgtggcgcccacggccgtgccggtgtgggcgttgctcttgatggtctcctccgggaggttggcgatgacggtctccagaagcgccttctgctcgccgtccgatgacggcgcagccgcggcggcggcggtggcgccgcctacatggcggccggagcgcgacagcccagggatggagcgcttggcgtaggcgatgagagcgccttcaatgatctccgggccgacgttccgctccttcatggcggcaatgacgcgggtgaacgtggccagcgacaagccggcgaggtcgtcgaaccacgtcgcgccggcgccggcattgttcttgcggcgcggacggtcgccggcggcggcggcggcggcggcggcggcatcgttgatgggccaaccgaacagtgcggtgggcgtggacgcggcggccttggcggcgatggcgtcgacgcagcgtgacacgaggccgaggtcgtcggcgagggggaggaggccctcgcacgacctgagggctcggatggcgtccctggggttcctcaggacggtgtgggacatgaacctgtcggcgcgggagatgaggttgtcgtcggagtggtcgtcggacatgccgaggcgctcggcggcgcagcggagcggcgcggcggtggccggcgtgaggtccagcttgacgccgtagcagaacttggccgcctgctcgaacgcctccgcgccgccggggaagtccgggaggcggatgcggtgcacgtcggagtcctcgtcgacctccagcaccacctcctcctctctgatctcgccggcatcctcctcctcctcctcatcttgctctcctccgcccgcagctcgcgactccctgttggtgatgaggtcgtggagcttcttgctcctcgacattaacgggaactgcaaggaaattctcgatatcaacaacaaacgcagaaaatcttcacactttccatagcccgacatcaagaaatggaccacacaagctcatgaatcatgacagagatttggagtacgagatttagcagcaaattaattgagatcaaggaaaagaaagtgctcaaagccaacactgtccgtgcatcaaggagagttgggaaaaaaagaaaaaaaatggaaattatgggagacacaggtgtgggggataagattcaccaaccttgtggagatggaatgtcatgtcgccgacctcgatcacgacgtcgctggggagtccggtggtgcagaacctgatgaacacaagacagacacacagattggggatcagagaacagcaaatcggtgacagagagacagagacagagctcaatcagtcgcttgccatgcttggcctttggagctcgattgctgctgctgctgctgctgatgatgatgatgatgatgattcttctcctccctggccatctccctcgcgctcttcatcttcctcccctgcatctcgtgatcctttggaagaacgaagcagacaacagcaatggcgaaaaaagaagaagaagaaaaaaaaaactctgctatgagctaaggcatttctcgggagaaaggaaggggtgtgatgtgtttgctcatttgctgtcgctatgggaatcagagaaggggaaggacaccagggagagacgagagacgagggagctctcaataatggcgtactattctgatgcttggttttaggtgggagaagtgaaggattccaagtggggaagacgaagacaagatggcgtttttggttttttgaatgccgttcggcttgcctcaaaagcacgtatcctccattacccatttgtttatcctaccatccgtacttgctttctcttaatctaatgctttactgtctctttctgaaagattgtcatctactctaggagtgacagttataaccatgttttacgcattgccaccaaaatcttaccagtaacagcaaaattttcacctctacacagccactgctcataatagtatgttttactactctattatgcttggaactccaaaagaatgtctggtatgcttggagctgtctgatcatccatcatatgtatagtgtgacactgacacaagaattcaactacagtacctggttcatttgtagaaccatttttttcccagaaattttctagtagtaggaaataggatgcattgcaaaacaagccttcacctatcaggtagagtatcaacatccagtatgaagattcggataccacctcgataaaatgaagccatgaaccaaagtcaccattactttaacccaagtgaacgcaggtcaggttaattaagtactaacaacgagaagaatgaaggaatctacggcacaagcgcacaggtaacgactgttcttttccttttatccagtacccaaaaatttttacgtcttgaaagtagtactcctaaccaacgtccatatgatccagccatctttctttgtcaggtgaaggccaagacgtgctctgaaaaacctggattttgaactttgaactccagctgccgcctggccaagggaagaagaagatgatcgcctgatcggacaataataaatgtgaaggcgtgatccggtcatcaagactggaggtggtggtgtcctggcgtacctgccggtgtgtgttactgcctctctcttttatggctgtacacatgagagagagagagagagatgcaggttactggtggatggagtagatcagtgctcatcacaaggcaacaactctggaaggtgagccccaaatccggctgcttcctcaccgcctgaaaaagagaggcttctgtgtcaatacccagcactcgtgccagtggcagcatgccagtgtagtgcgtgggcgtgcctgggggctgggtgtgctggacaatggacctggcaggcgccatggcctggcctggaggacacaccaaaggagaaaaagggctcaaaggcaacaacgcgagtagctacgacaaccttaactttgctcggattctgcaacagattgttcaggagtgcgtgtcactgtagaacagtagaggcttggcatgactcaagatgtctgtggttgtatgggcattggtctcatcagggcttgtgtggttgatgaggttgcagtcttgcagaaacccagggaatctagtagcccagcgatgtgcaaaggcagagatgagctttcctcaactttctgaaagtgttcaaagcattttcctatcagaaacaaaagtgttcaatgcattggagttcgagaaaaaggctaaggtcaagagccatttcagtgctagtacgactgttggagtaacatttgatgtgtgaaagttttggtgtcctcaagccaggtgaagtcgcttctgatgagtgatgttcatcaagactgatgtgtgctagtcatcatcaacttacagcccacaacgtgttgttcggtctgtcccttttgcttcttgttcgctctacatccacatcttctatccttatgttatgttaaaaagaaaaatcagcagcgacacattaatatggaagctgttttttgttatagataacagtgcagaagctggcaatcttggcgagacaaggcatggagccatggactatatggggtgtgagcaactagtgctgtgttgctttgtgaaacctttatggaagtaacagaaagagtcaatttcatgcggtcctgctccaagcaaccttttcccgagccttttgttcatccattgcctttcctaatcttcaggtaatgagtgtgcatgcttaaacaatctttgtactctttgcattcaccagattacatacttcctagtgcagtagcttgcatatccaggtatgtttgcacactaagttcatctcaatcttggtctgttattattgaacaagagtacagatgtaccatccaaactcacaccatgttcatccgacatgacgtatgagccctactctgattgttccttcacaaaacagtactattggaagaggacaattacctctgtaccggcatctgcagatcggaggcggaagtgaagaattcccagagcagaaaagttacagcggtaacagcacggagcaagggacaaagcttctgaattgccctaaacaaatccatcaacattcccttcacagctacgactaatatactgtaagtatcagccaggataaccaatcagagtatggttgtatgctctcacagctcacatgctgcacaataattggacgcatttgcaggttaagcatcagggctaacacacaattggaggcagtataaaactatgcataaatatatcaagatctaggcgtgtagcaaatgtgggcctctcttccactctctcacacggcttgaccaacctcttcttctgaaaaagaaaataaatacgcacaaccactgcccattattgctcttgcatcttgctcctagtatactcctatgcctgcagcatttgcatctcgttcaattgatgaattcttcctttttttgtaattctgcagggacctgatgatggggacaaacaatcggacaagcccaggttggcacgcaagcgagcgtgcgtgcatgcgttgcatgcttgcatggcaaatgcaaatggatgcatcgatcggtggacagaatgatcgcctgcattatcgcctccgccgctggctcagcctgcgtgcgagtgtgtgtgtgaccgatcatccactggacactggtcagctccagctgcgttgatagtgccggcaatcatccagccgcccggaggccgggacccagctcgcccgggttttcgtctccgtcgcacgaagcgcgccgcggccgagctttttgctggggaaaagaggagcttttgggtagacgattctaatcaccaggtgaacggctattcgtttattacatgtcaatcaaatggttatatttttttaaaaaaattaacacgatatattaatatataattttaaattcaacttatatacattataaaaaataaaaaaatgactgtgaatgttcgtatgcaaaatttgttttttttttcataacttgtacaagttaaatttgcaagtttataaagtgatatattatgaaacttttttaaaacaatttcataactatttaattgacatgtacttcctccgtcctaaaaaaaacgaatttatgactggttgtaacatattctagtacaatgaatatggacagagggctgcaggaat

SEQ ID NO: 54458 - DNA, 1288 bp, Oryza sativa
ctgagttgctgggattttacatttttaatgaccactcattcttggtaatggtatactgatctaaacatgcttcattttcggtgagatttatatcagaattcagaaacatgcgctagctagctgcatggcgctaattttcgggataactagcaaaaccatgtttcatgtttacaagactagtgctgtgctatacatcaatgaaattgaattattgatggattgaaagtttcttcgcttcgtcaggatgagccggccgccaaagatgactcgactgaagataaggctgaggcaagtagtgcatcccaggatgctggaaatccaacttttcccaataaagatctcagcagaaggatagcactggcctccactattggagctgtgggcctctttgcatatcaaagactcgactttggaggcgtttctctcaaagatcttgcagcaaatgctacaccgtatgaagaggtttgcagcctttctcctatgagacttatacacttacccattactggaaaaacagaagcaaacaacgtggaatttctaaatgctaaccgcaatccaccaacaagaaaaggggagcaaaatctcttatgtacttaaaaatctctaagcatcacccattatagtaccttttttgggggcagactgatcagaaccttttacgttcacgaaggaagatgaatatgcgagttgacatttttttatgtgcgtcaagacgatgttctgccactaggcaagctaaatgaaacatccaatcatttcagacaagatgttgttttggatattaatctgaaatatgttttcttctgtaaatgtattatatttttccattggtcgcaagatgctgtctttctttgggcagttgtcacagattgatgatgcattcatttccaatcaataggtccgatgcctttacatgtgaaaactttcacttgtatgacttgtcaattggttaagcaatatttatattttcttcctgtgctaaggtgaatagcttgaatgacaaataaaccttccatgtttttgcttcaaattggtatctggatttgctgcatttcctttgtttggtccgctttgtacataaattttacttcttcttaatacaatgatgcgctccttgggtattcccaaaaaaggatttgctgcatttcctgtgaagacattttctttacatgcctatgaatgtaacctgataatatatatgcaggctctctcaaatggcaagcccactgtagttgaattttatgcagactggtgtgaagtttgtcgagaattagcaccagatgtctac

SEQ ID NO: 54459 - DNA, 1762 bp, Oryza sativa
ttttcttgatcatgtggttgctcttgcttccggtgagcccactgtacctcatgcacgggttgttggccaattctcgagtgcagaatcccgaaagttcatcaagttgctgatccaagaagccatggctaacaatagcttgtggtgatcaattttagtggtaatgctaagacctattgacaagtaagtctcgtttttctgttgaagaggtactatgtgttgtctgcctgagcaccagcatgtctatgtctgtttgcagaagtgccaccagattactttactcactaaaatctcttggtgacagaaactttgaacctttatgaaagctacctttccagctaaactaatactatatactataatttaataatagttaaatgaacttgttttaaatgtatgttatctgaatatcacccttatcgtgttctctcacctgtatattgtcatatgtttcccttcatctgcatctcgatttctaaaagatggtctaattcctgcaggaggcgatatggtctgcatgctcagtcctggaaccaagcattagcgcgtggacattggtactgagctgttccaactcccttaacgtatatgattttgctggtagaaccaggcattcggctacagcattgatatgttggtgatatttgaatcggtgcatgtctgcatacatatttgcataatgaaaatgcagacatgtgttgcagccgcaagcatgcccatgttagtaaactgtttaccaatcaccactagtttctacttagaattgcaatagaatgtttatatacaggagcttactaaaatttgtgtgatatatatatgcttctgctactcttggggaaagctgcacaacctgtgttgatctatcttagcatactctcaactgaagtgaaaaattgcaggccaactattgccgtgtgtcgttcactcgttcgtctgaactttttcagttcggactttctatattttgagcataccagatgagatgacagaatcgtgacgcaggctcgttgtccccattgtcgacagagttctgaactcttttatctaaatctctgttctgttcatatgaagtcattcggtctttgttttcaagagcaagccccttctttagtactctttttaatatttgacggtttgactctcaacataagtttgaccatttattttatatgtatttcctttttccatattataaatcgttttgactttttccatagtcaaacttcttttaaatttgattatgtctatagaaaaatctgtagcatctacaacatcaaattaatttcactataactaacatttcataatatgtttgttttgtgttaaaaatgttgctatctttttgtataaatttggttcaacttaaaaaaattgactaagagaaaaggtcaaaatgatttacaatatgaaacacggggagtaattatttttatgtgttttatcattacaagtattttaaatatgattttttttcatatttgcccaaaaattttaaataagaccaatgtatgtctgtagatcaacgatgtcaaacctagtaaattttactttgggtcatcttttattatcattgttttgcttttgaccgtcatttaacaaatgttttcattttgaaccaattaaatttattttttatggcactttggaccaaccttaacaaggtaataatctaaagttagctacgggagttcattgacaaatagaagccggcgcattggttgtcctaagtgaaacaaagccgatctaaaatgaaaatattagttta

SEQ ID NO: 54460 - DNA, 1971 bp, Oryza sativa
cggcggtggaaacccccacctagatccgcgccgttttggccggatctagcggggctgacgccgggcgacgacgggcggcggggaagcgggcgtgctggcggcggggaataggcggtggtggcgacggttgcgggggcggcgcagctgggcgaggtcgcgggcgcgtgtgagcgtcaccaggcggcggttgaggctttttgcccggaagccggcgaggatggcgacgcagggcaagctcgtggcagtggcggagcaagctcatggcggtggcggcaccgcggagctcgcatcgacgtcgtcagcggcaacggcgcgggagcacggggcgacggcgacggtggcaacggcgcggatttcatggcgacggtggcgtcagcggcttgtcgacggcgacagcacgatggctggttgacggcattggcggctgtcggctgctgtggcattagagctctcgcggcggaggcagcggcgcggaacttgtggcgacggttgcagtagcggctggacaacggagatggggctgcggctggctggtggcgaggtggccgtcggcagcagcggccgtggtggtggtgggaggtggcatggtggcctcggtcagctagccgaggacgtggcagacggctgcatctggccggcgcgggagagtacggaggaggggtcggagaccggcttggcgcagagaggcgcagccgatggcagcggaggccggctcggcacgagaggcgcgggcggcagagatggaggccagcttggcgcgagaggcgcgtccggtggaggaggccggtttggtgcgaggcgcagccggtggaggagccggtttggcgcgagaggcgcggtcggcggaggaggaggcgaccctggtgcgaggaggagatgccggtgggcgtggcacgaaggatggccagcgggggcgccagtgcgggggtcccacatgtcggcagaggttgtgtggtggtggagcatcgatgcgtcagccgtagattcgcaggtggtgtgcggcgggtgtaaacccagtccggccttagccgggccaacaacgatggttaattccccctcctgagggcgttgtcgtgttgtctcacccctcaagggcagttgccgggcgaaagcccagtcctggctcctttgagcccggacggacggcggcggcggtttttccatcgcttctcttcttgaagacgtcattttggcacccctagctgtagggcgatctcgtctgtgttcctttgttagtctagcgacggcaggtcacgcttagcggcggccggtccggtgctagcctccccctggtcgtgtgtgttggcgctgtcggtgtgtgggggtggtgtatttttctttttttctagttatgatcctccagggttataatcttgtaattttttcctgctctgtcaatagaacttcgcaccgtctcgtgcgagtcgttcaaaaagtagaaaaaaagctgcttgtcaaactgtactactgcttgtgtgatcgagcaggatggaaccgcatggttcgcgagcctaccacttcgtgcgaggggagttgttctcgcggaccgcgcaacgctgactggccgcacccacggcgcacacgcggtctctttggaatcagcagacgatgcatcgaatcgtatgcgaagcggtgtgaaactgcacgcgcgcgcggcgtcagcgtgaaacgggagtgcgacacttggggtctattcgtgatactacactttgaaaaacagagcatttgactctgttgcacccaggtcttcttttctctttgcctgaaacagaagtcgtcggtcaataagacaacactacctacgaaaagttgcttagcaactcaaagaaccaccacatctattactgcgtgcgtcgccgaccagttcgccttgatcaagctgggagcttccaaatcaagtgagatcacattcacatcacggaggaggcgtgacaaaaaaatgtgtcggaaaggaggcgcacccgcacacaa

SEQ ID NO: 54461 - DNA, 1909 bp, Oryza sativa
ataagagtacatataagaacccaatagcagattaattaaaatttctaataataaataaataaataatctgcaattaggcaaattaaaaagagagttaaagtaggaatacaattttgaaacaactgcgattgaaaataaaaaataaaaatatcaaaagaacataataataaataaaataaattctgaaattagaaaaagaaaaaaattcaactaggagtacaatttataaataactaaaattggtgataaaaaaagactattgaaagaaaagaccatctaaaacacatacgagattaattaagtaaagtcctataggagcaaagtggtggcggttgatgaacttctagaaagtaaaaaaataaaccccaatgataatcatatttgattttaaaaatctcaattacaataaaaatgagaggcagcgagcgggtcatataggagtacaatggtagagccgccgatgattggtgggtcttctagaaagtaaaaaatgaattctaacgatagatagttatgttcgacttttacagtcccaatgacaataaagattatgcgatggacaggtcgtagagaagtatagtggcaacatttgacgggatttctaaaaattataaaaaacatgaaacccaacgagacaataaaactctaaaaacaataaggttcaatttttaaaggttcgggcttctaaaagtaaaaaaaaaataaaccccaataataatcatgtttgattttaaaatctcaatgacaataaagaagggcggcaacaggcgagccatagaggagtatagtgacaaagtcgccgactttttggcagaacttcaagaaagtaaaaaaaatgaaacttctagaaagtaaaaaaatgaacctaaacgataattatgttcgatttttaaaatagaaatgataataaaaagaagatgcagtggacggttgtagaggagtataatggcagtatttgacgggacttctaaaaattataaaaaagaaacccaacaggacaataaactctataagtttttagatccaatttttaaaggttccaaggagaatgaacaaagctaataaaaaataatatgacagaagtaaggggtagcaactgatgtatcttttaaaaactataaaattagaaataagaggatgataagatttggtttttcaaaatcttaagacaacgagataactatttaataaatttgaagtaaaatcataataaaaaatatataattttatattggtgctagccgcgcaattgcgcggaagccaccacgttcgctgtggaagctagaaattcccacattaatcgaagaaaaagaaaacaagagtccaagtagaaatacaaactaaaaaataactgaaattcggaattaaaaataatcaatactgaaataggagtccatataagaacccaatacgagattaattaaaacctttggcaattctagattttaactgtttatagtatagaaaagataagtgtatagatctgtactgtgtacgttacatactaggagtctttgtccttttctatttctttggcggtgtacacagtagacgtataatctaattcaattacaaacctatatggacaagagttgtgctgccaaataaacaaagcttgcactgctgcacctatatattctgtagatttcaagcagcaacgattgggctagagcggcagaatccaatgatagtgggagccgaccctagtaaaaagacatgatatttacatagatattacaacaaacagatcaatacttgcagccggcaatgcatcaaacaccaaaagtttctttgatgtttatgaaagtacaaatgatatcgacatattgtaattagtgtatatttttcacaggagatgaattagtgcaagccgctataaactgacagtcagattaaacgtttagattat

SEQ ID NO: 54462 - DNA, 1133 bp, Oryza sativa
agtacatagctcaatattagataacatttttttttccgatgcaggtgtgaccttatggagattcaatactcacccaatctcatgtcgtggccataggcaaccataaccttcgatcgttaagaaaacaaagacggcttgtgtgtggggaagaccctgctacttcacggttgcatgtgaagtggatgcagttcagttgtaaggctagcttaagttattatctatttggttcggtgatcagatcttacaggtgaaaaatgtcaagcacctcttctttccctttctcttgtttgtttggttattgtttctgttggtcaatgtaattccctagtatttttttcactttattattctctaatacttgtatgcttgcatagtcaaagcatgtccgatgtaagattgtttagtttgatgtaatgccagtggacatttctaaaaagatatttttggaaatcacattttcggtagaataacataaataagcaatcgaatggaaataatccagccgattaggaagaacggggccattgtaccacactctgtaggctgtaggcctgtagcctctgttccctaatcccagacaatctcggtcgttgattcccaatctaccggtggagacgccaccactgcacgccgagaaattcaggcgagaagcggaaaagcttatccctctcccatcgccgcggcggcctatccatctctctcccccgcacacgctctccctcccatggcgctctccctcaccaccgccttctcccacctctccctcccctccacctccaagttccacccgctccccctcctccacctccgcttcccctcctcctcctcctcccgccgcgccgcgcgcctcgcgctcgccgcctccgccgccgaggccgccgagcctgtcgaggtggaggaggcgcccgccgaggacggggcggatgaggtggtggccgtggaggacgagctgtccggaccggcgctgcgaaagtacgtgaagcagcggcttcccgggggcttcgcggcgcagcggatcaccgccacgggccgccgcaagacggccatcgcccgcgtcgtgctccaggagggcaccggaagggtgttcatcaacttccgcgatgccaggtgtgtgcccgtgccctgcgcgctta

SEQ ID NO: 54463 - DNA, 722 bp, Oryza sativa
agctacaaaattcaaaaagtaatttagaagttagaaactgggtttttcaaaaaaattcatattctcaaaaactaaatcagttgcttctcaaaatttagggagcttaaaattataagaagcaattgattgatagtcggtctctaaagaatatgaaaaagctaggtttcctagtttctggcttctagttcattttctagtttctacaactatagctcaattttctagcttattttctagtttattttttagattttactatatctttttagaatctgaacgaaaagctagagatgattatctaaagagcttctaatcctaaaagaactgcatttgtcagagattcccccaaacaagccttaaaagcatgagcaatgggtatacttggctcgtacccctgctcatggccattacttttcatgtccatctcgtgcccctgtgggggacgcaccccttggtgacttttggtagagggacaagccaggagctacattgggcacgccgtagctagggctggagcttgtggacaccgcttcccacacatgtatttccctttctacccttggccagacctggaggcggcgaggtggtggaggagccagaggcgacgtccgcgaggtggatagcgatgagaggcgagagagaggaagagatcggaagagtcgttgtcctccccggcctcctttgccgacgccgtgcccgccatagtctcctcgggctgcagg

SEQ ID NO: 54464 - DNA, 1709 bp, Oryza sativa
gtagtagctaggtgtagttcatcggatcaagggggggatggccacggcggcggcttgcatctcgttcgcgtcgccgtcgccggcgcgcgtcgtgatcaggcggcagacgcgggcgtcggcgtcggcgtcggcgacggaccggcaggaggtggtgtcgccgaagcggcggctgccgctgcggaaggtgccgggggactacggcccgccggtggtgggcgcgatccgggacaggtacgagtacttctacggcccgggcggccgcgacggcttcttcgcggcgcgcgtccgcgcgcaccgctccacggtggtgcgcctcaacatgccgcccgggccgttcgtggcgcgcgacccgcgggtggtggcgctgctcgacgccgcctccttccccgtcctgttcgacacgtcgctcgtcgacaagaccgacctcttcaccggcaccttcatgccgtccaccgacctcaccggcgggtaccgcgtcctctcctaccttgacccctccgagcccaaccacgcgccgctcaagaccctcctcttctacctcctctcccaccggcggcagcaggtgatccccaagttccgcgaggtgtacggcgacctgttcggcctcatggagaacgacctcgcccgcgtcggcaaggccgacttcggcgtccacaacgacgccgccgcgttcggcttcctctgccaggggctcctcggccgcgacccggccaagtcggcgctggggcgcgacgggcccaagctgatcaccaagtgggtgctgttccagctcagcccgctgttcagcctcggcctccccaccctcgtcgaggacacgctcctccactcgctccgcctcccgccggcgctggtgaagaaggactacgaccgcctcgccgacttcttccgggacgcggccaaggccgtcgtcgacgagggggagcgcctcggcattgcacgggaggaggccgtgcacaacatcctcttcgcgctctgcttcaactcgttcggcgggatgaagatcctgttcccgacgctggtgaagtggctgggccgcgccggggcgcgtgtgcacgggcggctcgccaccgaggtgcgcggcgccgtgcgggacaacggcggggaggtgacgatgaaggcgctggcggagatgccgctggtgaagtcggcggtgtacgaggcgctgcggatcgagccgccggtggcgatgcagtacgggagggcgaagcgggacatggtggtggagagccacgactacgggtacgaggtgagggaaggggagatgctgttcgggtaccagcccatggcgaccaaggacccgcgggtgttcgcgcggccggaggagtacgtgccggacaggttcctcggcgaggacggcgcgcggctgctccgccacgtcgtgtggtccaacgggcccgagacggcggcgcccaccctgcacgacaagcagtgcgccggcaaggacttcgtcgtgctcgtcgcgcgcctcctcctcgtcgagctcttcctccgatacgactccttcgacgtcgaggtcggcacctccacgctcggctcatctgtcaccgtcacctcgctcaagaaggccaccttctgaccaccgccggtcaaagtctccggcgcccggtcatcttattttccgtcctcttcttcttcactaaatattttagtagtattagtaattttttcactctgtatggtgtgatcaatcagcttgtacggatacggag

SEQ ID NO: 54465 - DNA, 5771 bp, Oryza sativa
  unsure (1)..(5771): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcnnntaccaaatgttatcaatttatattacagcaaggacatatttctagctactgacctttactagtgctgttccaagataaacaacagccgcttttacacaagtgccaattgtgtcatactctgacctgcagaaaatgactgggcataagaaagcgaagaacaaaaatcctttgatatacaacattatttttatctatagattgatagacatctaactagtaaccactacccactaataagattcttaaaaacaaagccctccattcatcaatgatcgtctgcaaccctccatcaaaagtaaaaggccaagatctatgtgaccatccaaaaactctctgtcattagaacatacacagcagctctgtttccaactcttatcttcacaaacctccgccacttattatccattatgccagaagtacactgttaccacttatcaccaatacattttgaaacaaccacaacattgatcaaatagggatatgttaatgagacatcgagcttgctctgattagcataagaaaatttacatgctctgggggaacagggaatttaagatcaacatgggagcatggagtaggttgggtccaagggggaactccaacatgtacagcatggctttcaagagggacatgggacagaaatccaaatacccaatatttgcaagtctgaaaatgattgatattttattcaatggttcttatttctagtgtttgcacacgatagtatgcaacaccttattactagagtacatgtaaccaacgtttgatcaacaacaaccacaggaagagagttggaagttgacaggggccatgttgcacatgtatggcatctgcatcgccatcttcatcatctgctgctgcccgagtccagcacaaataacttgttgcatgctctgcatcatctggcaactggtgccacagtggcactgaggcatcatgccttgtagctgcatgcaacattgctgctgcaggagcgccattggctgcgacatgaacatggctgtggagctacccatgcccaacgtttgcatcatgtactgcctacacggatccatggtgcccatggctaatgttggtgggaaatactgcatagtggtgattgcagtagtggcacttgcagaaagagcaattaaggcaaacagggcaaagatcttgctggtgtatgctgccattgctgattctacaatactagtgttaaacaagattccagatggtgtagacaatattgttgaggatgatggaataatggttgcctaggggcctatttatacatgctggtagctgtgtaagccaggaaagagtttggcctttgcaaaaccacctagtggaggccacataagctggaaatcatgaggcatggaatttatttggacatttattcaaccaatacttttggaatatctacacaaagataattctgccagtgctttaatgcgtggaaagaaaatatgatgataaggttgtgccagattgctttggcattttgcagttttgtaaattatgagctggacaaagaaacttttgtgaacagaattcgtatgggacttgtagaatgtgttacacaagtcacagcttacacagataacaattaagagtttgagtcatcgccatatgtgaatgattgagtaggtaaacttggagctttgtaaatgtgccttaatagcatacatacatatgcagtttggcatgtatttggagttttgttaataagaattggaagtaaagaacattgttgtaaagggaaagaagtaaaggagaaacaaattttgggtccatcccaaaaaataaagcaaagattagagtttggccatactctttgctatcctactttccacatatctagttctttatcttacaaataaagagaaacgaggaagtaaacatatttcatgtaatcatattatgacaagacacatttcttaggcaggcactactgacaccatgcaagtatgaagttgcattattttcaattttaactgatattataattatccagtgcagcgatcactgcagggtgaattgggatggagaactatgcaatgtccatgttcagaatcttcatgtttttagtactagagtagtagagatgtaccaaacgtgatgtatagatctcaaaatttccatcctggattgaagaaagattcgaccccattccgaagccatacaacaactcacaaattgcaattgagttcaatgtggtctgccggtctagatgactagattgtgataaatctagggttaaggcttcatagaagatagaactgattcatatgctcatgtgtatgagtattgttcatcgcttgagtagataagttcaaggacaaatgattttcactgaacttggatggagaaaactgttgcacaaggtaagatcaatatattgctgaaatagaaaatatctatctgacatgctgccaggtaccaatgtgctatgaataaaccatcctagctacttatcttgctaacatattatatcacgaataccttcaatgtgatctcccctcagctagaatgaagttttctttcactgtcacgaagttactctactaatgagatgtatatggttggcaatttggcatgcattttccagtttcacaacaacatgttcatcataatatcaagtggcattagttagatcactttatatttgctgcatttgcctcataaaaattgtattcccagatcgtgatcccgtctagctctgaaaacgagctaaccgctcatctgaacttacttgatactcggaggtagacataaaccaatcagattcaattcgagcaacctagttcagaaaacagagcatccaaaccagaacgagcaacgcgatttcatgttctccaacaaacggtcacacgcggaaccaatctcgtgccaatccaaccgagttgagcaaaatccactgaaattgcactgactaaaccccatctcacaagccaaaaacacacagagaaccggcagcatcagggattcaagcacctccttccgctgacgacgcgacgaatctctgtccagaccgttcactacaagcagatctagcacgttcgtgatacggatctcgcggcgcaaggggagatggaggggggggggggagagggagtatacagcggggtggccgagtagtagacgacgtgggggccgaaggtgagggcggcgcagttgaggaagtggaacaccgtcatctcgtccccgccgccgccgccgccgtcgtcgtcgtctccggcgtctgagcaagcaacggcgaggtcggatcgcccgaggtgcgcgacgacttgggctggactgcttgagtgatcgagtcgcaccccatcgaggctaagtaaaagtatctcgggccacgtggatcagttaatgggcttcgcataatcactcatgggcttggagcgggaggatgatggcccataaaacaacatcccgcaagtcggtgacagtacaccatcccggcccaactaacaggccactgttagtcggttaggcttaggcagcaacgttgtttgatccagtgatgggtcacactcccacgtgggaatacaagtgtaaatattgaacataaatcgaaactttatttcatgattcttattctagccagtcgcacacgatagtatgcaacaatttactgttggagtacatgtaaccaaggtttggttaacaacaaccatagggagagagctggaagtaggcaggggccatgctacacatgtttggaagttgcatcgccatcttcatcatcatttgttgttggccaagtccaccacaaatagcatattgcatgttctgtatcatctggcaactagtaccatacccacactggcactgtggcatcatgccttgtagctgcatgcaacactattgttgcaggagagcaattggttgtggcatgaacattgttgcgtagctatctgtgcccgtcgtttgcatcatgtactgcctacacggatccatattgcccattgctattgttggttggagatatggcatggtggtgattgtagtagcggcgcttgcagaaagagcaagtaacgcaaagagggccaagatcttgtatgctgccattgttggcactacagtgctactatgatattgttgagggtgatggtatcgtggttgctgaggaacactatttatacatactaaaagtcgtgcgaggtaagtaatattttggcctttgcaaaaactacctaatggaggctagataagctataaatcatgaggcatgacatttatttggacaattgttcaactaatattttggaagaatacatggtagatactaagatgacgttgtagatatattcaaaaggctatcttttgccaatgctttaagaaatacgtggaaagaagttatgatgataaggctataccataaaagtttggcacttcataaaacttaatttgtagtatagttatttatcgaggtggatcaagaaacttttttcaacagaatttgtttgtgtcttacaaacatgttaatcaacaattcacatataaagtaccttttcaaagctttgtaaataggctttaataatagtatacagacatatgtagctaccatatatgtttggaattttgctaccatgtatttggagtgttgctaaagaaacatgagtgagtgaggttttttgaagggaaaagggataagctacttctgtgactacttgtttttatctttactcattacttgtgtatgtttattcctttatttttaaaaacagaaaagaaatttgagaaactcaaagtatttgtttattcaaattatgaaattaaattttatttaattattccagacactacaggaaatatggagtctttaaactgaaaatataactatatttttaactagtaagtaaagtcgtgtagggatgaccaattcttcttttggatcatcacatgtcaaattggaatggtggggtggtgaaatttagaatgcctgtcactcttgatgtgattagtaatggagacaccaaaaatgatgtctagattgcaaacatttcatcttagataggataaacatgttttgttcaattacaatctcattatggaagtgatacgacagctcacaaaattgcatgagttcaacgtgttctagacctctagattcttatatataaaggtggggttaatgtttcaaagaattatttcacatggtccttgtgtattgtgattgcttgagtagataaggttcaaggacgagtgagttttgactaaattaacatgataactagatgagcaggggcaaaaccacgttggccttctctgataagcatgacccaagttgctaagcttgttcaccattacatattacctctaaacaccaatttatgcttattatacatgtaatattatgtatatgggacaccggtaattttgttatagactcgtcactgtagatgggataaattgttgcactaattaagctactatttattagctagtattgtgtgtttcactagcatcaagttcatcatgatatttaagtggtcataacttaaataatttgagcatttatataagatgcgacatgattttcgagaaggacaagggctgcaggaat

SEQ ID NO: 54466 - DNA, 1299 bp, Oryza sativa
atgtatttaatttgtgtgtagtttttaggatttgtgatggatttgatttgtgatgttgatttgggatgtgcatctcattcgattcgggagaaaatacatagattaacactagccattagcaaatcaacaacaaaataataataaaaaaaatctcgaggaactgtcgcttcccctctttagtcccggttggtagattccctctctttactcccggttggtgttaccaaccgggactattatttgaaccgggactaaagatagcgatctttagtcccggattcgtagtcccggttggaaaaccgggactaaaggggggttatcaaccgggactacaaacggtttctccaccagtgtgagatgcacacgatagtatgcatcatacacttgttatttgactatacaagtaattgaaattcgatcaacaacaaccataaggaaagagttgaaagttggcgggtgccatgttgcacacatatggcagttgcatcaccatcttcatcatcatttgttgttgcccgagtccaccacaaatagcattttgcatgttctgcatcatttgacaactagcaccacaatggcactgtggtatcatgccttgtagttgcatgcaacattgttgttgcaggagagcaattggttgtgacatgaacatggttgcgtagctacccatgcccaaagtttgcatcatgtacagcttacagggattcatggtgcccattgctagtgttgatggaagtatggtatagtggtggtgattgcggtagctgcacttgcagaaagagctagcaaagcaaagacaaccaagatcttgtatgatgccattgttgacagcgtatgggagatgcttaacaagattactagatggtgtaaatgtagaagattatatgttgagggtgatgagataacaattgctctaggggattatttataggtaatagcaatattacacgccaaaaaggatttgatttttgcaaaactacctggtggaggtcaagtaagctagaaacaatgagtcatgaggtgtatttggacatttgttcaaccaatattttggaagaacgtggcgagatgatgctgtagatataaaggtgtttgatcaatggtgcattggtgctttattgagaattgcgtggaaacaaattctgatgataaagatataccatattggctcggcactatgttaaactaaatttgtattctaacaatattcttttagatgggtgaagtagtattttgattataagcatatatataatttgtccaattttaagagcgtgttacataagtcacgacttacat

SEQ ID NO: 54467 - DNA, 4526 bp, Oryza sativa
  unsure (1)..(4526): unsure at all n locations
ttagtttattctggtcctttcaggtttgttcatacttcataggcacttagtgtttttctaggtttgctatgttgcattctgggatgaagtcactcgtgcagctcaagaggaggaagggaacaagattggtgaaaacctcatgattggcctttggcggattattcttgtgagagatcttcctttctcagatcaacgattgaatgggaaaattcccaaggtatcatttgaaaactatgtgtaaattatcttcttagctgcaggataatattggctcaactcttcatattcagttttttttttcatattctggtagtccgtgaaaagaaagattctgagggagcttatcgtaggaatatcttagttttgatgatgtcaatgtaggatattcattttgcaaagctgatttccgttttggtgattttttttttctcttcagctgataagtcatcgccttttccctatggcaagatactcaatttgggtggattcaaaatctcagtttcggagagatccacttggagtccttgaagcccttctgtggcgttcaaactcttctttagcattatctgaacatggagctaggagtagtttgtatgatgaaggtaaagcaattgttaagaagcacaaggcaactccggaagaagttaaaatacaattggatcaataccgacaagatggcattccagatgaaaaacgattcaatggaaagaaaggttcgcttctagtcttcttttggtgtgcctatttttatttccttcttacagttgtaccatgtcttgcatttgtataatattccaattttgattggcactgatctaatgtttttttttccaatttggtttttttagttcacatatcgatatacagcaacttctacatggctatgtagctatttttttttttcgttggatcaccatctttaaacactactcacactcaactaagtcttaattcaatactaatcaccttcagaattcagattcttaggttatgttcttcctcatgtcccagttagtgatctttctatcgtgtaacataagatggtttgccattcatatactttagttcattttgtgaaagagctccacccagctctactcccagttttggtggagctgaaactgtttggctgaactccagctccaggaggggtggagctggagctgtgccaaacaggccctttatgtgagaagtcatttctatagcatttacagtgtgggccaggaaattaaaatgctggggctcacttaaataagtagaataacagccggtgttgtagataactttggttggtgttactgcacagctgtagttgtgcaaaaagcataagctataaagttggccaggctgcatgcgtttagcataaaagcgagctcctttctgcacttgaaccagtgtccagtccagtgaggcagtgatacaggacacggcatgtctaaagcccagttaccccacaggtgggctaagtagaaccagaaccaccgcccaaagtaacataatgtttcgcctcaaatcatacttgtccgaaatgaacagatatgtccttgcaattgcaagtggtcctctgaactgataagttagttaatgaattttctgcccttttttacagctctcgcagaagcttcagttattgtgagggatcatgcccctttgaccaacctcttcatgtgcctttggttcaacgaagtggttaggttcacgtcccgggatcagctgagcttcccttatgtgctgaggcgtctaaggatgcctggtgtccacctgttcccggtgtgcgcccgcaaagaccttgttaacagcttcgggcataggcgcaaggcgaagcctcttgccagggagcgaagatgagcttctgaaacttactctacactgcaattttggtaatgcaaagcatcgatcagattaaccagcttagtctgcagttgttatcccattcatgaactcttgtgtagatgagtagatgatgctaacgtagacaaaggagcacgcactcattcgaggtgcgtatctgctgctagtgtttataagtaagagaaatggttgtaaccatagtcgtagaaatgttccgatagaagaattcgtttcttgcaagttgcaatacgatactgttcattgtttggcacttgcaaacgtcgactgtagtagctctgttgtttatgcagatacagccgttggaggatttccggtcgattttgtccaaatgtgttcgccgagacagggttcaataaataccctgaactttacacatacctttcgggatagtggagtactgtactactactgcatgtacctacctatactcatcaagcgtctctctgcccaacatggtggtgtatatgcaaaagtgagaggctgacatgagggaggggtacaccgtcactgcgtgccaggacgcatttatcatcttcatttacccgtgtgtatctgaactgaagaaggttggtaggcgaagtgaatgcctctgtgttctgtgtgtagtgtgtgcccgtctatggaatgggcgtgcagggagccagagagcgtctgctcgctttgccaaacgcttccaggcaaaaacttctgctggaccatggcgataaacttctgcaggaccatgacgttcttctgattgagacaatgtcctgttcttgttactgtactcggtggagcagacgtaacagtggacgttttgatgagctacagttgagagatcgtgttcggtgttccgtcctcccttccgaggaggcacatttgcaaatgatttgacgcttcctattgccacatttgggaacgtgatagtgatacttcatactactaattcatacttcatactactaaggctgtgtttagatccaaagttccttttccatcacatcaacctgtcatacacaaacttttcagtcatattatctccaatttcaactaaaatctaaactttgcgctgaactaaacacagcctaattcatacacttggagtacagcagtagtagtagtacaaattgcaccaaaagcagttcaattcctcagctttgacttttgacgcctttctttttattagtattagtatttcttttgccgtcaactagtgtcatgggtgatcatgattcatgaaaggatgaactcaaaggaagtcgccggtgggcgctggtggccgtcgaatccaatgccgctttggagagttctctcgcactgtaccaagtgccaccaccacgtatccgaagcgtcggcatcccaagtcccagagcccacgcacgcacgatcctgtttactaccagcaaatttatccacaaaacgctcgtctttctggcacaaaagatggctgcgaaactcggcctttcgccgcttttcccctctctttttcctgccattttcttccgttgcgtcttgcgtgcagcagcagcagcagcagcaaagccacacaaggtatctggctttccctttggctcttctcgtgtaacctttctctttagatttctttctcttctcgcgtttctctgtctcaatcgccgtgtaaaaaatgagtaaaaagattagccgcacgtagcagcactgacccttcgctccgcttttgctacgggagaagcgaagcaagcccaggattcgcggccggtgtgcgtgtgtgagatacgccgtgttcttctcgcagtcgcaggcaggagtagattatgctggcggtttggtcactttaaagcaaagcgacgtgtgtttgtgttggtaattgtgatgggtttggaggctttctgtcatcaaagcgtatggttttctgcgtcaaatcttccttctgacacggttttttttactttggagtacagtaactgcttatgtacagtaaaatatttggggatgagatgttcattggtgcagcttgcttgaaaaccaagtactgtactgttttttctgcgtcgagaaaccggttagcattaatgacagcatactcagatgacaaatgcattcatatttttcagcacttctgtctccccttgatactgtagctgttcaagggtgagttgggtaggttactgttcttgagacttcacaagatctggtgaccaggtcatgacacattgacactaaatacattcgtgagctggtttatttacaccttaaaggcacatgctcctattacatgatggaactcttcatgaacgtaggccccgtttggcacagctccagctcccaactcctacttacctagagntggagctgtgccaaacggtacaaattctttgttttttggagcggagttggcagagcagctccacaaatttgtactacggggatggagctgggtttttgctgctccacagctccactccacttcaaaagacccactacccttttaaattttgatgtatttacacagaaatgccattgaactacccctaaactcctcctcctcctcccatcctctctctcctctcccatcttctccggcaagattcggcggcaaccggcggcgggcaggctggcggcggcggagcacgggctcggcggcggcgtgcgggctagcggcggcgcgcgggctcggcggaggcgtgcgaggtcgg

SEQ ID NO: 54468 - DNA, 4795 bp, Oryza sativa
gcgacgcgggggctggccgctggcggcggcgcgggggctggccggctgacggcggcgtgccgcttggcggcggggattcttttttttttctttttttttcagatctggagctaaaagtttgccaaacacttttgatgggtctgtaactccaataggagctagctccaactggagtaggagtttggagctgggagttggagtttggagccctaccaaacggggccgtagtactatgcactcgtagtagtagtaatggccaagaacacctaacacagcaacagtgcaatgcactcgtcggtaaaaagctgaaaagaggctgtgaaagttagaccaccgtggtgattaatcatcagctaatggtagcatctttgcatcaaagagtatatccaacagtatccaactatcagtagtatccatggtggtcgtggacctttgctcccaaaaaaagacattggattcgcgtgtcttttgaccttgcaataaagaacacaacaacacccgggctcgctggccaagaccaagagagcagaagcagagaccttgggttttggagagacccaaaaaaatgagatggacggacggatggataccgatggatttgatagaaagaaagagctgtctctgcagtgcacacacacatgcatcttttgggatctcaagaagatccatgcatgcaatgcaacgatgcagcaaatgagatgcatttgcatgtgccagtggcaagcaagcaaaggggcaaagcatagtctactccatctccatgtgacatttgacattggaaatcaagattccaagctccatcacacacgccctgtgactacgagcatgtctgtctggactgccagtcttgttcttgtcggtaaagcaaaaatgaatcttttttttcaacactctcaatcttgctgtttgcacagtgatttaacttaatcactgatgagagtagtagaagtactagtagtactccctccgtctactaatataagggattttgacattttgcttgtactgtttgagcattcgtcttatttcaaaaaaaattggaattattatttatttttttgacttactttattattcaaagtattttaagcacaacttttcgttttttatatttgcacaaattttttgagtaaaacgagtggtcaaacagtgtaagtaaattgttaaaatttcttatattatagaacggagggagtatcaaaatctcttatattatgggatagagggagtactatagtgggaatagggtgaacagtaatgtaacatgaaaatgcttactcaggattttggtgcagggtgagatgtgattaatactttaatcatcatgtgatgcagtggccaatcatggatggattgacttggacatgccatgtggtggcttgtgaaaagatggcaggagcaccaatccatcaattcacaacccaaggaagagcaagaggagcagtgagtgatgtacactctgcaatagctgaccctggagaagctgggccttcttccatggtggcagccattgccggatggggagcaaagcaatgctggttttgtcctcgtgtacattagggatgggcagtttgtaataacgtgatggtactgtgtccaaagctgcagattggccatggtattggcatggcatggcatggcattgtgtgtgcctaatttaagaagcgcatggaaatcaaaccaaaatttggcacggttcaattgttcaaaacttgtctgccgtctggatgtcatataaaacagggcacaccagtattttcattcaagtggtaggcaacaagaacatggcatgtaaagggagttagtagagcgttctctattttatatatatggccggacacaatgagatgatctcgtggccatctgttatagtactaaccatttgttagatactctgcgagatgaaagttattggttctcatgtgtagcaatcataagacattctgcacactattcctctttgcattaatctatctattatattattaagacaaccttgaaagaagacattacgtttgttgtgggggctataaattctcacattaatcggagaaagagagaaaaattctaaaccgttagatcgtagtggatctaaattataacggtgtagattgatagctatatatatgtagtgcaattgtagtttttaaattataataagttgtagatgaaatatagtaatctactactcatatttggaatcaggcagattagaatcggaatttttttctttaatgaaaccgttaaggagtaggattgcagccgcgtgaatttttcctgttctttaatgaaaccgttaaagagtagaattgcagctgtgcaggagctaagtgctgaccggcccttcatgctctgctcctgtgcttattagaactctagatttactgtgaaaagcagaggctcatggcaaactaatcaggagtaaacacacaagccattgttggaccatgcatcttccgagttaccagttggcatctggccaaagcacatcttcacacattaagctttatatattacttgctaaaataattttaggacatcatcttttcacttatgcttatacttatcagccaaaatttaaattttcaactttaaatataaagctgatttaaagattttttttcatcgaagtgtatttttcagcttttgcttttaaacaaccttgaaaatataaaaattttattcacaaattactttttttttgcaaatatgtcgttaacgatggaaccgttaattgtttgttaatcttaaaacatgtatatatgtgaaagcatcctatcaatccacaggtcagattaaaaagggacaatgaggatatacattatgttaacagaagcaaaaaatatcaccaagtttgatttggagttctagaaatatcatattaacaaaagaaaacaataactatttacactattagattatgacagatctagattataatggtacagattaattgtactatacgaagaaaatctacacacctaccaatgtattgcatataaaagaaatagcagattctaaaaccacacaattatatgacaattcgatttaacatgcctaataaagaatagtagcggtagacattcgagtggagtggtagcataggaataggaagtggagggacaatagggaatataattttgaataatataactttgtttcgacgctagccatacaattgtgcgggccgctcaaccttaaaaggagtcaccatattcatcatggtggctaaaaattcttatattaataggagaaaaaggaagaaaagaactcaactaataatatactaaagactacaaggtccaattttcaaaggtttggaacttctaaaaagtaaaaaaaaactaataataatcatgttcgattttaaaatctcaatgacaataaaaaaggaggcagtgggcgagccatagaggagtacaatggcaaaaccgctgatggtttggcgggacttctagaaagtaaaaaaatgaacccggacgataattatgttcaaattttaaaaacccaatgacaataaaaagaaaagacaatgaatgggccatagaggagtataatggcagcgtttgacgagacttctaaaatttataaaaagaaacccaacaagacaataaactctaaaaattatttgatccaatttttaaaggttccaaggagaataaataaaaatagtggtagatcgagcaagtaaataaagaagaagatgacaaaagtaagggatagcaactgatgtaacgtttaaaaactatataactataaacacagggatgataaggtttggtctttcaaagtcttaagacaacgagatagctatttaataaattttaagtaaaatcatactaaaaatatatgattttgtttaggtgctagccgcgcaattgcgcaggccacccagctagttagcttgaattgacagtgcttctcatatctttaattaacatcgtctgagttgtgcaagctatcgttaaataagttatcgatcggggatgtcacacgccacggcacgcatgtggagccatgaccttgaaccctaagaacggtgtgaaatgcctacttgaaatctactatgttcattttttaggtttctcgttataaaagtgatttttagataagatttatactaagtgatgaaagagtagtaatttgcataagatgatggactgggtttttcaccttttggttcttttagaaaacttattctataaatagaccaataaaaaaacttattttaaaagtggactttttcatggcgccggtccaacatgacggcatctatgatcgttggcatcgtccccctcatccctagttggaagctaaataatttaaagagagacaacaccaatatcgttgacaccgagggtttatttgtacttttttttaaaaaaaactatttgtaataaaaaaatatttataaacagatcaaccttcaaattagtgacttactctattagcatcgttatattggaccacaacattaatgaagttggcgccgtgaaatgtttaattcctaaaataagtttttttagtctatttgtagaataaatttttaaaaaagaccaaaagatggaaaatcaaagaaggatggacaacacatccaattcatcgtactccaagtaatagtaaatgcttgttttttctacagagtctcagtacaaaatcacttgttagcgattgtttagtttggtaaagtaacaaatgtccgactgtccgattcaacatgaatactcaaatttacggctagttatcttttttccacacgaatgctaggagacgggataccgttgccctaacagga

SEQ ID NO: 54469 - DNA, 3872 bp, Oryza sativa
agtgtagcagtagtacttgctttgttccattctttagggtttgtgcccctaaagaatggcttaaacattctttcggcaaatgcgtgtgctcttgtctttaatgactgtttgtcttagcagggtaggagtaggttctagccttttgttcctgtagtttgtactactactaggatcatttcaggtttgggttgctttttcaaagacaaattgcgtgaaatatattcttttctgcatgttttgtttattagtgtaaacattattgtttgcatgaaatgtttacagtgtcacattcagtactgttttcacaaaaaaattttaccttaagagaataagagtttgtatcttctctttgaaaaatcgtacagaggatcatgtgtgcatctctttttttttaatgttttgtttagtgttcaaattgttgcatgaaatgtttacaatgtcacattgggttctgtataaaacattattttaacttacaactactgcatctgtcccaaaatatttttgaatggaggggagtatctctttttattttacaaacaattatgtatacagcggcatgcagactcgaaaactgtactacattttacggattggcaagtgccaacctttgggtaatataggtgttatggtacatcacgattgcttgagactcaggagtcaggaattcaagatagctgcaccaacccattgcaaatttgcaatgcaaaaggaatatatgagatggttggttgcattagtgatgagttccctttacttccaaatgccaaccaattttagtttgtacaatcaatgtgtggtactatcacgggatagtatatgtagcgtaaacctataaactattgtaggatacacaaatggatgtctggaatttgttcacgtccccctgattaatcttttacttctagattaaagtatgattatttttttattggctaaatctcagatgataatttgtgtatcatataacagttttcaggtttgtattacatacagatggtttgcactatatattttctccgctatcgttgtgtctctatctccaggccatttctagtcttctctacatgagccaatgggaagttggcttgcattgaaatttgcatcattgttgaccatagtggaaggacgagtgagtattaacaagtggactcattagtcattagtcatggtggttagtatgcacgtacgctgattaatttgaaacaaaccaataatgatgcccttctccaaatggcactgcagactacctgctctcggctcatttgctggtctgtcagtatcataaaacaaactcatcgcagggcagaaaaaactattatggtcacaaagatttctgaagagctatgtcaggcacatctggaaacctgcctgttccattaagaaccccaaactccaaagtgcaatttcaacatactactaatattctgatgctgaaatccctcaaccaagtttggtagacaataacctaatttaacaatgctgatgttttgtcggttaggtatgcaagcttggctctattagcagctggatgcagtaatcctgagttaatataatcccacaatcttactgctgctcacaaccccaaaaactgttactcgaggttggttgaggtagaaagcctaagacacatataaccaagctgatgttagaaaaaaaaaagctaaccttttcctagttttgcaagctgcagaatacaaagaagccgggagggattaaaattttcagacctgtggatgcaaaaaaggtacagtgattagtgtatactactactactccatttatccagcaaagaaccaagggaaaagttgtgcgtggcattttcacgagatgtcacagtcaacggcctttttgcaggcgccctaaacactagtgtgcgtcactggttgtggctgtgctgtatataacgcagagtgcggggtttctgcagagctggagtggagaaaggagagacctttccattccctctctgaaaaaacaacaatttagtttttgacctgaagggtggtagtagtgggctagttggcggtagatggcattgacactggttgccaagcacagtgcaggttttgttggagcctagtgtggcttcagagctcagaagcagccacatttctgcattcttggatcatttggagctctccttgtttgttgttgggtctcttctctttcctgcttccgagttctgtgaaccagccaactaatctctgtaagttctactatcttgttcttatttctcctgctcctttgcccccaaggatatggctactactgcttgatgtcctgttgcttagagtgttcttggctggttgctttcagttcttgattggttcataccttggtgccaagaaatggaggtggaggcgatggagaagaagggacacagagcctttgctaaggcaattaagtctttcggttcttcagaaaggcacaagcgttctaagaggtttgtgtctttggatttcttatgcaaagttctctgtttctgttgttacgaatgctaataacgagatctagatgtttttctatggcagtgatcttgaggatatgtgtgctaaagatgcgctgtatgcttcagataaaacatgcgttcagcctaagccagtgagtttattttctgttctctgttctctgttctgtcttccacgtttttctactgtattctgcagtaaatgcataatagttctgcatagtttcagtaattttgagcattctgtgttctggtttactcaggatgctgtaaaagttaaggtaaaaagtgatatcaacgctgaagtgcaacctgggagaggagcgcagagcttcttgagaaaagaggtaatgagtgtaaaattctatttttcttcattgattttatcgccaacctgccctttctggacttaaaaatcttttttagtaggaaaagaaaagaatcacatttcaattacagacaggaggttgcatttcctttttgtatctccatgcttgccaaatgacactttttttttaaattttcgtttttggccgaacaatgcaaatccttaaacagaccaggtttttttttgtttgttttacaaacaaagcatgattttcccagtgaaaaataatcctggtaaaaatttctctgcaaatggtctaggataatgtcacttttctgctgaattcaacatagtttagactcatcatgacggcctgatgcagattctccagctagaaaagcacctcaaggatcagcaggtcatgcgtggcgccctggagaaagctctgggaccgaacgctactgctgctccagtcaacgtatcaaacgagaatccaatgccaaaggtaactcctttgcctaaccacatgaatgagaattcaccaattttaagtttttaaccccttacctgagcaatactgatctgaagataaaatggtttttttttcaggatgccaaagaacttatcagggagattgctacactagagcttgaggtgaagaacatggagcagtatctccttaccctgtacaggaaggcctttgagcagcaagtgcccacattttcccctcctgaccaccggggagctccgaagccgccggtaccggcgatggcggcagtgagctcgcagcctgtgcagctgcagaaatcacccagtgtcaaggcatctcgcaagaacaacagagctgacgcaatgctgcgatccagctacccgccaccgtcccgtaggacgttgaacgatccagtgatgacggattgctctacgtcgggttgctctagcaggctaggtgaatctgatgttctccggtgccagtctgcggtgtcgtaccgcggcatttgttcgtccaggatttcaccatcggaggacagtcttgcgagagctcttcggtcatgccactctcaggctgcaggaatt

SEQ ID NO: 54470 - DNA, 2937 bp, Oryza sativa
atgaattttgtgagcaggaaggagagagtactgcagcaggagtgataagcttagcagagtatctaggcactaatgtagctgaccacattcctgaaactcccaacaacctatcggaggagatggtgagatgcatggcaggggtgtactgcaaacttgcagatccccctttggttcaccacggctcgtcgtcttcgccaacgtcatcgttctcctcgacgagtgcgatatccccgcagtatctgggggatatctggagtcccaattacaagagagaatctactctggactctcgtttgataaaccctttccatgttgaggggttgaaggagttcagtggaccatacaatacaatggttgaggttccactgatttgccgcgatagtcggaggctaaaagaagttgaggatctgctccagacttacaagtgagctgttctttcttgtctctgtttggtgaatgcagatatttttcttatatgttcaatgtcctaatacgatatactgaattgtatacttcaggttgattttgtaccggttggaaaccgtcgatctcaggagaatgacgaacgaagaaaagattgcattctgggtcaacatacacaacgcccagctgatgcatgtaatgcttctactgtttcagttcactacaaatttctagcattgtctcaagttgtttttttgttaatgggtataatttgtactacctccacaggcttatctaaagtatggcgtcccacagaacaatctgaagaagacatcacttcttgttaaggtaaacattttcctttgtagaatcaatggaatgcacctttcgtgtacttaattcagacgaagtttcttctttccctgacatctgttcaccacaggctgcctgcaaaattgctggacggagcatcaatgtagctgttatccagagcatggttcttggatgcaacacatactgtcctggacaggtaaagcaaacatgattattaggtcaaaactagttaaaagtgtaatattcacactgtactgattatatagcaagcatgctaattctatgtgttgttccttttaatgcagtggttacgtactttgcttcacccaaggatcaaaagcaaagtgggcaaagtagggcatgtgtggcaagcctttgccgttgcacaatcagagcctcttttacgctttgcgctttgttcaggaagccattctgatcccgcggtaagctcattgcgttttctcaaattggtgtcatcttcattgtacctcgatctattttaaactaaccaatgcttccttttatcaagccatacttgagtaattcaaccctttttagcttttaggcacaaattcggtatgaaaaagtctcacgtgtcctgaggaaatcataccctgacacattgtcaaaacatgctaatgaaatgaaaacctttcactgattggggaatattgttaggaatcattcaatcattctccatgtttggaatctctcaccaaagttactgcaggcattattacttggtggtgccaactactgccaagccagtcaatcccctttagtcacaatcatctcacaaactcctctttttctgcaggtgagagtgtacactccaaagaggctgttccatcaactggaggctgccaaggaggagttcatccgggcaacggtgggcatctggaaggagcagaaaatactgcttccaaagctcgtcgaggcgtatgcgaaagacgtcaagctctcgtcgcagggccttgtcgacatggtgcagcgctacctcccggagagcttgaggatggcaatgcagaagtgccagcagagcagatccagcaagatcatagaatgggtgcctcataacctgaatttccggtatctgctgtccagggacctggcatttcctcacctgaactgactaatcttactgctctctgctcaaataggctgtgaaatgagctgaagtatatgcattgtatcatatagatttagacgtaaggattgtgtagggttgatgtgtgagtagtgtttatctttgcctgtaaaaatttttgtagatgaacagtaaaaggggaagaaatgagaaagaagcatcctttggttatctgacaatttcggtatgttgtgtcattgtgtgccatgttaagcctctttgtgtgggccgaaatgcaggtttaatttttcggccatgttggactgacttgattacatagatgggccaggacttttgcccatccaaacaaccaaggttcagaccatttgatagctgacaaatgtttaggtaacaataatctatttgggctaagagaacaccacatcggggttttttttttttggcagtttcagagctgaagattccaaatgaacactgggctataaagaaagctactatctcaattcagagcacattggacggtgtgttagctagagattggagaatacattttgctctcttggtagattaatcgattgattattcttttattcagatgagtctgttgactcttgtgttctgaacttttgatccacatgccattcaacaatttcagtttttgaagatgcaaaaggcacaaatagaagttatgagcttaggcagtgatttggcagttggtagcacaccatttcttatactttataatagtagtagtagtatcatttatatttacatttaaatctacctacattttcttctcatgtttttggcgcctaaattaaccgcaccaagaacggacgcaggctggctaccgttgctacacatcacaacgcaagcgcaagctcaaagcatcacaaggattcccagccgtccgatcgagttgggcccacccgtctccccttggcgtgggacccactgccagtgagacagtgcactgatgcttctcgctgtctcgaggtcgttggccatggcggcgaggccggggcgctctactcggactccggaatggcggtcaggtcaggagagaacttgct

SEQ ID NO: 54471 - DNA, 4323 bp, Oryza sativa
  unsure (1)..(4323): unsure at all n locations
tttaggccgtaacatttagcaaaaaactaatcttaaggtcctgtagatactagtgcaacattccctattcatagatccgcgcccgcctttatcgagttagatacgaaattatccatctttgaaactggtattaaggtggtcgatcttttagctccttatcggcgtggaggaaaaatcggactatttgggggagctggagtaggtaaaacagtactcatcatggaattaatcaacaatattgctaaagctcacgggggcgtatccgtatttggcggagtaggggaacggactcgtgaaggaaatgatctttatatggaaatgaaggaatctggagtaattaatgaaaaaaatcttgaggaatcaaaggtagctctagtctatggccaaatgaatgaaccgccaggagctcgtatgagagttggtttgactgccctaactatggcagaatatttccgagatgttaataagcaagacgtgcttctattcatcgataatatctttcgttttgttcaagcaggatcggaggtatctgccttattagggagaatgccctctgcagtgggttatcaacctactcttagtacagaaatgggttctttgcaagaaagaattacttctactaaaaagggatctataacttcgatccaagcggtttatgtacctgcggacgatttgaccgaccctgctcctgctacaacatttgcacatttggatgctactaccgtactttccagaggattagcttccaaagggatttatcctgcagtagatcctttagattcaacctcaactatgttacaacctcggatcgttggcaacgaacattatgaaactgcgcaaagagttaagcaaactttacaacgttacaaagaacttcaggacattatcgcaattcttgggttggatgaattatcggaggaggatcgtttaactgtagcaagagcacgaaaaattgnnnnnnnnnnnnnnnnnnnnnnnnnnnnnnnnnnnnnnnnnnnnnnnnnnnnnnnaaagtatgttggtcttgcagaaactattaggggatttcaactaatcctttccggagaattagacggcctacccgaacaggctttttatttggtgggtaacatcgatgaagctagcacgaaagctataaacttagaagaggagaacaaattgaagaaatgaaattaaatctttatgtactgactcctaagcgaattatttgggattgtgaagtgaaagaaatcattttatctactaatagtggccaaattggcgtattaccaaaccacgcccccattaacacagctgtagatatgggtcccttgagaatacgcctcctcaacgatcaatggttaacggcggttctgtggagcggttttgccagaatagttaataatgagatcatcattttaggaaatgatgcggaactgggtagtgacattgatccggaagaagctcaacaggcacttgaaatagccgaagctaacgtgagtagagctgagggtacgaaagaattggttgaagcgaaggtagctctcagacgagctaggatacgagtcgaggctgttaattggattcccccatctaattgaagacaacccaacggtttagttgatacaaagaaaaagggaagaggggtagaaaaaattattagatagcgaagcgaagtagggccaatgctatctagtaatttttctacctacctacctactattggatttgaaccaatgactcccgccgtatgaaagcaatactctaaccactgagttaagtaggcaatttatcaccacaaaggaagaccctttacttcgatcgattatagatcgaatcctttttataagcaaataccgcttcgttattggtatgttattatagtaaacagatcaaaggatatcctctactattagagaatattcatcttgacaagaaattctctatatattaagatatctctgacaagggctatagctcagttcggtagagcaactcgtttacacgtgcgccaatgcttttcaagggagcttattatgcaatgaacatagtggatcttcttgcaaaatcaatgtcttacttcatggattcgagagaataggagaacagtcgcctgacaaatagttggttcagtccgattcaggtaccaatccaggtgcctaaacaaatagaacctttattgatttgctagttgataaggtaaatatccagcccactaaatgctaggcttaatgaggataagggcctccaaaaaaattcttttcgttctatgaactttaaggtgtatgaagtctcatagtcaactcttgtagcggaacgatagagactctatttcacttaggttgatttaatttaggccggaggcagacctaagtcaaggtaatcctcctttgaaacactttggtattgctcttagatagatcataatacaaataatcaatcagagcgcagggagccatctcattatctttccgtaaagaaaaactatggtggactaactgatctttctatcagttgataaaagagcccaatgcaaaaaaatgcatgttgggtctttgaaacagttcgaatcatttcgataataatccgtttgatctgttttaccgagaaggtctacggttcgaatccgtatagccctaatatgtcctttgctaattctcaaactacggaaccaactgctttcgcaccgggggaacaagatccgtttcaaggaccctaagaatttggaagatatctcgagaaaaggttttagcaccggtctctcatatatgtactccagtttatccgaagtatcccaatggtgtaagaccgtcgactatttgggaaaaaggaggaaaatcactctgatctcagatttcggagaaataagtggctcacgaggaatggagagacagattctctatttgatctcgaagtcctcatataacacttcttccagtcggatcacttgttggaaaaaaataatgctcacacatgttccacacgggcaaggaagcataatctaatgaaagccgtctgagattctttctataggaaccctgaagagaaaggaccctcaaacaaaaggttcctgaataaagaaggatgtaaggaagctgtcgtaaagtttcgttgttcgttccgtagttgaccctatctatgtttctacgatggcccaagaacacgctcattcttcagccgtagagagacttttgaattgtgaggtaccattacgagctcaatatatacgagtgttattctgtgaaataactcgaatttcaaatcattcacttgcttcaactactcatgctatggatgtgggagcatcaactccgttcctttgggcttttgaggagcgggagaaattgttggaattctatgaaagagtcccgggagccaggatgcatgccagtttcatacgacctggtggagatgaattcagaggactcaatgaagagtgctctaaaagaaacctcctcgcatctaagttttataaaactagtgggtgtcaaaatcccaaattgacagatctctatcatcatgtacatgaaacataaaaaactttaaaaaaaaactacaacccgaaaaaacaaccacctgtcaattgaaccataggcagacctcttgagctacccacagcaagtccggtggcattgtagcccacactcgcccatccctatgcttaaacaacccccaaaagacccctatgaaaatacctgtgaagatcgtgcatttcagtcacattcagatccgttttttgagtccatgatataaccaaattggatggatcttccacccgtttagctaagaaagaatagatgcagaggtggataatagatcgatatgaagatcatgagctgccccataatgaaaccaccaggagtcgcgaatatctccttcttccctaatccaagattggagaaagaagatctaagagggacccatggagaatgtggtcagaaacccataatagagtccgaccgcaacgaccgaattaattatcctcatcgagaaacttagactactaagtagaaaagatttgaaaatcatggcatgggtctcctttttttctttctttagagttttctatatgcacaatttctcgatgtttcgatgagaatttcttgactttccatatatagaaagagatagactataaatgacatctcttatgtcaataagaccaaagggatggatattaaatgataggaagtgctaggaagtgaaatagaatgaaatagagccactctgggcttacctatgaaatgaggcatggaacggagccactacgaagaaattccgggagttacgaaagaagcttcggactcatattgttcatgggttgagagcgggagttgaactcta

SEQ ID NO: 54472 - DNA, 764 bp, Oryza sativa
cgaggaccaatgtccgtctggcccgaggaaacctttgcacgcctccgttaccttttgggatttggatctttttcgtatttcaaaatagtgaaaaagtcaaataagaggtgttaagctttttatcattctggcatcgagctattttgccgcaggacctcccctacagtatcgtcaccgcagtagagtttaaccaccaaattcgggatggattggtgtggttcctctacgcctaggacaccagaatatcgaaccatgaacgaggaaaggcatgagagaaatattggctagtaattgtgaagccccaattcttgactggaagggacaccaaaggcctctgccctccctctctatctatccaagagatggaagggcagagcttttttttggttttttcatcttttcatcaaagagttgaacaatgaagatagatggcaagtgcctgatcgatttgatcaggtcgtgtaggaacaaggttcaaatcgttcgttcgttaggatgcctcagctgcatacatcactgcacttccacttgacacctatttaaacggctcgtctcgccgctaccttatcctatttccatgcttctgtcgctccatccccgtatgggtggagaacccgtcgctgtctcggctgtgctaccggaggctctagggaagtcggaggagagagcactcatcttggggtgggcttactacttatatgctttcagcagttatcctctccgcacttggcttcccagcgtttaccgtaggcacgataactggt

SEQ ID NO: 54473 - DNA, 1042 bp, Oryza sativa
acttggggagatttgattcattctttaatgtaagaataaagaattgaattaaagggcttgctttgacccttaggagtaggtaacccgttcgctatccttgtttctattgcattttatctcatcgtatcacattctgttctacgattccacttcgacaaaaggaaagagcatacccaagttcaatagctttacgtccgctatcccgatcatggttttcctaccctcagggggaaagtaaaggcccttcccctttggaaggctgtgggcgaggagggattcgaacccccgacaccgtggttcgtagccacgtgctctaatcctctgagctacaggcccaccccgtctccactggatctcttcccgggggtaccccccaaaaggaacctccctctcctcagccatttcatttcgggttaagaagatgggaaagcccctttctctctataagaacagtgcgttccgaggtgtgaagtgggagagaggggatgtgatgattgaggttttgaataagacgacctttgcattttggatttggatctttttcgtatttcaaaatagtgaaaaagtcaaataagaggtgttaagctttttatcattctggcatcgagctattttgccgcaggacctcccctacagtatcgtcaccgcagtagagtttaaccaccaaattcgggatggattggtgtggttcctctacgcctaggacaccagaatatcgaaccatgaacgaggaaaggcatgagagaaatattggctagtaattgtgaagccccaattcttgactggaagggacaccaaaggcctctgccctccctctctatctatccaagagatggaagggcagagcttttttttggttttttcatcttttcatcaaagagttgaacaatgaagatagatggcaagtgcctgatcgatttgatcaggtcgtgtaggaacaaggttcaaatcgttcgttcgttaggatgcctcagctgcatacatcactgcactttcacttgacacctatttaaacggctcgtctcgccgctaccttatccta

SEQ ID NO: 54474 - DNA, 761 bp, Oryza sativa
ggttgaagaataaacactaaacacatatacctattgcatttatcactctttctcaaataacctttagcacaaaataaccaagagaattttttttcatttttttcttttcttgagcctttttgctcatatttttctcttttattccgggtacgtccctgtcgtcaagactgtttccagggattcggcacccattattttgctcacatcgaacacgtccttgtcgtcaagactgtttccaaggattcgttattcatttttttcatattttattctctttctcacaatgagcaattaaagctatttgaggaataacaatttaataaagcatatatatagagcatttatagatcaaaccatatgctagcatcaacattgcatattttcttaattcaagtatagaatttaagtgtcatgcatcatctcacataaaaacaaaatctaaatctcatgaaaagactagaatacatacaagctatgttagagacaaataaaccttcaaagtattgctagcatgcacaagaaaataccatatgtataaacaaagctctcttttctcaaatttttctcattgtcatattattgcttgataaaaccatgaggtacaaactccccctcaaaccatgccaaaaggatgaattattcccaattcaccacgaagaaaagcaaagcgattagaatccaaaggtttagtgaaaatatcagcaatttgcaacttggtgtccaaaaaccgaaattcaacatctcccttctcaacatgatct

SEQ ID NO: 54475 - DNA, 14136 bp, Oryza sativa
ttctaaattatatttgcatcaggcattgcactgacttgcacgcagatgtgataaatgaggcacctgctggcttgcaaagattgtagtgttgtacatttcatatgtatatatctacatgatattgtgctttattgcagaaaatctgtctaataggaattgtgtatactaatctaactaggatctgacttttgacatttgcacaattattgggaatactaaagatgcctctgtgtttcgaggttgctgcctcaagcctgcaacaagcccgaatcacattctcctagaatgctccaccagcatgactttgtccaaaattaatgtcccaacattaattgcactagcaagcttgaaccaagaagctgccttataaaattctacctgtttcagccggcctcataatattgtgcaaatttgaagttgttcctgaagtggccaaaacacccccgtaaactaggtttgatatttaatggcaggtgagcttcaagtctgctgacatgaacatgagatgtaaatatactccttaacatcgactaaaaggggggacattcctatgcacacatgcttcaggtgcactttgtgcacaacaactaaccaatgtcaccagaaaatcttaaataaaattgttcatttacttctaatcttactccacctatatataagttttggaattcaaatccattaaatatcagcggttaccaaaaggaaaaaaaaagaaaagaaaaaaactctctgttttatgagtatgtatatgtcagttggtgtgcacagtgagtgcaccagagctgtgttcacgtgatatgttatggccaaaagagtttgtgggaatttggaaatgccatctttaccattaccaatttggccaaaagggcttgtgggatttctaacaaattaaatccttctcaggattcgaacccatgaatgctgtccacttggtccacacattaccattattaggatatcattttgaacaaaagtaggtcttctagtgactttgatacatttaaacttcaaaactgaatggaaatattttggccagtaaaaactttatcaggacttgcctaactatccagttacttgcattaaccactaataactgcctggtgcaaagtgtgctggttctgtctcgagggggcaacagcactgttatagcctctttattgctgcggtttcctgatactcaccactaaacattttgtttcaggctgcagaagaggcgctgaagaccttgaaaacaactacggacccacaaatcaagaagcatttgagaccagtaaggtagctatttgatgcttgccgtttttgcacgtcaacatatcttaatttgcagatgaatgctatttttatttacgaataatgttttgttctggacttcattgagtatttttgccagtatctcttcctaaaaatatcttgtattctggatagtaagatgtaaattaatcattattcagtccttatgtctctcttatcttacagcttgtcatctcttcttattatttttattccagatgcaacagctgaatttccccttatatcccacagaggtgagtttgataatgttgaaatgtgaggccagctgttgataacatgccattttcaaaattgtggcattctggcaatccattggtttattactggaagcgcttctccaattatggttggctggctgcctcttgaaccatgattttcatgcaaagtgttttttgcctctccgagtttagaaggtgataaattatagagaattgggcatggtgcatcgtggattctgttgaccttggaccgtttgctccatacaaccaaagctgtaatcttcacaggatactggcgtagttggatagctgtaaacaggtaggggtaggggtatgtcatgaatattgactgtttccttgacggatacagttatttgtaaacaagttagtttaattaaagtggaatgtccacgctgatatttcacgtttacatgttttaaatgctgccagctttcttatgtaaattaaagaaagcattgcaaatcatggacatcatttttactagatcaccagaacaagagcatattagcattacaactgaaatgattgagaaatgaacgtaaatctggtggattaaagtacatgtggttgagcttatacgttgtggttatggagcacatgttatgccaaatctccagactttcagcttttcctggctcttattctagatgtattctacagaatttatcgaacagataaatttaaccacaatatgcatttcactaattgagttttttggtagcttagtcattactggtcctaaacatacttgcactgctaacagctttcctgctctttttgcactgctaacaagtactgctggtgttgcagaccttagcaacgtaaagggttttttgttgcagttctcaatacacttgttccttgtaggtttgcagcatgtagaagctttcgagttttgaatgaaggcaccgcgagaccgtgtgatcagccaaaactgcaggtcagcgtctctgatgcttacttcatgtttttctcgtgccgatttggaaaccaaggcttcggagcaactgctgcagggctttcctggtccaggccatgtcattgaagaaaatgctggccagccccagcctattattctctactggatcgccctccttgtgcaagatggcatcctcaccgttgcttccagcaaaaccagaagctgcggctgcagtagcagtgtgattgccatcttgtgctgccatgtttgcctccccactaagctcatctggaatcttgtggtgtttgtccaatgctaactgatttagaaaagaaaaagggacgattaaattaacaagaagctgatcttaaatactccctctatttcaatgtatgatgccgttgactttttaactaacgtttgaccactcatcttatttaaaatttttatacaaatataaaaatacttatgtcatgcttaaagaacatttgatgataaatcaaatcacaataaaataaattataattacataaattttttaaataagacgaaatgtaaaacacttgtcaaaaagtcaacggcgtcatacattaaaatactgagggagtagtatattgttgcacataaatgtttgctgcccttttacacagaacaatactgtcaccaggcaacttacctgtggctggatcgcgtcgtttgctcccatcatttccctgtaaatataagtgactaaagccgattttgcatcatccacacctacagtcacacccttgttggtctcttgttcttcacccagttgaagctcatcttcctggaagacgccatcgcttcctgaaaatatcccatctgcgtcaccaatctcttctgatacttgctgattcttcgcctcgtcccagtcctcgcagacaatcaaggtgttcgaggtgtcagctacatgcagtattctgttacgaccgtgctgccattcgacatgtcccgatcgatcttgcagcaagaacttgaactcgatcgatctttctgctggcaattcctggacagatcagaagtggggatgattcattacgagattatacacggagaatggaaggattcgcgtgatgggattcaccttcttcactgtccacacgtggtcttcggaccaatccagagcagccgccttcgccggattccagagaccgagcgccgcgacgtcgccgacgacgaggaagcgctgcccgaacgcgcaccgcttttgcagcacgaatttgacgtgcactgtcttcgtaggaactggagggtagaatatatcatgagctgtttaagagaatcgcatcgtcttgtgattttgtaatttttgagtggagctcaccgtcatcaggaggtgggagtgtcttggtggagccggtctcctcgtcggcgtcaacctggaccgagtgatcaacgcagtgagacggcttcagcgacgggatcaccgaatcggagcgagccagcgtctcgtgtaccgcggcgccatctcccagggacgacgacaagggttgcgccgtgatgaggggctccccgagcgacgcgacgagcagcggcctccgtcgcgcggtggtggcgggcgccggggaggcagcaacgccacccgcgcgcgtcgtgctgctgtcactgccaccgcgacgcgccggcgcgcgcagcccgccgcctcggcacaccacggccgcggcggtttccatcaaagcggaacgcctgcacgggagctgcacagtggacaccacaccaccgagagttgcttgacgcggcacggatgcattcgcgctccgggcgggcctttttcagcagggtgggacgagggaatcgcgcgcacggcagtgtgtgtggccgtggtgacaaggcggttagcgcccgcggggccctcctgtccccgttctcctagctgccctggtctcgcgtcggatccgcgcgcgccgagtgtttcgcatccgtctgcccctgccgttcgttgcgttgcgacttgcgacgcccgctgccgtggactggatccgccacggcagcgaagccgtgcgggcgaccgggccgtccgggagtgccaactgagactagctctgcacagcactgcacaggtgtggacttgtggtgggttaatagatgatgaagtgctatatatgttaaaaaaaagttatatactcccttcgtttctaaatatttgacgccgttgacttttttaattatgtttgatcgttcgtcttatttaaaaaaaattacgtaattattaatctttttcctatcatttgattcgtgtgtatatatatatatatatatatagttttacatatttcacaaaagtttttgaataagatgaacagtcaaacatatgctaaaaagttaacggtgttaaacatttagaaatggagtgagtatatattttttttaaaaaaatgaagccaacaaagctggtgttatattaagtaggggaggaaaaagtatttacaagatgaagtgctatattgtatgtaggaaactgtaacgtgttgagaaaaaaaaaaagaggcagcaacatcctagtcgtacggctcgtctaatcaaccgtacaagtcacaacaaatgcccgtgttttcttacaagccttcgagcaccatggcaaatggtttcttgccttctcgcttcggcatcaatgcaacagaagaaaaggatgctagctggaactgaagtgcaaacaaaccggagggaacgagggcatgaccgcgtgagttatttgctctagcaaatgaaagtgtgcactgcagacattgacaacaatgcacgtatgatcttttttttaagataatggatagaaatccagcctctatatccataggtggatatatacagccaacaatacacgtatgatgggagtagataaaacgatagacatacagttcacccgaacattcatttcattgacatacaaatgcagggaacagggttctaggagggaggattgaagccttgaaggatctgaaactaaaggaaggactattactggtaaatcccaatataggagtgaaaacaagacgtaataaaaaggatcgacgcggaaagttccgattgaataggatctagacaagaatataggagtaaaaacaagacgtaataaaaaggatcgatgcggaaagttctgattgaataggatatagataagggagatcatttgccattcgttggttattagaagcatcccaaaagcgtctgggtcaaaatatggcttttaaattaagttccgagttagtagatgctgctaaagagggtgggggtgtcatacgcaaaatgcaagctgacccatagaatagaatggcaaaggcaaatagagctcttgcacattttcgttaattcatgaataaaatctaggtatgagctgactcatagaatggcaaaggcaaataaagctctcgcacatttccgttaattcatgaccaaaatctaggtatgtagacatatgaatccatacatcttgatcggaaaagaatcaatagaaggagaatcagacgatacctttctcaaaacaaacaaaaatgtactatagttgcaagcaaaaccgaaaggttaggtatattactatgcaccagtgttaaacggcccatgtatcaccgatgttaagagtatatggatatgaacggaaatgatccggttgttatggtaggatgtgattgatttttgtctctatgattctttgagatccaagcatttgtactctatatataccgtccacaaggctcagtacattatgcatatgtgacattcgcagtacatctctctaccctacactcttgcatttgtaatctatatataccccacaaggctcagtacattatgcatgtgtaacattcacagtacatctttctaccctacacgcttttaactgacatggaaataattttttgagttgataatggcgacatcaagttctagtgttcaacaatctcatgagattagcctcctcccacatctgccacaagctaccttttagttaaacccaaagtggcaggtaataatggttgtgtaattgaaaaacatgacacaacagcaagcacagactaactttatagacgacagacatcttaagaaaggaacactagagatttaaattatgttgacaggttgagtaaaataaagcaataagcttctacttatctactacacaaaaatattactgaaacttaatagaattttggattttcaacacaaaaagtaattattcaaaacaacaaaatacttgaatataaacatgtgttcttgacaaatttacccatataggcttcataattcataaccaggattggtttcagatatttattttgcatctcagactatgttcgtttacccatttcaaagtactccctccgtttcacaatataagactttctagcattgcccacatacatatagatgttaatgaatctaaacagatatatatgtctagattcattaacatctaaatgaatgtgggcaatgctagaaagtcttacattgtgaaacggaggaagtacaaagtttcttctccaaagaccacatctaactgatggcaagtttatgtcagcatgataaactgatggcaagtttatgtcagcatgagtttatcagagttttaacttcatgttacaatgaaaaagttacataatacaacctgtgacaggaagcatctttctaggcatacaaagaatgattcctttaaacaaacataacagatagcactcacatgtcatgataaaacgaaagagaaataacaatatttactacaaagatatcaacaagtgtcaccaaaatgaaccatgaacggattagctccataagtctatactgaatattgctcatcatgtattccatgaaggccaacagttgttgggacttatgaatcaggccagccaattagaaataatatctatagcttagaatattcattatcataaacccacagccttggtgtttcgacaatatgatggaggtatttgattgacttaatagttgtgaccaatagagctatactgtaagttataacatcactggttgcaactgttttcataatcagttaggtgctttatgcacataatcatacagctatacttgaaaatcactccttgcaccttgaatctgttaaacaacaaagtatatatctatttcacaggaaaggaattctggaatggattgcatcttctgatgaaggcaaaagtgaggtagcccgcttttactgtgcataagcactaagcactggtataagttcaccactgtcaatcaaatacagttgctatagcaaaccaagatcatgaataaagatatacaattgaattataattccatagatcaaagccagttggctatttacgggcaagagtgcagagttagtcaggactaaccttgaaagatttgctacggtttcaccaacacacttgatctaagaatttagacaactaaacacagaccaattgaccaaacaaatcgtaccttattaaagaaagttacatggagtgaactggtggatagtatcagagcgcatcctatacactaaactcccaaatttattccccgataagcatcagtaatatacaaatgcacacttacgttcgcaaatcaagaaacatgaaccataatcgcaaaacctaagtaagtaccatggatatgctgcagtattacaggaaccacaggtccttttgctcaccaatcaatcgatgaaatcgatcacttgtcgccgtctgcggtgactgaggcggcaggacggccgctgtcgtagtcgacgacctcggcgtcggtgacggagcgggagtgctggacgatggagcggccgatggagttgatccactcctccttctccttctcggagtcggcgatgaagtacatggtctccgccggggtggagagctcgaaggcgaactgccggttgagcgtgtcctcggcgcccttgacggtgaggcaggtggcgacggggatgacgccgcggggcaccgacgcgcgcgtgacgcccgagtccttgaaccagaagagcctcccttgcttgagcacgaaccaccgccgccgccacgtcttgatgtactccccctgcttggtcagccaccccgcgcgctccggcgaacgccagaactccaccccgcccgtggtgtcggtgtccgccgacgaggcgccggcgcccatcaccgcccgccacaggctcgccgccatgagatgcgtggggatttggggatcggctgcgggagagttctttttcttctctctgggaagagatgcctagatgggaatcgattcgtgcgtgggtttcctgttcccgattttgttttatttttagaggacgggatgggattgagatccaactgcctactctgaatctgttagcctgttgctactcggtaaaaggattagagcaccgctacacgtactaaatttttcttactaaatttatactaacaatcatctcaaccgtttgattcaagtagatgaaagttataaaaaaatctagatacacttatagcatggcatgtcagtgttagtaaaaatttagtaagaaaaagttagtacgtatagacttttccatagtattatggttttctcagttttttttctttgagatggaacgttatctcgacattgatcaccggaatttccccgttaactttcttatagacggataatcgtttctacgagaaagaaataattttaagttgtactcttaatgtatatttagtttcacattcttctgtctataataaatcattatatcaatttattttaaaaaatagatggtaccatgtacgtaatatagttaggacggttgcaagtaaggaaagcctagtaacacatcgcttctaggtgaggacgaagatagttataggctaaaacaacattaacgtgcatttcaagcggtggcggtggcgtgaagcgacagcacaggattcccgacatgacccctatcttggctactaccgccgccacaccacccatgaaaaagtttgctagcactctcaccggtgatctccttttgatggttgtggtttttatctttccagcgacaacggatttataagagtgaagggcttggagatgtttgctagagcgtgatttgttgcagcgatatcattgttcttttcacgttaaggagcttaattgttatatagtggtaaaatgttcactccacatgagctaacaaagttaaatcgatggaacgtcacgtcaataacattcttatacaaattgtcttataagatggtatttattgtaacttcattaatcgcaacttgataaattagattcctatcaatgacacaccttagaatttcttactgattttgtgttttcaatgttttctttactggttcgatatatgccactcaagaaaagtgaaaataaaaaggcaaaaactctatgtgtgtttgatatgacaacatatagttttgccttctaaatgtatccgcaaaccttgatggtatgttttgaatttaagtacattgcgatttgggtcacctttttattaccaacaatcgtagcattgtgtttgtgttttacggatgaacgatctggatgcaactaaatatggatgatggacaaaaaaagtgatgtaatgaatgaaaaatatatgtatttcctaagtatgtgagatttcacaaatatgatttgagacttttactttgtcgcataaatatttcaaatggtttgcagggaacatatgacgatagttcaatgcatatgcaaagagattaacaaacatttgaaacttttactagggccatcgatggccatgtgccaaataggcacccgcacaaggcccccatttttagggggcccatataaacatgaaggcccactttaaatatagcaatgcaatacaacatcatctaataggcaatagcccaatggatagatcaacaatgctaggccttgcccaaaatcaagaggatgttgtgcgatcgttgatttcgtcctgttgttggttgctgagcgatctaattctacgtgccgatttcagagaccgagacgacgatcccaattccattcacggcgattgaggtggcggcgatagcgatacaacttgctacttgcgattccaacgctccgagcggcagcggcgacggctttgccttgctaccttgtctcgtctgctagctcatgccgtcctcctcctcatccgctattcatcgtcgactcaaccctcgataactcgacctcggaggtttagacgggtaagattagacagtgattgagtagatgatatatatagtaaattcataatattagaacacatattgcatctatataattaagtgaaaatatattttatttatgttgtacatgatttttaaattatagggccctactttgcatttcactccgggaccctaaatttctagagacggccctgacttttactactacggcaaaatttgctacaggacacccaaaaatcgtgtaattggctgtgagacactgcaaaatcttggctttgcccacggacactataaaagtttgtgaaattggctgtgagacaccggaggcaatattttataatttctgagataaaagaggtcagataattttctaaaagaccaatctacccctacgcaattggcatgccatggcatgctggcatggcgtgtgcgcgccgcgccgcgccgcgcacagacgcgaatagggccttgcctggcgcgatcctgacatcaagcgagcaggagattccgcatacagagaaaatctctcgctcgtcttctccgcctgcgccattattgcctttggctgcttcttcctcctcaatcctgcacggcgacgatgcacctgctgttataatccactcagatgctaattggtctatggcaccaggaaatatttgtcaccaaaggacaacttaattagttaattaactgacggctgtgcagagaacgtgtcctccatttggaaactgagctccgccgtccaccgctatcggcttgaaaccgccgcaccgtgcacttgccgccaggactcgtcgggtttgccacaaggatcgatttactgcgtcatcatcacagctccagcggccgccgtcgtcgccgtggatcgagatcacctgcagttgcaacggtgactgcaagttaagcagtcacatccattcgcaaccgtcggatcaaactgatcaacgacagatagttatgccacgtcacaaccaaggtgccaatggtacagtacatgctacagtgcgctacaggactatgtgtgcgtgatacagtgttttggtcaaatctgagctgtttttctttgatctaacggtcacacaaggactgctaaagttgcagtcaccattgcaactgcaggtgatctcgatcccgttgccgtcctcaacaccttcgccggtgtcgaaactgtctccgccggcgccgccaccgccgccggccccaccgtcgcctagggttagggttcgagactgggaaatcgggttggggagggagatggacagctgggtgcagggggtagattggtcttttttaaaaaatatttgacctcttttgcctcggaaactataaaatattgcctctggtgtctcacagccaatttcacaaatttcatagtgtccatgggcaaaaccaaaattttatggtgtctcacaaccaattacacgattttcgggtgtcctataacaaattttgcctactacgataggttcgtataagtgagaacgaaccattctctagttcaaatttggtggataacacacacatcatgcttaggtatacgtaccaggaaggcacaagaacaagtgaacaaccaacatttcctcccaaatcccctttccccctcctaaaccctacttcaaaaaagcggttacccacgaaggaaccaagccccaaacccctccttccccttcctctcaagccggcgcggccgacgagcccgcggcaaaaccacgcaaaaaatctgccaaaagaagatcccccaaatccgccaccgcgctcacgccggcgcagccatggcgacctccttctctttcggctcttccgccgcgtcgggatccaccggctcctccccattctccttctccaccggcaccgccccatcagccttctccttctctcagcccgccgccgccgccgccgccgccgccgcctcctcccctgcccccgcctccgccccagccttcggctcctccctcttctcctcctcctcctccgccgccgctcccacttttggctcctccctattcgggtccgcccccgccgcctccgccgccgcccctgccacctcctcatccccatctccgtttggcttcggatccaccggcttctcgttcggccaatccaccgccgccgccgcgtccgccccatccatcttcggcgcgtcctccacccccgccaccgcgaccacccctagcgtattcggcgccgcatcatccgcggcatccacccccaacatcttcggcggcgccacctcctccccggcaccaccccgagctattcggcggtgcttcctccgcggctaccgcacccagtcctttcggcgccacctccgccgccgccgccgcacccggtctgttcggggccgccgcgtccgctgcttccgcgccaagccttttctctggcgccgccacgggctttggctttggctcagctgcgtcgggcaccaccactgccgcgaccgctgctgcctcgacaccgtctttcggcttcgggttgaacaccggggccgctgcatcgagtaccaccactacttcggcttcctctccggctctagggtttggagcaggcaccggctcggcgctgtttggatccactacctctgcaccactcttcagcaccaccaccgcctcgtccccagcgaccacggccacgaccacggcgtcctttggcttctcatcgtcgccagcgaccgccgcctctgctccgtcgttcggcttcacaccgtcatcggcaaccaccacgaccgcgagcaccgcccctgccttgttctcttctgcatcttccgctcccgccttctccttcacgaagagtagctctgctgctcccaccacgccagcgtctgctccatctactggcttctccttggccacttcgccggcagcacctgctccctcattgttctctaacaccagtgcagcagcaagctcgtctgccacttctctcagctttccgtttggctcatcttctgcttctgcaccggcatttgcttctgcttctgcaacgagcgcatccacaccgtcagcagctactgcttcccccgcgacatcagggtcattgttctcagtgccagcacctgcttcttctgctggtggtttcagtttcacagtagtaccatcgtcatcatcagctgcggctactacagctactaccacaacagtcacaagtgcatcgacatctgcagccatgacaacgccggctccttcagcaacaacaactgctacactatttagccagcagagaactacaccagcttctgcctcagctccatcaacacagacacagtcaatattgtcattcggtgagtgctcatgttcttgttaaaactattgttttattttcagtctaatttgaccataccatttacataccttgatttaccggcagtgaacaattaaatgtcaccctcatgcaagtaaccatttagctcataacatcgcaaataacttatttgtatcatcatttgaggacccgatcattgtgcatttgcctttcctatgcaatacaggaaattgttgttgtaacgcactgttttgactataat

SEQ ID NO: 54476 - DNA, 1521 bp, Oryza sativa
caggactgttcttataaggcttgaggtatgttcttatttttacattttacagctcttcttttctagttctgttcatatgaacttttgcagctagatcaatatcagaagatttgatggttatatatttacttctttattgctgatttggttttgcaaagtcatttgcataaagacaatatttatgaaaaatgattacaattagttgaaagcagggtagaaggaagcctggttggatttgaatagccatgcttaccctatggactctagaatttatcactggtaatgcaaacttacaaagacttggaggtttcattcttagcagtagttttaaattgaacatgaaacatgaataattatttgattatctagtagatgattgtcttgcgcaatgcatgttgatttgacttattcatgtaaagccgatgtattgttgcttttaaaagtgtacatgattttttttatttatcctcacccttttgcatatattttatgtaatttagttttgattattgatggaatgagaaattaggaaaatgaaaaactaggaagtctgaaagtgaacgaactgctttttccttgctgttcactggtgagctttatcagtcgaatgtaaagcagggaaatgtgtatatcaatgccctatcactagtcagactgtgattgaagatgtaaaaactatgccaatattctgcctttgcgaaatacatgtgcaatgctacctctgatccaaataacttgtttcagctcccctaacttgattcaaatacttcacatgtgatatctcctatagttttttctaggatgctcttggtaaatattgatagctatgatgatctccctctcagctgcctatcgttcacattagattaatgcgagaagatatgttcatttcatgaatttcttcgtttagtactaattaagttagtgctgatgttgtcttcccaccattatcacctcttgagctggtgcttttctggatagatgtgtgttagcatgcatacatgtttatattactcaaaagaactttatataattagatcatttgctgtgatttaaaataaattttatgtcccttgcaggctgaggtggctaaagttgttgaaacacaaacaagcttggagaggcaacttgagttaatagaaactcaccagaaagaggtgggtatggatgcatatatttcatgtcttctgcatactctagttatgacttttgtttttgttgcatgcttgtttgctctttcatttgctgatccccatggatgacatcataatattgactagtgaattgctttcctgtaagctcattatttatatgctatgctgccagggatgcatcatatttcggctgtcatctccttttttacacaattgcgcacaatatggttaatgaagataggttgactgattttttttttaaggatgacaagctttcaactgccaagctgcattttagaatgcattaatatggaatgccttttctaagttttatgtcatctagaatacattacaattcttatatttt

SEQ ID NO: 54477 - DNA, 1613 bp, Oryza sativa
ttgtttgcttccatagttccatactatgatgctttggtctgacctctttaagtgggaaaaaaattaatcgcatatgctgtttgaacttcattgctacaaactgaacttgggggcaaactttcggggtgccaaattgggggccggggtaaacggaacatttccatattaccccagggccgggcgtgtgacaaacaccctttttattatcagtgacacaggtctgcgagcatggaggaggaaacagagcgggtattccaggatgaacggctgttgcttcgtgaagatgaggctgcttctgcaagagatacaatgttagtcaccatttggattcagctacttccatctgtttgtatttagtaacagtaatgcaaataaatagtgcaccacacttcgggaacaaaaattaagacaattgctttaaaacgatttaggatgcattgaaatgtttgattggacagattatggatgattgcttatcgggatgaatttaaatattatatattgtaaagataacaaatggcttagaacaagttgtctagggctgaattcgtttgttgcagttgggaactaatctcctgtgcacgcaaaatggtgtaactcattagcacatgattaattaagtattagctatttttatttttgaaaaatggattaatatgattttttaaagcaacttccgtatataatttttttttgcaaaaaacgcaccgtttagcagtttgaaaagagtgcatgcggaaaacgagggaggtgagttgggaaagataacaaacgaacacagcctaggcatttaagcaattctgaaggcgacagtttttggagaagttccttttggaaacgtggcatgaataatctgcacatgatctaaaataaatgcagcttaagctaagtaaatgctgtgcattgcttaaaaatattcctgaatcgaataacatacgatattctttgtttcctgagtggcctgtctcaatagtggtgttattactcgaaatatgtgcataatctattctgccccactcagttgcttagcttggtttttctttttttgaggaattgccaaattggctgacaaagctgtttttttttgtttgtgaggacaaatgattatgttaatgttttattatatcataatatacatcatcagcttaacagaataattttgcaatgccaaggtttgagcaatctgaaactgtggagaatgaattgcaacatatgacagaacaagtgaagtccatcattcagacattgaatgctactcaggtaagtattctggtcgcagtacttgtctaatgatgacttgtgtcttagacatcagcctcctccaatccagggtgctgagtttgagactgctgatagtatgacaccatttgatgctgctgtccggatactggataatcaactgcgttctttaatgtggatcaatgagaaggttggtaactcaattataccactttatgctcatatttttgaggtggctttagttacttatcgcaggcttacagcctcacagtttgtgagggtatttgtgctactgtgctaggctgcaagcaataatattgatttgacgcagaatgatatttccagattttatgctaggctttagtagaatcctt

SEQ ID NO: 54478 - DNA, 2200 bp, Oryza sativa
tgcactagaaagcttcggggtcctgtaagattgcacgatttgcatttctaaactacatgctatatgttcgcctaactacttgtgcatggcgcgtgttcatgatctgccattatcagatcaagattgcgcctatacaagaaagataatataattctttacctcaaactcatagcttggtacatgtagcctgtcagatagcgaaagttatcggaaaattaggcatatgctccacatggttgaggcgtatcttagcatcgccaacaattcccttgcaaatagaagtaagcactaagcatagttctttagatcatcagttgatgttcttttccacttgggattccttcaacggcaagtggcattaccatgtgcaagatgggactcgagcagaggtaagtatattgtactataccatatacacttcaaacttaagaacacagggatcaaatcaaacaaaaactatcatcaacggccagttgctgtcagattaaaacatctatatgctgtgaagtcgaaagcacatgctcccccagttagcacctcgctccccccctctcatggatggttggaaggaacacagataccagcaaaaggaaatctggaaagagaaacctgtcaatagaagcacatgccccctccatgtgaaggctgatgcccgagggagtgagggattagagagaatcccatttgcaacggcttggggagagcctaggagtcccacatgggcgaattaaagcacaatcttctctctaaccaaagtccgtatcgatgctgtgaagcacaagccaacaataatgcatccatgaattgtactactactagtaccagtacaagtagtggagtctaatccttataaagttagcctcaaccgccggtgtatcagtatgctggtgtgataagatgggctgctaatcagggccgtctgctgcgtgacacgctgtgtcaactatgcaaagccagtgtagccagtagtggtagcctccatctttagaactctggatgagcatttgagcctcacaagcaagtttcagagtgcgagtcattatagcttgcgccgacccgcgccgcacccgcatcacaaccccactcgaccaccattcattactacgagcacatctttttttttgctccatatctttctcccttgctttgtggtcctttcaaagaagcccataaaatttctcaagaaactttaatcgcttggcgcaaaggtaacacatacggaagagaagaaaaaaaaaagcgagcaatcgctctacatttacaataagaacatccaaagcggaacgcaataaacaaaggcctccgtgttttgcctttagctagcacgaggaatcgccgattacaattgctcgcgctagacaacatggaccaagctccatccaggtagaaaacaaataaccctatagtgatatgctacatcatatcatatgaaaatgtgacatgagctgaaaatctttataagccatgacgaccatcacatatatatcgccagagggaggggcaagccaaacaaacacaaggacaccatcgaggatcgggggaaagcaacgcggcagcggacggcccggggcaagatcgtagggacccatgccctcttcttcttctaccattttggtgtgacaccctagcacaggaggagaggctttgtatattacaaggcgaccaaaacctaagcaacactgaatttttgcagccgtgccggccaggagagcgaggttccttgctccgggctcggcggtgcacgttgtcacggtccgccgcggcggcggcggtggtgcggaacgggcgcgcgctagtggtgcggcaatggcaccggcgactgcgccaacgccggggcgggcttgggacactggtagcacttggcgaagagcccgaacgtgtcgatctgcctgatgaagttgaccatgctggcccagccgccgagcccgaagcccaccacgagcacccacaccacgatgaacatgttgagcacgaacatccccgtccagctcggcaggaagaacggtggcttctccgccgcgttctgttgcaaacaacaacataaaccctcgtcaaaaaagagatgcgtattgtagattctcaacataaaacatggttggtgcttgctggttttattcgccgtgccgcgtccgtactaccacgcacgttcggtcgatcgcctttcggaaaggcgcggaaaaaggaaggggatcgagaggga

SEQ ID NO: 54479 - DNA, 2794 bp, Oryza sativa
ggtggattcgtccggtgtaccgagccgcgcggcagcagccagccagataagcagggaccacctttggttgggctcctaatctgagacactatacatgggagcagtagcgcaccagaactgggcacggtcactaaaccaaagtgactaggctaagctaacctctcttggggaagatactgccaaagcagcggccagaatcgaaaggggaggggggggggggggggggcgctgcttggaattaatgtggttgttggctggattcaatgattggggatttgcccatgtatgaggtgggccccgggcacggcccggctgtgcttttgcattcaacacgaactgctgcttgcttctgctgcctgcgcacagatctccactgtctattctattgcctgtgtgttccagtctcgccactgttgatgatggctcgaccgatccgctgctcagctatagcaacacggaggaagcgtcgatgaaatccatcggacccagttgttagtataagttggccgtcacgttgcattcgccctagcttgcactagtacctgccattgaatgcgtggatggatggacgaggcggtgtaccggaacaaaaacatgcatgcagcgatgatgatggggcatagttagggcatgtgcagagaggttcttgaggttaccatgcgcgcggaggccgtacggtaggtgaggatgtgggcgagtgccgggatgatgtagacggtgaagctgacgaggagcgcgccgacggcggagttgatggggccgaagaaggggaagatgatggcgaggaaccagatggggacgacgatggggagccgcgcgagcgccctgaggcagatgctcttggtgtcgtgcatgccgatcaccttctcccacacgaagtagagcggcgtgcacgcgaacccgaacgtgatgaactggtggatcagcatcagtatcaccgccgcgtcgcgccacccggtcttgggcagcagcgagaaggcgttggagtgggtcagcagctcgtccccgaacgcccagtacatggccgacgccgacggcagcgtcagcgtgaacacgtacagcgtcgccagcaggtagatgtacttgaacttggccggtttccacatcgcgtgcatgatctccctgcaccaatccaaaacagccacccccaatcagtcattattttcttttcttgcaggttattaatcaacaaatcaacggacaaaacggcctcggcacatgcgagtcaatgatgctgagactttaatcagcttgatcaaatgatacggccaaaaagtaggactactactacagctgctgcttctcctagtcacgcaggcaggatacatgcaaggatcgcggcggcagggggaatctcgcaattgctttctttctttcaccaacacatgtatccgccaccggtcaaatgatggaggagccgacaaatacggccaaataaggccgttgccaataataatttataccactaaatacgagtactaatcacctaaaaactctgctccacagctagcgaagatcccatcccatgcatgttatgctaatggtctcatgtcgctaccaaactgggctttgaattagcctgagaccagaagtggtgaggggcattgtcaagatggacaaagacactcacattcttcaattgggaagcaattctcaaagcaggtctgtgtccccttcgccccactaagctaaactttcccatgcaagcctagcagcataatagtagtagtaagatataaatggaatcatcattggatgatttggcaccaagatgtcccaatccatgatggaaatcatttcaccccgttggattagggcaactagcacggaattgcatagcttgatgtgaactccgcactagctgaattgaatgaagctggccccccttatcattccattccatttccaacccatcaaaagcattttcaattttcacaactatggaacaagtactggtagcactacattaaatttttgaagctaggagatactatatatactactataagatcatcaaatctccaatccgaactgcatgcgaccactaaggcactaacgaccatcgcattttgaaggaacagcgcactgaaacgctaattattcctcgcatgggcctctaatcatgccaaagcaaaaacacactcaataatccaagcaatagattaggcacataaacgagcaatgggaataaaggggctcaaggagtctattctaatgcatagtggcccattcttttctcccctaaaccatcgcgtgtactagcaggggaccttttggatgcatcaccagttcagcacatcgcacatgcacatgaacgcaccgagctttagcagctggatcgatctttataaatttttatcgaccgatatcaatcgatcagccgactaatggtcgcaagctaacgcagctgtttcccaccgcgcacaggcttggaatttttaagtgcccctatccatccattgggatctgtacgccatagagctaactagctgcaaagctacagctacgtgtgttttaattaagcttagtagtagtagtagtactcactatactacactgtgaccagtgaggtgcgagtaccagtaccatggagggggaccaatggaatggaaaccagaacctgatttccaatcgggacatgtcctccacattggcaggcaaaagctgcagctagtgaaaagttctccctcacttcacttcctcaggaggattagcttgtagtcctagtactaatactactgtacagtattaacaactggacaaacagagcaagttctgctttgcttacactgtg

SEQ ID NO: 54480 - DNA, 3795 bp, Oryza sativa
ctgtgacggcgtggccgccgaaggtgtagaggatgttggtggcgccggtgaagtacagcaccagcttggttggaccggtgtgggtgatgccttcggcctgcgacgcaaacgatcatcagtcactgcaaacccaagctaaatggacatgtagtagacgcgatggatgatcgagaaagtgacaaggacagtttccctcttcttatctcacctggccgttgaggagggcggcgatggcgaggtaccaagcggtataggtggtcatgccgaggcccaggaaggaccagatccggtagttgtggaacgacgggatgaacaccgtggtggcgcagcacgcgccgaagatgtacgtccacgtccgcttgtccagccggtcgttgatgtagtagatgttactgaagaaaacaccaccaaattatcggtcaggttttcagcccatccgcacaaacccaatctgtcaccacgacacactgttgcgcagcagcacggctacatatttacactggcgctgcgaagtgacagtgggagagtgatggttggttggttgagttggggaggaaaggaatttgacctcgcgcaggcgatcagctggatgacggagccgaagaggaggaacgtgcagttgaaggcgagtccggccgccttccagtacgggcccagtagcccatccagcacctcgaaccactgccaccagtcaacgtcacaagcttctcccattagccccagttgttagtatagtaactatagttgtgtagttatgcaaaatttgcagtaataagtgattaattgaacaaggattaaggatgagctcgattcaggctcggctttcatttcggcaagcaaccagaagagagccatgggaggcaggggatccaataccccctgccattttcacaaaagaaaaggaggcatttttcaagccagtaaggatcgaaaacgaccaaacggaaggggaaaaaatgcgtgctcgagaaaaatgtgttttcgattatgccacataaagacggggataagaagctgtaacaatccgttactgatgaggaggaggatacgaagaagcgacaaggccagcacggccatggcatgacaaggcgggggggtacctggatgacgtggttcttgaagctgacgccttccttctccttgcgggagcggtctcgacatacaggacgctgattaggtagacgggtcacctgcccatgaaaccgtagaacagctgcagcagcacgcccgagagcatcccgagctgcgagaaggagtacggcagcgtcaggagcacctgcgcaacctgcataaacccaccacctaaaaattcagaaagtcatgcacgctgcctttcggattcctctcgatgtgattccttcatcgagcgagctgcatggccgcaatggcggccatggcggagcaggatgagttatacctggttagaggcgcagctgaaccaggcgtcccagacggagccgacgtgccagagcaggttcttcatgctgaacttgccgccgccgccgtggtggtcgtcggcgccgtgctccccggcgctgacgcccatcaccccgacctcctcctccttgccgttgctgtcagccacgatggcctcctccgcctgctcgcgcggcaccatgctgaccacgccgcccttccccgtcgtcagctgcgtgagtgcgtacggacggacgtcggatcaagatccaggacagcacaatatgacttaacaaaacagagcaggaaaccgaccccgccaataaaaaaaacaacaccaccagctgcagcagcaagaagaagaagaagaagagcaccaacctttctcgctacacaaaagatgatctggagatcgcgctcaaggaagccggggcgagtgatgggggagcagtaaatgcagggtgccggtggagagtgatggctggaatggtatatgatatggaatggaatttactgtgctatcgaggcgagtccctgcacgctgttcgttctccgctgctagctaggagtacgagcgtcgtggccggcgccgcccgggctgcactgtttaaaggcagagccggagttgcagcagcagcaggaggaggaggatggccaagattacggggctttctccttcacttgctctgcttcttctcagctataggtcctctcctctgcccagtctttcctctgttcctcctttatgagggagtaatgcggaagagggggctagaaagagaagcgcggcgctcgtagggccgtaggggggaggggcgggcgaacgagcgctagagagggatgagctggtgatggagagagaggggagggaagaggaagatggggagggaaatggaaacgcttgcggctttataataacgaacactccgcctcggctcagcggcctggactggccttccaggaggcaagaggcaaagacctttcagttttttttttttttttacgttttcatcttctctctgtaggccaggttttgagaaatatttttttagcataagaaaatagctgtaagttgtttgtatctaagggttattttgagaactatttggcctttaatgcactttcccatgaagagagagggagagaaaagacactttttcagtaagtcccacctaaaatagcccttgagggagatagtttttttaatgggttatttccaaatagccctgaaatagctcacgtgtttggaacttttaggctatttggggttatttaagggcgggctaaaaaataactcattgattcaaaaagggccatagtgtactattttcttcgactctaaatgttatggaccatatctataaatctatctatgtgcatatgcagattgtgcatatccagattcataatttaaacatgtaattcatagtcagaatcttttacatttaaggagggaggaagtaattattagtacagtatatgtttatcaggtgctataaagattttgtttctagcaactttcagacaaactatcagtgaagagaaataactatgccccttattcgtactttagttgtatttcgtaggctccaattaaatatgtatttcttagtttgattgactaaaaataaacttgacattttttaacgaagggtgtgtttagttcacgtcaaaatttaaagtttggtaaaatttggaacgatgtgatgaaaaagttgaaagtttatttgtttaggaaagttttaatatgatggaaaagttggaagtttgaaaaaaattttggaactaaactcgggcgaagtaggaaatgaagtctgtgtgactatgacgtgaacttctattctctgttttttcatccacatgttttctaaacaactaaatgataagtttttaaaatttatatgtatatatatgttttctttaagaagtatattaatctatttttttaatttttaagctaatatttacttaaccatatgctcataaactatcccattttacttgcatgggagaaaaattcttagccttctctcccgaaagcagctaggtcccgtttgagatacatttggatgaagattaagttagcacacgcagaacaagaaagccattagcacacgattaattactagtcggttttaattattgcaaatttaaaaattgatttattaattttttaaaacaacttatatatagaaagttttttaatgaaatacaccgtttaaccgtttgaaaaacgtgctaacgaaaaatcaaggtaaaatctactctatttgtctcaaaataagtttatttttagcttctccgatttatcctaaaataagtttttttggctaattattacatcggagttcgtaaaattaatgaataaatgtaatagaa

SEQ ID NO: 54481 - DNA, 1836 bp, Oryza sativa
aaactttcaatttttccatcacatcgtttcaattttaaccaaacttttaattttggcgtgaactaaacacaactaaaagcgatggcttgttttgatttaggccgagtttagttccaaacttttttttaaaacttttaactttttcatcacatcaaaactttcctatacatacaaactttcaacttttccatcacatcgtttcaatttcaaccaaacttttaattttagcgttaactaaacacacccttaaaaaaaagagcgatatggctaggagatgaagttactgctggcttctcaaaagtcttagcccctgtcacgtggttactccaccctacaaggtcagaaccccgttgtttcccgtggttactcggctattccctcgctgtgtgtgtcaggcttacttcgcgtactgagctggtgcttgtactgagctggtgcaaggttgaatcttgccatctttgggttggtgaggggactgaaaccgggtcccacccaccggcacacgattaagttaagcctcaaagccgattttttacgactttttaccgaacagtgtaaagtttatattgatagtgtaaaaaaaagattataactctaaaggtcgtaaacagaaaaacaaagaaaaaataaccaccattcacgcaccaataacaccaaatatatactcgggagaaatctatcaccgaaccggtcgctactaagcatgactgatcgctgctaagcgaataaaggaactatagccaagatcgtccaaaatctaaccctaacaaccgacaccaaactctactctagccacctctttgcgactgagcgagagggtgagagaataataaaaccgttttcccctagaacctccgatgtggtcaacttgtataaggtagaacgccgacacaagaagacatgctcacagccgatttaaacttaagagtttgatttttttactattagagcaagtttaatagtataacccacaactagctctaaatcatctatagacaatgtaatagccaattcgtacaatagttgcttactatactatcaatacctggtcccacctgtcatacacacattacgtcttggagtctaaagctggctacagatctgtagcccactgctcttctacctcttcctttatccctttaaaatatatttatagctggtttatagcttgttattgtacctgctattaagtcagcgtcttctcacctaaaaatctatttttttttaaaaaaaatcactttaaaatttcaaacctcggtcataatccaaaccagatagaaaaaatgctagaatttctcgacacataagagcaagtttaatagtatagttaactgctggctctaaatcatttatagtcaatttaatagctaaagttacctataacatatagtacacaattaatatctggccccacttgtcatacacacatgtgtcttggagcccgtgtgtcttggagcccgtgctgcagctgactataaatatgcagcatgttgctcctctctcctcttttatcttcttaaaatatgtttatagctgtgttagagtctgctattgtgcctgctctaaggctgtgttcttttggaggggttgggaacccctcccctccgtacacaaaacggagtgatagattagcgcatgattaattaagttatagctataaaaaaccttgaaaaatggattaatataattttttaaagcaacttttcaatagaaactttttgcaaaacatgtaccgtttagtaatttataaagcgtgcgcggaaaacgaagaagaagagctgcgaagtcatgtaaaagaacacagcctaaattgtcattaagtaatacaataaccaa

SEQ ID NO: 54482 - DNA, 714 bp, Oryza sativa
ttcctgcagcccagcatgctattgtacctgctgtaatacacacattatattgttacagcacatcagaaacagaactgatataccacgaacccagtgagtccagggacatttattacatggatgaaaagatgtgtcgtgcttagctgtgttcttcgtgaacaagaatgtacagtaaatgaaagtggaataccttatgagcttggtataatatagtactgtgtacaacagcaacaatattttgttggagatcgattttctggtggatttgatctcttcaatattgaccagacaagcacctgaacagcgaattaagaatttaggacttcgattcagatgagagttccaacagttcaagagctgaatgtccatattgaaatacttaatcatgcatggtgtacaggtatataataaacggacccataatcatccataacatcgatcggtttaaagggaaaaaagctccccaactacttctaatgcaaccttggtgagcgaacccatggggccctaaatatagccatgatctggtatttcactacaatttctgcaattggcaacaagtactacatgcatggaacttttcctttaaaaacccaacgtttttatagccttgatttgctgaatatatgctgatgacaccatcaatttggaaccagcttggtttgtttattccttacttttcctcctcctgaatgacccccacagaatttatgc

SEQ ID NO: 54483 - DNA, 5550 bp, Oryza sativa
ggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgtttgagatggatctggatgttatattggggggtgatgtatctgtgatggatctgtgactggaatatatctgtgatgtatctgtgtttcagagggcatggctagcaaatcctgaggctagctaatatttagcatttattttttttgttagaattaactcatcggtgacgggtcggaacaaaaatccgtcaaaggtaatctaacctgtaacggactagcaagtaaggcccgtcagaggtgacctacctgtgacgggcctttacttttggggccgtcacaggtagatcatctgtgacagcttctaactacggagaccacaacctctgacggcctttatttaaagggccgtcagagataagtcacctgtgacgggtcctaactcgccctaggctagtggagaccaacacctctgacagccttctagtaacttgcccgtcaaaggtgggtgtcacctgtgacggccggccacccgtcaaaggtgattggactcaccagtgaccactgatcactgaccatgcgcgaagccgtcaaagatgaggatttgagcccgtcacaggtgaccttggccagtgtagtgacgggaaagtacatttaaatatcaatccaactactttttgttaataaaatttaatttacattagaataattgttggttaaatattttaagggttgaatatgaaaatatgtgcaacttatattattgagaaagaagcaatgctacttaacaggcttgtaaataataattttaattaattctgtttcggtcaaccaagcttatgggcgaattacttctattaaacttggttacttagaagtgatgatcgaatttacggcctgaaatattcagtttctagcaattatgctcacccaggccgaaactgcaaactagcacaaacttaggtatatttaacagagctttaactccaccttttttttagttaaagtccaaccgaacaattttagttacacccaaaaagggggtcgagcgggcggaagtaccctcacaaaatgaaatgaaatgaaatgaagaattggatcggagcggggttaggctgctctataactacacttcaaacccaatccttgaagttaattttaggaattgaaacgttgtcagatagacccttataatcctctctcctatgtgtaccttaaaattaattcaaatgaggaatcatatcgacccgctattagtcgttaaatactaagtcaaatacatgtttacttgtctaagcacatgcaatttggtccattaaccagctgctaaacaaacatttataggcaagctgggagaatttatatagacctatagctagctagctacgggtggcaaatgcagttgtatattgtagtgagtggagaccgccgatatattaatcgatatgtagcgagctgattgatccaaccaaacaaaaagtaaggaaagtaaccacctttgctttaactagtggattggattagatctggtatattagtaagattatatacttgcccgacttgtaagagtacccacaatggttatctataggctctctacaagagatccatgtcagcatattttcctacttagaaggtattaaatgaagagagagagcaaagctatctattaacttagagatagtctatagagaaaaacgaggcaatgtatgagagagctatagataccaatgtggacatactattaaggtggtttactattaatcgagtctattgctgagatgtacatgttttatagagagcaccttactttatcattgcgggtgctctaagtgctacacacccggccaggttttgcagtttaatccggctcttaatgattaaagagtggacttttggcgctgccagtccaatcagtcgatcgatatccgaaaggcctagctagtctgcgtaattaagcaacgaaacttaatcatcatgtcatgtagatgcacacgggtggcttgtggtgtctttttctgtttggcaatcgagcagatccatcgagcaatagctcctacggagtattacggagcactactttcagcgtagttgttctactccgaccacttggccacgatcttctctactgtaaaattgcagcaaatagagtgattttaacatcctccgtgaagggaaaaaaaatgcgggttttcatatgtttgcaagcagagctccattattgtgggccactgttctgactgcccgtacatttgtctagtcatggactgcgataacctcacagattcggcgccaacccctagtagcagcgaagactttttcgctccctgcacacgatacagtctactagtattgacgtactcgtactactctcgatcgctagctctcgagagaagagaacacagctttcgtgtgtacgcgatgtgcgcgcgcgcacgcacgacggtgcgtggtttgcttggacgcgcgggcagcgagagttgccgacgatcgagcgatttccttgggaacgcgggaaccgatcggtcgatgcaacgcgagatccgatgaaatgtggtgcgcgcggccggcgaatccgattttgagcctcgctttcctaccaacgtgacttcccaggcttagcttcaacttggaagcccaggtgttagttttagtcctggtacatgtcaagttgctaacatatatcactcgcacgtacagcaatatccatatactccgtagtcctgtactaagtgcttggaacaaaaacgatggaaagtactgaccagtttggccacctaaaaccttctcctcttacactagtgtacaatgtacaatactgtcaacaagtgagacgaaaaaaaaaagaggtggcgctcgtcgactgaacaatccaaacggttggtaaacgcatctgtactgttcagagtatattgtattagaaacaaacatgagttagtgtttgattaatttgtaacatgtttgacgaattaattaaggccacttgcctaggactgtcttgcaccagcaagaacggctccttaatttgaaaatgttttgcaggttagccggagaatttgtagttgcaagcaacggggaaatgttgaatgggattctatatgctttgaaaaattatttctggcggtcagcttccttggtttaagggtattgcacggcagtaggtggcgaaggatcacgcttgtgtaattttattcatacatcctttagatatactataattcctaacacgtgcggttgcttcacagttttggtggatctacgcatgccatcatacgagagcgtatagtatacccaaaataaaactagaaaatacgtgaatatgtatctccttatttctcagttcgatctcagtgagttgcagtattgcagtgttaatttggtacatgcagatttgacagataaatatagcgatgattcttattcctccctaactgtaatttaataagattgtatatacgatactggttcattaaaacttggttaaaaaatgagggcagctgggagcagcaaaggccgatttctattgcatttttcgaacgttggaacggacggagcagagtatgtaacccaactgggaactatcttatgctaattctaatcgtgagtcaactgatgaatcaccggccagaatatatgtatttgagccttgaagcttaattaaccagttaagttcagcgcattaatgagatgatcaacaatgactttaatttttccccatatagtaacgtgactatggtgacatttccgatttaattagggccaattccctatatacccatgtaatttcacccaatcccttctacgcccctgaaatttgtttgatctcttatatacccctgagtttttatttggatcccttacatacccattccgttagttgaccattagtttgaccgttagttattgtagaaattactttattgtccttgttatattgttaaaagctagaaatgttttatgtgtaaattatttgagttgtgaaaaccaataaggaataaattactaaatatttgttatgaatttttgaaaataaaacattatttcattaaaataaaaaaagatttattgtaaaaaaagttctgcataagatttgaaaattacttttcaacaaatatttagtgaaaaaagattcgttgtgaaaaaacaaaggggatataattagtttatcacaaattagaaaacaaatttaaaatttttaaataaatttcagatcaaatttgatgaatttcgtatatcttcccaaaaatttaaacctaaataacatttagtttttgctcttaattttctggtgaaactaatgtatggatttaatcataatttttaaaaaataaaaaataataagttttattttttaagttgggcattaaatgattatattgcttgtattttgtataagtttatttttcatatgaaaatttattgggtaggtaccacacatatgtataggatgggtaatatagtcattttaaaatatttaacggtcaactaatggtcaactaacggagatgggtatagaggagatcaaaatgaaaactcaggggtatataagggataatgtcaaattcaggggtattgaaaggattgagtaaattttcaggggtatatagggaattttctcatttaattatgtagcgacgagatcccatcagctattttcgtttcttcattaggcattactgactcagccctgtagtactatttcttgacgacattactaatccgttggaatcgaaatctatcgaccaactgacgcggaatagttgaccatgcacgagggagatcaccagatggccgttacacaacaggagttgactacttgcactgcaatttttgtttctcgtaaataaaaaaccggggccgcgaccaagatgtttcagcgaatcaaattccctttctgaacatgcatgcactactgaggcctggtttagttcccaactttttctttaaacttttaactttttcatcacattaaaactaatctacacacacaaacttctaacttttccgtcacatcgttccaatttcaattaaatttttaattttagtgtgaactaaacacaccctgattctagtgatattcggtaatccatggtactagtacacaaacttactagtacacaaacttgtaaaatgctcattatgaacttgtctagtgcgtctatgcggatcaagtctaaaacgatatattatgactaatcatactaatatagagtttgattaagatgtcacatgcataatcaaagaacacgagagatgttcatgtgtaaataacctttacatatagtttttttatttatttgcttttatccattatttttatacattgcatcttccttttattttatatactttttctctgtacacttaacataacttatccattgagtatatgttttttaaacaagcggtagctctactatttcaattggtagaaggagagaaaaattcaaacttacatagcagtatcatacgccaaggc

SEQ ID NO: 54484 - DNA, 4989 bp, Oryza sativa
gccagccagaggacggccatatcgcggggcggcggccttagttcaccccttgaagtttgaaccgtgcgcagcctcccctgcgcgcaagtcatcttcgatcggtttcggtatgcacagtcgcaccccggcacacggccggccgcatgctatggtgtctgatgcaaggccgacggaccgtagccggacacacatggggggcaactactgatgtgatagatctctccggtgtttcaattcaggtgtgtccttacacttttggacgcgggtcaatagcttgtttgcatatgtaacgtctcttttgcgggagaaattagaatgaccggtgtatatttttgtgcattgatctattctagacctgcaactaaacactatctggcgaataggtattactactgtgcttgtttagttcctaacttttttcttcaaacttctaacttttccatcacatcaaaactttcctatacacataaacttctaactttttttcttcaaacttccaattttagcgtggaactaattagcacatgcagtataccaatatacggtcagaaggaaaagttttacgggctccaaaagtcaacgaacggatcggaccggatttaaatacgagtacccagcttactacaaaataggagtagtggggtacccttgggtgcacgagttacatggacgatgggtacatgcatgtacgcatgcgcatgcatgcttactgtgcatgtctcagccagcagccaattgccgtcgcctttgccatgtacccaaaataaaactcacggagtcatggtcacgggtaaggtagccggatagggttgtagtatccgacaggactatatacgtttttttttttgaaaaaaataactcatggtccactcctatataggtagccagacgcccaaacttaactcatacctaaaaaagttgtccaatattctacccatccattttacaatgttgctataacaacatcttatattttaaaatagagggatttaagaatttctaatgaagatttaaggatttaaaatatatacacttgtttccaagagatgaccaaaattgatccctaaaataatagaaaaaagtgggcctccttctaagcgagatcgctcgctccccctcccgtgcgttatcgcttggccttcctctggtgctataatcagggtttccccaactgccagggacgtggttaccacaccccggcaataagcacggtaaccgtggaaaatcgtacgcaaccgtgcaaaatttatcaaaattttaaattattttttaaatttatttgaatttaaggaggttgccgcggtttttgttttaccgtatcccacggtaagcgagcgcggtaaccgcgcagttaccggcggttttgcaaaccctggctacaatctctctcgcccacacgtaggcggattgggagtactagccgtgcctgagatgttgagatgtgaagagcagtaaaaacagttgaggattcttttcttggtacctccaaaggaaaattttgaagcctattgttttaaaaaataaagcctaaatattacggattgtgtgtcatgtatttgatattgcagtgttaagaggtgtatagttttaaccctacggtctcgcgtttaattctcaacgcgtttattttatttctaattatttgataaccatctctctctctctctctttgatgacttgacttgcttgagataactttctccgtattttcaaccatttcctatggggacactccaccaaccttcggagatcgattaggcttgaaaaggtccccttgggaaccagatgatcagaccaaatatttctgtgtttctttcagcagcatgacatgtactgtatagtagtacgcaataaacatgatctgacagacaaacaacgacatcacaaaaaccatatggggtatggttaacacgaataaaaagtcatggccaatcgacccatgcaattattccgtgtacaccagagaggtgaccattttacatgaaccagtgcccctccacacccatccaaatatcactttgatccgggtgacttgacttcacaccaaaggctggtaatcctggtgcagatttgtttgtttctccgttgcaccatgcagcagtatctcagtaatgcaccctcaaaaaaggcttctggagccgcctagatctcatcctcacctggcccaagccgatacgcgtttcatgcaaaaaaaccaaacatgtcacgcgctgctgccgctccggctacaaacctacaacgacgcattgcacgatgcactagcgagccagcgagagtgagtggcgcacactgagaagacaccaccacgcattagcaacaaagatggccaatgcacgcatgcctgccttcttgcctgctcggctgctcgatcagtacctcgcctcatctgtggttagcgatctcgctacgtatgctttgcaagttgcaagctgcattcgatcggggcgcagcaatgccaatgccgacggccacataccatgatagtatcagcaatggcgagtgtgtacatacacgccaccagctccggccactaccatcgcctgtccccctcttgtctgcctctgggggatcccgatgctgccatggcctagaccatggatcattgcttgcactcaccggacaacaacatgtcacctccactgcatgccctggctggccactgccacctctagttgtatactccaaatctttctactacctgggtcgtctttgggtagcaccaatagtggctggtagggtataccgctacgccaaagtagtagtaaagtgacgagatcgatacgtgcccacacacgaaaactaaaccagctgctagctcgttgttggctccaccacaggtagggcgccgggcgatggacgcacggccggccagtcatcaggttgcatcaggccggtggctgtgctcgttttagggtgcaccggcgcaccaaagcagggggagataggccactccacgatcccctgcctctcgtatccgccggcgataatccggcggccatcatggcagggccgccgtgctggctggtgtgtgtgtcggcccatccttctttacagatcgcggtgaagatttactgatacgtgtgcgttacatgtgttggcatcattggctaagggcatgtacaacggtgtttattagtggtctctctttattgccatgcaagtaaatttggtgacatggaggaaagagaaaggagtatggttgttatgcatgacaacggctcagagtcgactcttagcatttactagagcaaattttgttgcatggtgatgaaagaaaggaaataaaagtaagaaaagttattttgatacattaatgattagagaccatattgtctctaactgttgtaggatgctagtctctaaataacgtagagcttatatacgactctatctttgtacgtgccctaattagcaactgggcagcgtgaaaacgcatttcctatcaatccacgaggcgatttgttttggagaaaagaggaggaatgaagaaaatgaaaggaaattagtgactggtagaagaatgtgccgaatattgggtcatcgtcgacgagaaaaactccaaatattcgcaacaaaagagagttcgatctcctaattattaacgtctcgcttgatgtggaagttgtcatccgtgggaaaactggaaaggttgaaaacactgtttttgcacggaagaaaataatttgcaaaagctgatggatgtttgtttgcctgctgccacgcctggataacaatagtggttatcatataacgtcccgaatcctccaaggtatctgatccctgcagctgattgagaaaatatttatgcccactgaagtctgaactcttaagctgtgaagcaacgcaattcagcgtgtagcccaaatcgagtacacttggatcatctgttcgcacgctacctccgtcttaaaacaagtacagcagtgaaaatccgtgtccaacgtttgaccgtctgtcttatttgaaaaatttataaattttttttaaaaaatagtcacacaaaaagtactattcatattttatcatctaataacaaataaaataataatcataaaaaattttcacataagacgaacggtcaaacgttggagataaatagtgtaaaactatacttattttgggacggacggagtatatgtcaagagcgggggatacatgccatggcctgtgtacagccaagtagcagcaggatttgattgaggagagtgagatatatcctgccatgagaaccaacccccaggaagcaagagctaatggggatccaaatgaagtgacagtgatcggggccgatgtatagaggagctttgggacttggtgtttggtatgacagcagcctaattttgacatttaacagccgctgtcaattcaatcacaaaattaacggagaatgttttgagcttttggtgcaagaatgggtgtggccccagttttttgttctctttttaccaagagcctcttcttagcggttgacaacactaactgggccgtcttatctgactcacattgtggcccgtttgttggagtactagcacagtagcaccagttcggcgatgtcatgatgtcagcgattgatgcagtaaaatgattcatacgcgtgactcatattgcttgttttcctcttattcttttcattgcagccatcaggttcagtcttcatctaccaacaagaccagtagtagtctttaagccgttccagtgggaaaagattccaaaagaggatgtgtcaatttttctgttagagcaagtcccaatctttagcttaaaagtgcgcctcgccaaaagatacaaggacatctggggccatgatgatcggctcagaaatatactccaactcactaattgggatgttatatcgcttcttagttaagaaatgacctagtcatgtactacaactactcctgaagaacgactgttaatcaagtaatttcactccagacaaggttcagcatgttctcaattagaagaattaggctagatttggcctactaa

SEQ ID NO: 54485 - DNA, 1675 bp, Oryza sativa
attccaagcgccctggatggagtttcggtatgattaaacagagcaaaatctgccggattagaaggatcgaattaatacaggataaagggcccatcggtggataaggtttcccccgaccgtagctcgggctcaccttccagctttccgatcgagcggctcaaacgcaactggcgcctgacgtgaaagcagcagccagccaggacagttcagaggagaggagaggaggaggatccgtttcacgtgtggcatggggtccctgacagagcccctgcatccatgcgcccgctgcgtgcatggacaaacattcgtgtggtgtggtgggagcgcccggttccctcgtgccgttcacgcgggcgccacccgcccatgccgcccgcaacagcgaccgacggcttcgcgcgccgatcgggtgggtggtggcatcgaatcccgctcaccaatccagtggttttcgctgtggacgcgctattccgcgatggcttcgcttgcgcgcgcgagccgagccgcgccgcgccgcgcccacgccacgccgggcccaagaagcgctggccgcatgggcgctgggatcgcgaggtcgccaccaaccatacgccgcgacggcgaggctgcgcgtgcaaatgcattgccgctactaactggcatggggaactcgggagccatgccactgtgcccgttgaagcaagcgtacaaatctcgaaaaactagtacgaagtacgtagcaacgtgccaaacaagtgatcgggcgttcgagccaatcatgacgggcatgattatgggagagtttgtcaaggatagtggccgattctgctgctgaaccatcgcattcgcggtttgctactaataataagctaagctgtgctctcgatctttgttcttcggtgtagtataacgcgcacggtgcttaaagaaacgttcgttctggtgtggtgcgccactcagcctcggtaaacaaatgtgtggcattttgacctttgagtttttggatatttttcaccgggccttttttgcaaaaggaggagagatcatgccatcaggggcctccgtgcattttttttaagttttggaaaacctggaaaaggcgggtggttcaaaagcaaagctttgtccttttggaaaagcaacaaccatccacttcgctgcgttgtgaagaagagtttttgctactcgtagcatttttttttcttccagctatgtactctagtggggttcaagatctgtattgcgagagggtaagatatgatactgtatttctgtagctggggatcaatcaggatcacagtggccgtcatctccaattgaaggcgccgtaccacgtcaagctcgactaggcggaatcaaatgaatgaatctagctggtgatcatggcggtgatgatggtctcggccaatccaatccggtggtgggcctctttggaacttgcgacactgcgtcctgatgaaatggactggccgcatctattgctttccccatccacgcccaacttaaactagcgcacctgtggcttcttctattggctactagtatttccttttcgtctgtgcaaatttcacactaatatctagtccgtcggtcccaaaataaattaatctcatacgagatataaactcgtatatcgcatcatgtacgaggttaatttattttagaacagagtaagtatatcttataatatatctaa

SEQ ID NO: 54486 - DNA, 1021 bp, Oryza sativa
tcattatataaatatgcatgtcatcattgatgcaaaatctatgatgaattgtccaatttacctttatgtatatcatagaaaaataaatataagggtgaattagacataaccatgggaaaaaatacttatcctttttttcacccttttgaggtatatttttgctcttacattttactttttgttttttatttttctatgatatatgtaagggtaaattggacaaatcatatagattttgcatggaaatgtgacatggcatatctatgtggcgattttggtaagatcaaggactatgtcaacccacgtgacaaaattaaaggatttgtttagacagtatgaaagattaaagactaaaatgtcccaggagcgaaattttaggaaccatattagctattctcccttaaatatagcagaagaaaaaacagcacaagtttcatatgataagttgatagcgctgtagttgctgacttcgtaagcttgcatgctcctatggtttccacacttcagcaaactagatggctgctaaataaattagtaaactttttgatccgttccaggctccaggctagctagatccacgtactttgtggcagcaaagacttttttgcgtaggtcgatcgaacacttgtcgtgtatgcatgaacgccatcggttctaattctaaactaacaccaactaatcgatcacgggcttctagctatagataattaattagtactaatatggagtacatgagtaatgtaatcctaacaggaacacgcctctctggtgcctgaaacttcacgctgctcgccactaatcgagtactctatttggtcagaagagaaataaaatggtatagcaacaacacatattttgcagcatcgtctttctatgacgtctttcacagtaacttactctgaaatatgaatcaaacgacctcgagtccttgacaagtccaagagggagtaggcgaaagaatgtgacgccatttctgttcttccgcataaatgggcaaagctcgcgttatttttattgtaaa

SEQ ID NO: 54487 - DNA, 7781 bp, Oryza sativa
actgcatccagcagtgaacatttcaaaggataatcatgtggatagatgtgtcggagtacggaagcgagaaattaatctcagtttcggcgactctcttcattaaacttctgcgtgctggctgcaattttcttcacatggaatgcgaatttcttcatatagagtaggagtaggcatactgctactgtgctagcgaggaacggtctttttttcctagtccagtccatcaatgacatggggtgtgtccgtgtgtgtcggtatgccgtgaaatgcagtatgcaagcatgttcaggagacaagaggtacatgatctccatgttctcaatcaggtctgtccctgttcactatgagacattacggcgaaaccgcgaaagggcgaaagataaattaacccttgatggttcatattgtaatacacgagatctacctttcaattaccacgtgactttgtgtgtcctgaaatcgaccagacatagcttggcatagagattgcataggtcatccacatcttaaaagcttggattcaacattttcaactagaatagtagtgtggacaaatatatatgtgggcctttagttctgaaaaaaagggcctatccgggcctgccatttggcccatatcccttgttatcatctccaactgggcccatgacatagttgtgacaaggaaaaatgtgggcctttagttcagaaaaggcgggctttcgctttctgcaagaggcccgtttgaaatgttgaaatttcttactaagtcatttttttattcaatgaaattataaattccaatctttagtttgacagctctcagccgtatcttatttttacctaagttcagcattaagcaaaccttacagaagctgaaactggaaagtctaaacacattaaaagccaatattgttttgatgaaataattataataacaaactctaatgctaaatctctatctatgttcccgagaatttgcatagggtaagtccattcgaaacgttggtttttttttacatattttaatctattttatctgaaatggtttagggctggtttaaaatggaatattgaccaaaatactgtagtggattatctacgcggttatagatataaatctaatattttgataaataaacataaaaataacttaatataggcgtaacaggccctcacgaaaaagaaacctattctgatttcaccgcgtagccaagcaagcatcaggctctcttagccagtcttagggcaagtataatagtaggctataagctggctaaaagttaaggtggagaagagaagagagaagaagtgggctgtaaacttacagtcggcttggaaacaagatctaagaaactctgtgagagagacaagtggaccctatattaattgtaaagagctaactattatatgggtagactgagagaatgctacaaagaaccttatagccaacagatcggttgtattattagccttgctcttagaatagatacaatagcaggctataagctagctataaacatattttaaagagataaaagaatagagagaagagctagctgcaatacggactccaagacataatgtatgtatgatatgtagtatcaggtattactagtatatagtaaccaaatattgtataaattagctattatatgactatagataatttagagttagtaattggctatactgttaaacttctcttagcatacagcagtagcacccgagctaactgaaaaacatcagcccctcagccgtcatcctatctcaccaaaaatttcaaaacacacgccgcacaatcgtgacaacgccataacgtccactggcgccgcgggccccacactgcaaaatctccgcctccccttccccacgcatggattagtacgcgtccagctcactcactgcttgcttccgccaccccgcaccgcttccccctcccctcctaatcaccaccaccgctcaccggcggtgacctccccccctcctcccccgcctgcgccatgtcatcctcctccggcgcggctcgccgggcgcgccccgggccatggccccccgcaccgccgccacagccgcaggcgcagcccctctcctgggccaagcgcactggcttccagtcccgcgtctccggcgagtccgtcgtcatcgtctccctccagctcggggcaggtatcgctgcctcgccccgccgaggcaccttccgatctggagtccggcccaccggccaggcccaactccgccctcccgccccctcccgccgccgccgcggccaatgcggaggcaaagccgcaaccgccgccgccgccgcctcctgcgaggacgcggaggagggattcggatggcggaaggccgaatgggcaggcggccgcagcgccgcttcctcagctgctggaggaggaggacgacggtgcgccggagcggcccaagtacgagctccgtgacagccccggagtatgtaagtgctcaaaagaggaattaaatatcccacactgtcatgtgcgagcgcgctgatttacgaggttttacgatgtgttgcagttccaatagcggtatatggatttcagcattacatctccatgctcggctcaatcatcctgatcccacttttgatggttcctgcaatgggcggttcacctgtgagtgtggcttcaatttagtagtagttctcacagcatgtttggttttgtaggtttagtacttaatatacgctgttggatgcttaggatgatatggcagcggtggtgtccacggtgttgcttgtctcagggatgaccacattgctgcacacattctgtgggacaaggctgcctcttgtgcagggaccatcctttgtatatcttgcccctgcgcttgcaataatctactcccctgaattctttgggctcaatcacaatgtatgtttatatgtataaattttatttgtgttggcgtgatgcaatgccacatgttgtcatgtagggattgcctcatcattgctttagagcgtttgttgttgaacctaacacgttgtatttcattgcagaactttaagcacatcatgaagcacctgcagggagctatcataataggaggtgcattccaagtgctgttaggatatacaggcctaatgtcactatttctaaggtgtgcagctgttgctgtttattagatacaaatacattcatctttttctcctagttgtctgctatcatgtggcttgttgacatggcagtatatttctctatttaccatggccacatgattgggtttggtagtaagtcgatcagatttttatttggaatggtgcatactgagtactaacacattcttaagaaaacaaatgatccaaaatttctactgtactacagagatacatctcgtgatgactgtgaacaactttctcttatctatgtggtgtttgttaacaatggtcacgatatgttaataaacaccgattatgatacaggtgttttactatggtctctattggtattttatagaatcaatccagtctgttcatactctctaatctaatggattgatctatttatactaccacctcaactacttgtagaatattttttttctactggtagtagatatcataaatcaatggttgatatcgcttctactggtgatgttagtagaagaccaccatagaggtattcaaataataaaggaaactttgttggatattactagttattatacatatttcctgcttctgagcatccctgttatgaattaatttctttgcataaaccgttgtttctcggacaataaacatacttttgcatgtcttataaactgatgaatccagatcaatgaaacattagtaagcctgcctctatttcttctgactgtaccatcaactgtatatttttgtgacaaatagtaatacatatgtatctccatcttcactgagcattttgtcattaactacctctgtttcaggttgataaatccagttgtcatctcaccaaccgtcgcagctgttggactttcgtttttcagttatgggttcactaaagtagggtcatgtatagagatgggcctattacaattattgattgttgttatgtttgcactagtgagtatgcagtaaaccaacttgttaaatgcattgtaatattttgtgcaaataatgtcttaagctgatgatctgtctatttctgtgacagtacctccgaaaagtaaagttatttggctaccgggtgtttttaatttatgcggtaagatttgggctaatagttatttgagctaatacctccatctatgctagtcattagtgtgattatgcaattctaattgctgaacttttggtgctgccttcttaggttcctcttgctctagggatcacatgggctatcgcttttgttctaacagcaactggagtttatagctacagaggttgtgatgcaaatattcctgcctcaaacaatgtatcagcctattgccggaagcatgtactgaggatgaaatcttgtcgcgtagacacttcacatgccttgcgatcttcaccttggttgagatttccatatccgttgcaatggggcactccaattttcagttggaaaatgggtcttgtgatgtgtgttgcatctgttattgcatcagtcgattcagtaagtttataattgctttgaacttagatgatgcttgtttttctttcttttggtttgtttacttttcataaatttggataaacaatctagtacttactgggaaatgatctacaaagcatattgttgctccccctgctaagcatcaacttaacataagctttcttctctgacaatattgttaaatgcctgaaattggatcactcagtaagtaggattctagaatcaaccattcattgctcttcactatccaatttatttttgtttcctgacaattcatttatgcattttggacttaaggttggttcctaccatgcatcttctttgtttgtggccacaagaccaccaacagctggggttgttagtaggggcattggtgttgaaggtgtctccacagtcttagctggcttgtggggtacaggagttggatctgcaacaataacagagaatgtacacacaattgcggttactaaaatgggcaatcgaagggcggttggatttggtgctattgtacttatactactctcttttgttggtaagcaactatttgcactttttcccctgtgttggaagagtagacatcatttaactgtgacagcattcaggttcttgctataacaattcttgtgtccccattgtaggaaaagttggtgccttcattgcttctattcctgatgttctagttgctgctcttctttgtttcatgtgggccatgctatgtgcccttggcttatccaatcttcggtatagcgccaagggaagctccaggaacagtattgtagttgggctagctttgtttttgtccctgtcagttccatcgtactttcaacagtacagattacagcctaattcaaactcatcagttccaacctacttccagccatacattgttgcatctcatggacctatacacactggatctagtggggtatgtattcatccgttcttttctaacactatgctgtttgcatactagagtttcaatggaaatacataaacaaaagactggtgatacacatgcagagtccatattatagtgctcacattatttatgaatatagatagtttgccaactgtaactcttcatgccgcttgcctggtacaataacaaatatctggtttctttcagtaacaatattgttgtggagtgtcttatggaagtatcctgaacatttacataactatattgtacaactggagaaagcagtagaaagaaacataaagaaaggaataaacaaatcctgggaaaatagtcggaattagaaaattctcattaaatatagtcctttttactcctctgttttgatatgaaccctggaactttcatttttcatgtatatactatgcttcaactgaaattagtcaagctataaattcctagtggtaataaactttatcgagtagaagtgcttaggttgagttccataacttacatatggttccagcatagtttccttcttaacaaagaacacaattatttcactcttatataccgtgccatgatattttcaatcccattcacatgaatgatatattgctttctaatttactgcgtaggcacatttgcagtatataagaactgttctcattttatttgtgaagcctgacaaattcattcatataagtctcaaaatatggcaatatttttgctatatgtttatgttaactatttgatttgcaattcctttatttccttgctctcaggtaaactatattctcaacacgttactgtcactcaacatggtcattgcgtttttggttgccctcatacttgacaatactgtccctggtggtcgccaagagcggggtttgtatgtatggtcagaggcggaggcggcaaggagagaatcagctgtcatgaaagactatgaacttcctttcaagattggacacgcattcaggtgggtgaaatgcgttggcctatagcacagttttggtgtggtttgtagccttggccaactgcacaaaaaatattctgcagcttccaagaatgaaaaatggttactgtgcaaaatctcaggcgaaagaaatggttagtcacgaatcatgaccgactgtttcccaatgtttttcaaccaaggtatcgactatcgagtgtacatactgaattgctctctaggttagttgtcttgtcctgatgcagatgctagatgcatcaggggcttcccacatttttttggactaccttttgtcatcacttacagattttgctcttctcctggtactatttaattggtgttagggatatctatttgtacaggcggtaaatgatctgaaccaaacctgagctgtgcttaattgatctagttatcttactttcaacatttcctgtgtgtggatattttactttcaacttagctactagtgatagcgagtttcaccgtgccaggttttcctgctgaattatctcatcctcgcagtgctaaaggctggcatccatgtcaactgttaagcatgtaaagctgcctgtctgaagtacatgggcaaggaatcaaagagtctgtaatgttacggggctatttttccagttgccacctcccaactttggcataacccagcctgtacacattggatctttgctgacttgttggttatcatggctggctgacttgttggttatccccgtaaccacgtatatagcccagttctgagaccactcaggcactctagagggccttgtcgtggacactagaccctcttttctgaggggtcaaagccaatggacctcgccaccggcctgtaccgatgacgaggctgacaaggaccttcacatggaacggccgtgccgggcacggcggcacgggtggcttctcagcacgctccttccaaattccaatgctgttgcttgtctacggctagctgcgtgcacggctcgaatgtcgcgtgtacagcagttagcacgtactacatgaggtacggcaatgatgccggttgtcaccggatgcagcacaatatgcaaaacattatgatgaattcactgggataaaaatgtgtagcaagcttgattccgaagtcaagcaacactccgctatcatgactgctgggcatgccacataaacaaaggacaagaactggggcatgccagtataaattgctagccgcaggccatccagtggcgcaaggctattgcttctttgtgacctgcaaggctgcaagtttgcaatgcacttcaacatactcccttcgtcccataatataagg

SEQ ID NO: 54488 - DNA, 9369 bp, Oryza sativa
  unsure (1)..(9369): unsure at all n locations
tgagtttttgtttatattgtttgactactcatcttatttaaaaaaaattatgcaaatataaaaaaacgaaaagttgtgcttaaaatactttggataataaagtaagtaaaaaaaaataattccaattttttttaaaaagatgagtggtcaaacagtgcaagcaaaaactcaaaatcccttatattatgggacggagggagtaccaattgtcaaaaagtggcgcacttcccatgtcttggtcaaattatctcccctagtaatcgaacgccttcttcacaaggatatgcagccatgagaaatactacttgtcaattatcagtgctgccttccgctagtaaaaaaagcaaagagaacaaattcatgcatgttacaagctacagcatccacttattagaaatagtgtaatcgcagccacgctgcatgaacaggtctgcatctgcaaggggccttcccttcctgaaatcttcagcaagtccgggaattccggagaggaaagaagctccccttattgtaaaatctgaacttggagtgctacacctaccagaagtaggcacagacagcagcccagaactgtgtggatcgtaacatggcctcgttgaaaagccatgatcatctcttatctctgacggagctaccgtgacacgatcagcagtgttgctcacgaaggcgttctgaggagcagctgcagttggtctcagattgagctctgaacctccatatttgttgcaagttgagaccatctcgtcctttggaaatgagtctgttggcaaccgaaacaagccggcaatgcagataggtatcttgatgtcatccactatctctctgtggtaatcatctaccggagccgggagagccaggatctcctgccggtgtgggcttgaactggtctgttcctctgtcagtgaaatggtagcgtcgtcattggcaggcaaattctccctgtcatggtaatcctctggtgcagggagagccagtatctcctgatcaggagattggcttgagctgcagagctcatctcttgcagaattgaactcgtcgtcgacgggggagtagccgtcgtcttctgaatgttcatggtcccctggtgcaggaagcgccagcgtcacctggctgggtggaactggcttgctcagcttctgactcagggaaatcctggcaagctgaagtgcctgaagaacacactctatgtccatgttgctcgttggctgttgatctggccctgcatcgacctggttgtcgccatggtcatggaagcgtgatgagctccaatcagagaccttgctgttcagggtggcatcactcattgacgggctcccatctgatggcgctttgatgtcacagtagcttgaacatccatccggattctcgtttccttgttcttgattcttccctgtcattgtgccggcgacattagagtttccttgagactgtgcatgacagtggccgtgaagctcctcgtgcgagtcacgttggtcggctgctgcttcttgtcctgatgtgtcttggggtgattcaggaagggaaccattcaacagaagtccagcagagcggttgttgctggcgctggggtgatttttaacgcctggttttgcctcttcgttgcaatgaaccgcttgatccgcgagcctagaatgctccttgctctgctcccaaccattttctatctggcacgccttattctctgcctcaacatgaacctggagctccaaagacaaaagtatgagtaaaatgtcaaattttgaaccaaaacaaccaggtttcactcatgatactaactaacctgtgggtagcactctgcagtgcattttgttattaaaaaaaagcattttgagagagcaaattatttatacttatcaagttggtggtacacatttttgtactgcatgtgcactaaatttggtagcatgtggaagtcaaggggaagttgactctctctgtggcgtagttcatggtacaaagttatgagattatatttttgttgtacacatgtactactgcagaagttgcttcatgtgaaacattttctctggaagtggaagaatttggtatcacaactctgagcagtgtttctgtgtaactgtgtttggttgcttaccttggctgagctccgattctcgttgaactgcttctcccactgcctctgagcttcttcctccgcctcatactggccgatcagctcggcctgcctctcgagcaccctttccatctcgccgtccttctcgtacctgatcacatactgaccaccagcaacctcgccgtccatgtccgcctggccgtcgtcggtgcaatccgatccatcttgctgccccttctgactccaggcgatctcctcgacgtcgccgcgctgctcttccggcgccgtcgacttgccattgctgatgagcagagccgtgggatgttagaattcgacaaacaatggcgtgtgcggtgtgccagcgtctatggcgggacggagctcacctgagctccttgcgcttgttcttgcggcaggactgccccatccggtacttgggcgacgggtcggaggagaggaggtagaagtagctcctccggtgcttctgcttgagctgcctcgccttgcgcgggctcacgctgcggcctttccacgacagcccgccgccgggctcggccgtcccggacagcgcgtcctccgccgcttcgcactgcgccggcggctgctcctccccgcgggagccggccgtgtcgccgtcgctcctcgcgtcgcgtgggtcgtcatcctcctcgccgtcgcggtcggagcccgagtcgagcacgtcggagaggttgccgccgaagccatgtgactccagaatacccagcacctccgtcgccgcccgctccgcctgccgcctctgcgccgtcaccgcctggacctgctcctccagctccgcaacctacaaccaagtgacccaacacacgtaatcaatggcgcgaacgacagcgagagtaggctgcccctgcgcgcggtggctggctgaccctcttggcgagctggtcggcgcgctccttggcggcgcgggagacggaccgctcggagagcagccgcgcgcggaggaagtcgacggtcatggccgtggagtccgccatgcatgccaccgcgcgcacgctcacgcgctccccgagccgagccgcgagtgacgttgctgcgtacgtatgccgctccgcgcactgtcacatgccggcggtgtggcttgaccggcgccgcgtattaaaaacggcttggtttcccgtgagccgcgcacggcgcacacgcagcgcgcgtcgtactcgcggccgcgggcgcacggcgcaccgacagcccaggacagggagtacgctacctacgcgcgacacaagcgccccgctgcagcacgagggccacgggctgacgagaccaccgcaacggtgtagttagctaggctgcgccgtccattttcaagggagaatggcgatgcctcacctacctgtatcgactgatctgcctcctgccctgtccggggtccagtggcatattgtcaatttggcatcttacaaaatcatgagagtttggatttatggtgtactgtgtacatgaactccagtagcacttgtttatgggggtaaattcgtcgaggacaagagtagtgaacgtggtacagctttgccatgttcgagcaacgcgacgaagccagcaaaactactcgtcttctcttgtgctactgcctactgctactggtgctgctccaaaaatggccgagatctcaggctgtccttgcttggaatctttctgcttggatcacgaacttctaccgcacggaaacatttgagtcttgcaacggtttcgataaggtcattcaaagcaaagtcagctcatcgtgcatagaacaatacgtcttcaaagaccatagcggcaattatagcatcgagtaacagatgtttccattaaaaaactttagaatacacatatgcagggtgttgaggccgatgatcaagcaatgaccatgcggcagattaatgcagaccgtaaccacaatctcaggtacttaaataacgtcatacccggtaggcgggtttacaaaacgttttcgtaaacgtttttagccgaaatttcgctcaagaaacattatgtctgcttagtttgacagattcaaacaagataatgacgatatctcaatcaccgctggcacagcctctgcatccacagtgaacacattctataaccttctcctctctgagatgcttggggacccggcagacgcatgtagttgcaaagttgtggtctcgtgtctgtatgcatcgaagacagcaaaggcgctcataacccggctgaaaacacacaaaaagaagcaatgatacatttgatataagaatgcctgacaaactcttgtgacaaaaaagcatcttctggatttgcatctaaaaagtgactgaaaactttgacagttgaattcgtcacgtacgtctcacaatattcttagggcaatttaggcccctcgttatcaatgttcagacaagtatataaagtagtaatatggaacacaagtattgcatccctcccaaatctgccaacttttatcagatgtccaggaaaaaaaatatcattgggtgttagaagtctatccatgatttgatttctggttacatcagctgctagtatgccaataaaaatacatagcggaaaatatataaacatcttttagtcaactgccttttctttttgctcccaaaatcttatttttcatggtgcacccatataagagaatatctagtccataaatccccacgtcactcatgctgcattatttcactatttcctacggttcattgcaagaaatccaataaggcactactcaactttgacatacagctattaatcgcaggttcatacatatagattagattctaaaacaagatttatgatgtgtcatgtcaaactagatcagtatgtgatagcttaacccaatataattgatttactgcaagaaatggtaggatgcggttagtttagtgttttatttttcatagtacaagtacaaaaagtatggttcaaggcttcaagcagttaagttacattctaagcatggggaaaaaatgtgagaaacttagcggtgtatccaggggtctatggcttcatctgaattatctttgtacacaagttaattaaagtcttaaagattatacaaggtggataaggcatcttactaaactagcacagagtataaggaatgatgggcatcttacagagcaaatcatgggtcgaatactaacctttttccactttgcaatcagattacggtctgcataaccctggtccaggcaaaactcatacaactcttttgatatctccttccttctgtaataaagatcatatatgtagcgacttctttgatgggaaatacggaaaattggccagagggcttcgcactttctcttcccatcatgtgtgtcattttcagctacatgagtagatgatattagtatccatataagagcagaagtatcaataaacatctgaaaggggagcatatgtcataccttccctcattttggcatccaactcacggatagttggttcaataagctcccatcctccaggatatttgacacggcttgtctttattttaggcatgttctgtcaatgaacgtcgagcggctaaagcttgcaaagaaaccctgaggacatagagtaggtgtaagattcacaatgcaatacatttgcacggtcaagctcttccatcgaactcaagagattataagaacataatacacactattacatagaatttagccccacattgaagccttacatcagatatgctatatattccttactataaaggaactgtgttgaacacaaatagcacaacttaaacaggtattttgcatcttcaggctaacagtcttgtcgaaccatgatttaaccctattttgcaagtacaaaatatgtgcacctcgaatcggtgaatggacggtctaatacctaaagaactaatcgacacgatgataaaaatcgtggaaaaggttccccaaaccctaggctactcggaagttttttttttgagggaatactcggaagaatttcgtcccaataaccacatacgcgagaatttcgtcccaaggaggagacgaattgaacggatccaataaacagcgaggtagaaactactaaagcatccagcgaatcatcttcagggaaaaaaaaagggaatcatggagcggaagacgaataataacctcttggcttgggcggccttgcagtcgccggatggaagctgtggcgcgcgggggagcggcgatccagagggggcgcgcgtcgtccacgccgttggcctgcgctgcgctccgctccggtcgagcaaagacggccgaagaggagacgggcgggtttggagtttggaccggagctaccagctatatgtcgtgattctttttcccctccttttttttttttgagaggagctatgccggtttgacggttttctcctctggtagcagtagtatttgctacatcatgggcctcaagaatcaaaacgggacaccaactgtgctgaaatccaattcggcaaacaaggttggtttggtttgtagccagggtatacgattccgacatgctctttcgtttcggacaccggtggaattcgaaatttttgaaatccggtggaaaaccggtaaattccgaacaaatttcataaaccaaaatttgaatacaaatccttgagtttgccggcaagttctcgaaaaccggtcggttttggcgaaattccgatcgaaatcatcaaaatttcgatcagtaatttgttttcttttttaaattctttattcttttctttcttgatgtaagtttcagtaaatatacataatacatcatttttcgaacatttatatcccaataggttctatgaatatcatactccctccgtttcacaatgtaagtcattttagcatttcccacattcatattgatgttaatgaatctagatagatattgtcgaggagcgatcctctctagtaggtggtcgtgagacccccttttgtgagttcggctgggggaaatggcgcgatgacaggagtttacttccgctcgcagtctagctgcttgatcgttgtcgggactgtatgggagatcgaggattatacaggttcgggccgctaccgagcgtaataccctactcctgtgtgtgggattatggtgagtttttacaagggatttcaagctccgacggggacctagctgttcttccttcgagcttgagttctcctcgagtcctccctttttcccggtggtaatggtcctccttttatagttcaaggggataccacatgcaccgtttgcacctaccccccacgaaaaggggtacccacatggtcctaatcatatcgctatcctttgcttcaaccggaagcaacatggtcgcctggcttcaggtggggcccaacgccgtcctccgcctgacacgggggacatccctatcattctctattaattgtatgaaggcttcggcggcccatcacgcgcgtggggcgcccctagcagcgtgccgacgggacagggcacacctgcccccactccgcctgacacagggtggaacgtgggggcactgccctccgtcccgtcgcctgtgaccggtcacaggccggtcatgctcgattgacatgggtcaatcgagcggcgccgcacgtcccccaacgccgcattgaatacggcgtgggacggttggggtaccgcgcattaaaggcgcggagcatcgtctttcgccccgcctcctctccccgccacgtggtggccaggtgagggccccggggtagcacgccccgaaagcccgaggggtgcggcgtggcaccccgaggctccctggccacctctctacccgaggggcggggggaaacgaggccgtgtggccacgcgaccagatgggaaagatatttccctttactgtgcgtacccctgggcccatttcaccgacagatatatatgtctagattcattaacatcaatatgaatgtgggaaatactagagtggcttacatcgtgaaacggagaaaatagtatttataagattttttattttttatcaattcaaatttgaatttggatgaaactcctcaaaatatctcagacggtttctactttcgagtctcgtcgaaacatcgaaattccgacgaaatccgatcggatttcgtcggaatcgtaaaccctgtttgtagctcaactttgctaagtcaatatttatgcaatgttaaactatatagaatataaaacgattggcatggttgaaagccaaatgcaattttgataacaaaacaagcaaatgcctagtcagttttgttaaaaaagaaatcaacaacaccttattcttaaccatgataaagtttgataaagtttattttaacaataaagtaaataaaatttaactatattactccctctaggtcttttaatgacattggctagtttgaactagccagcgtcatatatacgaagattatggtggtataaatttagttagttttatttcaataataaaaggaactaagcgaacactctttgtttaacttatgatattctatcaagcccattcaaacaatgatattataacgaaacacttctctatctctgctattataaaaattaaagatgttttaaccggtattttggtatatcatccatgtttgagtcattttttaacttccttcgcttttagaaatacatatatgtgtttgagttagaatttaagctcatttgcttttgaaaatacaaaagaagtcgtacaagaaatctcttttagaaaatacccgcatactaacttaagataaaaatcggactcctaattgtagctcgtgattttctaaaagaaaaatccaagcaaattcctaccgtgaattttatcctttctaaaccgtataacaataataaggttaaaatagtattcacccgttgcaacgcatgtgtatttttttatactaaaaatgctcgtgcattgcaacgggtaaaagctattttaatcttattattgttatatggtttagctaggatgaaattcactatgggaattcacttggattttttttagaaaatcatgagctacagttaggagtctggctttcatctcaagttagcatgcaagttgttttaaagaaatttcttatacgacttcttttgtatttccaaaagcaaacgaacttaaaatccgactcaaacacagatctatatttccaaaagcgaatgaatttaaaaacctacttaaatacgggtgacgtaccaaaataccgaccggtaaattttttttcaatttttataatagcagagattgtaaatcctatcttagtataaagttatcccccactaactccttnnnnnnnnnnnnnnnnnnnnnnnnnnnnnnnnnnnnnnnnnnnnnnnnnnnnnnnnnn

SEQ ID NO: 54489 - DNA, 965 bp, Oryza sativa
caccgttcgggcctccggggagaacttagccaatggcggcggagcacaaacctggggagcacttgggggactcgatgctctactcagtgacacaggcacacagcgtgcgatgcgtcgggagagagcaactgcgtaaaccattttacaagggtgtcaagcgtctccgatgccacctccattctcgccaccatgatgatctggtaaaaaaggtggctagggttcaggagtaggcgatctgtttggtggaatggaggagatcgggaggaggaagtagggtttttgaaatttctcgtggtccaagaatcagtgtgcgcagtggcgagcagttaacggcggcgatggagcatggtgacctctgacgagctcttccgctattcatacaaacgcgagaagtacgcaaggcaaggagaacaacatgaacacgacctagaagaacacgagctatgggctagcaagatcgagtgtcgctgccgtcgacgcaaccagagcatgatgcggccggtggtggcctcttctagcgttggagagaggaagaagaatatttaagggtaattccgttcacgaagcaaacaaccacctgtttaattgtggcatttctggcgaagcctatttaaatgatggcattctaatgaagctaggttttttaagtggcacatgcaaaattctcaaatttcataacacaaaacaatacttcctccgtccaagatcaagaatataagtactattgatgctgaatcacgccgccacaccttgagcacgttatgtgcaaactacagcagcacccagagacgcgctgccacgagaaggaagatgatgccgaacgagcactccgagggacccagtcagggtgaacacgtatcgatttgtcctagactcggtaggccaattagggcatcctctaacactatagcaagaaggagattaaaatagacttgggataggtaacaagaaggagagagaaatat

SEQ ID NO: 54490 - DNA, 2130 bp, Oryza sativa
tttgggataaaaacgtgatctaaaacaactttaatcgttaggctttaataatatatataaaacatcaataaatatatgattttgttaaagtattttgtaagactaatctatattgtatgatctccattagaatttattatctatagttaaagattttaaagtttgatatgagttttgtccaaaataacaagtagagtattatcaaaccggatagagtagcttaattagctacatccaaaatttaaatttcgaaacctaaaagttgatttctatttttctatttgtatatttttaagtattggcatcaaactattaatgagacatatatataaagtttaaccatatattgttttgtgccgcttcgtttttttttttttacaacctatggccttctgattccgacgtattaattgcatccatatacatggccgtagctgtgcaccgtacatatatgttgttgtactctcttcgtcccataaaaaataaatattagaactgaatacaacacattctaatactaatattatagtactacgtgcatactccctccatcccacctagtacaataaatctggacgggatcacatcttcttctaggttgggttttttcttggacggagagagtacagtatctccccaatagagcctatttagttggcaaaaaaaatttgcccctgcatgttgcatcggatatacgaacacacatttgaaatattaaacatagtttagtaacaaaacaaattacagattccgccatgaaactgtgagacgaatttattaagcataattaatccatcattagcaaatgattactgtagcaccacattgtcaaatcatggtgcaattaggcttaaaagattcatctcgtaattttcttttttttaagaagggaacaactcaggacgcacactaacacacactgcactcacaccacgacacacatgcgtgcgcgtccctaacacacgctaggaatgagattggaggctcgtaattttctggcgaattatgtaattggtttttttttctacatttaatactctatatatgtgtccaaacattcgatgtgacagcgtaaaaaactttgtttgagaactaaggcctagtttagttccaggggtgaaaagttttggcgtgtcacatcggatacacagacacacactgaagtattaaacgtaatctaataacaaaataaattacagattccgcatgtaaaccgcgagatgaatttattgagccaaattaattcatcattagcaaatgtttactgcagcactacattgtcaaatcatggcgcaaataggcttaaaagattcgtctcgcaatttacacataatctgtgtaattagttttttctttgtctatatttaatactccatgcatgtgtcaaacattcgatgtgaaagtgaaaagtttttgcatggaaactaaggcctggtttagttccccaaaatttttttcccaaaaacatcacatcgaatctttggacacatgcttggagcattatatatagattaaaaaacaaattgcacagttgggaggaaatcacgaggcaaatattttgagcctaattagtccatgattagtcataagtgctacagtaacttacacgtgctaatgacagattaactaggctcaaacgattcgtatcgcggtttccaggcgagttatgaaattagttttttcattcgtgtccgaaaaccccttccaacatccggtcaaacatctgatgtgacacttaaaaattttcttttcacgaactaaacagaccctaaacagagcctaaggccgtgtttagttcctaaattttttttcccaaaaacgtcaatttgaatctttgtacacatgtgtcgacgcttgatgtcgcgattccggtatttgcatagtatggggatcgttggtactaggatatatgcgagacttacgtaaaagagacggatgtgaggatttttatacaggttcgggcccctgaattgtcaggtaataaccctacatcctattggccgaaaccggagttgctctttattcatctggataacacaaatacaacatgtgggataacatatctggctgtcgtcgacttgacggctagataactaactcgtagtcgatgacagggtagtcttcttcctc

SEQ ID NO: 54491 - DNA, 12943 bp, Oryza sativa
agtattaaatatagataaaataaaaaactaattacatagtttgcgtgaaaatcgcgagacgaatcttttgagcctaattagtccatgattagccataagcgctacagtaacccatatatactaatgccagattaattaagcttataaattcgtctcgcggtttccagatgagttatgaaattagtttttttattcgtgtcaaaaaccccttccgacatccggtcgaacgtccgatgtgatacctaaattttttttttcgcgaactaaacaaggcctaagcaggctctgtgtgtcatatttcatactattagattattttttatgggatggaggaagtactctgttgctcctctgaaaacgaacagtactgacccccgggaatgacgtcccgtcaggatcacgatcgatatgaaggcgcccgccctccgacgaccgacgtgcacggtcacagcactagtagagatgagaacgagacaccaatcggcggattagttaggtgcatcagtcggtaaggaaaacgagtactctgagctctacgagcacttctgtgctatatatggtggccaagttggcgagcatataagccactcgtacgtcaaggcctcatgggccacggactcgtgcaagcctctcggccgcgctacatgcgcgcaccatttaatccgtgtccatctcgcggtctcgccgctcgatccgtcgacttcgacaccttgcaaaccacacgataatccgaaggaatttttttaaccgttttgtatgttatcctttgattagttgagtttcggctaagtcgtaaacgaataaatgaactaaaaatgttattttttaaaaaaaaataacggtatttttagcagtttaaataaacttacgaaagaaaaaagatcaactctaaaattaaacttcggaactcaaatttggttgcgattgaaacaaaccaacaaacagacgatgagatgagaggctaggaacagttcgatctggcttattggatgagcatctttgcagagatagagatatggcaaaattcagcaactaatttttgttgatttattttcaaagggatatagttgtgtcgtattataaataaatctatttactttttctaagttaattatgtatattgtcttctaaatgtatgcagactattaatcaaaatactatgatcgttatacatggaaccgatagttcaaagtaaataatcgtgtagaaagtatatttggagtttgtaatcgaaacaaagaaaactggagtatattttaatgccatcttttactgtgagaatctgttgcaattcaaaacgttgaaattattttgaaaattataaactgaaagcaatatgaaatataaagtactgttcacagtgtaaacaaaaaataatgtaatcaaaatcaaaagtttaattaactgaatttattttttgtattttattttaaattttgtaacattaaatagggaaacaacgtcattttcatgattagaaaacgataattgacatcaaccgcctttcgatgataataagtgactcctagcagccacgaggatttttttttaacgatcccgcacaagacaacgtgaaatttcttatgatatggcatagaaaaattacaaagttacatgacgaaaaaattgtgaccaatgaaaaaaaaacaaaacacaacccccacgtgctaacagctccctacacaactaaggagaagacactaggaacaaaccgaccgccgctaagtttgaccgatcgctgctagacctgcaagatcctactcagacaaatcatcgatgagttcctaatcatcctcatgtagagtggttgaggaagagggcgagagagaagaagatccgctcgtccctcacattaaccagatgacgtcaaccaaaaatttgccaagaaaaagctaagaaaagacggtaaagcgaggaaaaaaacttcccaaacaacaccaccaaagagatcatgacatcttagacgccaccaccgcccatccattcggactgggttttgacatgaagaatgatgttaatgagtggaaaggtgtcgatgatggcttaacaatgctctaagagaggataataatgtccgtaggcatcggcgttgatggctcagagaaacctcaggctaggttttcgcctacaacaccctcttcgcacttatcgtcaccaccgcaatgctccaccaattgaacagcctcttatagctcgcagctctgctgcacctatgctatatacagctaaccggcctaaactgccggtcttcaacatggctaggaaagacaaatattactccctccgtttcaggttataagatgttttgactttggtcaaagtcaaactgcttcaaatttaaacaagtttatagaaaaaatagtaatattttcgacccaaaataaatttattataaaaatatatttaattattaatttaataaaactaatttagtattataaatattactatatttgtctataaatttagtcaaatttgaagtagtttgattttgatcaaagtcaaaacatattataacctgaaacggagggagtagcatttatgctaatgcaaaatgagatttacaatggctttgtttataccataaaaaaatccaaggttttttagcactacaacttacacatacacaataggatctactagtacatgcattatgcatacctaaatatgtagtacttcctctgtcccacaatatagcaacctatgataaaactcatgtccatatttgtagttctagaataggtcttagaggttcctacactgtgggacggagccacggagtatgtacttatcccctccctgacatgttttctatttttcggtggccacgtgacattggcaaggagagggtagtggccagtgggcgaagccaaggctaccaaagaatgtagcaggcacaaattagtgtgtgtagcactagctcttctctgttgccgtaatgcagaggatccatgcctgtcaaaaaggttgtacacgaataaaattgtgaagttttgagtccgttgacaattttttatgtttacgatactggacggcctttggcttaaaatcctagtagtactagatggactttctcatacttgcattacaatgtacaataaaaattttcctcgtttgggttctcgacggattttctttttatttttggtttccaaagtatgacttttttcgtgatcttaacgtattagcgattctctgccgactgcccggcctggtcgcgggagcgagcgcgcgggagattctcccgccgtggcacgcgcgacgtgccgcgtgcgcacaggccgcactgtccctttcgcccgcgcgtcatacggtgtccacccggtccgcgagcgcgcttgcttcttcttctctatatatggagtacgcagttcagcttcagcagtagaagcgcaaaaggcaaaaccagagcccgctcacctgctgagaaacaccgcgcagaggcagagacaaacaacgtacggccgtgtagaactgtagatcgtatcgtccgagtcccccaagagtttcaggccatcaacccgtagtttggcgctcccttggttttacctgcaagacaaaagagctagcgaccgaatcgttcgacggcagaggcgtcatgggggcgccgagcagggaggatgaggaggcgaagaagatggaggccggcggcgacaccgtcggccagaagctcgacgccggggctctcttcgtccttcagtccaaaggtgcgttcgtgtctgacatgagctctcttgtttctcgcttactcgcttctgatcacccactattctttctttctttcgttatttctttcttgattcctctttggcgcatgtcaggcagcaagcatgtttggctagctgcacatataagcgtaacctgtttgtgttctgggagcatcggaggccgtatattctagactgttgatggattgtccccagctattaataagcaaaagagctggctaactaatcagtagcaactagccaactaacatgtacgagttaatagattgttctggctgctatatcaagatggtttgatgaagtgttgttgtgcaggatttggctatgccatcccgattgatatgatccgtatgtaaatgatttggctcatgttaataatcgtacccaaaaactgtacaaactaccaagataacgggaaaaaaatgatggtttacaaattgtttcggttaattttcctcagcgcatgtacccggcagccattgtgaggggtactgcgttactgttctacttgaatgactgggtgcgtctcctgaactctgattaaaagttcttggacagatgtagatgtttgaatggtccctgcccatctatccttttgcactactttttcacagttttaccctatgaagattggatgtagtaacaaaaactctcttctttctttgctcgcttttttccgttcccctacatccgttgcctgcacgcctacatctattctttttcaacattcagagaagagacaagagaaaatgtacttcagggatgatgggctccctggctatcaagcctattatcaatagcaatgcatgtaaagttgtaaacatgggcaattcatattattgttctgctaggctgctagctcagccgatcccccatatcacgatacagtactcgtattagtcaacctttcgggctccatgaaatggttacacgtctatttggtcttgttgaagcagacagaaaatatattaatatatggacctaagtgaactataaaagtataataacgatgtattgttatttttattccaaaaaaataaattaggcatgaatcgttcagtctttagcgtgatgtctgtatcgtataggagaactggtacaggtcaccatctcgttgattatcatgcgcactagcgcagatactcttgactcgaggaaattataaatggcatcgggaggttggttagctagaactctctccgtttcaaaataagcgcagttataagtttttttttaattttaatcgtctgtcttattaaaaaaatttaattagtatttttattgctattagcttataaaatatgaatagtactttgtgcgtgacttatattttttttatttttttttaaaaaaataaataagacggacaattaaaattgtacacggaaactcatcgtagtgattattttggaatggagtgaggaatatggtaggagtaatgtactaatcaaatcatatttggtctattttggaaaaaggaaaatcgaattaggtgtgagactgcaggcttaacaaaatcaaattgctcactgcccccaatgcctcatagttccctgttgatttgctgacccctgaaacatactagtatcaacaactttattttaggataattttaccatccttaaaaatgtatctagaagtaccaaaaattttaatgtaaaatttaggtatctcgatgtacttttttttaatgactgcaaaatttcttttatttttatctttcgattgtcaaagcaagtttagtgactgaggagtactacatgtgtaagacatacagctttggaaagtaggtatgggcattgtgcaggattgatcaatgtttgatggagggatggggtttcttccgatggcaacgtgttttttttttttgaaacgactgatagaaacgtgtttactcgccatattccaacttccaagcgtttagctaacctgtgaactttcttttgccaatccttcatctcctacaacttttgaccgagtggagctgcggaagcctctcccaatcagcttatcatcatccagcgactaatacaaacagaaaaaataccagtaggattaacagattagctaactactagcaggagtaatgttattctttttctatatctatgatatactactttgaatgatattagtgagggtgtctgagttttccccatcaccataagttaacatattagaccataagatcctcaaatgtgagtatttttgcacttgatatgacataatatgcctaattaactaactacgttagtaggtttgtaatttttatttttatatttatctcttatgatattcgccgcaatgcacagtacctttagctagtttaacagaaaaaaactgatcatgctgctgctgtataaatgcgcagggtcatggctgcactgcgggtaccacctgacgacgtccatcgtggcgccaccgctgctgagcctgccgttcgcgttcgcgtcgctggggtgggcggcggggctcatctgcctcgtcatcggcgccgccgtgaccttctactcgtacaacctcatctccctcgtcctcgagcaccacgcgcagcaaggacgccgccagctccgcttcagggacatggccaccgatattttaggtcagtaatcactcgtatacctatctatccgtaattacagttaaacaatgagattgatcgacagggattgttgcttcagccacaattaagactgtgtttagattcaaagtttgaatccaaacttcagtccttctccatcacatcaacctgtcatacacacacaacttttcagccacatcattttcaatttcaaccaaaatctaaactttacactgaactaaacacagcctaaacgctgctgtaaactacagccatttttagtactgctacagccgtaaccgctatagcaagaataggtactgaacacaccctattactatttactagttaggttcccattaaaatggaaataatgtagtaggttgatgctaatatactcattaaactcgagtacataagtgattaaaaggaaggcacgtagcaactccaagctaattggtagatggaggagaatctgcatataaaattgcattggctgacaactgtctcgcaaactcatactacgtgcaataccaaaagcattacaatacaatagtaagggcgttcacaatggacggacgtggcattcagccttcacccaaaaaaacgaatacagtacaactgtacaagtcagtagtgggtactagtatccatcacgaggcaggtaagattctctcgcccatgtcttcacttagccctggctcctaaaggcccgaattgagaatttggagaaaacaacctctgattataacacgggatttatttttctgtaatggaccatttctttcgaagcatttacatagtttgtgatattcttgcgttcaaacgagacatgaggatgagtcaatacatcaacacctatgtcgtcaccttgaatataggggcagaaacgccaagtgcagtgttctttcagaaaagaaaggaagggaggaaggaacaccaacttgtagacgtgacaggtttagcgactgatcattgatgtcctgttttattcacaagaaagtcagctgcccgcccccttttcttgtgcggaacaagtcagctgtattatttggccaaatcaagtcccatttcgcatttgcgagtttgcgacatgtacgtgtctgcagcattcatgagcaatgggtatggccatactatatcggaccggtaaactcttcaaccggagtgagtgcagcgtctgaagccgacatgttgcttgatttcagtaactgactaagcagcattcaataaaatcgtaacacggtacagtacaggttagaaaagtccagctgctagggctcgtattttgtcactgtcaagagtcgacgagggaaagaatccccactggttagataatactaattaaaactccagttagcgcttggcggatatatagagaaaaacttgattggtcgaaagggatagtattcccacattagtactacagatcatgcaattggtcgagtttgacgaatttgtcggcaagtatttgctgtggaatttaatattccagctttccacttgattgcctgtctaaatcgattgatactgcttgcgaaggaaaaaaaccagcaccgcgcgccgtttcttgtcaatatgtcaatcttaaatactccctccgtcccaatatgtaacaacctagaactggaccctccgtcccaatatgtaacaacctagaactggattggacatttcctagtactacgaatctggacaggacagtagtagaaaatgtcccatcggttctagattcttatatattgggacggagggagtagcactgtaccaggtgtagtagaatcagtcatatactagcatcctagctgatacgacattggacagataagcacaggtttaacgtacgtgttgggaaaaaggaatcgtccttagtgccatctggcagcagattcatacagtttaattacacacgcatctgacaaaaaatgtttcgaaagggatattcatcttcatcaccgcgacaaaatcactgtcactgagatgagattcatggttaatttttccacggtgatgcatgcagggcctggatggggacgcttctacatcgggccgatccagttcctggtctgcttcggggcagtcgtcgcgtgcactctcctagccggtcagagcatgaaggtatcttcatcagaacttagtccacgaactgatttcgtgtcggatcggatcggatcgcgttcatcaattgcacatggtatgaatccacatttcttactcgatcgcgttgcaggctatctacctgattgccaacccgggcggcacgatcaagctgtacgtgttcgtggcaatcttcggcgtcttcatgatgatcctggcgcagatgccgtcgttccactctctccgccacgttaacctcatctccctcgtgctgtgcctcgcctacagcttctgcgccgtcgccgcctgcatctaccttggtaggtttcccggcgacccggcccattatttagattagctattgggctttaatttggcctgtcgacgcgacggattaaaattggactgacgaattttgtgcaggaagctcaaagggagcgcccgagaaggactactcgatcgccggcgccaacacccgtgaccgcgtgttcggcgtgttcaacgccatcgccgtcatcgccacgacgtacggcaatggaatcatccccgagatacaggcgacggtggcggcgccggtgacggggaagatgttcaaggggctgtgcctgtgctacgccgtggtggtgacgacgttcttcagcgtggccatctcggggtactgggcgttcggcaaccagtcgcagggcacgctcctgagcaacttcatggtgggcggcagggccgtcatcccggagtggctgctgctcatcatcgagctcttcacgctgctgcagctgtcggcggtggccgtggtgtacctgcagccgaccaacgaggtcctggagggcctcctgtccgaccccaaggccgggcagtacgccgcgaggaacgtcgcgccgcgggtgctctcccgcaccgccgccgtcgcgctgggcaccaccatcgcggccatggtgcccttcttcggcgacatgaacgcgctcatcggcgcattcggcttcctcccgctcgacttcgctgtgccggcggtgttctacaacgtgacgttcaagccgtccaagaagggcgccgtgttctggctcaacaccaccatcgccgtcgtgttctccgcgctcgctgtcgtcgcgtcagtcgccgcggtccggcagatcattctggacgccaatagctataaactgttcgcgaacgtgtgatgttattatgctttaactcttgacaaaggaacatcaatgcaggaagaagattttttttccttttatttttcttttttttaaaagaagtcatcttcccacttatgtttatattatatttattaatcatttattagcaactaaaaataatttatagcatgtctttagtgatttaaaaaaaaatactgtaaaataaactacaacgagaaaataacaaaatcaacgccaaaattgagttttaaactttaatttttatcttatatgcataagcataaatcaatcgaggcagaaatatagcctgagtttcgctcagaaatgtgtgttctgtctatgaatacggagagactcaacaccggagacgctttcttatatcgaaggcgtataaacgagaggtaagttgggctcggtactgaaagcacgcgacctcacgcgccgctaacaaaagcccaaagcgacccaggccgtgagtcgttggacgggccaggctcgatgcggacggcccgcacgccggcgtcggcggcgcgcggcggccgggcgctgtacgagctgtacagggcggcgagccgcgcggcggcgccggcggcgcttctatggcggcggctacgaggactggagcacccgtcgcgttggcccgagcggctgggcaggccgtcggtggcgcggcctcgtccgggctcgccgctcgtgtggttccacgccgtatccctcggcgaggggatggccgcgctcccggtcgtacgccactgcgcccgcctccaccctggtctccccatcctcctcaccactactaccctctcatccttgtaagcttcccccattaccgcaaatacgagttgcctggctctctcatttccgtgtaatgtggccatattctatttcggttgttttgatttcaatgcagcgaagtgatgaaagacttgctcccggatggtgtcatatatcaggtgagctcggaaattgctcttgtactttcagatccctgtcgtgacggccggtttagttttctgagaaatggcgtatgcacaacaaatttttactgatggactgttcttgaaaaaaaaggacattttaggttcgaactgtgtcaaggcagatagatattgtctgttcattatatgtatcccttaaactaaggtcatattatactcgttgaactatgatagtaaggtttcgtaatattaaacctttaaggtggtaatattcgatagtacagacacagatcaagcaaagttttgggaacagatggaacttgtttagatgaagggaatcacgaataggctaacagaaggatagtttaaatgtttgatatgccctatatacatctacggtagcttattgttgttttacataactgaaatacatatgtgtgtagtttgcaccccttgactgtcctgatgcaatagaaagtttcattggatactggaaaccaaatttgatacttcttatggaaagtgaactctggccaaacctcattttgtctgcagcagagaaaggggtaagttttttttttctcataatgactattttctactaagtggttaggcttccctttgttacccttgttttttccatgtgcaatggcagattagctatattttcggtccatagtacattctttcactatttaattatctgctgtgaatgaccttcctatttttcagattgcagtggttcttttaaatgcgcgcatgtcattgaagtctttcaaccgttggtccttgcctctagggttgcagttagtctctttgatgctctccaaactatcacttgttatcccattggtatggagtggtggggttctaaaccttattttgatgtaaaattattgccattgtattcatttctatctgttccagagtactattcaagctgttcgttttcaattacttcatgcaccaccacagatcatccattttgctggcgatttaaaatacggtatgcgccatgccaatttttctctggcttcctatgttcatgagagtatgtttgaaataaacatatgagtgatgcatttctcaaggattatcttgggagcttgaaagataaccaggttcacaaactcaataatttatagagattcatgtgatttacctagctgttggtgacattgctgctggggagaaagaggtagctgcaatagaagatcttcagcagcagttcagcaataggcccatctggatggcagcttctatccacaaaggggaagatgaaagtaagcacctcagacacccaccttttctttttattggatcagtattatctgctcttccaaggaactgtgtgcaggactaaaactgtatatatgtagctgttttgcctatggtgatgatcaccattgatatccctaaagtcattgctgacttctttatgctttcctgaataattgaatccttgccttactatgcttatgttctcaacataaaaacaatgttgacaagcttcctctctttttcagtcattctccgtgttcatgatgagttaaccagggcgtatcctactctacttttaattctcgtcccaaggcatcctgaggacagcaagaatgtttctcaagtatgtcaattgtcttccttacccttttatatctggtcctgtttagttgatgaagtagttggtgggttgtactgcttatcttttagttttttttaatacattatcatattgggtaatctataggtgtagcattgttgtaatgaaaaaaagggaactaacttagttcactgtatgaagcttgaaattaattgcttataactgtttgtatacgattacttgaaatttcttatggttctagagcatgtagcatatgattctcacttcaatgctgatagtataatatgtatgggccacatctttagttctttactcatcttcttttagaccctgaagaaacagaaagtgaattttgtgctgaggtcaacaagagaagtggtgtcttcaaacaccagtatatatgtggttgatacgttaggtttgtgctatctcttatgccttaagtttgcacattttttcagtatggagtatggactgtgtatattcttttgaatgttagttaatgaatgaaataccatggaaaataggtgaattaagaatgctctacagggttactccaatagctgttattgggggttcttttttgcccggcttagctggacataatatttctgaggctgctgcagttggttgcgctgttatgactggtacgcaagagtgcaagacacatctgactattttgaatgactttttctacaaaatcggaatgtctagagtttcattaattgtctttcaggtcctagtgtggggcacttctatcatatgctggtcgaaatgtggcaaatatatcctttagctgtcaagcaggcgataatctg

SEQ ID NO: 54492 - DNA, 7105 bp, Oryza sativa
aaagtttttaaatcttgacttaaaaatttttaaatcttaatttaaaaaatttcaaatctcgagttgaaagttttcaaattcgagttgaaagttttcaaatacgagttgaaagttttcaaattttgagctgaaagttttcaaatctcgagttgaaagtttttaaatttgagttaaaagttttcaaatctcgagttgaaagttttaaaaaattttcttgcaaattgaaaactttcaaagttcgagttgaaagttttcaaaatttgagtttaaagtttaaatcttaagtcaaaagttttcaaatgtaacttaaaatttttcaatctattaggaaaaagaatctcctaataaaataaaaaatctattgttaattaccatcattatccttaactaacagagttagttaggctaccgcgtcggcgtacgcacatactaggaacgcccctttaactgcccgtccgtattctcagaaatggagcaaaaagccaaggcaacgttcagagcaagaatgcaggatatacactattcagcgttttatatacgtcaatggttttcaattgagtaaattgcatcgccggtacacgaacttgtcagatgggtgcaatctagtgcacgaacttgtaaaatgctcattttggtgcatgaatttgtctaggtgcgtgcggagaaaaccgaaaagtacactacatggttaatcttattaatttaggggttgattaggatactatgtaaacatatatctaagaaggttgccattagacatatctattcaataaaaatcagaaagattaaaaaacttagcactaatataagggttagaaacatatgagattcgttatttccattctgaaggataaagttaagacgaaatttataaatattacgtgtcttatgcatactcactatacgtatgcacgtcacatcctaatgaacatcataaattaacattgctaagttattttggtcctcgttcgcacgaactagacaagttcgtgtactgaaataagcattttacaagtttacgtactaaattgcacccacctaataagtttgtgtaccaccaatacaatttactcttttcaatttttattaaactacagagctttccttcttgaaaagaggaaaaaggcctacgtgtcaatggtttcagttttattgacaccttcacaaaggaatataaaggggttgttgtacgacgaaatcccgttcgaacgggatgaaaccggttgggtatcaggtataataccttatagttatcagatctcaagtattatctaataccttagggatatcaggaccttatacctaactagtatcatcccatttgttgtagtagggggtgaacgccatccctatgttcggcaaaaacacacacaataaggaaatcgtatttgagccatgcaatctgctcgaatgaagttttgacctgtaacaacccttgatcgatcatttgcatttgcccaagaaatgtttattccaaggaaagtgcgtttgagtagtttcacttgctcaaatcagtattccctccatctcagaatataagaagttttagagttagacacagttattaagaaagtagatagaattaagagaaaatcccttatgtatctatgaaagtttacctaatccattctatatccctgaattttgctcaatcccttacatacctctgaattttagtttggatcccttccatgccttttccgctagttgaccgttagttaaccgttaaattcttttgaaaaaaagtccattttgccctttgctacgaagaaacataataaattaatgaagtatattgttggaatgtaaaaatttattggatgagactattatatttatgagtctgtgatgcaccatattatttgtgacaaatttacttttacatatgatataaaaatttaatacttatttattagttattaaaagttcttttatgtagcatgtgttttcatagtaatacaacagatttgtttattactatcagaacacatatgctaaaaaaataaataagtattaattttttatgtcatatctaaaagtatatttatcgcaaataatatggtgcataactatctcataaacataatagtctcatataataaatttctatgctccaacaatatactctattaatttatatacttctttataccaaatggcaaaatggactttttcataagaatttaacggtcaactagcggaaagggcatggaagggatccatactaaaatttaggggtatgtaagggattgagcaaaattcagggtatagaagggattaggtgaactttcaggggtacacaggggttttctttagaattaaatagggaaaggttgtgattggttaagaagtggaggtagttaggaaaagtgaacgatggagggttgtgaattgttgggaagagaatgttggtgaaaaaaaatgttatattttggaacaaatactgagtgttaaaggttgttatatttttggactgatggggtatattactaacaacacaacgtgtttggacaattctcttcacttagcaggtgagaagccagaagatgggaaaaatgtattcaagccctcacgagagagacattactctacccggatgattgaagtcaagggaaagtatcattgagcaaaagaacatgtctcaagaaggtaacaggggatcactccaactacaaaagaacatgtctcaagaaggtaactggggatcactccaactacaaaagaacatgtctcaagaaggtaacagggatcactccaactactctcactggatgttacttgaagaccactaaaatatagtaaaatgctcttaggattgtaaactttataagggtagtatgataatatgtaggccctcaggggcaaacttgtaatctcaagtgtatggttgagagtcatttaagccgacctagatcctgtaagcagggacaagttcaatagagaaaaatacttttcactcactttgcttttgagctcactctcaggataggcgggaaactatacttccccgtctatccccaaatttgtccgtaccctaaggtcacgataccgttcgaacgagatatcgtcccgtagtattcttgtaaatcaatttcttgcaatttgtttagaattccccaggaaatcacaacatcataaaaaaaagaaaaaaacaattctaaaaggttaataaatgcagagcttttcatccttttgtcggagtttgggggcaatgcgccaagccgccaacaccatgctgccctcccactctccagctgctacccatcagctacccacctcccctcgccgcagcacgcgccccgcgccgccaccaccatgcccatgcccgcgcgccggcgcagccccggcggccgagtctctcctccctggatgccttcgggcggagtcgctgccccggcacgtggcggtggtgatggacgggaacgcgcggtgggcgcgggcgcgggggctcccgtcggcggccgggcacgaggccgggcggcgcgcgctggaggagacggtgcgtctctcccgcgcctggggcatccgcgcgctcactgccttcgccttctccaacgagaactggagccgccccaaggtacacacgcctcgccgccgattccttcgaaatctctgccttcgccgagcttgacgcgtcctcgccatgttggaattcgcaggtggaggtggacttcttgatgaggctgttcgagcgggtgatccacgatagcgtcgccgagtttctgaggtaaacatccgtacttgcaaattaaataattagttaatgcctcacgcgttcacaacacttggctttgtggaactggaagttcgccaatagatgctcaaagcccacagtgctccgggcgtaccagcaactcaattaccagcttgtaataggaatttcttgcaagattcataggaaaaagattcaattttcacaggagccagtataatttcctgccaaagtctaatgtgtacatgtcatgtggtgatgtggacaacaaaatgaggattttttttttccacagggaaggaattcggctacgtgtaatcggtgacagctcaaggctaccggtttctctacagaagattgcgagagaagccgaggagaccacgaggaacaattcacagcttgatctgacactggcaatcagctacagcgggaggagggacatcgtgcaggcgtgccggaagcttgcccagaaggtgcagagcaaggcgctcgcggcggaggacatcgacgaggcgctgttcgccgacgagctcgagacgagctgcgcggccgacgagttcccgtaccccgaccttctcatcaggaccagcggcgagctgaggctgagcaacttcttgctgtggcagtcagcgtactcggagctcttcttcaccaacacgctgtggcctgatttcggggaggctgattacctcgaagcgctttgctccttccagagcagagacaggcgatttggtgtaagaaaattgtagcacaaacatacaaaagttgaagcatgaaaggtatgtgtctgaaaatgctcagtgatagttggcaggtaaatatcagtcaatgcttatgacttggttctctgcaggaatgttgatcaagaagcataggacatcacatttttcatgttagttcaatacttcaattatccatgttaaaggcaagtctgaacatacagtacaagaagagccaaaaatatgtagaaaagcaattcagcaagtgaaaacaccatgacaactaggcatactgagtagaaaaatgttgctatgaaattgcaagatgaggagcacaaacacgaatgtcatgtatatggcatttgattcacagaaccacaaacaaacaggtttatacaaggaacatatgaagagtataatgtattcgatttattagaaccacaaactagatagcagtgaatcattcattgtgtactcgacggagtagtactagtattaacggccaagtaacatgagattggccaacttatttggtttcagttcctttttctcacatattcctgcatcttcttttttcactacactttctgatcataatatttgattagtactggagaccatttattcaccggttatacaaactataaaaataaaaataatctaatgccaactacaagtgatttttcgttaattttgaacgaattttagcaaaatttcaatgaactccaataaactttgaataaaaccattcgagatgcgcattttgagccggctctagatgctcaaatttcgccgagattttgaaccctagagtgcatacaactctataattcttgtttattcattgtcctttgcatcttcttcacactttaagcatatcatgtccttgtattgctccattatgatcaatggcaggatcgatggcatgataaatgctggtaccattgttgcggtctctgtagtactagcacataaatcatgtaaaagaggtagagggtgtccagttcaggtgagtgaataagtactaatgtgttcacgggttgtgcttgtctagttgtctatgtaaccgtaatttttttttatagaagttggggtacgaagatataatcatcagtaccccatgcctgattacagctcatgagaaatcttatgaaatatgataagagtgaactatatatatatatatatgcatacatacttactcccactgaatgctactagtagtttgtacatatcagttgaagcagccaacggaaagttgtttaacatacatgcttggttgtttattactaatgctgataccaatttttttgtccaaaatttattcacagagtatttatccttgatcccaatccacccataaatccaatccaacctgattgttccacaagcatttcctattttcccacacggttctaagctggtccgcagtagtacaattcaacagaaaaggagattccccaatatgcagaaaacaaaaactagtctcccggtgcaaaccacgccggatgcaactcctgcgtaggactgtaggagtcaggcatggaccctagaaaaagtgagatccatatgtcagttttgcaatgatcaacttcaatacgatactatacccatcctaaaatataaaagattttgctaatatattagacggatgtagtaataaattgtactgctttcgtcctagagtaaatttatttattttttgctcttctcttttgtctcaaatcggagtttgtgaaagtatgagataaattcactaggagtaaataaaaggaagaataattaaattgagatttgataaaaatagtggtattttagtctttttttgattttgtattactccctccattcactttaaaatgtgatgatcaaattttaaaatctgattttttgaaatatgacaatcaaagtgaggccgtgtttagtttattttaaattttcaaaaattccaacacatcaaatgtttagacacatgtatggagcattaaatgtggacgggaaaaaaaaccaattacacagtttgtatgtaaattgcgagacgaatcttttgagcctaattacgccatgatttgacaatatgatgctacagtaaacatttgctaataacggattacttaggcttaataaattcgtctcgcagtttacatgtggaatctataatttgttttgttattagtctatatttaatacttcaaatgtttgtccatatacttaaaaaagttttggcagaggaactcaatacagccgcctaaatgaaaatgaaagggagtagcaagtactccgtaccccatattggggcatttaactatttgccacttttagatttgacaattaactatttgtcacttttagatttgacaattaactatttgtcacttttagatttgacaattaactatttgtcacacctatcttaatgacatgtggattcagtggcaaatagtcaattgccacatctaaaagtagcgtataattcaatatctccatattggatggatgaaaaagtagcctttgaaataagtgggacctgaatatcagtgatctcgttctgaccacaccgaccgtacatgccgtgccggggtgcctaacccagtgacgcaccgagccgggttcggcacgcgacgtggtccgaccgaccgcagccagaccggagaccggaccggaaaaacggaac

SEQ ID NO: 54493 - DNA, 1729 bp, Oryza sativa
ccgccggtggggtcaccatgcggatgttccacggcgacgtgttcctcggcgaggcggaggtgttcccgatgaagcagggggccgaggggagcctgccgttcccgagcaacgagatccgcatcagccacctctcgccgacgagcgagcggtgcccgccgctcgccatcctgcagaccatcgcgcccttctccgtgcgatgcaagctccaggccaagctgatgcctccccacccgagcctacaccgcctctacctcacttgcttcaacgagtacaaggtttgcccccacgcaatttctcaacaatcgctcatgtccatcgctttgtattagtatagctggtactcccattcgaaatcgaagcgaaataagttgtttacagcgactacttgggaaatggtattagcgccacttctaaattttggggcaatcaccagtaatcaaagcgttttacacattctattatggatcttcgatgggttgtgtgtttgatgtggtttgattcgttcggatgatgtttcccattgatgatatttccatcaggggccgaaataataggatttataaaattttttgtctccttgggtttgtgtagagcgcagtggtagtagttggagatgaggagctacacctagtggcaatgccgagcaaggtggagaaggtgccatgcttttggtgctgttcagtacgctctgggatctatgcagcatctgttgggatgctgaacttgcggtgccttgctatcgtatttgatctcgatgaaacccttattgtcgctaacacaatgaagtcctttgaggaccggatcgagatgctttcccgtaggatggatattgaagacgaccccgtcaggatagcagggatgtctgcagaaatcaagcggtatattgaggacagggagctgctcaaggagttcattgacacagatacagttacagataatggcagaatcgttgggacccaaaaggaggaagttctgcctatctctggtgggcaggagcgtgttctccggcctgttatcaggctgccagaaaggaatgcgattctaactcgcataaatccagaggtacaattcagatagatcatgtataaatatatttcatttaaatgaaatgttgttatcgtttgcctgtgtgcatgtttttggcctggggttatctagaattacactttgaaatcagttggacctattcctgggttggaaaaatagaactgggctccaatttgctgcccacaaaaggcatgctgtatgtctatttggttattagcgatggtacaaaaataagttctataaatgacttgtaattgctgcagttttgatcctcggataagacatatttgttcaggctcattgtttctacctacaggtctgtatgatctgcatagttacataatttgctttgtacatgtgatgtttatgaataaaacagatgcagaaatgaacttgtagcctgatggtttgggaaatgatgaaataacaattaacacaaagtttgacaacctacacacaatgtgttattatcagctcatatgtttgctgccaattagaaaaaagagattctattttagtaattatttttgtaatgcttatctgagacgattaatcaagctgattaagtcattctggactgaaaatgggctcagtataattctcatatgtctagttattcaaaattttgagataactagagtttttaattattgtagaattctgtaattagttcccttttttg

SEQ ID NO: 54494 - DNA, 5761 bp, Oryza sativa
  unsure (1)..(5761): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaatctgcaagggatgagtagccaaacccgacatggccatgctcacagctccatgaaaactacatctgctcgaatctactaactcatgtcgcttcagcaagcaactagatcagagaaagagatggttccgatcatgacatgtacggtggatgcaacctagctcgtcaaatgtacgcccaccgatcgagttgccggttatgtagcacgatcgatcgacgcgagctatcaatcaattcaaccgggcacatgctctgggccacctgcagagtgtaagattgtgcctgaacttattctaaactgctgttcttgatcaggcctcgacatgagcctcgccgtgttgctcgatctcgcatggcccctctgacggagctagggtccagagttttgagttatttccaagaggaaaaatccatggcgaagtgtgggggttcagaatattagtgtagcttagtacgcagcaatgggatgatgacaagcgccggaggagggagaggggtgctccatgatttcattctgcagcttagtagttgcttgctttatcgagattgatagaggcacgtggcagaataagcctatttgctttgggatttccgtcttttgaagctgattagctacgaattgtgcatgtattatcatcatcctgacatcctttgctacgctacgcatgattaccgatcacatcttcggtacttgatcaggaatatatgtaacagatattttcacgcgagtagcacaagctggttgagaagggatttgaaaattccaggatagttcagccattcttgacagaatcacagaatcacgctttgtatcgtgtactgtatagctgaagaatgaggacccgacccacatgtgagcagcttcgactgactcttttgccatgtctgattcagtgaactttggggcagtccacatccaatagatttggtcgaggctctggcggttctggactacattgcgtccaattcagactctcttttttttttttcgacatggtccaattaagacttctgcgtacataaaagctgattaaagaaaaacttgtatcaactttttaagagaaagcccatagcagttaaaaagcccgttgaacccaacacctaagcagcccatatgctcacaccaaggccttaaaacaatagtcccatattacaaagctgggtataagttcactttcactccctaaaatataggtttaatgtgtttcttatccctcaaccgtaataccatatatcttgaccctaactattaaaactagtataatttgactctctcaacaatattaacggcaattttcgatgaccaagacacccacatggcaacccaattatcaaatacacttttaaaagagtagggcccacatgtatcccacactctatcccttctctacccactctctctccccatatcgtcttctcagcagtagcaatgcgttagcggggaggcggggcattggcaatagagcggcggtgacggaggaactccagggaggtgtggcatggtgcgccggctaagggcgaagggagtcccctttgccacctccaacttcccattttccctcctctcttgccctcccgactcatgcgttcctaggcagtggccgacccatgcatagctctaggcggtggcggtgagtcgagacctggagccacctgggagtcaggaggtgtgacaccacgtggtggccatgagcgcagcttggcaagcacaccctgaacgccctgggagccaaatcctggatgatgacgacgcccaggagagcctcttcatcgagcatgtcgcggcggcgtgcgtgggagcatgagatggcgccacggggagagcccgatcggtgctcattgcaatcgtccctctctgacgtcatcgctaaggagaggagacaaaagtaccttccccacggcaaaagctggtgtgaaagggagcctacgtgttgcatgccagggtgggagagagaagaggagcgctcactgccagccgccgctgctcccgttcttcgtcccgccgttgatccttctcgtcgtcccgtcactgctcccgcttgtagtcccaccgcgaccgccgccgctgtggagaagagggacaagaggagacagccatgggaggaagggccaaagggggaagagagagagagagagaagggggaaagagaggaatggggaagaacggaaggggagtgagaatgatatgcgggtctcacatgctgactcagttggatagaccaagctaattagccacatcaatgaaagccaccgtcaatactgtcgagagaatcaaattgtacctgttttaatagttggagggagatgaatcatattagacatatattgaaggagttgaactggacttattcccaaagctggccaaccacatagtcctacgcaactaatgggcttaccgggccatcaattttatcaccctaaccatccccattttgcaatgtaaaaacgcaatgtcatatgctgtgctaggaatgaggaatctatccatcaataccttccactccgtattctatcccaataagtcgctctgataaattaagttcccacttcaaaaagatataacaattaattaaatggatcttattgtcatgacgatcgatcatactaagaatatatgttaattaaaacatgcctttggaaataccaatgactctttagtttttagctttggtttcccttaaaactaaataaagtcagtgttgtggataatgaaatacagttgtcggactgagaggatacaaacaatcaatggaataccgattaatcataattatatggaaatttggtcttgacagatatatggtttcccatttacttcacttgttaattgatttacatattaaataaattatataaataaattattaaatgatttttaaagttctaaaagaaaatcagggcgtgacacccatttatctacactactattgatgcaaaaaaaacacactggcctaggagatctgcttagctccagtgcatgtccaagattttaatgagatgcgggcgtgccagtcagtttgatcatgcagctgacaagatatgtaaacagcagatcggctgacaagccaatggagtaatatcagccgatagccgatattagtcgatgctgattctagccgatgtcgatagggttttaagcaatcagctatatgttcaatgtagacaatgatataaagacaatcgtctgatgataataagatataaaaataatataatccaatagaaatcaatcggctaataataatatgataggataagtactgatccgatggttaaagcatatacatcggctaaaagtccgatgccataaaatccaatcgatttagataaacagtgagacctttgttgcaatcggctaaatccaacttgtatgtaatctttgtaagccgatgcaacgtccagataacttatcggctagtaccgcgataaaacactaggtcggacctaaccgatgcagcatgagattatatatgataatctaatacttgatgagccgatagatctgtctaatgtgatggatataacaagtctatttataacagcattgtgattgtagagatatatcggctaagacagaagatcagacataaccaagacagtcccaactaaactgatgcttttctaaacacaatgcaattagagatagaattgagatataaggtaggcaaatatatcaaccaaactagagtgatccaagagatcgaagcgatacagctttgaacaacaccaatgtagctgatagattcaccagggccgatggaacgtaagacttaccccttcgtcggagatcgaactgaatcgatgcaggcccgcgtcaagtgccaaattccgccggttgataagtaaaacctcagaaaagaaggtagcgatgcgccgagagtagtattgatcgagagatcaattacaataaccccgggtgtatatatgtatacccatgggtagatactaatccttgtaggataagaaagaaactttcctaaagataaaaggaaaacataaagtccttatcgaacactaaacatacttccctaaagataaaaggaaactaatagactattcttaattaatagataaattgacatgccgcatcctccttgaactcggtcacttctagataaacttcatttagtagattaattttcataaccgaatctactaagaatccgactattggcgacttgataattcccatcggccgattccatggctctgaagtcgatactgactctaggccgatgatgactttggagcttaccaaatttcactattaacaactactacataaagtgtttttacattctcggccaaaacctattttcgcagtcgaatggcagcccgccttcccacaagtgtctacgaaaatagagattatcgtaggtccatccagccgcatgggtgaatcgattatccaacatgaccggttaagacggccaactgcgataatgttttttgggtgaaaaaataaaatcaaaatatccccaaatcccttctcctctcacaaaccctagctctagatccagatccaaaagttcatcacgacaacaacagaatccattaatccattacttgaaattgaaattgaaacagaaccaaaaaccaaatgcgaacaaacataaacttcatccacatccacaaacatgaactccatccacaaacaaacataaaacaaatgaagatctggccacctccaccgtcttcttcgccgccggatccggccgacgccaccaccatcgtgcggatgcgccacctccactgccatcgccgccaccgagacaggctgaagagagaggcacgatgcgaccctcttcactactccccgcccctcccaaggtcaccgcactagatctgttgatggcaacggggtgcctgatcttccgtcaagtagagaaaactatcaatttggtggaaacttgacacattatcgtgcttctgatcaacactatccgaaccctataattgcagcaccacgtcttctctggttatcaaccatgtcgaaaccgattgaccttgttgctgcaaattgaaaacataagcaagaacaagaaaggttgcaacacaaatgcagatgattgattaataactcgaagttggggttccacaaatcaatgaacgacgaaactggaatggtataaataatctaagtaaacccaaccctaacttgatagtggctacaatatatataggttctaaggtcgaccaaggaggcaaggacacctggatgcatccttatttgattccaacacgatacacggcccaacagcccaaaagacggtgatgcaacacccgtacatattctagacgccacgtgtttcaacaattccatttgactttgaaggaatgatgtgagaccaggtccattggaaaggcggtcttgttacctttccatacataggtagaacgtcgaagatggagtccgaatgtgacttgtgcgacattttttgcacagactgctcagggagcccgaggtagactcgaacatggtatgatttgggcctccatattgacttgaatgcccttgatgatcttgtccatcttctagcttctctccttgttcttctccatagttcctaatcataataaaattattaggtaacaatctttcctaaaaatcacatgaagaagtacttaggaacaagctcacctataaatgcaattg

SEQ ID NO: 54495 - DNA, 18985 bp, Oryza sativa
cctcacttctcagctgagaatcccgtttatgtacctacacaagattagcacaattgcataaactagaagacaatcctctttaataaatattgacttcttccttatttgtggttccaaatgattgttagcctatgtggtgaaagctttctagctgaaattgtttaatcttgtacacgttttggcccttctaaaaggcttccgtgtactaagggcctgtttggcacagctccagctccagcttttttggagctaaagcccagccaaatagtttctgctccacctaaaatgggagcggagctaggtgaagcgctctcatagaatgaactagagaggtgtagttgggtttaggcagctccacaactccactccatactcaactcctgaagctaaattttgggagttggagctctacaaaacaggccctaagaaagcttgtgtaaaacgttatgttgtgtaacactgattacctagggttaatggtagttagtaagttaaagatgtcacggctcaagctgctactgtactaatcatttgtggtaagtagttaatcatatacgtttaagcattctccttggaaagtacaaggagcaaatgaagtaattggatgaagtaatcaggaggcgtgccattacggcgccccaacgtctagttttcttatatacttatcaatcagtctttgaacaaccgctcccatttggatatgactcatgaggaccaattagctccattggtcattcttcatccaatggctatggttcctttatctctattttgtctttttggtatcagatggctgccgctcaattgcttacatggatgaacctagctagtacgaattggtgttggcgtttcacttagagagaatgggacaatcgacatcaaaatgccaaaaatttaaggataaacccgttactttagagcatatatatgatgtattatcccatagatagtagttatcatgcaccatttatcatttgttttttcttcggtacctcgactaattaccggttattctgctagatatgtaacggcattgaatatatatccctatttagacatgtcggttttagtatgcagtttcactaatacgacaaatctttgtcgtatgtgaaatcaaaacgccagatttctaaaagcttaaatccgcgggtagttaacattcagtatttttatagtttaattcttgatacttctgaagataacaaattctaaatttgtgatgacaataagattaacctgtttaaatactttggtgaacattggccggactcttgaaacagccgtccatcctattgatgcattacagcattgcttatggtatcttgatcagtactactggattaaatgctcaaggactgtagccaaatcaaccatggtggtagacacacactcaacgttcatattcatgcctggcatgggatgtacactagagtgctttgcatggcatgcagatacagccatatacctttgctcaatgcctatcctactggcagctcattgccactactgatatgaattttatattgacaacacccttttgtctgccagctcacctcttcaaacgttgcatgcacttggtgtacacaacctcctgggctatacggacagcttaaaagagacctggaaggttataatctagctctatttgtgaccattggatcacttcacagatgaacggctgatgcattccctcttctcctatataaagagaggactcaggtctccatcacactattctatccccttattgactttctctcaatcgacctcattctgtctttcctagaaaatcctccacccacaatcaaaaatctatgcttccaacctcaaagaacaagttgatggcggctgcaggtaactccttcctcaaccaagatccgacgatgatgggatctgggatgccgcatatgtactttgcaagctctagccatggcaccggtgcccactaccaaagtcctggtggtgctcccatcaccatggcagtcccggacatggggtttcttgttgcagggataggcatagctccatctagctttgtgatgccagagggggccctagcagctagctatagcgccatggctaccgttccagtaggggttgttgttcctcaacagcagtcgtcacgatttgggggcaacaatggtaaccctgggtcgttcaaaggagcatggacaaggcaagaagatgagtaagtaatagatcaatcgacttctagtgagattttatttttctcactaacaagattttttatatctatgtgttaacttgttttcagagttctcaaacaaatggtgatactccatggagatcgtaagtgggcaacgattgcaaagagcctcccaggtcggatcgggaagcagtgtcgcgaaagatggaccaatcatttgcgcccagacatcaaggttttactcttaacttcttgattcctatattattatgtagatctaagggggtttcttcatccatgtgattttgaggggtgatttctttttagatttacattaaaatcatgctaagcagtattctagcatagggattatcgaaataattcattttgttgcggttgttgtgtatgctaatcttaatgttctaggcaccgagtaatccaaagcctccgttttatatgatgtttttaggactagaaaatcagtagatcttgggctacaagatcaaagattcagactcatcatgtccctgcaggaaaaaaaaacaaaggcaaatctgtccaaaattgtacctacttcaattaatgcgtattacattttataaggttaaatctcttcttgatttataactacggagtaaacaacaacagtgttatacaacaccctgcatgaatatggtagccgttaatgatcatatatagatatatttttctatccttaataaatgtactgcttagatttaaattattccaactatctaccgatcttagaaggttcgagggcatattttcttgtgttgtgtcgccgattgcgtggatgaaattagtattcaaaaactgtacaatttatactgcagaaggacgtctggactgaggaggacgacaggatgctgatcgaagcacacaagacttatgggaaccgttggtcagtaatcgcaagatgcctccctggccggtcggagaatgctgtcaagaaccattggaacgcgactaagcggagcctgaagtcgaagcgtcggatgaagaagaagagcgtgcaagtggtgaattcaccgccggggcagctctccccccttgaagagtacatccgcagccagtacccgtcggccgttgagaccacaccgccgccaccggccgtgcctgcaccgccttccgacgtcattgtgcacggtgccggatcggtcagcgcaggtccaaccgttgccacacaggagcccaccggcaccaacccatcggaaatggggatctaccttggcctgggtaacccggctggaccgaccacccagcagctagcggcgatgaacctgaacatgtcactggcgccggacctcaacgcctacaacgatcagcgagaggggtactacctcccgttcgtcccgcagggcaacctgcactatgggatgcatgtgccggcaccgccggtgcagcagcagcagcagcaagggattagcgttgatcagggcctgcattcttcttgcctgagcctgtaccacccgttcccgggaacccacccggttagcctggatttcggttgccaatccagcaaccatgccaacgcaggtggctactacagtgaagctggcccaagcagcggcagtggcagcggcgaccctgacgacgtcgacgtcatccagatggcctccaggcagttcctgatgccgtccgaggctgaggtcactctcgacctgaccaggttcaagtgaggttcgcagtgccagtgccaatgccatatcaccgctcggttaataaatttatcttttgttttagcagctcctgttacctttctccaagtacaatgcatacctgactgtatgactgcagtgcgcgtttaagcttttcttgtatttctgtttggtacattcggtgatcattcgagctttgcattgtccatgtggtgtactggtgtgggaactttaacttgttgtactagtaccttttatgcatggatcaatgtgtggatttcatagttttccccctaaaattagtactcctattcctcgaaaagatgcttttaattttgtagtttactactgttgaggtattggagcgtggaaagtggtagcacctggtacgtctactccatgtactacagtctttgcttgcttccgcggatggtgcgcagctatctgggctttaaatgttggctcgcagacaaaaagagcgcaagagtttgacgtgcagcaaagctgttcagttcctctccccgaaccactcaaacggctgcctgcgcgcgtgatgcgccagccaaggatgcatgcattgcatgcagctagctgcctcggcgtacttcactgctggaagtagcccgggaataaaggcgaataattgtagtaccttaattaactattattactactctgctactggagttaagttgtaacatttgtcgtattaacttcaagtgccaaatgtgtcattcagcatctttcacaccaatacaccatggtagtaaccagtaggcagtagccagccactccatagtccatgacaccgtctgattccgaactctgactgatatgacagatttttcctgagttcagtgcaatgtcctatgtgggaggcccaaaccacgtggggacggcccaatccttgccggaaagttggtttcacgggaaacgggcctcctgaatcggccctaaatgtatcttaactgggccgaagcccgatcctttagatcagatgcttcaatttcgaaacaagttcattctagatacctcaatttgtcgccaaatatgatccttagtcttgaaaaccggatacaacacatccttcaacttatcaaaccgtgcaatcgaggtccctcgatagtatttatctccggttttgactgacgtggtgcctatgtggatcgtttgaccaggtcttcgtccgacgtgcgctggcgtggcgcttacgtggcaatgtgatccaaatataataataaaaccatggggcccacatgtcagtttcacacaaaataataaaatatagtggatcccatgtgaccccacatatcatctctatcctctctgtttctccctacttatctgtttctcccttcttcggccggcagagcaggggcggtggtgccgttgtggtcggagcaagccggcggcaagaaggccccctctccctccttgcccaacgatgacgactacgagagccgcgcaccgccacctcatcaggagatgacgaggatggagatgagatagcggagagggaggatgcggggaggccgacgagtgtggcggagaggcctcccggcgctcaccgccaagctcaaggccgtcggcgccgccgtcgcgctcgagtaatcccgagcagaagaaggggttcgcccttttttttggttcctattcattatccttagatcgaagatgctacgcttgtggatgccttgatttgtttggattgaaattagatgcaattggggcaactgagctgggatgaaggtcttgattgcattgttgtagcttgcctagttactgatttatcatgttgcctagttaccgccttctgcagcagcgccgaggctggacagcatgcatccgcgcgccatgctaagcgccggcggcaagagcgggtttctcgtggcggccatcggagagaagggcgatgatcgacaggaaggagctaggcgacctcgtgtcccctcccgacatccttcctccctcctcgagctccttggcctaccagcgagcgcgcgtaagagagagatgtcttgtggccgctcttctctatctggggcccattcccagcgtaagggagacgaagagaggggagaggaggaagaagatgaggggtgagtagactagcatgtggggtccatgtggtccccatcattttttattagtttgtgtgtgaaactggcatgtgagtcccattggttttattattttttcggatcaaactgccacgtaagtgtcacgtcaacgccactttagatgaagaccgagtcaaactagccacgtcagccaaaaccgctgtaaaccaccgagggatctcatttgcaccggttttgatagttgaggatctgttatatctggttttctggttgaaggatgaaaatcggattcattgacaagttaagggacttcagatgaacttattccttcaatttcgtcggcatcgtgagtcatgatgttgctgttggacatgctggcatgtaggcccaataaattaggccttaccgtcagaaatggcccatatgcccttttgatctcctttccttcgtactaggcctttttggttcatcaaagatggcagggagatttctaaaagtaatactatatgacagagggatgaaaggtgcttcgttctacacacgtagatacgtttaaggttggcgacgacgcttgcggagagtttttgggagtaccttgaaatgaatgggcgcatgttgatggtgtgtttgcaagtgtgccttttatgcagtaattgagaaaagaaaaggttataatcctttgaatgttgatatagtgttttgctttttcttttttttttacgaccactacatgaatagacaactcatgttgtatttgtatgcccatttgcatgctgatggtgttcatctccctttccggctagtgcaatccgaggaattatacccagctgcgcagatacaatggatttgcgtgcaatcgcccactggtttagccatttgggtcgtcctaccgaggaactcagactgcctctgactgggaggcatgtgctggtgacgcggtctcgacgaatacatgttgcccagtgcacctgccgggatgatctggacaaaatggtggtctagctagttcatatctagttggacttggaccggttctttgaacgtaaggaacggcgaaattgtgtctaacacgtctagattctagaagcagcctacttaatttgaaccttccttaacccttcctgtagtagttggcatgttagtcagttagataagctgtaaaaatgcggttgtatagcttcagtacaatgatctttggctgaatgctgtttttttcctctatggtctaccttatcggttttgtgatgtccggattagtcgctggaatttcttcctttttttttctctgttgatgagggggtaattgattgttcttccaaatctgtcatgtgcaagtattacataaacagctcggtcgttacttttagttgcatactctaactcatgtccatatataccaagtccgctcaaatcttctattaggacatggtcagcttaagtctcaaaagatggcctgagccacatcctcttgatttgattcatcaccaggattacatttatagagcattgctgtaactaggtatataaacatatataaaaaatactactatctgattaggaaataatttttcctttgaaacaattcgtagtacatcaaacattatcaatatcggacacataatccattgaaacatatttacagagcattatatacatcatcagtactctaattgaaatatatgatcctagatcattttcccgttaccatctagtaatcaaatctaaaccaaaatgtctcccaataaaacatttactcgaactgaaagatgaacgcgaccactaccctacagaaataaatcataaatgtattaaatgtatcatcaaccttgaaagactgcaaaattcagggtccggcggcatccatccgccactatttccgccgctcagcttcgcctggacgaagcagagtcaccgtcaccggccatccgccgtacccagtagtcggccaagaacgtcttggcggcgtcgaggctggggaagtagggcggctcgaggaacatctgcgccagggggtccatctcctccgccggcgagaacagcgcgcggttggtcgacgactccgcggtgcccatcaccgccgccacgagctgccggtacgcgaagaagaacctcctcaccgccgcctccacggcctggaacgcctgcagcagctccaccttgccggcctcctcgccctcgccgcgccgccggctgtggaacagcctcatggctgcctcctgcaccctcggcccgccgttggggtccacctcgacgccaagcacacatggcacacgcttcttgaggtccctcgtggcgttagcgacgtgcagcagcgccctggagcggaagcaggaggacgcgtcggagcccggtgccgcccgtattgcgagctggctcttgagccgcaggaagtcgtccgggtccatcagcaggtgcaggtcctcgacgtcggcgagcagcttccagacgcgttccaggatccagcagtcgctcgccgcggcctcccagtttcttgcttcgatccggttgtttaggcgggtgagaagctgtgaggccgcgcacagccaggactcgagtatctggtggatagtgaacagcgcctcgttctccttgttgcggtagccggtcttgggctccggcgcgatcttcgccttgagggcgtgcagctcgtgcggcctcacgacgcggtcgtactcgagcaccggcttgccggcgaggttgggctcgccgaggccgagggtgaacacgcagccctgcatctggctctcgatggcgtacttgatcctggccgccacggtctcggacttgtcccaagcggcgagccgcgggagcaggctggcctcgctgacctggcacaccaccgcggcggcgctaccgggaatcttccacacctcagacgcgctccgctcccgcgggagcacgcctttggacgcgctcagctcggccagcggcgggcactgctcgccctcgcagagcgcggccaccagctccacctcccttgccgcgagcgcctccagccgccgcgcgagctcgcggcggctggcgtagccccgcgggtcggagagcgcgacggagatgaagcggaaggtgatctccagcgcctgcagcgccggcttgacgaggccctcgtcggcccactccggacagcacctatccttccacagccttgcgagctccggaagccgcaggtactgctcgtactcctcgaccgccgtatcgtcctgcaccctcagaggcgcagccaccgcccccgacgacgacgaggaggacgcgcgctgcttatcttccggccgcaccggcgatacaggggacagcttgggcgttgccatctccgcgctccagttgagttgaactctccctcgatatgatcagcgtctagtttgaattttccaactgtatactccctccagttatcgatcgctaatcctcgcttgtctttgagtttggcctcgagaattagcagatgagtcgtctttatatactgctgcgctaggtggaagtggagtattacagctgtacaaggggagcgtgccagcatggcgtgtgggccacgctgctgcagcgtgattcgaaattcaattttggaaaccgcgggtgggccgggccctgtgcctgtggctggcgttcgcagagaaaggcaataaataatcgtgcaaagtgagaaaagaaagagatcttgagcttatccggatgaaggagaggtgacctctagttgtgtgaactgtgaacggcggatgcgctcgtggcctcgtgatgtccaggtcgtcgtgaatcgcgatgttctcttgcgttggggcagctcacgccgacgttgtattcgatgtaatgcttaacgcggacatctctatccgttgcgcacttgcgttgcccaccctaggtaggccggcacgaacgaggttcgctgaatggataaacggcgtctctgtttctctcgctagtctcgtaaaagaatactatcaaatgaaaacttcgttcgcttgccctactttgcttgtggtttatacttgtggatgattctatattggaatactagttcccgaagcgaacggcgcagcatgtatgatgattttgggtcggcaatatcgtcaatgaacgacgtcgtagctctgttattttcctatatgttattccatatcgtgagcgtacgtaactttcatcgaaaggcttttgcagtttcgccccgcccggctttcggtagtgatagatatctaggataggcagttgacctcaactgagttttccctcttcggtttatttagcaccaaacgttcttgtcaaccaattttgtaatatgtagtgagcgtttaaagttgtctttctgagctttctccttatcttctcgggttgttgagcacgtaagaatacaaatacaaccaatctagactgcatgctatggccttctttacactatactcaaaacgactgtgtgataccacttatagacggggtcgacagttctaaaccataaattaagcacggtcggtggaaataatcccatatgcactacacaattactacttcacttactgtgaactttcggttatactgacgcctaagtatctctctcctaattatctcagcaaaaaagttgtcttgtcgtaacgcactaaaccaagcccaagtaggcagcagctcgtgtagtcgtgtgtctattggctagtgcgaaacaaccggatcaatttcagtagggcgtcgcaatgcaatgctgatacgacgtgcacctagcccatcacccacgctcaaattccaccgtcacccacgctcaaattccaccagcgggtcgatcgccgccgcgaccgaaaattcagcggtcgtggcgtggatttgccggacgaccgcccgcccggccgtccgcgagcgctgccgaactttgacggcgtacgcgccgagacaccgcgcggccctgctccccagcctcctactagtcagaaccggcagtagccgaagcaaccaagaaggttgggtggatatgcgtaatgcgttgatttgggagggaagcgccgtgttttgccatgtgtcgccttgctattcgcggtgcttatcgctcgagtggattttcatattggttgacctagtatattccacgacgacctgtgctgtttagttagtggcgtaaattaattcaattttggaggattggtattttcgcgataagtacgaatgcgtttttttttttaagttgaccggaggaatgggaggttgagaataggtttttgtgcatatccaggagagatggagatcgatacaggctagctggggacgggttgaggctttttagctgaagaagacgtgctcgtacgcgagatgaaaagcatgtaaggtcggcagattacctgcctaagttaccctgtgcgacagagcatatgacgtgcaccgactgattttgttcagttacgcaacgtttcagtatacataactgtgcatgcgagttcaaatgattacctcaaacgtatagagacatcatatggtatttgttttcaagggattagtttactcaatgaaggaaacgggcatgcgaaaaattcagatcggtttctctctgactccgagagtactcgcctctcaacccatgaaccgcgaacagccgctacaactgcattgtggataacattgacccctctttataccgagggtggtgcatgatcccaactggcaacgagcgtgctcgtgcatgtgcatgaacccgccattaaaacccgtcacggtcgtttcgtcgagggccataattcgtgcatcaacggctgggctccggcgcgtgagtcgtgacgtctgggaagggaggccgggtccatgccgatacggggccaagattatggccaccaataacatctcatcatgatttccggataagagcttacgaaggtagtagtagctgaccagccggcctccgacgcctcccttccttgccgcctgcgcgctagtacgaataacgaatggacaaggacgaccggccggtaaacgtccacgacccgatccgagtatctgaccaatccgtcaccaggattagctcgttaagtttctaggcggacaagactttcacgcaaacgcacgtccgtcgctgtcgtgaaaaagagctctcgatctcccaagaaaaccgatccgatcgcggccccggtgtcccgtacgtcgatcactcgatcaccgatcgagggcgacgtgtctaggctgaggggagacagggacgccccgccacgagcgaggaggcgcgcgcctcgccggttaacccgctgttgccggacgcgacgcacgccggcacacgcgggtgacagctagcggttggcgagcgttctcacgagtttaccccggtccgcgactccgagggtgcgtgctgtgcatgagccgatgcgcgtcggctgcacagcgcagcgtagtggtgcggtgtgaccgactggcgtacttgtgctggcgacggcggcaactggggttgggattggattgcgccggtgcaaacgcgacattcgttttctccgttccgtcccctagccgacgcgccttctcgtgatgcgggatctgggtcggacgaaggaaagaaggctaacgacagaagttcggcggtgtgtgtgtggggcacaagggctttcagttttcggcgttccagataaggggaggcctcgtcgcacatggcgtgccgcacgggccgcggcgcactacgggattagacgaggcccatcatgtgcgatgcccagctcggccatatgctgcgagggggcatcggtcatcggtgcgcgccggctgagatgaccaagccgacgagctggcaaccgtttcaccgtacatggcagctcatgatcttatctggtttgatttgaagactagtccaattcgcacggtactgtattgcgtagggtactatgaaaatcattggtttatgcttccaagcagacattacgtcgagtatctacccttagtttcagacatcactgaagccatttttactacaccaaggttcacaatttcgtttagggtcaaaatacaagcccattgatatgaagaatttcgataaaggattttataaaaccaagtggttccgggagcttcgaattacggaagaaattcaaatagaattgtgcaccctagctcaagctaaaaagtcaggtttgagcctagtcccaacctaaaagaccaagccgaagctaagtccaaacacctttttttttaataagttcactttgagtcccttaactagtgatcaaatctaattcgtatccttaaaccacaatatcttgacctccaactattaaaaccggtgtaacttgactccctcgacgattttggagggtggtttcgctgacgtggtgttgacatgatcttcgtcctacgtggtgttgacatgacgcttatgtggtcaccacatggcgctacgtatgacgaggaccaagtcaacaccgccatatagtcgccacgtcagtaaaaggtgattacctttgatgttgtatgccacatgctcacgtgactaaggcgttgtgtttgcacctaaatgacaaagtttgggacgtgcaatacaccctgcctctaaacatttttctaagaactttttttttctaaacctgtttatataggttggaagcatctaagattaatttaaacatcgagatttctaagtccaaacaaatagtcatgaaaatgtttgaaaatatttttgagctttagtaatagtgtcatcgttggcttaaaaaaatacaactcaaaaatcaacatgaaaagaagatacaaagagtaaaaaatctactaagcagtaaaatggatcatattttatagtttactggtaatgaggaaaaaacagtttataaatagataatttctcaaatcaaatagttcaagagagtaaaattaactattatttccttctatgaataactagcaaaactgcccgtgcattgccacggaaagaaaaaaaagagaaaattgaattacaacatattaaattataattaaatgaaatacaaattttctggaatattttgggtattttttaagtaggtaggtatataattaaattaatttacaagtaaaataagtgtgagaaataaaatgatatggttggatttaattttcattaaattctccatattaattacactttttgaaattttcttggaatttactgagcttaattgctaattttgataatacaaacatcatttaagcatttatttaaataaaaatcattctttctctatgagccattttcagcctatttttttcttcagcctgcaagcgaccaaagtctacataatatccccacactcctcacttgccgtgcgggccgtaaccaaaaatgtgttggaccatcggcccacgtgtggcccaaatggtgcggtccggtgatgtaggccagcccaacgctcgatcaatccgagccgtttgttttgatggatggctcagatcagttccaatcaatcaaaaccctaaccctaaccctccctctccccctccccgatcggctcagccatcccccatcccccctccaccgccggccgcctccccgcacgacgcggcctctccccctcccctcaccggcgccgactctcccttcacccctccagcggcgccgcttcccttcccctcccttctccactccggcggcgccactccctctccccctctccctcctgtctcgctggcaaggcgcggcgacagcggggtacggcggtgataacgcacggtgacactcgtccctccccctctccctttccctctcctcattgcctcaatgcccgtccctccctctcggtgatgacgccttctccaccctcaagatccggcgacgtcgacggcgacgacgatgtcgtcagcctccgcgggtggatctgtcggtggtggcggctaccgcttgcggatctggcagcgacagctccctccgtcgcctctcttcttcctctggcgacggtggtggcgtcggcggtggtcgtggatgaatccggcagtagtggcgacggccgaggggatccgacgacgccccgtggtcggattcggtggcgacgacggcgttggtggcttctcggtgatgtttttatttttcttccctttttttttctcaatcgcttgttgtccgattgaattttgtatgaattttttttttgctttttttttgccttattatgatgcaaccggatttgattttttttcaccttttttttttttttgccctttttcacggacggacgacggaaacaccttttaatttttagacgatggaaacaccttttaattttttaaatagtagagatgtagttgacagagttgccaggcctataaaaacacgattccaactggcccaacggtcttccctagccaactggcccacggcccacggcccactagcagcacatctgatgctcatctttgtaacctaggtcacatagccaacttgacagttgacactcgggcccgcgagcccccgactcgcccgccgccggccgccaggccgatgtccgacgacgctccagcctcctgcgctcctcacctcctgttcgtgcttgcttgacgtcgacgctggcctggcctcgctcggtcctgaccgagcctcgaggagacgtcgccgccgaccgccggggctgacctctcctccgattgcccgacgcccgctccagcgctcctactccatctccggcctccgactcccagccacaggggcgcaggcggctgatccccaggctgctatccgcggcggcggcggcgcgtgcggcacaactcgccatttcgaagggagtagccgctctttgatgagcgggcgaatgggtacaggtatgaacccgtacactgtaaccgtctcactgagaggagggagcgcatcgtctgccgtcgtaactataacggcacggtcatgccgttggcaaatcctgatcgttccttttctttggacgattaggatttagaaggatccaaataccaggcctgcaagttcattcaagcccactaaccaatcggctggtgcggcaatataggcgccgcaaccttctgacgcgagagaagtcccgatgcttttttttatcgatttcactttccccatcttcatctctcacctctgtctctctctccacgcatctctcaatcactgcaaagcaggagcgccgattcagtggcttcaaccataaatttttgctgccaataacagcaataagctccctgatattacccaggtttgcttcccatcatttttgtcaattaatttggctcctgttgctagcagcaatcagtcctggaagcattggcaacagtacgcagctatggttgctgtaatcagagaagtcaagcacgcatgcatgagcagaaaatggaagagacgaagctagagggtttgggactgattccagaatcatcggccaattcaatttcagtagcttgtgctttagaaatcttccgttgtgaagacattagatgacttgtctctggtagttggagcatgtggttgtgttcaatagataaatcatgcaaggtgtaaagaccagaatccctatctaaggtaattcccattcgggcatcacaacctgttcttgtctcagctcggggaagttttgtcaagtgatctctcttgtcctgtgctcggtagccctgattggaacatacaaatctacatgatgtaactaccttgtcaattttacttgtgttctcatacttcttcctagcattgaatcctacttgacctccatagaatacccaaaagttccaagcctcatcagcacaactaaaattcatgcctattcgaggtatccaagaaggtgtgttatttgtgctgcaaaacatggcatcgcttcttattttaccaaacatgattaatgtaagatatgaaatgaaatggtcggactggatttagatggtacatatggaactatgaatcagatcctgatatggcactcacaagtttgatgactcagaaggagcaggtttttcttgcagcgattgctttcgtactagcgtctgatctccctcaatctcattgcttcaatcaattgtaatattgttttaatcataggagaactaattatatgtattacagatgaagatgataatatgacttacttatttggagtctctgttgttgttggggtacctcgatcttcagaattatccagtgaagacatttctttaactcagatcttgcttgcatatactttggcctcttgaaactctcgatcaagagatggcatcagaccctttggagagaaaggtgaaaactgatttctataggtttctatcctctaaaatgaatgggtgaaattggcgccaagttatctgcttgccgcgcgccatttctctcgcgtcagaaggttgcaacgcctatattgccacaccagccgattggttagtgggctgaaatggacttgcaggcctggtatttggatccttctaaatcctaatcgtccaaagaaaaggaacgatcaggatttgccaacggcatggccgtgccgttatagttacgacggcagacgtgccgttatagttacgacggcagacgatgcgcttccgggggacccatacccgcgaagcattaagcggtccccaaaattttcaacgcgccctttcacactttcgtgtcgttcccgcgcgagggtgggaaaccctttggcgggcttggctctcgcgccactctccaccaccgcgccctttttcttgtcgcccacctctcgccccatcccccacaaacaattcctccccaatttccctcccaaatctctcccgcctccgatcccacagtctctctctctctctctctctctctctctcgatgccgacgcttcgcagcgccacagcgagcgcgtcaacggcgggcacggcctcgccgacggcaatcgccaccccacgaagcgccaagcggcgcctcacgagccctcgccgagccgcagggtcacccgacgcgtctcagttcacatccccccacaaatcccccaatgtcggaatcgtaagtcccccacctcccctcgatctctagtgcaggactatgcagatgctggcgtgctgctgctgctgctgcatattacctggtattctgttgcaatgaggagcaattgctcgatcttgcaggttggcaccccgaagctgctctcggcgtcgcccaggtcatctaggaagcggctttacggcgacttcgtcgcggccgagaagcccaagtggaatcctcgaggcaagtctccagaatcccatttcagtagggctcagagttctgattgggatctgacgaaagaattcatctgttctgcagatcccgctcagatgcaggtggtcaaggaggcgcttcacgtggctacggtgccctcttgcggattggtctgccgagatgatgagcagagtcgcgtgcttgagttctgcaagggttgcgtggagcaggagcgttcagggagcctgtatgtgtgcgggtgccctggtacagggaagaccttgtcgattaacaaggttaaggagagcgtggcgcgttgggcagacgaggtaaattcaatttctcatggttctgtaagattcctgaaataggagtgtgtagttgttgatatggttgtttgtcctcgtagaccggaatggagacacctgatgccttatcgatcaattgtacaagcctagcaaagacgcatgaaatttttagtaaggtatttactgttgcctaattattgactcgatatatctatgcaatgctgacaggcactgacaagttcttgatgcagatacttgcgaagtttcagactcggaagaaggcaacctgcaaactgtcaccacttcagcaacttcaaaccatgttttcccacaaggaatcagccccaagaaggatgttgtaaggactgcttgagcccagtacccatcctcacaacctggcctttttcgtgccatttagttcctggcatcacaattttcatattactgctcctctgtaggttggtcgttgtggatgagatggactacttaataacaagagaccgggctgtgctacatgatcttttcatgcttacgacttaccaattctcaagatgcatactgataggttagatgtcaaaggatgcttcttgtacttttgtaattatgttaatatcaaaatactgttttgccaatcgacaattggtgctattttttcaggtattgcaaatgctata

SEQ ID NO: 54496 - DNA, 1064 bp, Oryza sativa
acaaattatctacactctgtcatttttttatctattcttctttttgcccctgctgtggctcaataagtgatgaattgctcaataagaacagtttatctgtacccttattgtgggctgttttttaaatttgcatggttatatacctctacacttgttctttatggataagaacagagtatctacacttgttctttttttatgcataagaacagattttctgcacttgctcttttcttctggattgataagaggagactatctagacatgctgttttagttaatttgcccctgttgttgctgcccctgtggactatctttgccgtgctattggtcttactgtggctacttgttcaccctgctgtttatgtgaatttccccctgctgttgctacccctgtggtatatatactcctgctgctgctgttttatgtcaataacattctatctgtacccttgctgctgctgttttttaaatttgcatgattgattcagtggttatatacctctacacttgttctttatggataagaacagagtatctacacttgttctttttttatgcataagaacaaattttctgcacttgctcttttgatgttatgatttcctctttttatcccttcatgcaaatgattgtaattgatgcatatttctgagcaaaactgaggccatatctttcatagtataccccgtattacattggatctaatgctatttagtataatggtaggaaatttataagctttttcgcaaaaattagaccatggcaacgcccggcgcaaacccgcccaccccaacacctgcgaggatccaggaagaagcaaacccagccacggggacagttgccgaaggtcatccttcgacaacggcggtcgaacaacccgaaattcatggtaatttataggataaattttcaccacatgaccacataaattttagctagcaccccttagcaaatattgccttctgtttgtgctgcagaattgccgcaggaacaacatacgttgatgtcgggcgcgacaagtgcaagtaggtctagcagaaatccccggtcacaaaatatat

SEQ ID NO: 54497 - DNA, 738 bp, Oryza sativa
gcatccacagaggtgccggcccctggtctcccgatcgcaccactagctgcagtggaccacatcgaggtaattgttgttatccgatccatatctaataaaaaaacctttacacgtttcaatattaaattcaaactttcaccttatgcagggcgcagcacagtgtgtcctactagcgagagtccacccaactttcgctcctgaagtcgctgagggcatggcttcaagccctcggttacagacaaggtccacggcgcagacctgctagctaggtatgccaaggtgtccatcgatacagtaaaggacacctggtcaggctatccactgcccgtgccccccaatgatgaaatcatgactttgggcgatgcacgcaagacgttcatacaatggcccaaagaagacatagttgtgaagatgactcctcgtccaagtcaaccgacggagcttacacctcccaagtctaagctatcaattgaggctccttgtggaccggcattatcagtacctcattctcctggtggagctgatatggacttggcagatataactcaaagcttggctccaataaagaccacaagaaaggccgatagctccccaccacttgtcaaagacaagaagcgtgaacgcggcaaggggaaggtcggggagttggcgccggagccaaaaaggggcaaggctgcgacgtcgatgccggtgagcaaagcggggaaggtcgtgagggcgccagcccaatttgagcta

SEQ ID NO: 54498 - DNA, 8202 bp, Oryza sativa
ctgcagcccaaatcaaacgggcgaggaggaaagggatgctgatggtaacaacttgcggatgatcttggtcagatgttgcaggacgccaaggaggattgagaaagtgaaaagggggcccataaattggacaagatgttagaggaccacagaatgtcgttgtacccaggttgcgagtaggggcacaaaaagttggataccactctggagttcttgcaatggaaggcaaaaaatggtgtcagtgacaagacatttggcgatttattgaaactcgtcaagagcattcttccggagggaaacaagttgcccgagacaacgtacgaggctaagaagatagtctgccctctaggactggaagttcagaagattcacgcatgtccgaatgattgtatcctatatcgcggtgaggagtacgaaaacctagaagcatgccctgtttgcaaagcactacgatacaagattagacgagatgatccaggagaagttgacaggcaactaacgaagaagagaattcctgctaaggtgatgtggtatttctctataataccacggctaaggtgtttgttcaggaacaaggggaatgctagaatgatgcgatggcacgctgaagagcgtcaacaggacgggatgctgagacaccccgccgatggttcgtagtggcgaaacatcgatagaaaatttaaagactttggaaaggacgcacgaaacatatggtttggtttaagtacggatggcatgaatccttttggagagatgagcagcggccatagcacttggcccgttacgatgtgtatctacaacctccccccatggctatgcatgaagaggaagtacataatgatgccgattataattcaaggccccaagcaacctggtaacgacatcaatgtgtacctaagaccattggtcgaagatcttaaactgttgtggaagaaggaaggtgtccccatgtgggatgaggacaaacaggaggagtttaacctacgagcgctgctgttcgtaaccatcaacgattggcctgtacttagcaacctatccgggcagtctaacaaggggtacaaggcttgcactcactgtatggatgaaatagaaagtacgtatcttaagcactgtaggaaggttgtgtacacgggtcatcgtcgatttcttgcagcaaatcacccgatacggaagaaaggcaagcactttgaacataaggcggaccaccgtatgaagcctaaacatcgcagcgggaaaacagtgtttgctatggttaaagatcttaaaatagtgtttggaaaggggcctagcagccagcctatagagagcgaagatggtcacgcggcgatgtggaaaaagaactctatatttgggagttaccctattgggaattcttggatgtccgccacgcaatcgacgtgatgcacctcactaagaatctttgcgtaaaccttcttggcttcctaggtgtatatggaaagtcaaaagatacactggaagcacgtaatgatctgaagcatatggaacaacgcggtgaccttcacccggaaccaaaggagaaaggaagccattacttgagtctagccagctacactcttagcaaggcagagaaggaaagtatgtttgaatgcttggagagcatcaaggtaccgtttggatactccacgaatataaagcgaataataagcacgaaggagaagaagttaacaaatctaaagtttcatgactgtcacgtgttgatgacacagctgctaccagttgtaataaggggtatcctcccagacaatgtccgggcaacaataacaaagctatgtgctttcatgaacgcaatttcgcagaaggtcatcgatcctgatagattagaagccctgcagaatgatgtggtgcaatgtcttgacagctttgagttgatatttccaccttcatttttcaatataatgacgcatctgctttgtcaccgtgtcaaagagatcggtactctcggtcctgtgtacctacacaacatgtttcctttcgagaggtacatgggcattctaaagaagtatgttcgtaactgtgctcgtccagaggcaagcatcaccaaggggtatagaacagaggaggtcattgaattctgcgtaaaatttatcgaagacctttgcctaatcggggtacctgaattacgccatgaagggagactacggggaaaggagactctcggaaggaaagcaataatgacagtagacaacaatttattccgtaaagcccatttcatggtgctgcaacaatcttcattggtggctccctacatcgaggagtacttggctctagttcgcgccagaaacatcggtaagtccgatgcatggattacaaggcatcacattaatactttctccacatggctgcgacaacatctcatgggtaacgagacgattaaccaacaactggccttcctggcgaggggaccatctggctcgatcgcgacattctagggatatgaaatcaatgggtacacattctacacgagggcccaagacatgaagagcacgaatcagaatagtgctgttcgtatcgatgccatgggacacgatggtacaactggcacgtattacggtgccatcgaggacatatgggaacttgactatggacctctcaaggtccctctgttccggtgccaatgggttaggttgactggtggaggcgtaacgattgatgacagtgggatgacaacggttgaccttaacaaggttggatactcggacgaaccttttgtccttgccaatgatgtaacccaagttttttacgtcaaggacatgtctagcaaaggaaaaaagggcaaagggcctgacgagccgaagcgccacgtggttctcccaggaaaaagaaaaatcgtcggagtagaggacaagactgacgaggattacaatcagtttgatgggcaaccccctttcacggtgacgattgaccctagcatcctcctatcaaatgaagacaccccttactcacgtagcgatcacaaggaaggaacaatagtgaggagaaagtacgtgcggtcaaccgtcaccgccgatgtattgccataattgttctgtacacgatgtaaactatgttggatgtactgaatatccatacaaatcaattgttgtatggcatatattaaatatgtatgattattagaatttttatcaaattgaaatcatccatatgctagttatatatgattattatattttttttaattatgtatgattattagaattttaatcaaattgaaatcatccatatgctagttatatatgattattatattttttttaattatgtatgattattagaatttttaaaggttttaaatcatgcacgtggcatttacatatgttaatcataattttcaacaatttaatatcatgatatgctagttatatatgattattagattttttattaaaatcatgcatgtggtatttacatatgttaattagaattttcaacaatttaatatcatgatatgctaattatatatgattattagattttgtattaattttaaatcatgcatgtgctatttacatatgttaattagaattttcaacaatttaatatcatgcatatgctaattatatatgattattagaatttttaacaattttaaatcattcatgtgcttattatatattatccacgtattctactacgtacaacaataacttttcgaaggttttatcattaattgttcgactttaaataattgtaatgcattaattactatcttagaaacacatatgcaatgaaattcaagacacagctgctattatctttagtcccagttcctaaccctaacctggtttaaaaagaatttggaaatagcgaaaaaagatctttagtcccggttggtgtcaccaaccgggacttaaagatccgggggtatatatattcccggtggccctcgtcttctccaccaacacttagacgtttttcgatcttggcttctccttcgccgccaccgtgcctagggcaaccccgcgccgacaccgccgtcgtctctcgccgtcgcttggcggtcctcgccgcctccgccgcagacgccgccgccgcatcacttgggtgagagccgccgctgactctctctctctctcgatctcgacctcgatctctctctctctctccacggccgatgaccgacttcgacgcggccgccgccgccgacgacgccgtcgccactaccacgaacgccgcccccgcctcgagctcgccacgccgccgggccgctacgccacgccgccgcgacgccacgccgtcgcccctgccactccgccgccaccgcctcgagctcgccacgccgccgcggccgccgcgtgccgccgccgcgcccccacgccgccgggccccaacaccgccgccgctcccgcacgccgccgggccccgatgccgccgcacccccacgccgccgggccccctcgccgccgccgccgcacccggaggccaccaggccggcccacggcgccctgacgccaccgccgcaccgccacgccactgccgcgcgcgcccaacattgccgaacgtgattgaaacgtgaccgaacgcgaacgaacgtgaacgatacgtggacgacctttgaacgaacgctgaacgaacgtaacgaaacgttaacgaacgtggacgaaacgttaacgaacgcgaacgaacgtgcacgaaacgttaacgaacacgaacgaacataacgaaacgttaacgaacgcgaacgaacgtgcacaaaacgttaacgaatgcgaacgaacgtgaacgaaatgttaacgaacacgaacgagcgtgaacgaaacgcttacgaacgtgaatgaaacgcttacgaatgcgaacgagcgtgaacgaaaagattacgaaacgtgaacgaacgtgcacgaaacgcttacgaacgtgaatgcacttgtactaaaagtgtgagaacgaacgcgtttatactaatacgatttactggtaatatatatatgattatatatgtaacttggcccgtctagactaatacattttcctggtaatgttgcagagaagacgtcgtcgtcgtccctcaagacgaagtggtagctagccatcgaaggaattcgcgcaggcaagtgatgtaaagaagtgattgttagatatttaatatatgattgttagacttagcatatatgattattacaattttaatataagattgttatcgatttaatataagattagtagcgatttaatataagattgttatacttagcatatatgactattacaattttaatataagattattagagattaaatataagatttttagagatttaatataagattgttagacttagcatatatatgtatgattattacaattttaatatgaaattagtagccatttaatataagattattagacttagcatatatgactattacaattttaatataagattattagagattaaatataagattgttagagatttaatataagattgttagacttagcatatatatatgattattacaattttaatatgagattagtagccatttaatataagattattagacttagcatatatatatatatatatatatatatatatatatatatatatatatatgattattacaattttaatataagattagtagcgatttaatatgagattagtagagatttaatataagattagtagcgatttaatataagattgttatacttagcatacatatatgattattacaattttaatatgagattagtagcgatttaatataagattgttagacttagcatatatgattattacaattttaatataagattattagagattaaatataagattgttagagatttaatataacattattagacttagcatatatatatgattattacaattttaatatgagattagtagccatttaatataagattattagagatttaatataagattagcagagttttaatattacggtacgcaaatacatcctatatacctaacaaatattttttgtatgcacagatggctgatcgcgatgaggaacagatactatacgatacaatcgcagagggaagcagccagtactggaatgaaggagaggggaacgaggatccaaaccagtacttgaacgaggaggggaacgtggagagggatgcggagggaacgaggaggggaacgatgaggaggagactagtggaagtcatccctccgctagacagaagagggcacgtggacaacaaggtgccgcgaagaagacagagggtcggcacatcataactgaggtggacgaagacggccgacctagtgccccggcagaagcagccaagaattttgtacgccacagcggttgggttgtgagggacaacgtgcctgttagcacggtgtactggcgcagaacaagggcacgcggggataatgacagctttggtcccgcgactcagagtaaatgagcatgttgtggaccacaatggctcgagacgttcacgctacccgcgggtacggagaacatagtgaaacagtggactatgaagaaaatggcagaacagttccagagcttcaagggagatctctacaagaaatacatcctgaagggactaacactgaacttcgacgtattcccaaagctaagggatcattgggacgagttcgctgcttacaagacagggcaacaagggcaagcgatgatggccagaaacaaagacaatgccgccaagaagaagtaccatcaccacttggggtcaggcggatatagcgtcgcaatgccaaagtgggaggagatggaggcaagtttgattgagaggggtatcgaaccggccaccgctaaatggccggatagatcgaagttttggtactatgctcacggtggaacgcttaacccagttgatggctcccttgtcttcagcgatcagatacgcgaggctgccagtcgactaacggacgcagtggtagcctcttctcagggtacattctgacccgacagagagaaggatgagctgtcactcgccctacagactcccgagcatccaggatgaacacgagggaaaggcgtgattccctggaagattggatttaaggaggacatccacacgtacaggagtcggatgaggagcaagagagataccgaggcgaagattgcagatcttgagtacagggtatcgagctacgagctcagcatgcaagaggaggtgtcaaggaaggtggatgaacgtatggccgcacatcggtcccaggatccccagccgtaaattcatcctgcaatggtcagcccatcaggcaatcgtagcagctgcgcctcaacggggcaggtcggatcacagagcatggacgccatgcaaacccatgacgaaaccacctaccccgttgatgagatcatgcagcggacaccatgtgagctgcatatttccttcaagaacttatcaatcaaggtatgctcgtagtttgatgatttttgacttgtacattccgcaagttgctgcttaggttgattactaatagataacctctcatcacgtgaaggtggcgtcgggaatggccatcccaacggacccttccgggacttaccactgcaggccgattccagcaggatactcgagggtcgaagttgagctggtggaagccgcgtacgaggacctcgagttggactacccaggaggagacggtgagacgtatctacgagacacaagccacgccatcatactatggcgcaagcggtacatcatccttcctgggagacaagcggcgtctcgtgcaccatctcctctggctccgccatctcctcctgcaccatctcctccgattcctccaccacgtcctcctgcaccatctcctccggctcctctggctcctccgcctcctccgcctccaccgtgtctgcctgcacctcccaagacaaggtctcgccaagctccaccacctgctcgcacaagggcaacgaaaaaggcgaaagttgacgccaccaaaaacaaggagccaccgtacgattgcagtcaagagagcttgatgcttatgtggcaggagaggtgaagaggcaactcaagcctcggagtcctgaaaagaagatacctattgacccgagcgtgaagaacttcttcaagggaatgtccacaacaaacaaggaggcgttacagatatcggactatgaccgaacacttcagagagcctatcacaagaagtccaaaccagtccctcagcttggagaacaaccaaaccaagaggtcgagccgttggtgaccggcgaaga

SEQ ID NO: 54499 - DNA, 1427 bp, Oryza sativa
taatcatagcttgcaactgcatatgtagggcttgggatcggttccgtcaattggtccgcggaacttggaaagaaaaacttggacggaggtttcattttccagtgagtacatgcatgatccaaaattatattgaattgaatctctaattacagttaatataaagagtatattaaatctttcatcgtttctcatgtagtgtgcaaagcaggaccagggaactaacttatgcggctactacgtatgcgagtatgcctactgcctatcaaaccaaatatgcacaacacgagagctcgatgtacgtatacataaaccattcaaaagttcattgcgtatcgatttgttaagttgtttattaatttcatatattgatacgtcattatttttcgaatgatagcgtattcacatgagtgataatctcccacacaaggattttatcacggcttttcaagaataactgatgggattcatcaacgaaggagtctttaatcccgacggtgaattctactacgacggatcgacaattcataacgtcggtccttcctcttctgacataatgccggcgtcgaagtcgtagctatatatagctaccgagcaaaagaattgtactatatacgcatgtatatatatatttatatatgtacacatttacttttgtgttaatatatattttggtaacatatatatatgcacataaaatgttaagtgatttaaattatacatatgtgtgtgtaatatttgatttacacacacacacacacacacacacacacatatatatatatatatatatatataaaaccaaccatgcagcaaacagggccatgcaaaaaaaaatggtgcaccgatctttagtcccgattggtaacacaaaccgggactaaagatggtttggccggccacgtggctgatcgatctttagtcccggttatttcacccgggactaaagatagctatctttagtcccggattcgtagtcccggttggataaccgggactaaaggggggttaccaaccgggactacaaacggtttctccaccagtgatagttggagaaatagagatatgaaggggttgtgattagttgagaagtggagctaggtgggaaaagtgaatgacggagggttgtgattggttgatggagaaattgttatattttggaacaaattctaagtgctaaaagttattatattttgggatggagggagtattagctaaacttttttttgaaaatagatcaatatgatctttttaagtaacttttgtatagggaagtgagttgggcactcttgctaccgaactcagcctaaatgcggtgataatggctttatcctcaaccggtcagtactcaactaattccgcgtgaacaaagtcggtgatcgtcatgtttataagaattatcttcaacaacgtgaacaaaatgaggtagc

SEQ ID NO: 54500 - DNA, 2778 bp, Oryza sativa
tgtacatatatataccgttttaattcgcattgaaaaaagcaggtgtccttagcttgcaaatcatatatatagctcgccacaccaaacacttgtgcgcgcatgctccaaacttgtgggcaacccaaacagctactagtaatatatctttagtctttacacgccgacgccgatgataatatacgctcggaattaaacacatatatgaatggaccagtaataactcattaatatttaattacttaagagaactgctgtgaggtcgagaaggtctggccgaacgtccagcccgccggggcgacgtcgaggaaggtgagcgtctgccgtcgctgctggtgaccttgaacgacaggctctggccgtcgaggtaggcgttggactgccagttgacgccccaattcctggacatggccatccacccggtcctcgaccccttgatcgacaccgactggatggagccgacgccgccgacgttggaacgagcaccagctcgaagtagtccctgccgttgatggtgaacctcaccccgccctgcttggcgcacggcacccgctggtacatcaccggcacgatgccgccgacgtagacgccgatcttgagccacgccggtcggccatgtcgaagtgctgccgcggcgggttgcaccacccgccggcgtcgttggggagcgcgtagttcggcgggcagaggttggtcgccgtgatggtcaccgacgtgccggagatgcagaaccgcctgtccgcctggtagtcgcacatgatccggtagcactgcccgcacgacgccccgtcgttgaacagcaccgtgctcagcgccgccgtgttcgtcccgtaccccgtcgagtacaggtccccgtacccacacgccccacctgcacacacacacgacgacacgcatgcacatgaaccaacgtcaccgattgcacgatggatccattcctagctacagtagctagctagctacgaacttacccatcgttcctgaagcgtcactgccgccgtagaaggtggcgaacgccttgttccagccggacgccgtgaacgatgcggcctcgttccagaggaggcatgtcgccagcaatgccaggaaccgagcacacgacgttgcggctgacgagccggccatgtgtgcgcgcgtgtgctgccggtgaatgtgctgctaatggccaaactcagaaggcaggtagtgtcgcttaaataggcaggagagctgtagataacacatgcacgcaagtagtagctagttatttggttcggtgtgaggtgtgctgcatgtgggcagcttctcgggagctgacacggacacgagcgaggggtgcgtccagatcggtcggcgcatgggagattctatccagtcggggaggcgccatgttcgcgtcaataaactgttggtggcgcctctgacgtgtgtcgtctaggggtcgcgcgcgcgcgggtcgggtcgatcgatgatgctgcgttgcaggttccaaactgtcggcgctcgctcgattgatcgatctggtcccggtgtagatctggccacgcgcggtagtacactgtgtttttgctgttcggcatagtgaaattcggctgcttctgatcgagtgttttcttttttttcttttggcggtgattgtgcgtacgtaacgcaacaaaagtgctcctttgggagtatacgtgatgtgcaggtaatatatgttccgaccacgtcccggtatataaatgcgacggctaaataactgatactggataatatagttagctcaaattatctcgagaagaaatttatatgttgtcatgttggcatggctaggagatatataaacatgttacatgtcgttctgttaaaacatgtcaagtagtatttctctaatttgtctgtggagaacctattacgatttttatctaaattattgcacatgtgtggttttgtttttgtgtaacgatcaatgttaaaacttcgctctcccatggcccacaaggcttccatttagttgtgtcggtcacatatatgataagatccggttcttccaatccagatgaacttcatcattgggagcttgggtcatggagctttcgcaggagtttgatgctacatcaatcaacaagtacaagatttaacccagtcaaattaatacgatagaaaaatggattactgtgttaaaaaatggaaaatgaccatctttcagccttaatttcatgctgcgtggtcatctttatcctgtaattatggaatattccaaagttttcattttaatcctttgaaaaaatatcccttcaaaatattgttttaaataatggaagaggaactctaataccaacatggcatccccaactgtagttgagttagaacactatgggtctgtcgaatttaaatgcctaaaaaggtctaaaatatcagcttataaactaactaggaattcaaattatgaacttataaaaagctagccaatccatgaaaaatcaactttccagacgataacgatgactgaaaaacaagcttggctatttaattaattgtcgttatcattccatctcatctttcactatctttcgcaggttacccaaccgccataacaatcttccccattcatttccctctcactctactgcagccacgctttttttggatatttaactatatagttgtcactcttacaaaagctaactcttcaaataagtttagtcctacaaatttgccaccagagagaagccattttttccactgtgaagtgatatgtatgcttgctaacaagctggattttttacattttgatattttttttacaaacagacttct

SEQ ID NO: 54501 - DNA, 1659 bp, Oryza sativa
atggacagacacaagaagagaaaccggggaaaactacttaggaccgagaattactttaacttttattgatcttaagtgagtttcgttattacaaactgaagactctcacaccactaaactcaccaactacctaacactcgaaagcaaacaaacgcacgcacttacatcccaccactgatgtaaatcacatgcgagacccacacaaccaaacttaaacaaacaagctaacacaacgatctaagataacggcttgacaaggcactctaggtcttccgggcatcggagttgatgaaggctcgttcggctcgtcttcatcatcttgagttgctccccactcgatcttggaataggtgcgcttcgattcttctcctttatcatcacttacattgacgaccggaggatccgctagggctggggtaacttctttctccaccacacggacctttggcgccaattggtaacgagggacaaatagagctctcttccttgcggtaaggcgaaccctggcctttagcggtggggcttctcccttcaacgcggctagttccttctccaaacgatccaccttgtcttctagcttgcaaatcttaccacgattccggtcttcacgatcttgagccgctaacacagtctccgcacaggtttcatccatagcccacagcatctcaaccaaatgccttgtggtagcatcattctcaattccttcagtctcaaggtagctgccacggtcactcccctgtggttggcgaggatggtagcgatactcagtgtcggccaactgatcactatagcgatcgcggagctctcctatggcgattcttgccacctcctgacatgcatgaatgtagtttcttcctccagcttcgaacatcaccgaggggatatcttcactattactattcaaggtgactttgactcggcacttttcttcgtgacgatcatgaggaatctgggcataaaaaggggcagtcctaaatcctatggcaaaggacatcgtacgcaactcctggacaaatccctcaacaccaaacaagtactcaggcttgtagcgcggcatctaaaggcaagtgaaaggagggagttaagacatttatccaattaatagcacaagtttttggattaatttgaataaagttagaaaatcaaagtaaaaggtaagtaaataaagtaaaccaatcttgcaagataagttgaaatagttggaaacaaggtcataaattctgtacttttgaacaacaggttctaaaagaaataaaagaaagttataaaatcaacatgctaaatttatttccttgcagcaagattaaataaaaccatattgtagaacttttgctggtaaatgtgccattagtacagtaatagatgtatagtactaacaacgctaaaataaattttgaacgggaaccactaaaaaaaatattaggaaatgcatgtgccattagtttggtttaattaaaagagaaggagaggagaacagttctacttttccaatatttttagagggcttctatgggtaaccatttggcataacctaaggtcaaaggggctctgataccaacttgtcacgcccggaatttctatccaaaattccaaacgcttacatgtgtgtgaaccctcgtccaggaatcagccgaggcacacaataacaaattgataata

SEQ ID NO: 54502 - DNA, 2117 bp, Oryza sativa
gacggccgagatcgatcctatccaaaacggacggcggagatcgatcggtccacgtccggctcacagcagacggccacgatgacgtcagtggtgacgtcatcgccggcggcggcagcggctcggcggcttggcggctcgggcgcgcaagcttgccggcgaacgacggtgcggcggcgcgaacggagagcacccacgggtagcggacggcgcggcgaactcaccggtgaccaaagaaacggcggaggagcagcggacggtgacggcgacgaggttgaagcggcggagaccttcggcttgacgacggcgacggtgctccggcggtcttcagcgacggcgaaggggcggacgaggacggcgacgcgacggcgaccacgaaggcgacctccccgagcgacggcagcaactggagcgacggcggcgcacggctggagcggcggcaacgacggcggcgcgaggtcccacggcgctagggctcttccgacggcgagagacgaaggcgagggtggcgacgggtagaggagacaccggggatccttttaaaggggctaggaggcggtggcgaaggcccacggcgaccggcggcgggatggaaagctcgggctcggagaaagagagagaccgatccgaatcgacctcgaatcaaacactttccaagtgattttagccgatgattccataagagaaaaggtagagaagatcccgaagattgtttcccctcaatcgatttcaccggatcgggaaaggagcggccggatttggaaggaaacggcggcggcgcggcactagggtttcgggcggcagcgacgcgaggaagacgatcggtctgacagatgggccccacctgtcagcgaccgagcacgcgcgcggctgcggactgggccgtcttgagccggggggagagagagagagggttttgggccgactttcggcccaaagccaaaagagacttttaaaaacctttttcaattaaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatatttaggatttttagggtgtgacaagacatcggacggacgagggcagattcaaggtacaagggttgggttaggcagccttcagtacctttgtttaggacaggaaataacatatacctttatttaggggaaaaagtacgaattatactctcgaactatcgcggtcgaccgaattaccccccaaactcgaaaaccagacatagctcaccctaaactttcaatattgcacgaattacccccctcaacccaatccaaagctaggacaatttagtcgggggtggcgtgcacctggaactaccatcagcttattttttttatggtggggcggagggatcctgcactcttttaccctcttcctcctcttccctctctcttggcgttctcgccttctcagcaaagcagcgcgcggcggcggacgatgggcggcgccgtgggatgcggaggcggcggcggcgtgggatgcggagccggcggctgcgtcgctttctcctcttcccctctctctctgtctctctctctggcatcgttgggcgcgggtggcgggtgcggctgggcgagcgacgatgagctgcgggcgcggctgggcgagcggaggcagctgcgggttccccggacgccgcagcagcttcaggagatcagcgacgacgcaccgcgcattcttggtgatcggcgtagagaatgccctgcacctgacgcccgacgcggcaaagacgaagcatgtcgctgcagaagcaggagcaggcatggttgccatcgatctcgccgaaccattcggagctgtgtcgagcaaagcaagtgatcgataatagatggctaccaaaaggtagaaagcagttaagcagaagattgctcaaatgctgttcacggcttgagcataacacacgggcagtaggtattagtagctagtcgtgtgtccctcggctcggtcttcgttttt

SEQ ID NO: 54503 - DNA, 944 bp, Oryza sativa
aggggggtaattcgtccgttattgaaagtttagggtgagtgatgtctgtttttgaagttcaagggggtaattcggtcgaccacgatagttcagaggtgtaattcgtactttttcatttggcatataatgatgtggggatgtattatagtatgtatggtaccctaaatggttctggcttgaactgcatctgtctttataacctaaatgatgtggggatgtattatagtcaatgacatgtgggccacagggaggaaaatactcgaaaattccatcattcacatgtgggccatagggaggcaagaggcgcaagacacctggtagttgggttcttcttcccagcatttgcctcttatttccatattttcctgatgggtaccaagattgataggatttgtccaagggcttcaatcccttgttctccttgttttgtgcatgaggtgctttattccctttctgtttttgataaagctaattattcctttttttacttttttttagaaagccaactgcatccatatgagcttcagcagctaagacaatgtatgcaaaatagtgcaaggatgcaccagctaggaattcccgcattagtaaaagtgcttggaaataaaagagtgatcccgcaaaatgatgctacagctaaccatagaaagcacacagattgtgatcctgactacgaacctgagcttgatgaaaccattgatggataattgtgtgctactaacaacgctaaggtgctagttccatcaatcctgtgatgatggtcatgtgtcttctttgctaaggcaatataatacaatccaagcctttttgattgatctatgtttgcatttgtgttcaggaagcatgtagtagcaagaaaaggcattctgacatggctcctggtggcttcaaggcgcgtaaaaagacagcgcttgcagttcggccagtgaatggagtccttacaa

SEQ ID NO: 54504 - DNA, 1084 bp, Oryza sativa
gataaaaaaatagaccgcaggtatttcatacaaaagtttaaatgcatttgtctcccaaaaaaaaatacaacaatacatgtaactagtatgtacaattgattacatgcaaaatttgcccatcaaaacatatattttgaagctagattttgcaaaaaatagttagaacaaaccttgtcaaaatattaaaaaaactccactttccaccaacaaaatataacaaaaatggagccaaatgaagcaggatagagagttcttcacctttcgtatagagttcaagtaaaaatttcgagttgaaaacctccccccctaattggtgcttgctttaggagagagaaagcttcgttttcaaatggtcaagctcgggcctggaggagcatatatggccgatcatcgcatgcggtcccttaagccagccgcatgcgaagatccattatcgcatgcggctgtcttaagcagccgcatgcgataatggattttcgcatgcggctaatcaacccgctcccggggggggcggtttttgcaggcgccgccacaagcggcccgcatggaacctaccgaccccctcgtacagaaaaacgatttttgtagtagtgtaattaaaacacccagtaaagttttggtgcacccgggagagactcccatcctggtagtgaggtcgtggatgtaccccttgcaagctccgcatctccggcggcttatgctacgaccgtcattttgacatcgtatgcagacggatgccttctaagctgctaggaaaagctgagtgttctcgtcttcggatgagtggttagtgcggcaagctgattggaggcgcgttgttgaactatcacggagacggagacgacgatgtgatggagatatcagaaatcatgatggagtgccatatctattatatactaaaagtccattaacctttctaaaatcgctctcaagctgacatgtggcatcctaaaagcgctctcaagctgccacgtggtgcgaggagaggagatgaggacccacaaaaaacgaaatcctctcccacaacgtccgcatgtacgcatgcatgtggatgctttccttccatgcttagcggcaggattac

SEQ ID NO: 54505 - DNA, 10629 bp, Oryza sativa
gtccgttcagctggcgaggcctttgtgccacctatatatgccatgttccttgtattaggagattggtttttagttttcctctgtgttgtgccgccgccaccgcctaggtcaggaaggagatggcgattccatacgttttgccaccatcatttctgtgatggttaatttggtcctaggcatgttctgatttctgacgaagtcttcttgctctgatcggctatcattcttgctgcatgggtggagtttatgtacatgtttcgctagtttattcattataaactgaatcatctatctatcttaaatttggtgctactggagctattcagttcagtttatctggagtaaacgatcttatgtgtgcgaccctatatactttgctggacgagatctatatcttaatattgatgctgctcttgattcaactagagattagggtgtacatatatatatattctcgctgcattagaaaggacacatttatcccataccaagttgtacactcaacatagttatgtttacatcccaattttaagagatcaaaagcatttcaagaacaattgatagaacgtagacctccaatataaccaaagaaacagaaaggatggctggagttcagacaaaatttgggctaaatttaaacaaaatttgttgaatccaaagcccaatataaattgaagaaatcatttgaattttttttgcttaaagttcaataactattcttaagaacacgaatttcttaaagtttagaactccaaaacgaagatttgatatgtattaaaaatgacatttcataggaaccaacttcatttttgcgacataatactttcctataattaaagatttcatgtttgtaagtaattttagtttagaatttatgtgttgcaaggataattagcattcaaaatattcacaaacaaaatattgacaaaaaaacaggttgccaatagaatcaggaacaatcacgcatatacaaacattatattcacatgtgtagagtaatatttcaagcacattaaattagatgcccgcgcatatgcgcgggcttcctttttagttgttctaattttagaaaaactatagtggcatccatccgatttcatgaatagtaatattatttttgcaatgcgttgtatttgcagtggcattgatccaattaatttttttattacctatcattgattaattaattaattaattacctatattgattaattaattaattaacatacttttttaagaaaacaacgaattaattaactgagccgaccctatccaagcgagccgaattaaaaaaagaaaaaaaaagaacaaaaaagaacatacgctgatcctatatccatccgccctctcgctctctggtccgcctcgaccgcgcgggtgcctcgattcttccgcctcatcttatctcccctcctccgttcacatttccaccccctcaccctccttttcacactcgccagcgtcaccctccatcctcagctcctcccctccccccacaaaactctcactctccccacctctccttcgatctgccccgtctcgcctccctcgccggcagtggctccctacatcccgtctcgcctccctcgccccctcctcctctccctctcacctccctcccatggtggatacggctgcggtggtggcgggttggcggcagccaccagcggatccggcagtggtggcggcgggtagatcgggcggcggatccctcccgcgccagatccggcggcggcggctccctccgcccctcttgtctccctcctgtggcagatctagcagcgtcagccacagccacgagtagatctagcggcggcggccgcgggtggatcgggcgacggtggcagctgctgagggcagatccggtggcagtccgcggcacgggtggatctggtggcgccggcggcagccgcgggcggatctagcggcagcggctccctccaccccatcccgctttcctcccgcggctgatccagtggcggtggcggcgtcggcgtcgtccgcgttggatccgttaattatggcggcaaccgtgggcggatccggcagcggcggctccctcctccgccttttttctctttctggtggcggtggtagcgtcggcggtggctacggatggatggtggtggccgcgaatggatgcggtggcgacggccgagggcggatccggcggcaggcgagtgaagttttgtgatgtaatatattgttatttttcttggatgtttattttgtgatcttgtgattgtgattgattttttggggacagtgatttgttgtgccgattttgggaagattccatgtatccgattctgagagtgattgggattcgggggtaggggctgcgaaggcagaccgctgacggatgaaggccgccttcgttcgtcttgtgacgaatggaaaaatacgaatcttttaattagttaagataacagtagagaagagatatagattaaaaccaaaatataaaattaaaaccgactcaaatacggatgacgaaccgcagaaacatcttcaatttttataaccaactcaaacacagatgacggaccgcggaaacatcttcagtttttataatagtaacataaaattaaaatcgactcaaacacggatgacgaaccgcggaaacatcttcaatttttataaccgactcaaacacggatgacggaccgcggaaacatcttcaatttttataatagtagagattgagttcaacatgctcaagggtgaatgtttaacttgcctttctttttcaaaaaatctcccgaactcttttcctcacgatagcgatcttccgaaatggcggaatctacaacatggcacacaaaacgagaaaaaacaccaaaaaaaatcaaataaatagtacataaaaagtaaaaaaacatctagggctcaattttagattaattttgtaggttgaacggctcaatttggagtttgtatgaattagttatgaattttaaaagtattgagccatttaaatcaatttctggaattaaaatcgattttctaaagggaaaaggaaagtgctgacgtcatgaaaggggcgaccagtgctcacacgggggccccacatgtcagcaggtcaatgggagggcagtttgtcatgacggagcgtctgatactaaaaaggtctaatactacaattatcccatcaactgagctagtggtaattaagcatggctaagcatatagttctaaatgggtcacataagtaacacgagctagtcgatttattacccaaggttgacaaagggccgatatcaagtaaacatggcacaagcgagtagataggtaatacccggatcccatgtaattagcaaaacaatgcatgtttatttgtaaacgataaaacatttgtaaattaggatcaaaatgctcaaggagattgtgtgacttgccttgtttcttcacttgtatcttctgaactcttatccttgcgaccgcggacttccgaaacaacggattctacacgctggcacgcaagacgagaaaaaactctaataaacaagaaaacagtatataaaaagtaaacaaacatatagagctcaattttagatgaattttgcaagttaaatggctcaatttggagtttgtatgaattagatatgaattttagaagttttgagcgatttaaatgaatttctataattaatatcgatttattgcgcaatttaaacgaattatgacgtcgccgaggggagttggtggcgccggcaagtgggccccacctgtcggtggctcaaagggcgggcgcacggtggaccgagtccacgcgcgcgctgcccgcgggcgcaccacgtggcagccacgtgacggccacggcgaacaacgggctgtggtggcaaaggcgtggcgccgaggtggcgccgatgcgggacgacaccagggcggccacatggacggcctggattcatccacgcgcatgagcgggcggcccgggcacgggcgtgactcaagccgactcggccgagccatggtgcggcggcggcacgcgaccggacgaccgccggcgatggcggcgcgacgcagcggcgaacacgggaagtggcagagggggaaaaaggaggggtagggaattctcactgagcgccaaaagggcgagggacgatgggcggcggtggcgcccttgcaggttggcggtgacggcgacggtccggtggcagccggcaaacacggagctgcggacacggatggccacaacctggggatggcggcaatgaggttaggagaacacaagatggcagagaacagcggggaaggacggccagaggaggaagaagagagagtgagctcaccttgcgcggggagaacggagtctcggtagcgattggcgagggtggggggcggccgggcatcatcaaggccctgcgaagctggaggtggagatgtgctggccagacgcggcgtccattgccggcagcgagcggctcggagtgacaaaggcgaaggttgctcagttttgcggtggaggcaaggtttcggtggtggaagggggaaatggggtggaggccgggcttggcctcgagacgatgaggccgatggaggtggtcgcgtggcacgacgatggctaggacggcggcgaggtacggctggaggcagcaaatggcagtgatagctcaggtgcacggtggaagaggagttccggtggtggtttgtggaaacggagtggtggccggtgtacggcgcgaagcggcgaagctgatggtggtggcggctcggtgcagagacggctagggcggtggtggtggccggctggacagcgccggcgagcggtggagctcgagcacgcgtggggagcacgggagagggcgcgaggagctcaggaggaaggggaaaacggaagaggagagcacggggaggctttttatagcgcgagggagcaacggggaggccgggtagtggcgaatttggagcggcaacggccggtgacgtggagctcaacgtgggcagagtgggggctcgatttggtgccaaaaactggggaaaagtgggggatttggtggaggaggtggaggggaaccgatcccacgtgtttgggcgcgagggcgcgagcgggagagaccggaattgggggcgacgtggggcggcaaaggcgccgcatggcgcggttgggggcggctggaggtaggagatggccccgataggtggggcccacctgtcggcggctcgaggagaggagggaggaggggggaggcgagctgggctggcggcctaagaaaggagaggggaggaggcggaagggccaggaagggaaaggggaggcttgggccgagcccatgagggaggggaggggattttaaattgttttctttttatttaaattgattaaatgaactttgtattattaaaattatttcctgagctccgaaaattcgcgggaaatttcagagagttcattagggcgcaaagaacattacaaaatattctcggccatgatttttaagtggaaaattttaattctcccaatatttcacttgattaaattgctttaacttttatttaatttctagaaaatgatttatttaatgatttttaatcccaaacaaaaatcggggcgttacacctacctctatagttccgtggcatattgcaccacttaatgatattcaataatctaaacatcatgcttacattactaaatattcctagaagcaatcatacgaatgaacattaagccaataccattgcatatctctggtaagctagccatataatgaatacgagacaagtataaaccaaagttggtactcgtatagttatgcaaataaagtaaaggaccacaacaatataaagaataatatttcattatagaataaagtcttgtaggagggatataaattattagaaccatacctgaattctccggaagacttgaagaactaggaaactattcaaattctaacttcactagcactagaacaaagtaaataaactatggagagcttcttctcgattccttcttggtgtgtgttggaggagaagatgagagggctacttataggccaagtgatgccttaggaatgtggagatgctaagcatcaaaagagtatcttcactcttgagctaccaagtgtcctctacggtggtttattccgatagaaacggttgcaaccgccttggatagtcggtaactaccgacatgtgaaatttgagggtcagattggccaggcctgggtcggccgacccaacccctggctagccccactggcccaatccttcatcctgggttctgcttggtgggtacttggtccagtggtgtgtcggttgggcccatttgcagtgcttccattaggtttgtgggcccttccatacattcatttgccacttgtctacctttgacagattgaacgagtgttttctaccatttctcctccatttatatggtgatcttctgtaagcaaatacaatgccaagtacgacaaagtggaaataggttatttctaactaagtatgcatgcaagcattgctagttctcaattatttttggaagtattgatgatcgaaatctatttataatgaccgtcaacacccacaccacctcccacgttgcgagctaaagctccactgcccaccgccgatctccggccaaccaccgtcatcgttctagaccagccgcactacgcctaggccgcctccagcttcgcctcgtcgctccacacctcagccgccacttccccgccgccaggaccaaccaaaaaattcatgtcctcatcacccagtgagcccctccgcgatctccatctccggcaacctcttcctgccgcttcgtgccactcctccctctcctaaccactctctcatcttccccaggttgtgccgctcctcgggcgcccctctaccgacgtcgctcgccgccggagctccgtccacggcatcaacccacgaggcgccgccaccaaatcctcgccaccgccaccttcccagcgcgcctcttttccgggtgtgcccagtaagctccccctctctctctccctcgccttgtctgctcctttctgttatttcctatgcctgtgggcctagacatacgaaggtaattaactaggagtctttcaaggccccaggaatcggaggaccacttctctaagttcgatctacccaacagttagccatggtgtgcatatacatattacattgggattggtatttatgatcctagaaattaatcaagtacatctttcttttgttctttgtttactttgtatacttagttatactgacaagcatgcctatatatctctctaaagagatatcctcatgtgttattttctgtcctaaataaggaaaaagtacgaattacacccctgaactatcgtggtcgaccgaattacccccataaactcgaaaaccagacatcactcaccctaaactttcaataccggatgaattacccccctcaacccaatccagagcggttttatcttacgtggtgtacacgtggcactccagtcagcattttcttatttttttaatggtggggcccacctatcatgtactctctcacctcctccttctcttccctttctcttggcgttctcgccttctcagcaaagcagcgcgcggcggcggacggtgggcggcgccgtgggatgcggaggcggcggcggcgtgggatgcggagccggcggctgcatcgctttctcctcttcccctctctctctctctctctcgggcatcgttgggtgcgggtggcgggcgcggctgggcgagcggaggcggctgtgggttccccggacgcagcagtagcttcaggggatcagcgacgacgcaccgcacgttcttgatgatcggcgtagagaatgccctgcacctgatcgacgcccgacgcggcaaagacgaagcatgtcgctgcaggagcaggagcaggcatggttgccatcgatctcgccgaaccattcagagctgtatcgagcaaagcaagtgatcgataatagatggctaccaaaaggtagaaagcagttaagcagaagattgtcaaatgctgttcacagcttgagcataacacacgggcagtaggtattagtagctagtcgtgtgtccctcggctcggtcttcgttttttctcgtttgatcatagccatgattttttaggcggtggcgcgtgttggtatgcatgccagttcagtgaacctccctccattgtatgcagaaaagacacgagatagaggtttcgtctagcaagcagccacaaatgatacatgcgaaaacagaatcggcagatctcgaacggtagaacacaccaaacacgtaaatttctcacaattttttcagcttctaaatgagtatacaagccggccatcttattgtacgtgtttgctttgttctgaaatgtgtagaaactactccatcttgcagcgaacgcgcggcgcactcatcggcgcgtgtggttctacacgaacgccgccctgacacgagcttacgttggctagctcaaacgctggacttgcccagccgcgcccgacacccgcgcccgagagagagagagagagagtgagtgagaggggaggaggagaaagccacgctgccgccggctccgcgtcccacgtcgccgccgcgcgcggctttgctgagaaggcaagaacgccgagagaggggggggggggggcaaggaggagtaggaggtgaaagagtatatatgacaggtggatcccaccattaaaaaaaagaagaaaaatgctgactggagtaccacgtgtacgccacgcaagacaaaatcgtcctggattgggttgagggggtccggtattgaaagtttagggtgagctatgtctggttttcgagtttagaggaataattcagtcgaccgcgatagttcggaagtgtaattcgtactttttccataaatatgtggtctttcaacaacacttttgcaaatatatgtgttgaaatacatagtttccacataccacggctcacaagatcacaaaaaaatatattgtttgaatgcaacaagagcaacagataaaacaagaaaaaaaaaacaactactcatcatcgctgtcaacttcaagtagagcatctccatcttcctcgctgcagtactcttccaatgtgtcatcgaaaacttcatctccatcttcacattcactttgacatacaagggttggcctttctttcctcaaacgagaaatctcagaagcttcaaacatttgtcctggttcatcatctctatttaaaggcatctcagttgttggttcatcaactactgttcggataataccctcctcttgatcatcacagcaatattcctcttgatatgcaggaccattaaatggtacagaagttttcactgacattgtatagatgtctatggtcaaatgtttggacaacttgccaattgttaccgaatcttgtatctggcaaataaaacacttttctagcctgagtagctagaattaaagaatcatctttgtaccatagacttcccacattgatgcttttatagaacccatcatctttcagagcattcctcccatccagtttataccaatcacatttgaacaacacaactgacctatcatcaccattataatctatctggatgatctcttttatgtttccataaaactcaatgagctcggagttatgtgtgcctagtgaaattactccactattctgagtcttcttattcttatcacggtccaaagtgttaaaccgcaccccattaactatacatgacttgtatttcttgattcttaaatcaggaccacatgccaaggaaaagatgtcatcatctaccatttcctcatctgtattctttctcagcatctggcataccacatagaacaataaacattattagaatgcatagcacaatgtgtatgataatttgtaaaagatgcttaatgaaatctaaccaggttcctaaaccatgtctggaatccttgtcgaattgttttttcaatgttagacacctcttccctttctaattcatccctgaacattctgtaaaaacaaaaaagtgtcaaaaaaatggcccatatgaacaagaggaagggagcatataacacactacataactgaaaacatacttgatatattcctcaacttgactacagttgttcagcacataccacaccatttgatctaatccaccatcatcatatactaattctgctgctgaagtaaatctcactccatgcccgaacacatctgcaccataggcttcttcattagaaaacccaacatttctcgcttctctattaaatcttgtttcaacatcgtccatgtacttggagcaaaatgttaggcattcatctgcaatatatgcctctgcaatggaaccttctggtcttgccccattcctcacataacgctttaaagtgtacagccgcctttcaatagggtacatccacccatactgcacaggacctcggagcagcgcctcctcaaccaaatgtacaggaaggtgcatcatcacatcaaaaagagccgggggaaaaattttctcaagcttgcacaataatacaataatttcttcattcatttgaataacacatccttgttcagagttttgctacacaatcgcttaaaaaagtttcccaactcagctactgcttcatatatatccttgtcaacaaagcctcgtacagcagcaggtaagattgtttgcaaaagaatatgacaatcatg

SEQ ID NO: 54506 - DNA, 4924 bp, Oryza sativa
atgtattgatgagaattatctagtgcaagggcatattatgaagcatggagtagatggatctttgatttactttttccccagttgtacaaatgaaataccattgccaaatacggggtatcatttgtacaactgccacgaactaaccattcccctgcagaccatagaagaattttttgcaggtggagcatacagggagacgcgcaacatgacaatgaatgaacgagagagttcatcatcctcaacacccttgatatgtagacgggggagatccagtacaacctcacggaacacatagctcaaatgcaagaatggcaacaatctactgatgctcaatattccaacttcaacaacatgatgcagcaacaacacgatgaccttcatgcgtacttccgttttcaggggttcaatccttatcaaggaccctgagcgaaagccaagcttggagggagacatttctccccccactgagataacttgtatcacattgcatatttccctttccaattgcatatttgctttccaattgcatcttataaaacttgaaaacaacataaaaatttgcaaaatagaaaataccaaaaagataggataggtttgagtcatgctaggtaatacaagctagttctctgttttataccacatacacattttgcacaatcttgatcttaagtatgtttagtcatctgctttagtctaagtttttgacctagtaataaatgtgaatgcaagtatgccatgtttgatccctaccgagctccacatatcaaacctgagagtaggaataaaaaaggcaaaactggtgaggaattcaaattgatacacttggagagactgagtgaatcatttgaggaacttggttttctttttcaaaattatttgaaaacttctggaataagagttgaatgaagattgggtgattggtgctctaattgctgttctgtctttcaactgcccaaggcaaggagaagcagtgtctcataggaatcaggagtaagggtaagccaccgtgccaaatattatttaatctgagagagagtacatataccttggacctgtatctttgagatatgcagcatagtagcaactcctgagggggttttgttgacggtcgttatcgatcagtttcaaccgtcaatattactaaaatagaggagaactagtgatacttgcaatgcatgtatatgccagaataataagattacactagtattaggtatactaaccttttgcagagaatgacaataaagtggaggagaatcgacatcaactcagacgaaaaatcaatcggacggtgtcgagaaccagacttatgtatgaatgggctaagaactcagaaataacacgacacattgggccaaaattcacaagtctacagaggaggacaacaaaggaggccgctagccgaagatgggctgggttgggccagcccatggttcccgtggcgccgatggatgcaggatttggatggacagctggtattgatccccaatgacggttggagggtattaccgaccattccaaccgtcacaaccgtcattacctgcctataaaaggagctcctcttctcacttcacaaacacaactcaagcaatagctctctcatttctctcaagtttagtttagtagtatctagctggtggaataggaatagagtagaaatcaggagcccggaagccttcagaagagttcgggtatggctcttgtagctttcctcttctcttttgtaagctttgtacttttattagaatactcttctatatacatttatggtattgaaatactttccgagtatatgaatgtctactttacaatatgttcatgttatactgaatatacggctagcttatctgggagatgctttggtgcgggtataatgtttacatatacaattactctatgtcatgacgatgatattagagtagtatctggtagattaggcttggtgtctagattacgggatatcattatttgagattatatattgcggatgacaggcgggctgttgatggtgacagctcagtacgggtattcctccgcgtcggtatataatcctaagttaattccctggggagggtattcctccgtattttgccccggttgtatggtcatgacgggctgtcgtaaggaacttggcagtcagggatggcttctcgaagtaccaggagggcatcggatagagggtattatctagtatatcggttaactagaatgtatgtatactatgtatattagaagtataagaatatattttctttctcttttctttctacttagcttagatattatattatgagaatgagtagctaatgcttgtgtgtcactctacccttggattatcttaacctctgcttagaatatgattatcacaagtaatatataacttattagtcaagttctctctacatgatcttcccacgggataaaataaatacgatacccttggaatactctcgggtgaaatgctacaatggtatatccgtacgcttgcggatgaactttgtaaccataatataccagatttctgcgtcattgctgggaattatatttctagtaatgtcgttaagaaataccaacagcgtccgccagcgaaaatcacgttttccatggcggcaggtgagagtccgctacaaaaaaaattgaggtgaataaaatccaccacccgcccaccgcccagtccgtccttgtccctttccccttctcccttcccaccgcccagtccgcctatctcccttctccgtctctcctccctcccttctccacctccgccagctcgtcgcctccccaccaccgccggcttccgtcgccgcggctccaccgccgcatacgaccgccgctccggcccctttctcttcctcttccaactccctctctccctccacggagtgcgtggtggcgagctcgggcgcgggcggtagcgctcgggagcaggcggcgaatctcgagagcgggcgctggcggagctcgggcgtgggcgcggcggcgactctcgagtgcgggcgcggcggtgctcggaagcggcgacggctctcgggcgcgggcgtgggcggagctttggcgcgggcgcgggcagagcttggacacacggggagggcagatccactgccatcggaccacggggagggcggcaccgatctcgacgccgttgaccgtgctgcccagctccctcctctccgacctcaatgccgtcaaccatgctcccgcggctccctcctccgacagagctgctagatttgatattttttcttttttttgcatgttgttccagatgttgcatatgttttgatctgtgtaaatgatgtttgatctatgctgatgatgattttatatttcgtgtttgaatttggaaatgagcaacgaatctagatgtggatttgaattttgaaattaatgaatcaatgggcggctgcatgggtattttcgctggcggttgtgcagctgcatgggtatttctttctggcccaaaatatattttcactgatggctgatttaacacagtcgctagcgaaaatggatttttgctggcgataaataaccgctagcgaagatcttgattttcgctggccattgttttgtggcggctgcaaattccgccaggaaaaatccaaaatggccgccacgaaaaatggttttcgtagtagtgactactactttgatgaagttaaggctcttcactccggatgttaatgggggcaaataagtacttgttggaaagatctcatctctactttcatatgcgttcgacctcatcatcagattcgatcgaagctactcagaatgaccaaaacgatatccacatcagaaacttgggcttgggacttatatttagtagagcccattagtgctcagaatgactagggtttgctcccacctcacctcctggtcattcctccacccatcagcagcagtagtttagacatcagcagtaaccaataacacttgggttttgtttagatgaaaaagtttagcttcagccacttcgttgtaattgcatgtgttggctagaccacccgaatacttgtattcagaaccccaactctgtatgtatcagtttcatcgtttggtaagtgttgtaaactattgtcttatcaacttggtcttgcttattttaatgagaattatacttctcgaagtaagatgggtggcttgtttgaattttcccaactcacatttctcgtttttcacgcgcacgcttcccaaactgctaaataatttgtgtttttttaaaaaaaatctatacatgtgttacttaaaaatcatattaatttatttttaaaatagctaatatttaattaatcaaacactaatggattgctccgttttgcgtgtttgaactttgaagggagaggttccaactcgaacaagaaaaaaaacacagcctcaggaattttgaaggaaggaagtggttttcttgataacgaataaatttctgatgaagtccgcggtctgtagacaaagtctattaggactatggtctcgtaatttatttctgcttcgtccatataaaacctggcacgtaggggtagttaaaaaaaaaaagttgccttgccgggttctttataatcggaaaactccgtgcaaagaccgagaagttgcgactgaaacgacttggtgccacaccggaatgtagtcttgtggaatagtatgcacaattgcactgtcctcgtcaaggtcaagttagtcgtatggctttctttcccactagtccctaattgcattccactagaaaatggaacaggtcccagtcgtttggtacgtctctctcatcaggaaaaacggaaaaaagatcaaaattgttggagatggtgctctgctagtctgctctggcctggtccggcttcttcacaccgtaatttcattaaacctatatttttctcatcttgtgaatgtggcaatagtttctcaccgaaagcgatgggctgcagga

SEQ ID NO: 54507 - DNA, 797 bp, Oryza sativa
gacatttgtgtacgtatctgactgtatgacattcaacgcatcctattctgtaaatttttttgacaaataaattaatattttgaaagcctgttatacaaccattgatgtcaatctatacctaattaaaaaaacataaggcttctatctataattatcgtccgttttccttttttttcctttttcctttttatttcttttctctgttttttccctctttctatcaccgtttttccggtttatttcttttttccctatcttttttttcgccctttttcgtcaggccaaaccctatttttccctatttcttgcggtttttattgtcgggccaaaccctagcgcggccgcaggtcgatttgcctcccccatgcgtttcctccttcaattgatggcaaaagccgactccccaccactctctcatcatttttcccttgaatttccctttcaatttgcttttaattcaccggatggaattttcctttcgtcgtattgaatctccttttaaccatagtcgtttttgaatctttatttaaccatcgtcgtttttatcccgaatttagcggattgcttcgattttaataaaaaacgaaaaagggagatcgagtagatcaaaatccctcaaaaattttggagatcgagaaagattcgatcggatttgatagagatgattaattccatcattgtacgggcacgggactggtcgagatgggcctatagcttcacttgtgggctgagctgaagagaggtaggccaagcagagggaggtttcgtcattgtacgagcacggactgggggtgcag

SEQ ID NO: 54508 - DNA, 13087 bp, Oryza sativa
gtggtattgaggcacatggtgacatgatgtggggttgtgtcttgtgggtactgtggtacacctcttatcagagtaaaactattcgaatagccgtgcccgcggttatgggcgggtctaacaatgtctttcgtgattagtctcacccttctcaccatattagaagatgctataactggtaataatttgattagctcctggtttggaatggtatattcctggtttggagatagatctgtacagctgggtttggttgttcagaatggttgggcctatacaacagggtatgttgtatagtgttggattaatattgtttaattattactcaacggttttattaaattctcaaatgtttgctaaatgctgcttttgcaaatgaaaacctattatgccatcctttgttatcttgagcacttgcatatttgctgcgtggcttgctgagtatgtcatatactcaccttgcaatcattcatcagaggaagagttctacaatgatgctgatggtgtggaggattaggtgtagccttggtcaagctgcttgtggagtggagccgtctgcgccgtttattttattttccgctgcttagatctttattgattgagaggaactatctacctctgtaatgactttttattcgcttcttaattagagtaataattgtactctattatcaatttgttattgtgtgcttcggctgattcctggacgagggttcacacacatgtaagcgtttggaattttggatagaaattccgggcgtgacactccttgaccctaggacgagtcttagatcccaatccttagcaatattttcgaaataaaaaaaacctttcttacttgtgaaaatcctttagtctccctctgtcctgctgcttcatttattgtcaaaagctgatctttaaaatgttgcttttctcttttgctattgtttgtagatggccgacaccctcaaccgtcgtggtctggacttgactggctttgttttagagctgcggggcttgtgcgttgtcctggggtatccgcatggagtggactaccagggcaagaagcttccggagcaggatggtgacgatgcagagccccgcgccgcttgggaggtcaccgcggtgatcctcaccggctctcccgagaggacttctttggcaatcatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaataagataaatggcgcagacgactccactccacaggcagcttgaccagggctacacctaatcctccacaccatcagcatcactgtagaactcctcctctgatgaatgattgcgaggtgagtatatggcatactcagcaagccacacagcaaatatgcaagtgcacaggataccaaaggatggcgtagtatggtttcatttgcataaatagcatttaataaacatttcagaatttaataaaacagttaagtaataattaaacaatattaatccaacgctatataacataccctgttgcataggcccaaccattctgaacaaccatcccggctgcacagttctatctccaaaccaggaattaaccattccaaaccaggagctaatcaaattattaccagttatagcatcttttattatggtgaaaagtgtgagactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcagaaaagagctgtgacagtacctctcgcacaacataatccaccacagtgcaccactcccggatcatagtcacccccttataaacaaggtatggactccccagcgaacccccgtgggcttatctccgccacttctcagtctggtgctccgcaatgaaccatgctatacaaaaggtaaagccgttgcccacgctggcttgtggttggcacggtaaatgtttcacaaccgaaactcgtgaaccggtccttaattgtcatgagcacgaccatcaaaaccatctgctcacaacccaccattatcaagttttagttggcacattaattaattaaccaatcacgattgaccatcgtgagctatcagtaagagatcatgaaataatagtgagtcataagttatcccaatagtgtgctaatgtttctaagcatggctaagcaatcacatctaatatctagctgaaccaatatataaagctcaactagatcaagttataataacccaaggtatcaaggaataaagtaatcaagaacgaaagggctataacaaagaataggttaattccacccaatgacattcgaaaataaatgcaatagttaaatagaaacaatagctttaaataggatcaacatgctcaaagggttgtttgggatctgtgtgacttgccttgctggccttggaactcttcaaactcttctccggcgaaaacggactctccggaaacgacgaaatctaaacagaaagaagcaaaatcaccaaaacaacacataagcaagcatgaacagtacatgtggatatttttaacatgtagatctcaattttagaaaaatttagagacttgaaccaactaaatcggagctaagatgaattagttatgaatttttgaagatttaatcggattaaaacacttatatagattttaattgaattatgacgcaataatgaattatttttgaaaaggaaaagaaggtttattgcgtcagcggctagggtttcggtggaccgggcgcacgggcgacggttcacgcgaacggacggccgagatcgacttgatccaaaatggacggccgagatcgaacggtccacgaccggctcacggcagacggccacgatgacgtcagcggtgacgtcgtcaatgacgtcagcatcggcggcggctcggcggctcgggcgcgcaaactcgccggcgaacggcggcgcttcggcacgaacgaagggcaccaacgggtagcggacggcacggcgaacccaccggtgaccaaagaaacggcggaggagcaacggacggcgacggcgacgaggaagaagcggcggcgaccttcggcttgacgacggcggcggtgctccggcggtcttcggcggtggcgaaggagcggacgaggacggcgacgacttggcgaccacgatggcgatcttcccgagcgacgacgacgaccggaacggcgccggcgcacggctggagcgacggcggcgacggcggctcgaggttacacggcgctagggcgctacggacgacgagagtcgaaggcgagggtggcgacgggtagaggagacaccggggaaccttttaaaggggctaggaggcggcggcaaaggcccacggcggccggcgacgagatggaagtttagggttcggaggagagagacgaatccgattcgaactcgaatccatcgatttccaaaccgatttagccaaagattccaaaagagaaaaggtagaggagatcccgaagatcatttcccctctatcaattcggccggagaaggaaaggatcggccgaatttggaaggagacgacggcggcgcggcgctagggttcgggcggcggcggccggaggtagacgacaggcctgacaggtgggccccacctgtcagcgagcgcgggcggctacggactgggccggactgggccgaagagagagagagaagggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggctgttaaaatcatttctaaaaaattccaattaaacaacaatttatatattttgaatttttagggcgtgacaaatcaccacggatggagattctttccccgccgcttgccagaacgccgcgctcctcgccatcggcactcttcaccagcgctatccggacgagctgtagcactcgccctaccgctaccaccctcgtcgaggaggagcccgcgattacgccaccttcagggatgctagctcggaggatgacgctaccatcatgtacctggcgcgcatggtggaggagtacgacgcggcccgtatcgacttccatcatatggtgcgccgcgggttggtcgagaacaacatgaagatcctggagctgcgtcaggagaatttgcagctgaagaaggacttggacgcggtggaggcacagttgtgtcagctcaagatcgcccagggagaggtctgtcgccccaagcgtcgccgcgtctgccgcagcctgaagatcactgcccacaagagtacctccaggcctgagctggttcgtcagtccttggcatggacttgcttcgtggagacccctcgcgcggagcccgcgcccttggttcctcaggaggaggaagcctctggcgttggtagcacggaggatgtgctgttgctcaccttccgctctggcccgtcgcagaagtagacgagcagctagtaggctcgcgcgtgtgttcttctcgtttgtttttctgcttgagtcgtgtggggcatggttataccggtgtgtggtataactgtgtcggagcctgtctttattttatttgcataagcaacttgaaccttaatgaaccaatttaatagcagaaataaattcaagaattatggtagtcgtgggtggttagtttcaatagtcagctctctctgtttgctagttctgtgtgggattttcagatggtgacaaccaggagaagcgctgctactggtgactggtgagggcagtcatcctgaaggcagcaaccacaacaaccatggcagcccacctccacctcctccccagccaccaccaccgccacaagacaccaaccccatcctcacccaaatcctcgcccagcaagccaacatgatggttgctttcctccaccacatccagaatccgccgcaacacaatgctccacccccaccaccacccccgcagcattctaagcttgccgagttcctccgcatccgcccgcctaccttctctagctcccataaccctgttgatgctttggattggttgcatgccgtagggaaaaacttagacaccgtacagtgcaatgatgaggagaaagtcatcttcgccgctcaccaactgcaggggcccgcatctctatggtgggaccacttccaggctacgcagccagagggacagcctatcatttgggcccgtttcgccgccgccttccggaggacccatgtgcccgccggagtcatggcccttaagaagagggaatttcgggagttgaaacaaggcaactgctccgtgatggagtatttgcacgagttcaataatttggcccggtacgccccagaggatgttcgtgaagatgaggagaagcaggagaaatccctagcagggatggaccctgagctgtctatgcgtctggtctccggggactatcctgatttccagcgcctagtagacaagagcattcgcctggaagccaagcacaaggaattggagtcgcacaagcgtcgcttggcgaatttccgcaaccaacagggggctaaccaaaggatccgctacaccaatccctatccagggggatcctcctcgcagcagcagtagcaacaacctcgctccgcgccccgacctcaattcgtggtgcgcgtcctacagccacagcagcaacagaatcagcaagggacccgtgcaccccaccctcctgcaccagccgtgcagcctggacaaggccgcagggatgctcaaggtcaacagcgtctgtgcttcaactgcttcgagcacgggcactttgcggataaatgcccaaagccgaggcgccaacaaggtcaagcgcctccccgccccaacaacggtggtaaggatgtcactcggggccgtgtgaaccacgtgactgccgaggatatgctgacaactccagacgtcatcgttggtacgttcctcattcattccatccctgctaccattttgttcgactctggagcttcccactcatttatatctgtgccattcgtggggagaaatcagctgggggtagaaaggcttaggaaccctctgctcatcaccacccctggaggggttatgacagcaaagtattatagccctgccgttcctatagaaatccagggaattcctttcccctcggatttgattcttctagacaccaagaacttggatgtgatcctcgggatgaattggttggctcaattccaaggagtagtggattgcgcaaggcgcactgtcactctgtatcggggccctgatcaaccggttgttttctttgcacccccaacttccgccggcagttcagtacttcatcagctaggattgccagaaatacccatcgtcagtgagttcggagatgtgtttccggaagaactacccggtatgccgcccaagcgagagattgagttccggatagatcttgctccaggaaccactcctctgtacaagcgaccctaccatatggcagcaaatgaactggccgaagttaagagacagttggaagagttgaaagaaaaggggtatatacggccgagcacttccccctggggtgctcccgtgatttttgtggagaagaaagacaagacaaagagaatgtgtgttgactacagagctctcaatgaagttactatcaaaaacaagtaccctcttccccggatcgatgatctgttcgatcagcttaaaggtgccactgtattctccaagattgatcttcgttccggatatcaccagttgcgcatccgtgaagaagatatcccgaagaccgcattcaccacgcgatacggactgtatgaattcatggtaatgtcattcggtctaaccaatgctcctgccttcttcatgaacttaatgaacaaagtgttcatggaatacctggataagtttgttgtggtctttattgacgacatactggtgtactcacaatcagaggcagaccatcagcagcatctccgtttagtgttgggaaagctccgggagcaccaattgtatgccaagctcagcaagtgtgagttctgattgtccgaagtcaagttcttagggcacgtgatatctgctaaaggagttgctgtggatcccgaaacggtgaccgccgtcactgattggaagcaacccaagacagtcactcaggttcgcagctttttgggtttggcaggatactaccaaagattcatcgagaatttctccaaaattgccagacccatgacgcagttgctgaagaaggaagaaaaatttgtgtggagccctcaatgcgagaaagcattccaaactctcaaagaaaagctggtttcctcgccagtgttaatcttaccggatactcgcaaggaattcctggtgtactgtgacgcttcacgccaaggattggggtgcgtgttaatgcaggaaggtcatgtggtagcctatgcctcacgccagctacggccccatgaaggcaactaccctacccatgatttggagttggccgctgtggttcatgctctaaaaatctggcggcattatctcattggaaatcgctgcgaaatatataccgatcataagagtttgaaatacatcttcactcagtcggatctgaatcttcggcagagaagatggttagagctcatcaaggattatgatgtgggaatccactatcacccttgtaaggccaacgtggtcgcagacgcgctgagtcgaaaaagccgttgcaacactcttggcgtccgtggcattccacctgagcttaatcaatagttggaagccctgaacctaagcatcgttagccatggattcttggctacactggaagccaagcctaccttgctcgatcaaatccgcgaggctcagaagaatgatccagatatgcatgggatcctcaagaatatgaaacagggtaaagccgttggtttcatagaagatgaacacggaaccctatggaacggaaatcgtgtatgcgttccaaacgacaaggaacttaaacagttgatacttcaggaagctcacgaaagtccttattccatccaccctggcagcacgaagatgtacttagacttgaaagagaaatactggtgggttagtatgaagcgggaaattgcagagttcgtggccctttgtgatgtgtgccagcgtgtcaaagcaaagcaccaacgaccggccggacttctccaacctctccaagtaccagaatggaaatgggatgaaattgggatggatttcatcaccggagttccaaaaagccaagatggatatgattctatatgggtagtcgtggatcgactaaccaaggtggctcggtttattcctgtgaagaccacctatggagggaacaaattaactgaagtctacttcgctaggatcgtgagtctccatggcgtccctaagaaaattgtatctgataggggaagtcaattcacctctcacttctggaagaagctccaagaagagttgggtacccgattaaatttcagcaccgcgtatcacccgcaaaccgatggacagaccgagcgtctaaatcagatcctagaagatatgctccgtgcctgtgttctagattttgggaagacctgggataagagtctcccctatgccgagttctcctacaataacagctaccaatccagcatacaaatggcaccttatgaagcgttgtatggccgcaaatgccggacaccactattgtgggaccaagttggggaaagccaagtgttcgggacggatatcctgagagaagttgaagctaaagtcagaaccattcgggataatctaaaggtggcacagtcccggcagaagagttatgcagataaccgacgccgtaacctggaattcgcagtggatgattttgtgtaccttcgggtcacgccattgcggggtgtacacaggttccagacgaaagggaacctcgcacctaggtttgtgggtcctttccgcatcattgctcgacgcggagaagtcgcttaccagttggagctgcccgcatccttgggcaatgtgcatgatgtgttccatgtgtcgcaactcaagaaatgtcttcgagtgccgtccgagcaggccgattcagagcaaattgaagttcgcgaagacttgacctatgtagagaagccggtgaaggttctggacaccatggagcgcaggactaggaaccgggtaatccgtttttgcaaggtccaatggagcaaccacgccgaggaagaagctacctgggaacgtgaagacaagctgaaggcagcctatcccgatctcttcgccagttcttccgaatctcagggtcgagattccgtttaagggggtaagtttgtcacgtcccaaaacgaccctaaaatatatcctttaaattatgcctagaataattaaaatcctcgagaaagcctccaaaaattaaaatgtgcaaagtaaaagtcaaacaaggcttagaggatttttttatatttcctaaaagcctaaaatgtgtaaataaattttagtggaattttcagagcacaaataataattattaagaaataaacaaagttgaaaaggttttataaaaagaaaaaccctaaagaccctccctccctctcttgggccggcttggcccacttccctccccctctctcctcttccctcgcggcccactcggcctctcttcgcgcgcgcgccgctgacgggcgggcccgcccgccaccctcgctgacgggtggggcccaccagtcatctctttcctcccgccgctcctgccgcctcgcccgcgcctagcgccgccaccaccgcgaatcccgccgcctcccgtcgtccctgcgtgaaatcaatagggggcaattactccccatgatcccctctccctttccccccatttttccctctctctcgcattcaaacggccagatttgctcccgcaaatctcgccggcgccattgatggcggccggacctcccggccggtttccttccttccccggccgccctctcccccttccaaccctatttaaaccctcctcgcgcctccctcgcccgtttccgccccttgccgcaccgtctcctcaccggaatcgagctcgcgccatcgccctctctctcctccgtcgccgacgacctccggccggccttctccgctcgccaggaccgtttcccgccccagcgtcgcctcctctggcttcgccgcaccgtcgccgtccccgtccaccccctcgtcgagctcgccgaccgccggagcgccgccgtccccgtcgatccgagccgcgccgctgccttccaccgctccggccgcctttttcgtcgtcgccgtcgacctagggtgagccgtggaccgccgcctcgtttccccctttccctcccctctctcggctgccgctccgccgtgcctatggccgccgccggcgaccataggggcgcgggcgcgccgcctcctgccggccgcgccgacgtggccgccttcgggcgcgccgagcggctgccgcgtggggcccggtcgtcagccgcccgcgccctcgggtgtggctgacgcgtggggcccacggcgccggccggtgtgagcccgggtgcacccggtccaccgtggaccgtgaggctgccgcgtgggccccactcccgtgaacccggtccgcgcgccctctcccctcggctgacgcaataaatccttcttaaattaaaatttaaatgaagaaattcgcaaatattcacttaaagagcatataaacttcaaatggccataggttggtcatttgaactcggaattggaccgttcaagtctctaattttttcttaagaagtcaagaacccatttttgtgctttgtccctgcttgttatatggagtttattagagtaaaagcctttttcctttccgttggtcgtgtagacgctgcagcttcggaagatccgctctacgtggaggttgaagccgacgtttgggaaagtgagcaaggcaagtcacatcatccttgaacatattgaatccccgtttataaaattgttttgatttaaattattgcattatcgctttatttaaattaccgcgttatcactattttgtttagccatgcctatttacctttgttatgaccttataattgttatcattattattaccttgttcaccctagaataaacaaaaccccaactagtgggtactctattcatggtaccactagtatgaatttaggtagatgcttcgctgtttaattaggcaacattaggtggttttacaactctagactttgggaatattcatgtcacctagacactatggaatggttggattattgtggaatcggattcacacctccccctctattcaaaatcctcaaaatggttttaggctgggctcggggtgcatggttttgatagtagcacctcggccacataaggaccggtcttcgggcctctgttgaaaagcactaccgtacttccacatgtctagtgggtaaggcttagtttgtggctcagtctggttataaacaaaagtacacggatggagatggacgaagtcgggggtcgatggacatttctagggcaaatgaaggctacacgagctgcggcccggtagtcgagatgtcatggcacagggctggtgtcctgctgctaggggctcagtcctgcctacctgtcccggaggttccggccgtaggtagggttgggtcggtactcttgtctatggctaggatgggttggaaactatgtcatgtcttccgttcgtatgccgtggtggtatgtggcacgtggttacacgtgaggaagacatgtcttgtgggtaaagatgtacacctctgatcagagtataacctattcgaacagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtccaaatcatcgtaggccttgggttaaggtaggttcgtgttggttcacggccttgattaataatattgcatagctctaggatcgtgtttacaaagtagctttgagcaactaagtgacttttaatgctgtttactgcaaaccctaaccccctatattatagctcccttgtactcccttgcatttattctgcacttattggtgtgtcttgttgagtacggtggttgtactcagtcttgctcaatttttcccaatcctagaagaggagttcctagaagatgaaggctttggtgtctagctcgtgcctgccatcaagcgcctgtggtcgtcgccctagtcttccgttgtttttcgtttgtcttcgtgtgtgctgggccctcgccgcccatgtaataaaataactatttacgcttccacttgttaaactctgtattgtatcaacttttggtgtacctcgcctcctgggacaaggaataatacacgcacgtaaggaacgcccgttgggttatttctagtcgtgacaggctgatcctgcagaacgactccagaaccgtcaacgaggcatgcacaccgtccaagagacggaattacttgttgccaagctggacctcctcatgaaatgattggatgaccacgagaaacggccacaagacactgtcaaggccttggactctcacgtcacgtgtgaggtctacggcggcacaggtcattctaggaatgactgcccgaaaacctgtgaggaggcgatgtacatgggcaacaacaacgggtaccgtccacaaggaggtcaggggtggagccaaccacgcccatattatcaaggaggtaacaacattggtaacttttctaaccagccctccttgaaggatgtagtttctgcgcaggctaaaaccactgatgcgctaagcaaaaagcttgttgccaatgacaagatcggggtgcag

SEQ ID NO: 54509 - DNA, 707 bp, Oryza sativa
gcaggagtattacgacacacaattgctgctgtttccttaacgaatgaggaaaccgtcagtggacgagcaattcgctcgttttgttgaagtaatccagaagatccacatcaatgtcccgttgttggacactatgcaagtgccaacatacgcccattatctcaaagacatactcaacaacaagcgaccactcccaacaacggaggtggtcaagctgacggtgtaatgcagcaacgtgatactccacaagctcccggagaagaagaaaaatccggggtgtcctacgatcacctgctcgatcggggcacaacagttcgaccaggccttgtgcgaccttggagccagtgtcagcgtcatgccaaaagacgtcttcgacaaggtcaacttcacggtgttggcaccaacaccgatgcgccttcaattgactgactcgtcagtccgttacccggcagggatagcggaggatgttccagccaagatacgggatttcttcatccctgttgactttgtggtgctggacatggacacgggaaatgagacgctgctcatcctagggcaaccgttcctttgcaccgcaggagccaacattgacgtgggaacgaggagtatctattccacatcaacgggaaggaagagaagtttgagtttcaaccaaggacggaacaatgctccgtggtcaggataaagtatggccgaacccacagaatatt

SEQ ID NO: 54510 - DNA, 713 bp, Oryza sativa
tcctgcagcccgatcagttggttcgaggcgcaccaatcccgaggcgaagtgacatacaagtttgaactcggtaaaccgcttgtcaaacctaaaaaactgcagtccctaccgacacagatgtacaaattccatgaacggtgcatggaaatgagcgccaaatgtagagagatgttcggagcgaggtcagaaaccccgacatcttgcaaggagaagatgttctctggatccatttcaaggatctcttcgatctataccagttggacgccctcgacgtctctcttttgagcgcatggattttgtgagtatctttgagttcgatttgattcgttaataattagctcctggcatatatgtaagcaataatactttcctttcatcgttgtagaatggagattcaaagggcccgacagaggagggtctacgatactaggttcatcgaccctcggaaaatcaacatcgaaatgatcgacaagtacgagaaagacacagaggacaatcttgtccatctcctaacgcagcagcatttcaagacgtacatactactgccgtacaacacagagtgagtttttattgtcgttcgaacaaatttcgttcccatacatatagcatgtacattttcgatcatatatatctcatctcacgcatattccagattccactgggtcctgttattctttgacttggacgcatgcagagtcactgtgtatgactca

SEQ ID NO: 54511 - DNA, 1746 bp, Oryza sativa
attatgtctaacctttaaatttttccagtactccaaatcccacagacaaactctcctactccaaattttcacatttgcagttttgtcactatccaaggcagaacgcttccttttcctgctctccttttgcttgatcccaggtttgacatgtctaaccttctctaattctgctagtagctctgcttttgtaaatttacctggtggatcattggttccatgaaggccactgtattcattgttcctcctcaaacgatgtccccttggcaggaaacggtagtgtccaatatatgcaattttattccttagtgcataagacagaggatttttgtcacagtgaatacaagcaaaatagccttttgtggtacgcccagacaaagtagccagagctgggtaatcatgaatgcaccataacactgctgcacgaagtttgaactctttgtcaataatggcatcataagtatgcacacccttccaaagctcaatcaattcttcaacaagaggctgtagaaataaatcaaagtctttcccaggtgaacatggacctggaatcaacagagccatcattagattggattgatccatgcatgcccaaggtggaaggttgtatggcacaacaaatacaggccacatgctgtacttcgtgttaaaattgccaaagggattgaatccatcagtagctagcccaagtctgaggtttctagcttctttagcaaaatctggatattccctgtcaaaatcttgccaagcctcaccatcaactggatgactcatttccttctcactaggctgcctctttaacttgtgccattgtgcttgttctgaaccctccttggttacaaatagcctctgtagcctaggcaccaatggaaaatgccgcaatactttctgcggaatcttcttcctctgtgggtctttccatcttgacaaaccacaaactgggcaattatcaagatcagaataatcctttcgaaacaaaatgcagttgttgtagcaaacatggatcgattcatatccaagtcctaattccttatatcattttctttgcttcatcgtatgatgttggtagtgtattaaactctggcaatgcttcagctagtatcttcaagattgcagaaaatgcagtgttggtaatcctataaaatgacttcatatgaagtatctttaccacaaaggagaactttgaaaatttggcacacccaggataaagctgacgcttagcctccttcaccagaagtttaagaaaagaggtttgactgtttccatcattgttcccattttcaggttcagagtcatgactaccatgtcctcttgcagtttgaaggtcactaagcaaactatctaaccgatcaccaacattgttgtcagtctgagccataccaatggaaccctcatcagtgtcaaaaacagaaacagaagcagggacttcattaacatgtacactaatgtcctctccatgatgtacccaccgagtatatgtacagtccataccattcatcaaaatgtgtttcttcacagtgggctgatgcaggtacttctgattaaggcatctagtacatgggcatagaatctcatcatcctcagcatatttttctttaatgaaatccataaattcattgacaccattgacatattgagtagaaaatagtgtgctgtgcacccaacttctatccatctgaacatgcattggggaaacacacaatttaattaataaacgtgcacagtacaagaaaatcagagagaagatgg

SEQ ID NO: 54512 - DNA, 9218 bp, Oryza sativa
aaattctagcacaacatgtggcgtagtgcagtggtaaagcgcgccacttgtgacgtggagttcttaggttcaactctcaagcgctgcactgtttttttgaatcagacatttatcaaagaaatggctcgtggccacgtcagcatgccacgctggcacccaatatcgcaatggcacatcatgacgaaactaaaaacgtcacggatttggttcagctgcgcaattgtgacgggttcttgaatttcgtcacagaacctaggcccaattttgggcttcaagagacccatgtctggtttaggtaatccgtgacaaaaaaaaatctatcactaaaaactgtcacagatcaaccaaattcttgtagtggatggataggggccacatcccagttggttttttctttttttttttttgctgcttgtatatattatcccacccaaatccacacaaatcatccacaaaaaaattatccacaaatcatgcacaacaaaattatccgcaatacatacacatccacaatccacaaatcaatcacaaaatcatccccaaatcaacaaaaaaaaatctccaacaaaatatacaaatcattcactacaaataattcaaaaaataaaaaaaaatacatagtcgccagcagccgccgcccggccgtaggacgacggtcgccttccgcccggccgccgcctggccgtgtgccaccttgcggctagccatcgccgccggggcggccctccacgcacgatggccgccgccctccgcgctggcctccgccgctgccgcccggccgcctcccctcccgaatttggcggaagggaggccgccaccaccgcccgattgcctatcgccgccgaatgccgggaggtgcggcccgccggaggggaggagaggggtgagaggaggagagttaagaaatgagaggtgagaaggaggagaagagagaagagataaggttggggaccgcgctcgggcaatgttttttttcccgattgttaattatgactaatggactagtggagaaccagactaaaaaccggtttaaacggggattattgtgtattttgggcaacggaccaaaagatgatttctcaagcaagggcgggctgccttcctatttaaggttgaattggcgaggtgggattattctagctacagtaccgcgatggtattgagggctgctgctgctttgcgcgctctctctcgctgctctgcttgctgcactgctgcttgcatgcttggctggtttttgctattgggccggctagctactgggctgcataggctgggctgcatacctagctttgctctttttttttctctctctcttctttctctttttctttttctctaattattgcggcgcgttatagttaccaacaccatctaccgaacacacccttagtcgagttggcattgcagttggtcgagatgctcgtcgagcaggaagccgcacgtggcggtgaggttgccattgggtggagctcatccttcggtcccatttagcgcgcctcatgattcgggttctaagggatttgggtagctaatctcgtacttatgtcatcatcggtgtacggggattttcttcctttatatgtgtgtgcgctaagaggatgaggggcgagtccatagcgtggacagcaagtccgatcattgcgtgtaggaaaggatcgtgagtgtggccagcctcacagtactatggaaagtatcattggtgtcagttgagaatcccatataggggccagattttccaaccgacagcagtcagatggcactaaggactaaggaggtgcctaactagtgccggttttataaccagcaccacctatagggtgcaaccttttttcatttttacagacttgaaaaaatccaaaaaaatatttattattttactgggcatctatacacagttccactttggattaaattttggatactcgtggcacacttttcaaactgctaaacggtgcgtttcgtacgaaaactttctatatgaaagttgttctaaaatatcggattaatctattttttcaagtttggaataattaaaactcaattaatcacacattattacgacatcgttttgcgtgaaacacttaatcttcatcttcatcttcatctttaggacattcaaacaccacctttgtttccaacagctcccaagataaaatatttgctattttactagcatctatacacagccccactttgtttccaacaactcacaagatgtttgcaccattttcacaagaatatgagttgaagctagggttcaaacccgcaacctctcttcagccgaagtctgcttaccttgtcacctaaaaattattttctttaaagcaaatacttttcttttgttactactcttatccaaaacttataatccatatttaacgtcatagataagcccaaataaaatttttgttaataacaaagttataaatacaactttcctatacattttgttcacatccaagatagtttagaaattttaaaaattcacttctccaaatagatctgagaagttataacatatttttagacatccaaataacctcaaatcaaaacgtgatcaactacaaggttgtagatatcgtcaagttctacaaatttaatataagtttattttcgtatgacttcatatgaaaaaagttatatacaaaacacatatatgagtagtgtcattattggtgccgtttttattccaatttttattgagaaccggcacatgtgaaaactagatatgtcgttttagataaaaaaatcatttactattgtgccacactcataggtgccggtttattacgagaaccagaacctatatgatgtccattggtgcagctttattataagaatcggcaactgtaactattggtgccggttttttatggacctacacaaatgagtggttttgggtgtcagtttttatttatagatgtatggaaaggtgaggaaagtctcatatctatcggttttttactttatttctacgtagcagcacctatgatgctgtctcctttcagggtttcttgagtagtttcgtcgataagtgcgcattggcatggggtgggccaagctcatgtgtgtttgtctggttcagcggccagagatcaatctaacacatgtttctcctatctcctctttcaaatagataatcagttattctttgtcctaattatgttatgtagtgtgtatttcaaaggaataggggtgaatgtgtgtttatgtgtgcctacatttatactatgtttccaaatgaaattttattgtggactagaaaatccaaatacaagttttgaaatttactatctaggtttcaaactttacaatgtaaattaatgtaaccgtattccttttattttaatgagaaatattacaccacaaatataactagctagtacagtaggcgaaggcagttattggatatgacaaccaactttcgggctttattagtacttttctaatactcccactatcttaaggcatatttcatttttttaattttccaaatgagataggcatatttatcttaatattccttggttgcatacgtgcatgcatataatggatgagttaattgttccttgatcttggtaacaaaagaaaaatatgtctcagatttttaagatgaagagagtaatgcacttacctaatctaaaaaataatttagattggggaaagtccaaaacacccctgaactattgggtgagtatgaaatactccttcagacgcgaaaaacaagatatctttcatcatcaacaatcaatactggatgaacccccctccccagcagctttgcaagtggttttgatcttacgtggcagtccagtcaagaataattttattaaaaaaactgatggagcccacctgccatatctctctcctccctatctatttcccgtctcacacctgtcactctcgcgtgcgcgcatcaaatgctgaggaggagccccgcacggtggcggtggcatcggcggttgagttgtgccccaagaggaagcagcagcaattcacatcgtcgtggcacactgcgtagtagctctagttggaggcgatagccagcgcggggaatttggcagcaatgtatggggcggtgatgttcatcatgaactccacgccggcgagaggtagcatgcagcagcaggccgacctgtgcttcgggttctcgtcgacatcatccgcgctcaccgctgtctccccggtgcacatgtccaccaccgcgctgctgtagaaggcacgcggatgggcgtgacgcagagctgcctccgtcatcctgtcgtcctcggctccccctccatcgtccccacactgcctccgtcgtccctgcccaccaccaccactccgagttgcctccctcgtccccgctcgccgtcgccgtcctcggttccccctccgccatcccgcctgtcaccgccgctccaagccacctcccccgccgctgcccgctgccgccgtcctcggctccctctccgtcgtcgccgctacgagttgcctcacccgctgctgcccgccgccgccgtcctcgactatccctctgtcatccctgccaccaccgccgctccgagtcgtgtctcccgccgccaccatcctcgacaacctttctgtcggttgctcggtgtagagagagaggggggagccgagaagagaagagatatatgattgggaaagagacagagatagaaaggtgaggggaaagagatatagaggatgagactgatgggtggaacccattgatttaaaaagaagaattgctgactggactgtcacgtaggaccaaaaccactccagtttgagtcggtggggtttttcatctagtattgataattgaaggtgaaagatatatgcttttcgggtctgaggggtaatttgtacttacccaatagaggaaagagatatagaggatgagactgaggggaaagagatatagaggatgagactgatgggtggaacccatcgatttaaaaagaagaattgctgactggactatcacgtaggaccaaaaccactccggtttgagtcggtggggtttttcatctggtattgataattgaaggtgaaagatatatgcttttcgggtctgagggtgtaatttgtacttacccaatagttcagcggtgtaatgcggacttttcctttttagattaggtgaaactctacaagttgagaaacgaggaatgcaattttcttaataatctgtcgctataagtatatctaataaattcgtgatgctctagaacatttaataaaattaatttgaagtgcaataattacttctactaagcctatgatcattcggtgattttctgaaagggaaagcatttaaacccgttttctgtctgtgggtcaaatccggcccactctaacatttccctttgtccttccctgcatggtcgctctggtagtctggtttgcctaggaacaaccatggttgtctgagtagagataaatgggaattgttatttcaacaaagtttagagcaataatttttatgtcaattacaaagatataaaaaacatattatcgaagcagtacaattattaccgagaagaaataagtgaaagaagagggagccaagaaggtactactccctctttcacattgaaagtcgttctgaatttgtccggtgccaaaaaatgtataagaatacaaaaataaatggcaaaacgaaaccaaaaggataacgtgttttatgggggaacaagaccaaagaggctatataaccaatttcagtggacaatgtggttcattggtacaagttccattttgaaagcagagaaggtacttcaaaacatcacaagagctatcagctacaaacattttacttcgatccatgcatagccattacagtggctccatttcagcagcagtggtcgaatcactggcgtagacagggtggagcatgtgcccggcaacaggatcaacatgaacccattttctgccagtcagcttgttgcgctcaaaacgcacgtgtccttatttgagacagaagagagtacgatcctttcccattccaacataggccgtgtttaattgttctggcaaaaaaaaaattgatgtatacggacatacatacatttgaattattaaacgtagactaataacaaaataaattatagattccgtctgtaaacagcgagacgaatctattaagcctaattaatccatcattaacaaatgtttattgtagtaccatattatcaagtcatggcgtaattaggctaaaaagattcgtctcgcaatttacatgcaaactgtgcaattgttttttcgtccacatttaatgctctatgtatgtgtccaaatatttgatgcgacggaaaagttggaagttcgaagggaactaaacacagccatagttcccaggatggaagcgggttcctcattggcggacgatgatatttcctggctccactttctgaaatagttcatgaaaatatcagattatattccacgtctttcgcataactagcaaaatgtccgtatgctttgttatgggaaaaaaacttatataataatagggataagtccattgacacccctcaactattggtttaaattacaccccccaactctaaaaccagatatcctaacaccctccaacttttaaaaccgtgcaataagccccttaaggtggttttgtgttgacgagatgatccagatgatccacatgttagggaacacctcttacctctcttctctctcagcctcgtctcttcctcggccaccgccaccattgccagactagagcgccccagagctccaatgcctagttgagctcgtgctctgtctttcctaagctccgcgtctcgaccaccgccacctcatagagcggcggtagagaactagcgccacgaccccacctgaccctcacccccatcaccagcgaaagacaccccaccacctcacccccatcacctacaaaggactagaccaacgaccgccaagaagagcaggagaccggtgaccagaagggtgcctgcctacaatatcctccagcacaaaacggatgaagaaatcaagctcaagctcacttgctcaccaccgacctccacgccgcccacaccaatctcccccaatccaatctttctcctcctcctggctagcagtcgagctctagcttcgctacctccaccaatatcttgcctcagtagtcgctagcgccgagctcagccactaacaccacgtctttccacatcaagctcgaggatgagggactcggtctcaagcacacctcgagcctcctgaccgggcagcgacgacggaaggatgtgctctaggggcacccacctccccgtcctcataccctgagtgcctcgtcagatctaggcagtatcgaagggactccggtgagctcctctttgaggtggtcgatgcgagatccccaaccactccacttatagctctgcgaggggaggagggagtgagaacagtggatgctgagatggagaccgggacggagggagtttgccagcaacctcacctcctccattgagcttatcaagcagggagggaggggagagggagatagaggggaaggaagaagaagacaggtggaagtgagtagtgggactccttccctcttgctgacgtggatttttaaagtagaggtggcatctgacgtggcatccagttgtaccaaaaccagcctaaaattgctaactggggtaaagtatctggttttgatatttggggtgttagatacccagctttacagtttgagggtgtgttttagacaaactgaagagttaaagggtgtaaaatggacttatcacataataatatgtcattgataaaatatatttatatatgctagtattgcttgtttacttatttgaatatatagaaaatctaataaatgccattgcaagcgtcgaattccaagaaatgtcatcgacaagtacaagctccataaaatgccatcatacaagtaactttgttttagaaatgccactacactggccaaggtcacctgtgatgggcccaaaccctcatctttgacggcttcacgcatggtcagtgatcagtggtcactggtgagtccagtcacctttgacgggtggccggccgtcacaggtgacacccatctctgacgggcaagttactagaaggccgtcagaggtgttggtctcctgtagcctagggcgagttgggactcgtcacaggtgactcatctctgacggccctttaaataaaggccgtcagaggttatggtcttcgtagttagaagctgtcataggtgatctacatgtgacggccccaaaagtaaaggcccgtcacaggtaggtcacctctgacaggcctttatttgctagtccgtcacaggtgaggtttcctttgacgaatttttgttccgagccgtcactgatgagttaattccagaaaaaaaataaatgctaaatattggctagcctcaggatttgctagccatgccctctgaaacacagatacatcacagatatattttagtcaccccccaatataacatcacagatccatttcaaacatcacagatccctaacaacacagatccatataaaaattgacatcattcacatatgcagttcaaatgccacaattttgcacagcaaattcacaccccttgaaagccacaatttcggtcgttgctcatagaaccgcatatatacttaccaaatggattaaagctgtaatgtcctcgacctccacaacctgtcaataaggaataaaaaggagaaaacaattgaatagtacaacgtaaatcgtagttgatcaaatttgatgacaatttagtaaactaccataaatattgcacatatgaaagtaaattacattgcactccataaaaacatatttttttacatcacaagaaattataaaaacatcttttttacatcacaataaattatctagccaagttcatgagtctatttgacgtgaaaacgtcctttcttgttcattatttctgcaagaatgaaggcgcacactgcgcctctgataggggggggtggttgatgggtgagatcttgaagccagctctacctttctgtttaataaataagaggttaacacgttttgaatagcaatgttggtattgaaatgagcttattcgccattagcaacaacctcagggtcgaaatctttcacctctcttagaagtgttgacatgttgtggcacacgtggaaaccacattggtctcggatctgttgtgcgcatgcgaacttggtgccatgataaagctcgtcctttccct

SEQ ID NO: 54513 - DNA, 8150 bp, Oryza sativa
ttgatacaattcagagtttaacaagcggaagcgtaaatagttaatttattacatgggcagcgaaggcccagcacacacaaagacaaacgagaaacagcggaagactagggcgacgaccacaggcacttgacggcaggcacgagctagacaccgaagccttcatcctccaggaactcctcttctgggtttgggaaaaattgagcaagactgagtacaaccaccgtactcaacaagacacacccacaagtgcagaataaatgcaaaggagtacaaaggagttacactataaagggttagggttgcagtaaacagcatttaaagacattagttgctcagagctattttgcaaacacgattctagtactatacaatattatttatcaaggccgtgaacccacacgaaccaaccttaacccaaggcctacgatgattcagaccgaactggcaacccgaccctgggtcccagctcgtcccaagccaacccaggccaaccattccacattttagttgttaagcaagttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacacccgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagaaggagcggtgtgaagccaattccacaataaccaaaccattccacagtgtccaggtgatatgaatattcccaaagtctagagttgttaaaccgcctaatgttacctaattaaaagcgaagcatctacctaaaatcatactagtgataccatgagtagagtgtccactagttggggttttgtttattctagggtgaacaaggaaataataacaataacaataataataaggtcataacaaaggtaaataggcatggctaaataaaacaatgataacgcgggaatttaaataaagcgataatgcaataagttaaatcaacataattttacaaactgggattcaatatgttcaaagatgatgtgacttgccttgctcgctttcccaaacgtcggcttcaacttccacgaagagcgggtcttccgaagctgcagcgtctacacgaccaacggaaaagaaacggcttttactctactaaactccatataacaagcagaaacaaagcacaaaaatgggttcttgacttcttaaggaaaaattagagacttgaacggtccaattccgagttcaaatggccaagttatggccatttgaagtctatatgctctttaaatggatatttacgaatttcttcatttaaattttaatttaaaatcggatttattgcgtcagccgaggggaggggcgcgcggaccgggtccacgggagtggggcccacgcggcagcctcacggtccacggtggaccgggtgcacgcggcttacgccggccggcgccgtgggtcccacgcgtcagccgcacccgagggcgcgggcggctgacggctgggccccacatggcagccgcggggcgcgcccgaaggcggcctcgccggcacagccgacgggaggcgacgcacccgcgccccgatggtcaccgccggcgaccaccggcgcggcggagcggcgcccgagagaggggagggaagggggaagtgaaacggcggtccacggctcaccccgggtcgatggcgacgacgggaacggcgaccggagcggaggaaggcggcggcgcggttcgggtcgatgaggacggcggcgttccggcggtcggcgggcgaaacggaggggtggacgaggtcggcgaggttgggcgaacccgaagaaggcgacgccgaaacgggagagggtccggggcgacgacggcggcggaccggagctcggcggcgacggcggagagagagagcgacggcgcgagctcgattccgacggggagagagagcggcgagggtcggaaacgggggagggaggcacggggagcgtttatatagggttgggagggggagagaacggccggatgagggggaatcggccgcggaagatccggccgccattgatgcgccggcgaagttagggggaaactttccgaacgaatccgagggagagagagagggaaaagtggggggaaagagggagggaatcacggggagtaatttccccctctttattgcgcgcggggacggcgggattcgcggcggcggcggcgctagggcacgggcgaggcggcgggagcggcgggaggaaggggatgacgggtgggccccacccgtcagcgagggtggcgggcgggcccgcccgtcagcggcacgcgtgcgcggggagggggccggatgggccgcgggggagaggagagagagggagggaggtgggccgagccggcccaagagggagagggggagggaaaagaaactttttagggtttttcttttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttacttattctatgcatagttttgaggatgtattttagagtcgttttgggacgcgacaacgactcttgatccaacacaaccttaaaacatttatgtattagaactaatttaattaggagatattgtccaattatatcacaagtatagaaggtatgcacttacaaggagtagcattttagaagaccagtgtccaacttccggatcctaaaaaggtcgaagaggtcatcaaagcctatagttatataggcaggcgacgataggaacggctagtggtcgtgatgtccaactatcgatgattccctcattttccgcttggcattgcttagcttcatgtattgcttatgtagctctcggcaagcaatacccatcacggctaacacattgtcctccaccaatggcatgcctagctcaaattgggctggtgccctcacgaccttccccgctttgttcagcatcgacgtcgcagccttgcccctttttggctccggcgccaactccctgaccttccccttgctgcgttcacgcttctggcccttgacaagtggtggggagctatcggcctttcttgtggtctttattggagccaagctttgagctatatctgccaagtccatatcagctccaccaggagaatgaggtagtgacaatgccgatccacggggagcctcaattgatagcttagacttgggaggtgtaagctccgtcggtcgacttggacgaggagtcatcttcacaactatgtcttctttgggccattgtatgaacgtcttgcgcgcatcgcccaaagtcatgatttcatcattgggggcacaggcagcggatagcctgaccaggtgtcctttactgtatcgatggacaccttggcatacctagctagcaggtctgcgccatggaccttgtctgcaaccgagggcttgaaagccatgccctcagcgattttgggagcgaaagttgggtggaccctcgccagtaggacacactgtgctacgccctgcatatgtgaaagtttgaatttaatattggaacgtgtaaaggtttttttattagatacggatcggataacatcaattacctctatgtggtccactgcacctctgtggatgcacaattactcctatgctatgacggactcacgtcgtgttgtgcacgaggagttggatgcacagtaggtgttgtgcctcggggtatattcatgtcggcgaggaccttattaaccctttcttccaccctagcgttcgtgctagcttctagttcttgaatgacctcaaccttaagttcagccttcaaacgagcgttcctctcttccttggagactttccgtttcctgtattgggagctgtactgcgggagtccatgcttccagggcacatcgctaccaattcccctagttcggccaggatgttctttggttccgagcacctttgtgaggatgtcatcttcgcgcctcttcggcgcggactcaacctcgctttgtgaagcttgttcagcaaccaagcctaactagaaaaaaaagagtcatttatacgaacttctactttatacgaacggaaattagttaggttaagtagtgaactcaccagttcctgatagacgacagcatcacttttgttctcaaatgtgacagagccgtccgggttgaccttaccccttgcccgtgcccagttgcgagctctttgttcagggatgtctgaaaacggggcagggacatttgctgctgcagcggctacatcttcttgggcccatattgcctccttgccgatgtactctgcggtgcccagccgatgcgggtgctcattccgctgttgcagtaggcgatgtgcctcgcttgattccctagactcttgggtgttcttgagagagcagaattcctcccacaccacttcggttatttgagggtattcatcaaacggcgtatgattgccgggcgggttgacaatctcggtgaagagcttcaacttccaattcttccaagctttgcccatcttctggaatgccttccgcttgagcctatcctttgcttcagccgggaatgtgaaccatttctccattgccgtccaagctcgctctttctcggcttctgtgaccttgccgatatctttatggaggatcccgaagttctcacgtgccgccagcccgcagcagttagaccatcttccaatgacagtcctgggcgctgtgggcctaccactagcgtcaacctctcttataacttgcactgtggttggccatatattttgtgaccggggatttctacttgacctacttgcacttgtcccgcccgacatcgacatatgttgttcctgcggcaattctgcagcacaaacagaaggcaacatatgctaaggggtgctagctaaaatttatgtggtcatgtggtgaaaatttatcctataaattaccatgaatttcgggttgttcgaccgccgttgtcgagggatgaccttcggcaactgtctccgtggctgggtttacttcttcctggatcctcgcaggtgttggggagggcgggttttcactgggcgttgtcatggtctaattttcgcgaaaaagcttataaatttcctaccattatactaaatagcattagatccaatgtaatacggggtatactatgaaacatatggcctcagttttgctcagaaattatgcatcaattaccatcatttccatgaagggaaaaaaagaggaaattagctactaggagggaaaccaacccaaagtaaagcgtaaaaaagaaccaagtgtagatagtctcctcttatcaatccaaaaaaaaagaacaagtgaacatgaaaaaaagaacaagtgtagataatatgttcttatgcattaaaaagaacacacattctataacagcagcagcagcagcaacatcaattcattttatgacaatcatcaaaattcatcaaaatcaggcaatcaggggcaattcttatgcataaaaaaagaacaagtgtagataatctgttcttatgcagaaaaaaagaacaagtgtagataatctgttcttatgcattaaaaaaagaacaagtgtagataatctatgcacaaaaaaaaatgaataaggggcacaggggcaataggggtagcagcagcaacaacaattcatcaaaaaagaacaagtgtacataaaaaaaagtgtagaaaatctgttcttatgcattaaaaaaagatcaagtttagaggtatttctgttcttgagcattcatcactttgagcattcatcactggccatttaacataaggcaaccataggcagcagcacacaattaatttatcaagcaggggcaagtgtagataataaaacagcccacaataatttatgtggcagcagcagcaagggtatataaatcatgtatataaacaacaattcatgcaactcacctattcatagacagcaagggtatataaatcatgtatataaacaaaaattcatgcaattcacctattcatagatagcaagggtatataaatcaacaagtgtagataatctgttcttatccataaagaaaagaacatccactgcagcaaaattcatgctaagatcctctaataccaatagaataatttctctaatactgcattcatccaaaatctagcccctacattcatccaaaacatccacagacaacaaatcacatttaattcatctatacagcagcaccaacaatcgaaataacaaatcacatttcattcatctaaacaatgcaattcatccatcgaaaaaaggaggaatgggggagggtggcggcgtacttggagaagcggcgtacttggagaaggcggcgcaggccgtagtcgtcctagatcccggtggcggcgaacacgagggcggggaggcagcggcgaagaggtcgaggtggtcggcggtgcaggccggtgtcatcaatccaggcgttggcgaggtcgggaaagccgatggcggcggagagggtggcggtgtagaggtcgaggtggcagtggtggtggcgatggcgacagaaagggcggcggtggtcggggatcccagcgtcgtggatcccggtgtcggggaggtcggggtcggggaggtcggggaagtcgatggacggacggcggagaggacgagcgtccgtgagggcggcggtggagaggtcaaggcggcggtggagagggcggcggagagggcggagatggcggcggagagggtggcggagatggcggcggagagggcgacagggagtcgaggcggcgacggtggagatggcggcggagaggacggtggcggtcgagagagtgagtgagtgagagtgggtgccagatctggatcgatctataagaggtccaaccctaggtcaaccctagtcaaactcacctgtgacgggcgccaacgatggggccgtcacaggtgatgtcaccagtgatgggcgccaactgtggagccatcacaggtggcctcacctgtgatgggcccaacattctgggccgtcataggtaaggtcacctgtgacggccccgtaataagagcccgtcacaggtgagtttgcctacagtaattttattttattttatttcacttagttcttttattttccttaacatatttccacatacactacatatttttgttatacttaattattttatttcactaacggtagaaattgcacttcattattttactaattttattattttatttccaatggttatacttgcttaattattttatttcacttctagtgggtgcttcacttaattattttatttgactatttcataagcaatatactattgatcattccgaacatattagtcatacagataacagacatgtagacataaactacgtacataaattacaaaaataatccttcctcatggtcgacgcgtgcatattgaacgttatcttcttcttcctcctcttctagaggtatttcttgacctatgccgtggacgtgctggttgtaatcatcctcttcaatattgtccaatccaacaattccccttttcccttcacgaacaacatgtagtttcttgttacacgggtcaactatgtagaacacttgaacaacttgtttggcgagaacgaacggttcatccttgtacacgttgttagccaagttgacagtggtgaaaccttcattgtcaacttttacattacgaagatcgacccatgggctgcaggaa

SEQ ID NO: 54514 - DNA, 1562 bp, Oryza sativa
acctagcaattcggttcttcagccactcgttgaaagaagacatgtgcttatttctgacccaactctctaatcggcctgggttctcctgtcggagaactgcaatgtgttcgtcaacgtacgacaccacctcagtcatatgctgcagtaccgtgaaatgagctttatcgtacaccttcccatccaacctaacagtctttctttcaacagtaccaacaccatcaagcatccctttgtgatgagatcgtggtaatccaattgaagatgtttctgacatgtagtccacacaaaaattgatgacctcttcgatagtgtaactctcgatgatactcccctcggggtgtgaacggttccgtacataacccttaaggatccccaggtacctttcgcaaggatacatctgcgtcaataatgctggaccgcagcactttgtttgcctcacaaggtgcacaggaagatgttccattatgtcaaagaaagtttgaggaaagtacatctcaagatgacatagggttctcacaagttctgcctgtagttcatctagtccctcgggatcaatgatcttctggccgattgcatggaagaaggaacacaaccgctggatcgtgtgtcacaccttaggaggcaaaatattccttattgcaacgggcaacagctgtgtgataagaacgtggcaatcatggaactttattcctaccaacttaagatcttgcagtgaaacgagcctactgattcttgatagtaaccagatggaacctttataccactcaaacatgttagcaaatcaatcttttcttctttcgagagagtgtagcagactagaggaaggtaaaccctgccggattccgtagttatgggatatagttccgagcgaacaaccatttcttccggatctcgtcgagcgttgacaccatcctttgtagtacctgggttaagcagtaatcccattaaactctcgcatacattcttctcaacatgcatcaaatctatgcagtggcgaacttcaagatccttccagtatggtagtctccaaaatattgacttctttttccacatgctcctctcttttgtcttttgttttttcacatgctcctctgttttttccttcgacatgctcttctcttttgtctttccaactttcctcttttttccaaactcgttggttattcccatcactaagttgtgcacctctgtccctgttagctctgccgggggtccggctgtatctctgtgtccattgaaattctttttcatattcctatacgggtgataccttgggagaaatctcctgtgacccatgtagaccgtcttgtgtgaatgcttcaaccatttgctttttgtttcctccatacactccgaatacgcccatttctctttcacagtttgcccagaaaggttgccaagggctggataatcgttgatggtacaaagcagcatcgcatggaggttgaaatactcttgtgcatatgcgtcccatgttcgtgtgccctcattccatagcctttcgaagtcatcgattatcggttcaaggaacacatcgatatcgttgccaggttgtctcggtc

SEQ ID NO: 54515 - DNA, 13905 bp, Oryza sativa
tttactgctgtcatttccttcctacgaaattcctcatcaaacaattgccaccaaaattcaatctggcaatcttttctttcaggccatgtgctgtgcatagaactggaaatgtataaaattttcaattatcaaagaagaaacctatgttcactactactactacagagcacctaatcgaggacggcatcatacgttttgttttatctattccaaccgaggcattttctcttcgaatataaaagagtacagaactcgttttatggtaaagcgttaaaggtacaacatttaattagcattgcctcttgttgacaattatatatgaggtgatacgtggtcacacgaataacaagcagtgaagcgtgcacaaatatgtaaacttaccctttttctttcccaaaatcatttttgtacaacgtactaaatttttcgaccaattagatctgacaagcactaaaccgcgtgtaaatataaagaactaaagtcccccaagaaacaaattaaaaaaatactaaaactacttgcgaatgtatatgtatatatatatatactccatccatactcgtaaagaaaatcgtttatgacaatatttaagtcaaatcttaggaatataaatcatgaatagctctcaagtttgtcgagtttgaaaatgtaaaaatttatatgaatagatttgtcttgaaaaatactatcataaaagtatacatatattatttttcaataaatatctttatagaaacaagaagtcaaattgtattttgaagaccgtgtcgctatccaaaacgacttcctttccaatccgagtacggagggagtaattcagtacttattcccctaaaattcagtaattactaaacattcctacgagcagtttcatccaaagtacttagcatcttcacaccaaaagtcctgttggtaataaatattcaacacggctataactttcgttcttcgttaaataaacccataatttcaccaccaaacacatccatgtgcattggaaacttcatggctaaaggcgtgaagcatcttcggaatcttcaccaaacgagaacgaaactctcttggattgccataacacgaccgcgaaagaccaaaatcattttagtcattgcccaatgaaaaacatcaacttgaccaagcgctcacttatcattgacgtacagcatctatgtcagtcaccagcgacctcattaccagaagtcccccagcacgcattgcacaagttaattaatgtgtggaccagtaagtaaaccactaggcactagctccaaaaaaaaaaaaagctttagaaaacgacctgatctcacaccaaacgcatgtcaatccgtctatataagtagccgttgctagaagctgccatgtatatagtcctaaccaacagtcaggaacagcaacaaaagtaagccaagaatctctctgcctcccaccaacaaccacacacactcacagctttggtcatggaggtcacccccaaccacacgcagaccgtctccggctgggccgccatggacgagtccggcaagatcgtgcccttcgtcttcaagagaaggtataaagaaatgagcaagaagtgattgatatttggatagatttagatgtagcttgttgttgagaatgagatttattgcatgggtggttgcagggagaacggggtggacgacgtgacgatcaaggtgaagtactgcgggatgtgccacacggacctgcacttcatccacaacgactgggggatcaccatgtacccggtggtgccggggcacgagatcaccggcgtggtgaccaaggtgggcaccaacgtggccgggttcaaggtgggcgaccgcgtgggcgtggggtgcatcgcggcgtcgtgcctcgactgcgagcactgccggcggtcggaggagaactactgcgacaaggtggcgctcacctacaacggcatcttctgggacggcagcatcacctacggcggctactccggcatgctggtggcgcacaagcggttcgtcgtgcggatcccggacaccctcccgctggacgccgcggcgccgctgctgtgcgcgggcatcacggtgtacagccccatgaagcagcacggcatgctgcaggccgacgcggccggccggcggctcggcgtggtcggcctcggcggcctcggccacgtcgccgtcaagttcggcaaggcgttcggcctccacgtcaccgtcatcagcacgtctccggccaaggagcgcgaggccagggagaacctcaaggccgacaacttcgtcgtcagcaccgaccagaagcagatgcaggtaattacatacgaatatacgattgaactccaaggcaacctcatcatgtgcacgcataagattaattagttttttttaaaaaaaaacgaaccgatcgcaaacgtgtcaatttcattggaaataataggagtaaaagttatcaatacaagtatgaaaaaaacctactatatgagaagtaagaacactacgacagcataataagcgagatgtgctttgcccctgctatcgctcaagttctgccttccttaatctctgctcctaacgatgtgaaaaaaagaaaaaggctctttgcgctgaaaactccccggggttatccgctctccttccaaacctctcacgcgaggattagtgtgtggaattcttttttcggaagttctttagccgtcattcaagattagtggagtactaatttaattaagcactgaactagttaattacttaatttactgcaataaattaggctatgacgaggagccttgactacatcattgacacggtcgcggcgacgcactctctgggtccgatcctggagctgctcaaggtcaacggcaagctggtgctcgtgggcgcgccggagaagcccgtcgagctcccttccttccctctcatcttcggtgagcatttgagcaatcacccatcaagttaatttaattactactacgctacttagtagtatctgccaactaatcaatcaattaattcgtgggttgcgtgcaggtaagaggacggtgagtgggagcatgacgggtgggatgaaggagacgcaggagatgatggacatttgcggggagcacaacatcacctgcgacatcgagatcgtgtccacggacaggatcaacgatgcgctcgccaggttggcgcgcaacgacgtccgctaccgcttcgtcatcaacgttgggggcgactccaagctctagactcatgctactatcatattgctacctagtaccaacctccatgcctttcttaatttaatttattggaggctctgcacgcagaatgggacagttcgagctgtcgttttctcgttggccacgtgaagtaactgtacgcactttgtacttattcgagaaatgatcagtgataaatcatcaatggccttattttattcttaattagagcaagtttaataatatagccaactactaatttcaaatcatctagagtcaatgtaatagctaattcatacaatagttacttactatactattaatacctggtccaacctatcatacacacgttacgtcttgaagtccatgctgcagctggctacatatttttagtccgttgctcttcttttttttcctttatctttttaaaatatatttataaatggcttagagccttgctattgtacctgctcttaataagctatgttttgatctctgaaacgagccatgaactgaacatatgttggtcctatgttacgatccaacacctgccatagtaatgcgtgtgcacggcggtaatgatgagaaatcgagctgagctattgagtaaggggattggccgattgggtgtagctagctagccgtctagaggaattacaggtagaagagagaagggaaaagtacaaattaccctatgaactatcacggtcggccaaatttcccacatgaactcgaaaaccggacattactcaccctaaactttcaataccgaacgaattacctccctcgacccaatccagagcagttttgtcctacgtgacgtacgcgtggcaacctagtcagcattttctttttttaaatatggtggggcccacctgtcattctctcctatcttctccttttcctcttcccctcttcccccctctctctctctcgcgacgtcaggcgtggtcggcacgcgagggccgcgatgggcggcagcgggttgtcaagcgtggacgcgcgcgggcggtcggcacgcgagggcagcggtgggcagcagcgcgtcgtcaagcgtggccgcgcaggcgatcggtgcgcacggcgccgctcgagggcaggtggtgggccgagaagatcgatccggatcctctccagcggccccgtctttttcgttcttggtcatcaggagagatcgatctccttggttttgtcattgtcaagcagcagcaacggcacctcgctagctaggtcaggggcgaagcccaatagaggcccgtgggtgcagatgaacaccccttaaaaaaaaatttagttattacccccatatctctgccctaacaacagtccagttaacgttgtaaacccatgaggagagtcaaatccagatcaatcttttctcttctcgacttctcgtatgccgcgtcccgtcgctgctaatcttgacgactctgcctcgcgtctgtttggcttccacgccgctgctctgcaatcagccaatcccagtctcccagacagcacttgcccatctcggcaccacgacgcgctgccgtcggccatcgccctcggcagctcgccgtcgccgtagcccctgcttgcttagcgcctgcattgcttgctccagccgcaggagccgggaaggcaggaagccggtcgccaggcaaccagctaaccaggagcaagcgtcagaccacactttcacaagccatgaagccaacaacgacatcatccatctccatcaactgatcagcacacagccacattgtgcattagtagagacaaggtaagaaagcatgcttcatctatttcttttttaatcaatttgatttattagatacaaaggcctaaaatttttattggttgtttttttttacattgtagaattaggaggccagtagggttcaatttggaatccttcagaattggaataaaattgcagattgggggaaaatttgagaatttgagttgaaggtgctatttggatgtaagtcatatcaattttcaatctacttctgtacttgaacgaatgataaaatcagtatatatttacatcctcctgaatcatctaatgataggttaattgatggaatgattttacaaaaggaaagtgccaaagccgaatagtgctaacaatgcatgtaattcatgtttggatgatataaactgggaagatgagattaaatatgatccaagattaagaaaacaaattgatgagtaccatcataatctcagagagagggtgagaaggaaatacttagagaatggcccttgttaacctcgcacatttgcttttcctatgacaggttcaagaaggtttgtcccggaatggtttgatgagtttggaagttggcttgaatacagtgagtccaaaaatcgagcatatattgttttttctgtttcttgtttagagaaaagaaggatggtggatatgaagcatttgttaaaaatggttagaatggttttcatagaaaagaaaggttgaaattgcatgtaggtgatgtcggtggttcacactatcaagcaatgaagaagtgtgatgatttattacaaaaaagacagcacattgatgtagcttttcatagtgtgagagaaactggtaagagggactatcttactcgattgaatgggtccattgatgttgctaggatgctagtaaagctaggattgcctttccgaggtcacgatgagtcaaaggagtcctacaacagaggcaacttcagggaatttcgtgattacacagcggagcaaaatccatccttaagaaaggcaataggtacaaaaaaatcaaataacagtcttttggttgctcctgaaatacagagggatatcgtgaaatgttttgcaaaggaagtgctacatgctattctagaagaaattgggcatgatgttttttgcttgctagttgatgaatcaagagatgtttcttgcaaagaacaaatggtagtggtcttgagatatgttgataaatagggaattgtgagagagagatttattggtcttgtccatgtgactgaaacaacttctgcctatctcaagttttctattgatgctctatttgcagaactaaagctaagtctaaagcaagttagagggcaaggatatgacggtgctagcaatatgcgaggtgagttcaatggtttgcaatcattgatcatgagggaatatagttcagcttattatgttcactgttttgctcaccaactccaattggttcttgtggatattgtgagaaaacataaagacgttagtgatttttttactaagatttccatcttactgaatgtggtgggtggatcatctaagagaagggatttgattagagatattaatgttaaagaaatgagtaaggcattgggttctgggcaacttcaaactggaaccaggttgaatcaagagcaatgtcttcagagacctggggatactcgatggagttcccactataaaactctcaaaagtttggttggcatgtttgctacaatagtcaaagtgctagaaattgtggaaaaagacaaaaatgattggaaaattagagatcaaggatcgaatcttttggagtacttccaatcttttgattttgtcttctatttgcacctcatgttgactatattaacaatcacaaacagcttgtcactagcattgcaacggaaggatcaagacatagtgaatgctatgaaatgtgtaaagtcaactaggctcaatttggatgagcttagaagagaaaagtgggagaaagttctagatgaagtctctgacttttgtgacaactatgatattgtcaaattggaaatagaagatacatatattgatcccaagaagcgtaggcacaaatctggaattacaaacaagcattactatcaagtggattgttttaatgatgttattgattggatacttcaagagcttgacaatcgcttcagtgagacaagctctcaattgcttatttgctcatcggcttttagtccaagagactcatttcatgatttcaatctagagaatttgatgagtttagcaaaattgtatcctagtgattttaattctggaaatttgagggaccttagccaccaacttggtctctacatcgctgatgtgagggatgatggtagattctccaacatacaaactattgccgagctttctcaaataatggtggagacaagaaaacatctttgttatccattggtttatcaacttttaaaacttgtacttgtattgcccgtcgctactgccacagttgagaggtgcttttcagctatgaagaatgtaaaaacatatttgcgcaataaaattggtgatgagtacttaagtgatagccttatttgttatgtggagaaagaagaaatgaagaaagtcaccaatgaggccgttgttcgtcgcttcatgaaaatgtaaggatgcagatttgatgatgattgaaggtaatgattgtatctaagtgcgctggattctactttttatttgaaaaatgagaactgattttgatgttaacttgttttaggttatcaaatcatcgtcgaggatgttgagataatgaaatagaacggtgtttgcttatgtttgcatatgcagatcatcttttgctcatgggttagtaaccaattctcaattatcaatgttattagtggatttcttaattttgtaaaacaatgtttgtcactttttttattttattgatgcatgtgtgtctctacagttgatgtaaaaaaattattaatcaacggttctatcgaaaatgtagcttgaagttatatatattgatatacttgtggcaaaatctcgaacccccctccattttgctctagcttcgccaccgagctaggtcatcgtcgacggaatctgctccgccccctgcgcaccgaccgtcttcgccgcgaccgcggtcgaccttggggcctccagcccagacctcctccttctccggtcgtcgcgttctcctggaccacgccgtcggccggctctccctcgctggcgttcgttggtccgccaccgccgtcgaccggcccaagccacagtgtcctctgcgatgagccagcgctggcgactggctagggtgctcgttgctgccgtcaggacttggccgcttcctccatcggcaccgcctcctggattttgcggcgcaatcagagccgcctgccacgctcgcgtcgtgcacctagtcgcgctcgctgtctggagcccatcgccgcgcatgcctgttgattttgcaaattggccggggaagacaatgagaatccaaatgtctcgccatctcgatcacacccatgttacatccatcgatcgcatcgtcatatactacatcattaatgctaatcatctcttcaattctatcaatgtccgttgtcatcgtcgtcatcaattgtctattctgtaaccgtgtcctagctatagctaaagacaaaagacacaatcatcccctgacgacgcgctgccgcccatcgccgcccccgcaggtgctggggagcttccggccgacccccgcctcactgccatggccgccgccgtgcgcaaagctcgctcctctcgacctccccttccacctccatttcctccccttccccatccacctccgctcccccctcccccatcctctcaacctccccgcgcgccaccgggtgcaccgacggtcgggccgcccgcgtgcgccactgcacaccgcccgtccctcgccgatgccgtgcgcgtgacggccggcccgcccccgcgcaccgttggccaccggcgttgcccaccgcccctctccgcattgcgtcgtgcgtgccgtcgcccgttgaccatgtatgaacagaggaagagggggtatgacatatgggtcccaccattttttttagaaaaaaaagctgaccgggttgccacgtatacgccacgtagaacaaaactgctctgcattgggtcgaggggggtaattcgtctggtattgaatgttttgggtgagtaatgtctggtttttgggtcaggggggatttcagctgaccgcgatagttaggggggtaattcgtactttttccaagagagaaacagagtggtgggcgaagaggatttgacaaacaggaaatatgcatgacatttaacttttcgtaacttttaagatgtggcaattaattatttccaaatcatatagaattgttatatgaacataaatacatgcagaataatgagatattcaaatccatttaatctagtctaataacatgccaaatcatagaattgtggtatgaacgtaaatacatgatacggcatagatgcagcgatactttatgtaaaaatcaacaaaatgatatgataaataaatatttagaataagagtatttgcatctcactctcaagacatgtcacgcccggaatttctatccaaaattccaaacgcttacatgtgtgtgaaccctcgtccaggaatcagccgaggcacacaataacaaattgataaatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacgactccactccacaggcagcttgaccagggctacacctaatcctccacaccatcagcttcactgtagaactcctcctctgatgaatgattgcaaggtgagtatatgacatactcagcaagccacgtagcaaatatacaagtgcacaaggataccaaaggatggcatagtagggtttcatttgcaaaagcagcatttagcaaacatttaagattttaataaaacagttaagtaataattaatcaatattaatccaacgctatacaacataccctgttgcataggcccaaccattctgaacaaccatcccggctgcacagttctatctccaaaccaggaatataccattccaaaccaggagctaaacaaattattaccagttaaagcatcttttattatgatgagaggtgtgagactaatcacgaaaaacattgttagacccgcccataaccgcgggcacggctattcgaatagttttactctgatcagaggtgtactactgcacccacaagacacagccccacatcatgtcaccatgtgccccaataccactacggtacctcggaaaggagctgtgacaatacccctcgcacaacacaatccactacagcgcacctttcctggatcataatcacccccttataaacaaggcatggactccccagcgacccccgtgggcttatctccgccacttctcagtctggtgccccgcaatgaaccatgctatacaaaaggtaaagccgttgcccacgctggtttgtggttggcacggttaatgtttcacaacagaagctcgcgaaccggtccttaattgccatgagcacgactctcaaaaccatgtgctcacaacccaccattatcaagttttagttggcacataaattaattaaccaatcacgattgaccatcgtgagctatcattaagccatcattaaataattaatagtaaatcataagttatcccaatagtgtgctaatgtttctaggcatggctaagcaatcacatctaatatctagtcgaaccaatatatatatagcccaactagtcaagttaaaataacccaaggtatcaaggaataaagtaatcaatgcaaacaggccataacaaaggaatagtttcacaccacccagtgacattcgaaaataaatccacagttgaattaaatagagaatttaaatataggatcaacatgctcaaaggattgtatttatgatctgtgtgacttgccttgctggccttggaactcttcaaattcttctcctgcgagaacggactctccggaaacgtcggaatctaaacagaaaagagcaaaaacaccaaaacagcacataaacaagcatggacagtatatgtagatatttttaacatgtagatctcaattttagaaaaaattagagacttgaaccaactaaaaccgagctaagatgaattagttatgaatttttaaagattaaatcgatttaaatcacttttatggattttaattgaattatgacgcaataatgaattatttttgaaaaggaaaaaagagatttattgcgtcagcggctagggtttgcggtggaccgggcgcacgacagcggttcacgggaacggacggccgagatcgatcctatccaaaacggacggccgagatcgatcggtccacgtccggctcacagcagacggccacgatgacgtcagtggtgacgtcatcgccggcggcggcagcggctcggcggcttggcggctcgggcgcgcaagcttgccggcgaacgacggtgcggcggcgcgaacggagagcacccacgggtagcggacggcgcggcgaactcaccggtgaccaaagaaacggcggaggagcagcggacggtgacggcgacgaggttgaagcggcggagaccttcggcttgacgacggcgacggtgctccggcggtcttcagtgacggcgaaggggcggacgaggacggcgacgcgacggcgaccacgaaggcgacctccgcgagcgacggcggcgcacggctggagcggcggcaacgacggcggcgcgaggtcccacggcgctagggctcttccgacggcgagagacgaaggcgagggtggcgacgggtagaggagacaccggggatccttttaaaggggctaggaggcggcggcgaaggcccacggcgacccgcggcgggatggaaagctcgggctcagagagagagagaccgatccgaatcgacctcgaatcaaaaggtagaggagatcccgaagattgtttcccctcaatcgatttcaccggatcgggaaaggagcggccggatttggaaggaaacggcggcggcgcggcactagggtttcgggcggcggcgacgcgaggaagacgacgggtccgacagatgggccccacctgtcagcgaccgggcacgcgcgcggctgcggactgggccgacttgggccgggggaagagagagagagggttttgggccgactttcggcccaaagccaaaagagacttttaaaaacctttttcaattaaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatatttaggatttttagggtgtgacaaacctaccccccttaaacagaatctcgtcctcgagattcggaagaactggcgaacagatgcggatgagctgacttcaattcatcttctcgttcccaagttgattcttcttccgaatgattactccattggactttgcaaaaacggataactcgatttctggttcttctctcatctatttccaagatacggattggtctctcaacataggtcagatcctcttggacttctatttgttcaagattagcttcttcggtaggtacccttaaacactttttcaattgcgacatggaacacattatggactcctgccaaagattgaggtaactctaactgataagcaacctctcctcttctactaacaatcttataaggtcccacaaaacgcggtgccaactttcctttagtgtgaaaacgatgaactcctcgaagaggcgtgacacgaagatacacataatctccgtcgtcaaaactcaaatctctgcggcgattgtcggcataactcttatgacgagactgggccacacgcaatctttctcgaatgattttcaccttttcttctgcttccctcaggatatccgtcccgaaaacctgacgttctcccgtttgatcccacaaaagcggagtgcggcacttccgaccatacaatgcttcgtaaggagccatctgaagactagcttgataactgttgttgtacgaaaattctgcataaggtagattcttatcccaacttccaccgaaatctaaagcacaagctctcaacatgtcttccaaaatctggttcaccctttcggtttgtccgtctgtctacggatgataagcagtactaaagttcagcttagaacccatctcttcctgaagcttcttccaaaaatttgaagtaaactgactgcctcgatcagacactattttcttagggacgccatgcaaacacacaatccttgccatgtacaattccgccaaccgacttccagaataagttgtctttactgggatgaaatgagccactttggtaagtctgtcgactatcacccaaatagagtcatggcctgatgacgttctgggtagaccagtgatgaaatccataccgatttcctcccatttccattcaggaatcttcaaaggctgcaacaaaccggcgggtttctgatgttctgccttgactcgctgacaaacatcacatactgctacgtattctgcgatttcacgcttcatacttgcccaccaaaacctttccttgagatcctggtacattttggtactaccagggtgaatggagtataaagtatcatgagcttcttttagaattgcatcttttaaatctttgttgtcgggaacgcagattctctcgcccaaccatacagttccttgctcatcttccaagaaaccgatagcctttcctcttctcatattcttctgggctgcagg

SEQ ID NO: 54516 - DNA, 2299 bp, Oryza sativa
tcacacaacacaatccaccacagcgcaccgttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccgatccttaattgtcatgagcatggccatcaaaaccatgtgctcacaacccaccattatcaggttttagttggcaatttaattaattaaccaatcatgattaaccatcatgagttatcattaagccatcattaaataatagtgagtcataagttatcccaatagtgtgctaatgtttctaagcatggctaagtaatcatatttaatatctagctaaaccaatatataaagcccaactagtcaagttataataactcaacgtatcaaggaataaagtaatcaagaacaaaagggctttaacaaacaataggttaattccacccaatgacattcgaaaataaatgcaatagttgaatagaaacaatagctttaaacgggatcaacatgctcaaagggttatttgcgatctacgtgacttgccttgctggccttggaactcttcaaattcttctactgcgaaaacggactctctggaaatgtcggaatctaaacagaaaagggcaaaatcaccaaacaacacataaacaagcatgaacagtacatgtgaatatttttaacatgtagatctcaattttagaaaaatttagagacttgaaccaactaaatccgagcaaagatgaattagttatgaattttcaaagattaaatcggattaaatcatttatttagattttaattgaattatgacgcaataatgaattatttttgaaaaggaaaagggaattattgcgtcagcggctagggttcgcggtgaaccgggtgcacggcggcggctcacggaaacgaacggccgagatcgattcatccaaaacagacggccaagatccatcggtccatgaccgggccacggggaacgacgacgatgacgtcagcggtgatgtcaccaccggcggcggctcgggcgtgcatgctcgccggcgaacgacggcactacagcgcgaacggagggaaccaacacgtagagggcgacgcggcaaactcaccggtgaccaaaacaacggcggaagatcaacggacggcgacggcgtcgaggaagaagcggcggcgaccttcggcttgacaacggcgatggtgttccggcggtcgacagcgacggcggaggggcggacgaggtcggcgacggcttggcgatcacgatggtgacctccccgagcgacgacgacgaccggagtggcggcggcgcacggctggacgaacggcggcgacggcggcgctaggctacacggcgctagggctctaccggcgacgagaggctaaggcgagggtggcggcgggtagcggcgggcttgggggtcaatttataggggttaagaggcggcggcgaaggcccacagcgaccggcgacgcgaaggaaagtctagggttcggaggagagagatcgatccgaatcaaactcgaatccacggattttcaaacgattttagccgacgattccaaaagagaaaaggtagaggagatcccgaagatcatttcccctctattgatttcaccggaaaaggaaaggggcggccgaatttagaaggagacggcggcggcgcggcgctagggctcgggcggcgggcggccgaaggtagactacgacctgacaggcgggccccacctgtcagcgtccgagggcgcgcgcacgcggctgctgcgggcggactttgccggcttgggccggggagagagagagagaaggttttgggttgactttcggcccaaagccaaaagaggattttaaaaacctttttcaatttaaactattcattaaatgcaattccatttattaaaaatacttccttagctcaaataaatcccagaaaaatctaggaattatagaattaagcaaagtatttaatgaaattttatctggccctattttatattggaatttattaattaaaactagatcttctcttctaggcttttaaaataaattctaataattccaatttagacaacaatttatatatttgggatttttagggtgtgacaagaaggaggctctgtaccaacttgtcacgaccggaaataacccaacgggcgttccttacgtgcgtgtattattccttgtcccaggaggcaaggtacaccaaaagttgat

SEQ ID NO: 54517 - DNA, 12667 bp, Oryza sativa
cacgtgccacataccaccacggtatacagacggaagacgtgacatagtttccaacccatcctagccatagacaagagtaccgacccaatcccacctacggccggaacacccgggacaggcaggcaggactgagcccctagcagcaggacaccagccctgtgccatgacatctcgactaccaggccgcagctcgtgtagccttcatttgccctagaaatgtccatcgacccccgacttcgtccatctccatccgtgtacttttgtttataaccagactgagccacaaactaagccttacccactagacatgtggtagtacggtagtgcttttcaacagaggcccgaagaccggtccttatgtggccgaggtgctactatcaaaaccatgcaccccgagcccagcctaaaaccattttgaggattttgaatagagggggaggtgtgaatccgattccacaataatccaaccattccatagtgtccaggtgacatgaatattcccaaagtctagagttcaatatgttcaaggatgatgtgacttgccttgctcgctttcccaaacgtcggcttcaacctccacgtagagcggatcttccgaagctgcagcgtctacacgaccaatgaaaaggaaaaaggcttttactctaataaactccatataacaagtaggaacaaagcacaaaaatgggttcttgacttcttaagaaaaaattagagacttgaacggtccaattccgagttcaaatgaccaacttagggccatttgaagtttatatgctctttaagtgaatatttgcgaatttcttcatttaaattttaatttagaaaggatttattgcgtcagccgaggggagagggcgcgcggaccggtccacgggagtggggcccacgcggcagcctcacggtccacggtggaccgggtgcacccgggctcagaccggccggcgccgtgggccccacgcatcagccacacccaagggcgcgggcggctgacggccgggccccacgcggcagccgctcggcgtgcccgaaggcggccacgtcggcgcgaccggtgggagggaaagggggacacgaggcggcggtccacggctcaccctaggtcgacggcgatgacgaaaaaggcggacggagcggaggaaggcggcggtacggctcgggtcgacggggagggcggcgctctggcggtcagcgagctcgacgagggggtgcacggggacggcgacggtgcggcgaagccggaggaggcgacgccggggtgggaaacggtcccggcgagcggagaaggccggccggaggtcgtcggcgacggaggagagagagggcgacggcgcgagctcgattccggcgaggagacggtgtggcaaggggcggaaacgggcgagggaggcgcggggagggtttaaatagggttggaagggggagagggcggccggggaaggaaggaaaccggctgggaggtccggccgccatcaatggcgccggcgagatttgcaggagcaaatccggccgtttgaatgcaagagagagagggaaaaatggggggaaagggagaggggatcacggggagtaattcccccctattgatttcacgcggggatgacgggaggcggtgggattcgcggcggcggcggcgctaggcgtgggcgaggcggcgggacgaaggagatgacgggtgggccccacccgtcagcgagggtggcgggcgggcccgcccgtcagcgacgcgcgcgcggggagaggccgagtgggctgcgggggaagaggagagagggggagggaagtgggccgagccggcccaagagagggagagagggtttttagggtttttctttttataaaaccttttcaactttgtttatttcttaataattattatttgtgctctgaaaattccactaaaatttatttacacattttaggcttttaggaaatatacaaaaatcctctaagccttatttgacttttacttcgcacattttaatttttggaggctttctcgaggattttaattattctaggcataatttaaaggatatattttagggtcgttttgggacgtgacacagccaatcgtccatcccatgatgaggacaggcggctatgtactcctgcagtcgttcctatgcttctggaatagattcgtcccttgtttgctggaaacttgaagtccttccacgaagggcattggtttttcccatcgggaagaatttcgagaggaatgtcgtagagcatttgtcccaggtattgacagcagcacggttggcacagaaatactgcttcgctctcccgaggaaggagaatggaaacagccgcagcctgacagcgtctggactgacgcccttgatggtgtacgtgctacagatctccaggaactgttgtagatgagcattgacatcctcattagtcttgccacagaatgggctagcctgtgccatcgtgatgaggctggacttcaagtcgaaatccacgtctcccatgttgatctgcggcccaatggccacattgtcagcagagggagcagcaaactcgcggagagacttgttagccatagtcttctgcggagcaacgactcacggcctgacgctccggaagaaagctttgtacgactggtttctttgtcggtagagttttctgcggagcaacgactcgcggcctgacgctccggaagaaagcttctggattttctttgaagttttccggcaagttgaaaccagtcatgatctaccctgatttcacaacaaaaagtgaaaacaaacaaggatagcctgcaaaggaaaatgattatatagaggtaaatataaagtattagttcaggaaatctatattatgaatcttccccggcaacggcgccagaaatgcttgttggtatttcttaacgacattactagaaatataatttccagcaatgacgcataaatacttctggtatattatggttacagagttcatccgcaagcgcacggatataccattgtagcatttcacccgagagtattccaagggtatcatattaattttatcccgtgggaagatcatgtagagagaacttgactaataatttatatattacttgtgataatcatattctaagcaggggttaagataatccaagggtagagtgacacacaagcattagctactcattcccataatatattatctgagctaagtggaaagaaaagaaaaagaaaatctattcctatacttgtaatatacacagtatacatacattttagttaaccgatatactagctaataccctctatctgataccctcctgctacttcgagaagccacccctgactaccgagttccttatgacagcccatcatgaccatacaaccggggttaaatacggaggaataccctccccagggaattaacttaggatgatataccggcgcggaggaatacacgtactgagctgtcaccatcaccagcccgcctgtcatccgcaatatataatctcaaataatgatatcccgtaatctagacaccacgcctaaactaccagatactactctaatatcatcgtcatgacatagagtaattgtatatgtaaacattatacccgcaccaaagcatctcccagataagctagccgtatattcagtataacatgaacataatgtaaagtaggcattcatatactcggaaagtattttaataccataaatgtatatagaagagtattctaataaaagtacaaagcttacaaaagagaagaggaaagctactagagccatacccgaactcttccgaaggcttccggactcctgatttctactctattcctattccaccagctagatactactaaactaaacttgagagaaatgagagagctattgcttgaggtgtgtgtgtgaagtgagaagagaagctccttttataggcaggtaatgatggttgtaacggttggaatggtcggtaataccctccaaccgttattggggatcaatcccagccgtccatccaaaccctgcatccatcggcgccatgggaggttcggccgaaccatgggctggcccaacctagcccatcttcggctggcggcctactttgttgtcctcctccatagacttgtgaattttggcccaatgtgtcatgttatttctgagttcttagcccattcatacataagtctggttctcgacaccgtccgattgatttatcgtctgagttgatgtcgattctcctccactttattgtcattctttgcaaaaggttagtatacctaatactagtggaatattattattctgaaatatatatgcattgcaagcatgactagttctcctttattttagtaatattgacggtcgaaactgatcgataacgaccgtcaacagatgcttaagaggtccgcctcaaaaaatagattttttttatggcagacctcttagcgtggccaccagcgaaaatcggttttcgctggcggtccatggccccccacccctcgatatgtttttgctgacggttttcgcgtgtggccgccagcgaaaataataggccaacgccatgaaaaatcgtttttctagtagtgagtgctactagtgttgttcgcgaatctggttcctttctcatttttctaagaacaagtgtatatatcacaataaccagttggtagaaccaaattcagagaagaacttgcattaatagctaggaacaattttacctaataattaagttcacaaactgtcaccgctaaaaatttactagtaatttccaaactaatttgtgcattaaatcgtcgtccaggaatcaattgaagtatacaaatatgcaatttgaatatacgaaatcaattgaagtatacaaatatgcaatttgaatatacaattccaacataactaaagcgataaatacttacaaaagaggctctttgtctgcaacatgaagaaaactgcaacggaaaagagaatcttgagaagcttcaactccactcccacaggtatctcgactgggatataaaccagatgtcttctcctttgaaatccttcttcaattgagattgatgattattgcaaggtgagaatatggaatacttagcaagccacatggcaagtatgcaagtgcacgggataacaaaaggtgacaataatagggcttatttgcaaagacagtatttagcaaattgttaaaattagtaaaacagtagagtacttaaatatcaatattaaacaactctgaataccatgccaatgcagcacaggcccaaaccattcatacaggttgtacaggtacaaccttcatacaggaactaaccattccataccaggagctaataaattataatcagttaccaatttaatatcattaatcaataagtttagactaatcatgaaaaacattattaggctcgcctataaccgcaggcataactattcaaatagttttactctagccagaaatgtaccaatgaccaatgtacccacaagacacatcctcataacatgttgtcatgccctcagtatcaccatggtatcttgaaaaggagttgcgacagtaccctctgcataacacaattcaatatagtgcaccgttcccggttcataatctcctcgtgaccccatgcactttatctccacttctcagtctgttgccccccaatgaaccatgccatacaaaaactatagccgtttcccacgctagcttgtggttagtcctcttagcgcttcacaacagtagctcacgaaaccagtcttttaattgtaatgagcatgaccatcaaaaccacgtgctcacaaccctccattaattaggtttagttgtcaaattaattaaccaatcacaattagccatcatgagctaccatcaaataaccatcattaagtaatagtgaagcattcgttatcccgaccatgtactaatgtttctaagcatggatacccatatataaagtacaaggtagtcaatttataacccaaagggtactcaatgcaaattggtcgtacaaaggagtaggttcacaccactcgatgacattcgaaaataagagcacaattgaaataatagagaatttaaatataggattaacacgctcaaagggtgttttaggatctatgtgacttgccttgtaaacaagtatcttcaattcatcttcgaaaacttctccaacgaacaagtgatcctctgaaacgacggaaactatactctaacacgcaaaataagaaaaaaaaacactaacagaaaccaaataaacagtacacgtaaagttcataaataggtagaacttgaatttggatgaattataagacttgaatgaccatattccgagttcgtatgaattaataaagttttaatcaattaaaagctataaacaaagcaaccaaatggcttatgacatcgtatttaattaatttaaaactgaaaaggataataacgatatcagcaatgagagaaaatggactgacgtcactaaaaagttggacccacgtgtaatagggagtattgcatgggtctaccatggacctagtccaaaaagatagcccacggtgtaccacagaaatcgacgtctaggattggttgacaaaagtttgacctagatcagactactctgatcaaacttgaactagggttaggacatcacaatgttggcaaaaaggtagcattaagcatttaatgctactaagttttgcacctttgccaatgaggagatgcaccataagcatcaccaaactaatagcctcatcttttcgcttatgtttatgcttataagccaaaatttgaatttttaaccgtaaatttggagttgattttgggggtttttcaatcgtaatttatttttcaacctttgcttttagatcattaagaacacgtatataaaaattttatttagaaattatttttcgtttgcaaatatatcgcaaacgatggactccttgttgacggtcaatattaccaaaatagaggcgaactagttatgcttacaatgcatatccttgttagaataataatattccactagtatttatttcaaaaaaaaatattctactagtatttggatcactaaccttttgcagagaataactataaagtggaggagaatcgacatcaaatcagacgatgtcgagaatcagacttatgcatgaatgggccaagaactcagaattgatatgatgaattgggccaaaattcacaagtttgcataaaggagcaatagaggaggccacctgccgagtttgggccaggtgggcccagcccatggttcggctgaacctcccgtggcgccgatggatgcaaggtttggatggacggctggtattgatccccaatgatggttggagggtattaccgaccattccaaccgtcacaaccgtcattacctacctataaaaggagctcctcttctcacttcactcacacacctcaagaaaagctctctcatattctctcaagttagtttagtgttatcaagctagtggaataggaatagagcagaaatcggagtccggaagccttcggaagagttcgggtatggctctagtatctcttctcttctcttttgtaagctttgtactttatttagaatactcttctttatacatttatggtattggaatactttccgagtatacgaatgccaactttacattatattcatgttatactgattatactgctagcttatctgggagatgctttggtacgtgtataatgttagcgtatgcaattactctatgtcatgacgatgatattagagtagtttcttgtcgcgtcccaaatcgactctaaaatacatcctcgaaattgtgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaaagttaaaaaggttttataaaaagaaaaatccctaaaagtccttttccccccttcctctcttgggccggctcggcccagctccctccctctctctctcctctcccccgcggcccatcggccttcccccgcgcgcgcgtcgctgacgggcgggcccgcccgccaccctcgctgacgggtggggcccacccgtcatcccctacctcgcgccgcgcccgccgcgtcgcccgtgcccaagcgctgccgccgccgcggattccgccgcatcccgccgcccccgcgcgcaataaagagggggaaatcactccccgtgattccctccctctttcctcccacttttccctctctctctctcggattcgtttggaaatcctcccgcaaacttcgccggcgtcattgatggagccgagatcgccgcgccggtttccttcccctccggccgccctctctcactcccaacactatttaagcactccccgtgcctccctcctccgtttccgacccttgccgctttctctccccatcggaatcgagctcgcgccgtcgtcctctctctccaccgtcgccgccgagcttcggttcgccgccgtcgtcgccccggacctcctcccgcttcggcatcgcctccttcggcttcgccgcgtccccgtcgacctcgtccaccccttcgtttcgcccgccgaccgccggaacgccaccgtcctcgtcgacccgagccgcgccgccgcctctctccgcttcggtcgccgttcccgtcgtcgccgtcgacccggggtgagccgaggaccgccatttcgcttcccccttccctctcctctctcgggcgccgctccgtcgcgccggtggtcgccggcggcgaccatcggggcgcgggcgcgccgcctcccgtcggccgtgccggcgaggccgccttcgggcgcgccccgcggctgccatgtgggacccggccgttagccgccagcgtcctcgggtgcggctgacgcgtgggacccacggcgccggccggcgcaagccgcgtgcacccggtccaccgtggaccgtgaggctgccacgtgggccccactcccgtggacccggtccgcgcgcccctcccctcggctgatgcaataaatccgattttaaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccggcgtttgggaaagcgagcaaggcaagtcacatcatctttgaatatattgaatcccaatttataaaattatgttgatttaaattattgcattatcgctttatttaaattcccgcgttatcactgttttatttagccatgcctatttacctttgttatgaccttaatattgttattgttattatttccttgttcaccctagaataaacaaaaccccaactagtggacactctactcatggtaccactagtatgattttaggtagatgcttcgctatttaattaggtaacattaggcggttttacaactctagactttgggatattcatatcacctggacactctggaattgttggatcattgtggaattggattcacacctcccccctctattcaaaatccctaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcagcccggtagtcgagatgtcatggcacagggccggtgtcctgctgctaggggctcagtcctgcctgcctgtcccgggtgttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacttgcttaacaactaaaatatggaatggttggcctgggttagcttaggacgagctgggacccagggtcgggttgccagttcggtctgaatcatcgtaggccttgggttaaggcaggttcgtgtgggttcacggccttgataaataatattgtttagttctagaatcgtgtttacaaaatagccctgagcaactaaatatctttaaatgctgtttactgcaaccctaacccctttatggtataactcctttgtactcccttgcatttattctgcacttgtgggtgtgtcttgttgagtacggtggttgtactcagtcttgctcaatttttcccaaccccagaagaggagttccaggaggatgaaggcttcggtgtctagctcatgcctgccgtcaagtgcctgtggtcgtcgccctagtcttccgctgtttctcgtttgtctttgtgtgtgctgggccttcgctgcccatgtaataaattaactatttacgcttccgcttgttatactctgaattgtatcaacttttggtgtaccttgcctcctgggacaagaattaatgcacgcacgtaaggaatgcccgctgggttatttccggtcgtgacatttctggtagtttaggcgtggtgtctagattacgggatatcattatttcgggttatatgctacggatgagaggtgggccgctgatggtgatggctcaatacgggcattcctccgtgcgtgtatatagtcttaagttaatttcctggggagggtactcctccgtatttagccccggttgtatggacaagacgggctatcctaaggaactcggcagtcagaggtggcttctcgaagtaccaggagagcatcggatagagggtattagctactatatcagataactaggatgtatgtatactatgtatattagtagtataagaatagattctctttctcttttctttccactgagcatagataattcatatgagaatgagtagctccttgcttgtgtgtcactctacccttggattacattaaccccagcttagactatgattattacaagtaatatataaattactagatcagattctctaccatgatcttcccacgggattaataaatatgatacccttggaatactctcgggtgaaatgctacaatggtatatccgtgcgcttgaggatgaactctgtaaccataatataccaggagtatttctgcgccgttgctgggaattatatttctagtaatatcgttaagaaataccaactttcctaaaatgcacctttagcttaaagtgtggccacaagacatcaaaatatgagacttaccattcatactaataaaatgcattcacattgaattgtttttatcgtcattccattaaattgtttatttgtagctatttgtttgccacgcagaaccttttatttatcgtcatcccaatgtgacccaccttattttcttaccggtcacaagcattgtacatatggctcttgtgactttttccagtgggttccacttctattgctcatggtgccacaagcattggccttgcccttaaggacattcacagtgcacacacgtggtatgtggcaatattaaacgcttctgtggacgcgaaaggggagtggggacagtaacttcactaggttcgcgcaaccaaagttggtaacgagagccctgcaacaatttcatcagaaaaaaggaatcaaattgcgcgtaacaagaaagcgagagagagagagagagagagatgaagaacggtgtctaatagattgcgccggagaatctcaccggagagggccgcggaggtggtgaagcggcagcaagcccgaccccgccgacggtgcccttgccagctcacgcctcctaatctgcgtcgaaagatctcaccgaagaagggagaggagtaggggtgtcggcactgcctgatttgcccatagctcatgtggtggtgaccggagcggaggaaggaggagcggtcgtcggttcgatatggttagcgcggccgcaccgctggggagctcgtcgcccacatcgccagagggtttttcgatcgccgcttggggggggggttccttgaccgtcggtgctgcatttattctgggtagccatgggaggagaggaatgggcggtgccacgatggtggccggagattgcaggaaggggacggtggtggtgggttgcggctcgatctgccccatgcaaccgcgccgccgagggaggaggccgtagggggataggaagcggcggtgccgcggtgatggccgtagcgggggagggagagggcatttgtcgtgggcggcgacactgtctgccccgcgcggctgcgctgctagggagctcctctatcaccgccgagggaggagaccggagatggagagggaggagcggtggtggctggacatggagtgggag

SEQ ID NO: 54518 - DNA, 2447 bp, Oryza sativa
agaggaggacacaacgatccttaccactacttacacgaagacggacagtgaagggagaagccggtggcgagctttggaaggcagaggtcttcgggacatgccgacgacggtgctccgactatcctcggtgaagaagagagagcaactgaggttctccttggcggtgtgataccgacggtggcttcggcatggtcgggcggtgatgggatcagcggttggagatgcggcaacggcggactgcctcgggtgaatggcgacgaaggccttcctggggcctttgttggacgggaaatggaggcagggctttggcttgctgttgcagtacctacagtggaagtagcgcagcttggagatgcccgaggtgacgacgtgacacgaccgaaaatcggcggtggcggcggacagagaagacaagcgccgcggcggctctagagcacgggaaaaactcgtgttagggttggaaaagagagaggaggtctggggcatgctatttatagccaaaggaggaggagatcgaccttgacacgagagaatttgatggcagaagagctagggttcaaagagaaaacagaactcaaatcacacatcgaatccacgtgatttactacggaatttcctctgactattgagtggaaataaagaggagtatgacgcgaagaaatcccctcaaccaatttggggaaaacgaccacaaggccagtcggatttggtggtggagtcaggcggcgttgggctctgctgggaggagtccggccagaggtaggaggcggacctgacatgtggggttcggtcccacatgtcagcgggatcagggagaggaggcatggaagggacgcaaggtggacttgcagtgcgaaacaatgggccggcgtggtggtgtggctctgccaacaacactaactttgcattttttacaaattagttcttcatattttttgatattatgcaatagtctaatatttgtttgaatcaataccatacatagaaaattcgaaatgacattgacaattgcccaattacaagaaataccatcgacaagtgcaatttgccattctacagcgactttgtcctataaatgccatcgtcattagggttccacccatcccgccccattaaatgtattgttcagcctatagctcttaatggagggctactaacggaaccctaacggcgatggcacactacgccagaaccctacatctgtgacggcataccagtgacgggcctatgaattggtcatagatgaccgtcacctttgacgggtcgctaggtttgccgtcatcggtgaggcatccgggcgtagcccgtcacaggtattccctcacctgtgatgggccggaaggaaaagccgtcacaggtgaggaagtgatgggttttcctcccaacccgtcacaggtgagggtatcccctcacctgtgacgggccgtggcattatgagccgtcacaggtggtagtccgccacctgtgacggattttttttacggcccgtcataggtaggttaatacctttgacgggcaactcaattgaagcccgtcaaaggtatgaccaacacctttgatgggcttttttaatctaacccgtttgaggtgtgttgggtctataaataccccccaaaccgccaactgctttccatcccgaccagttcactgttcacaaatcggttgggagggcaaggggggcgattttttgctaaaatttaaggtaaaaaacacattattctccattccttctcaatatattgatcatcatatatttttcttcatatgttgttgatttcagatggatcgtagatggatgtactatgcacatcgttcgtctaccgagtatagagaaggggtcactgaatttgtcacatttgcggataatgacagaaaaagtaggatgagcatgcacatgttgtgtccatgtagggactgtaagaatgaacagatgatcgaagatagcgatgaagtgcatgctcatttgataatgaatggattcatgaagaaatatacctgctggaccaagcatggagagcaagaggcgcctgattgtcacgcccggaaattcactagtaatttctgaactttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttatcttcaactgaggttgattgattattgcaagaatgagcatatgacatactcaacaagccacacagcaaatatgcaagtgcacaaggataccaaaggatggcataatataggctcatttgcaaaatcagcatttagcaaaacatttaagagaagtaaaatagtggagta

SEQ ID NO: 54519 - DNA, 4910 bp, Oryza sativa
cacactcatcaatgaatttctccaatgatgggaatgcacccatacctacacacaaagcaaacaacaaacgttctaccctactaactattcttcaaagacactttggcggcataggttctaagataggttccaaacttcactctatctgaacacttaagattcgactatcatcttcttattcctcgatccacttgacttgcagaagttgacaacatcgacgtcttcgagtttctccatcaagattaacgactactcaagttgaaagaggaagggggaagaatgacaaaacgatttgcaaagaattctagataagaaagaaaggaaaattttcacaaattatgttttcggaaaattagtccttaaggtttgaccatttggcttatcctacagtcaagatggctctgataccaacttgtcacgcccggaaattcactagtaatttctgaactttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttatcttcaactgaggttgattgattattgcaagaatgagcatatgacatactcaacaagccacacagcaaatatgcaagtgcacaaggataccaaaggatggcataatataggctcatttgcaaaatcagcatttagcaaaacatttaagagaagtaaaatagtggagtaattaatcagaaattttaatcaacactgaacagcacacccatgctgcacaggcccaaccatcctgaacaaccatacccggctgtacagatctaactccaaaccaggagctaaacaaattattaccaagtataacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctcaaaaaccagaggcatggactccccagcgacccccgtggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttctgaacactcctgacgcactcacgaaccttcgcaacgacggaaacgacaagctaacacgcaaaacgaagaaaaagactaataaaaaccaaataaacaatacatataaagtaaacaaacatgtagatcatgattttagatgaatttagcaacttgaaccacctgaaacggatctacggttatttagttatgattttccgaagatttaatctattagaaaaaagggaaaaaggaaggatgatgatgtcatgctgacatcatccatggcggccgaaccacgatgacgacctcgccggagatagagcggccggctgcggatttggagggcatgtacacgtagaggacgacgagacgaacccaacggtactcaccacaacgacaaacgacgtccgacgacggccggcaacgacggggaacgggcggcggctcgggttgaccgacggcggcgagctacggcgaccggcggcgaagaaggacgggcggccgggcttcctctctcctcggcgcacctcttggcggcggcggcaagcggcggcgacggcaagggcggcggcgcgacctcgccgaagctcggccggcggcggcggcgagttggacgacgcggcgacgaggctacggggcactagagagctcgggaaaaggggcaaacgaaagaggaggactagagggtcctatttatagccttggattgaagagatcggactcctcccgcaagaaatcgatccgagaaatcaaaaactcggttttggagataaacccgaaaacgagtttgattcgagcaatatactcaaccatttgctccgattcttgaggggaaagatagaggaggacgagaggatcaaaacccctcaaaaatccggaagaaaaagggccggattggatgcggatttgagggagaaaaggggcggctcgggctcggcatgcacggctcggctctgtctccagccggctggagattgaagatgacactgtagcagggaggcaaactagacttttggctgggcttctacttcttggcccgattgaaagagggacacaaagcagactttggaggagggataaggccagccgaaaggaaaggagaatgggccgaggactgaagctgaacttttcctatttcggcccgaaaaggagaaggggattttaaatacttttccaattaaattaatcactgaaatgatctttgaattgttaaaaatacttccaatgctcaaataatttcaagaaaatcctgaaaatacttggacactcaaagtacttaacaaaattacaattagaccatttaatgattaatttaatatgtgggtaattactgaaatgctctttgtatgattaaaattaggaattgagctccgaaaaatccgagaatattccagagagtataattaaccatggagaatttaataaaaattaaatccaaccatgctttatatttaggaaattttatttcccacatttaactttacttgtaaattaatgaacatttaatataaattctattattaatttattaaataatttataaatcctgaaacgaaaatcaggatgtgacaaatctaccccccttacaaagaatctcgtcccgagattcggaacggctagaaagaaaaaggcataggtaaactgcagtctatcttattccataactccgataattattctaaggctttaaagaaaactactgccgctttgaaactggtggctgagttgtaacacttgaagacgcaactcttgaagacgcaactggcactgcattggctcctgtgacgacaatgttgttgacttgaccttgcgactgcggatgcttcggcttcggacactctcttgcaaagtggcctggcttgtaacagttgaaatatacctgctgctcccttccactactgttattcgactgatcctgctgaactagcaccggctgatttgcttgctcgatgttaacttcattgctttcattagtctctgatttgatctcaccaccgatgttcaactgttgcgattgtccttgaccagcggaagaagattcactaatttggagtggcttgatacgctgcctctggctactaccttgtgcctcctgggatacagtcattttccttttacggttatccatcctgttcttcttgtcttcaagtcgaattgctttgtcaaccagctgctgaaaatcaacatagtcatgagagatcaacataactgacagctcatcctttaagccttccaaaaacttctcctgcctttcctcgtcagtacgcacatcttctggagcataacgtgccagacgattgaactcatgaagatactctgccacggtacgatccttgtgcttcaaagccctaaactcacgcttcttcaaagcaacaactcctacaggtacgtgtgtcttcttgaatccttcggtaaactcttcccaagtgattggttgtcgttctgctctgttcatccggaaatgatcccaccattctgatgcagattagaaaaggtagaaggagaggggttacactaaagacaagaccttaaccaggttaacactgatctgatgtgtgtagaccattatattgttcaagttgattaagcaagcaacctagtatagtcacacactcatcaatgaacttctccaatgatgggaatgcaaccatacctacacacaaagcaaacaacaaacgttctaccctactaactattcttcaaagacactttggcggcataggttctaagataggttccaaacttcactctatctgaacacttaagattcgactatcatcttcttattcctcgatccacttgacttgcagaagttgacaacatcgacgtcttcgagtttctccatcaagattaacgactactcaagttgaaagaggaagggggaagaatgacaaaacgatttgcaaagaattctagataagaaagaaaggaaaattttcacaaattatgttttcggaaaattagtccttaaggtttgaccatttggcttatcctacagtcaagatggctctgataccaacttgtcacgcccggaaattcactagtaatttctgaactttatttgtgcataaaatcctcgtccaggaatcaaccgaggtacacaaact

SEQ ID NO: 54520 - DNA, 872 bp, Oryza sativa
gtaggatacaaattgggtctaatgggatgagtagttttgcctagttaatgtaatgacattttgcttctataggatctttactgtaatacatattagttaatagtgaccattctacagggagacaagtacaaagaccaggaacttgatgcagtggatatgttcaaggagtgccactacagtaaaaagaaaggctacacaccagatgtccagcttgctattgtaagttaacttttcacaaataaagcccaaccttaatttttgttgctgcgtctcatgaaccatgtattttttcttgcactactaggatgaaatggaaaacaagctgtctgaacatgcagaagatgaagaggccccttccatgaccgaggtagttgctggtgttcttgctgagaagaccaagaaacccacatttctgcagactgtggggattcagagcagaaagaaaggcacacttaaagagcaactagctgcagagaagttggcaaaggatgacctcaaatcacaagtgcaagagttggcgaagaagctacaagaatctgagcaagcaagggtggcggaacaacaggatatggcaaggaagcaagctgagactaatgcaaagcttgaccttctgttgagtaagattggacaccactagccaactgggtaagatggtctaggtcccttggccacattgttgcttttttgttgaatcatttctgctgctgttgctactgctgctgctgcttcgctatggtgctgtagtgggcaaagtgacatttctgctcttgttgctgctgagctagttattagctccttttgttgtgatgaaaactttgatgctggagtggcaatgccttggacttgtgctgtagtgggcaaagtgacatttc

SEQ ID NO: 54521 - DNA, 1271 bp, Oryza sativa
ttcctgcagccccaagcttcaactgatgaaacatcaacatatccctacaaatcgaagtaagaaaaaatatgtaacatcaaaagaatttatacataaatattttgatataatacaaagaaacatgtaaaacatatatgggatgaaacatggaaaaaatgacaaaaaaatatgccaatccaaatctaggtccttcttactctccgatggctggatctaagattccttcgatgaactcgtgcctatgacgacccagtgctccttaccttcgatgatcttgccttcctcattgtcggagtccacagcaacggccatctccttcattgctggttcgccacgatggggtcatccccctcctcctctccactggtgacctcctagatgtcttcttactctgcccgccacaacagtcgttctccccgtcactatcgccaccaggcggccatggaaacaacaataccatcatcaccgcaaccttttcatgtatgtggtgtgaggtttagagagagaagagagagaataaggggatagagacctagaaagagagaaataaggacatataagtgagtggtgcgggtattcgattttttaaccaggatcggatgcccaacccagtgtttttaagaaagtgttccaattttaagaactagtgagcgtgcacgtgcaaggcacgtccatacatacatactctctcaggaattcatcttggctctagctgttgggcgcgtggctccagcgacaagttggaggcaatagcaacggtgattcacgacccatggcgcagctcaccctctgccgttgatcatgatccatcctgttcataaataatcgcacaggttactaatgcaatgaacaaagatatctaaaggaacaatatattcttgcagtgtgtgctatagtccttccataatttgtccagctcatatggcccaaagcaaagtatttgttcaaaatatatgtagttctgtgaaatttactttgaataaaattatgtctgactaccttcaaatgttttgcatgcctcttgttcaagcaaaattgggtgacgtaataagaaagtaggtctcaagcaccatagatgcttgcctgcaaaatagcaattgacataatattggaatatttcctgtgcgaaatttgttatctacggccagtagcccttatgtgaagaaatatcagattgatcttaaatataagaaaagaaaaatattgattttcagttgcttatccagtgtgtagcagcatggcagttactgaggatgacaatatgcattggt

SEQ ID NO: 54522 - DNA, 719 bp, Oryza sativa
tacttgtcctcctgacgaatagccttatccaccaacttctggaaatcaggataatctccagtcatgagggggtaagaaagctcatcattaagtccttccaagaacttctcctggcgctcttcatcattgcgcacatcttctggagcataacgagccagacgattgaactcgtgcagatactcggtgacagagcgagatccctgggtgagcgacctgaattccttcttcttgagagacaccactcctgatggtatatgcatcttccggaaagcagcggtgaactcaagcaaagtgataggttcagcagtagtcctattaaggcggaagtgatcccactattcagaggcagggccatgcagctggtgtgatgcaaatgagaccttctcctgatcagtgcactggagcaaatccaacttcttctctatggcatgcagccaatcaccagcttcaacaggattagtggtgctagagaaaataggcggcctcacacgaagaaattctgctaacttgttctgcggcggtggagcattgttgttcccttggttgagctggttctgctggttctggagttgctgcatcatcatgttcataagctgtgcctgttgagccaggacttgggcaagtgtgggattctctccattgttgttgttattgttattgttgttgttggggccattcccgttgctgcgagtgagcaccatctggcatggacaggacac

SEQ ID NO: 54523 - DNA, 2950 bp, Oryza sativa
ctctcccaccagcatggatagaggaggacagaataggaaaggtgcaagccacgtacgaaggggatatggcagttttggacctggataacagcttttaacaagatctgaagcttggatctatattttgtaagtttgggagagaggcggggggtggggggaggggggtggggacgataagtttagggaccgcttgtgcacttcactcaaagatatgaataacaaaatttgtctactctatgaatttgatgtctgatgaaaagagttatatacaggggttcgaaagaacgcgtaccattagtcaaacgaaatgctttgtcctgacatcatactaacgtcaacttgtaacctagttaatactacacatgatatccagatgtataaggttctgataaataagataccacgctaaggtcaacacaataccttagatattagcactaggaaaaagtatgaattaccctccgaactatcgcggttgaccgaattactcccctgaactacaaagccagacattactcaccctggactttcaataccggatgaattatccccttgacctaattcagagcggttttgtcctacgtggcgtacgcgtggcaatccagtcagcattttctttttaaaaaatagtgggacccacatgtcatacctacccttcccctcttcccctctctctctctcttcactcactctctctcacggagtcacggggcagcgtagggggcaggcgcgagaagcggctgggtggcgagcggcggcgcgaggcgaggcggctgcgcaaaacgaggaggcagtggcgctaggtggcgattcgttccccctccaccgtgcccacgaacccattccattccattctccatcccccacccatgtcacttccgcgctcctcggctttcatctctcttacttcccggtctccctctcctcggtcgctctctctctctctcccatgcatgtgctcgggcaggcggatgcggacgggcggtgggcagcggcgcgggggacgcgcggtgggcagagtcgcagggggacgggcggggagatgggcgcccgccggtacccgggcatcctccacgccacccgctgctgactgggggttccaccgtcgtcggcgcccacactggagctcctccccgccgctcgtgccctccagggactcctccatggatgccatccagtcgcgcccgctgctgtcgctcgccacccagtcgttgcttgcgctgccgcccacctcccgcccctgtaacaccccgtgagacacataagagagaatagagagagaggaagagggaataggaggtatggcaggtgggtcccacaattttttaaataagaaaatgctgactggtttgccacgcgtacactacgtaggataaacccgctctagattgagtccagggaggtaatttgtccggtattgaaagtttagggtgagcaatgtctggttttcgggttcagggggtaattcggtcgatcgtgattgttcatggggtattttgtacttatagtactattacccgagtcttacacgacacccataagtatcagagtctagtacctagctatcatgttgatgttaggcatataattaaacaattccattccaagtatatatatgttaactgtaatatttctgtatacttatgactacacaccataccatctgtacatatgcctgagtactacaaaacttctgcacatgacacgcgcacggtgatacactatcagtacggatacataagagtagacactaactgaaatacttagcatggcatttgtctattctttctaagtcacaactcaaatgttactacacgtagtacgctagcacgtctacagggtgcaagcaatcaccttatatactgctgcctgcgtcctcatcaaagctcgccattatcagctagcttagctcaaacacttgtagcttaactaaccatcaagaatccaagctcgatcaatggcggccaccatgcgtggtggcaacgtagcactcgcgatcatcttcctgtgcttcacctgtagcaacaatgtcttcctcctccgttcgtcgtcggcgtcgtcccccatcgacgacttcctccggtgcctctccgcaagattcccgcggagcaagtgttcacgcagagctcgagcgggttcatggcggagctcacctcgtccgtgcagaaccccagttcgtgacgaacgccacggtgcggcccgcctgcatcgtggcggcgtccgacgcgtcccacgtccaggccgccgtgcggtgcggccaccggagcggcgtccgcctccgcgtgcgcagcggcgggcacgactacgagggcctctcgtaccgcgccgtgcgcgccgagacgttcgccgtgctcgacctcgccgggctccgcgccgtgcgcgtccgcgccggcgacgctacggcgtgggtggactccggcgccacgctcggggagctctactacgccgtcgggacggccaaccccgggttcgcgttccccggcggggcctgctcgacggtcggcgtcggcggctacctcagcggcggcgggatcgggctcatgatgcgcaagttcgggatcggcgccgacaacgtgctcgacgccatgatcgtgaacgccgacggcgagctcctcgacaggggacgcatgggggaggacctcttctgggcgatccgcggcggcggcggcgagagcttcggggtggtggtgtcgtggcggctgaagctctcgatggtcccgcccacggtggcggtgttcaccatcgccaagaccgccggcgacggcggcgtcggcgacgccgccgccctgctcgccaagtgggagacactcatcctccagccgttcctcccggatctcaccatccgcgtcgtcctccagggccggacggcgctgttccagtgcctctacctcggcagcggcggctgcgcccgcctcgccgccaccatgcgcgcctacttcccggagctcgg

SEQ ID NO: 54524 - DNA, 2901 bp, Oryza sativa
gtcaagagcaagtccgactaggtccgccgccccatgggcgccgccgcgtggtccgcccttttcgcggaccacctcgccagcaacaacgccggcgtcctcatcctcgagccccacggcggcgtggtcggcgccgtgatccctgacatggccacgccctacccgcaccgcgccggcgtgctgtacaacatccagtacggcgtgttctggtggggcgacgacgagggggagagctcagcggcggcgaggcggtggctggacgcgctgtacgcggcgatggaggcggcggtgagcggcaaccccagggaggcgttcgtgaactaccgtgaccttgacatcggcgagaacgcggtggtcggcggcgtgacggagtacgagagcgcgaggaggtggggggagagatatttcatggggaatttccggcggctggcggcggtgaaggggagggtggatcccggcgactacttccgcaacgagcagagcatcccgccacttctccagccctattaggcttagtagcctttttatttgtttgcacagtgcacgtgtgcattgcactgcaatttgagtccatgcaaaagttgcatatcgtcatcactcgatcgctatgtggagctgcacaaatgtatgcctagccaagaataaagacttgagtgacctctttgttttcttactagttaggccatgtacaatgtaccacagtggacagtggtctcaaccctccacgtcagatctgagcacccgtggcagtgtggagtgtggttccatgaactcttgccgtgcctgcagaggtcacagttgcctcgccgcggttcggcttgggaggtgcgaaatcactgctcagggctatgcgtttgggaaaaccgtagcctcgtgaagcgcttggggaaaaagagaggtcgaagagaacttgccgtggtggtcatcgccgctcgccgccgccactgaggtcgcgttgccgctccacgttgccaatgaggtcgcgtcaccgctccaagccgccgctgccaaggtctctgacgttcactggtgtcgtagatccaatgaggtcaagcatggattcagccagctcgtggctggatccgctactgccggtggcccctcgaccgccacgagaaggggatgggaggggagaagtcgacagacgcggccagatctgccgccgtcgcccaaagagaaggagagggggagagcagcgtggcggtggacagggagaagaggagagggggagagccaccctcgaagtttgatgtggtgaatggggaggaggagaatggtggtgggaaagtgcgacatggcagtggaatgggaggaggagaatggggagggggagaaatggggagaataatggcgcagtggtggatggggaggaggggggagagtcagcactgtgagcgtcagaagaagaggcagcgatttggtggcgaaagaggaggcggcaacggcgagatgtcgtggattagttttggtggccagtggggaatcgagagaagagagagagtggggtaggtgagaaaaaaagaaaaggtggagaggctgacagtggatccatgtgaagtttagtggtatctatctatttctttttgttattataaggtccaaaatataaaatttctaattgattcaataacttggtattgacacataaataaccaagggctgaaacaaaaactatactcaacggtggtcttcgtttgtagataaacggaaaatatactcaacggtgatctccgttgtagattgtgtgaattttatgtggtcttatcctatttagcatgttgagactactggtaccagtggcctcaattgtacacacccttaggtgtctgtgcgttgcaatgggaaaattgatatgtgttctagcacatcaacaatggaaattcgtaaaataaaaacatccacatatctgctttataatgtaattatgattttacccttttttttggaagggttttaatttactcctagtttggacatatgttatatgagcccaaaactaatgagttaaagaaaataagatatcattctaccttgggtaggtcaaccaactattccctgtgtggctatccactcgtgttccccgttccaaacccacttcttttgatttaatagcaagaatatactacacaagcagcaagtgtttggggaaaaaaaaagagaaaacaaaactattgaatagagtattccgggagcttctaaaactaagagagaatgctggaggtaggaggagagatagggaagagaaatcgacaagggtgccccacttgcctcctaggctgccgcatccccacagagagcttcagcccgcttcaattccctgcaacgttgttgctgcttttgttgcctctccaattaggttggcttgggccaatgcttgcgtgagaactggcccattatgaggcccatttgagttcctaacacgggtgttgcgcaggtccgaaccgcgagccgtgaatcatcagtacgtgttgtgcctattttgaggtttatgtttagtatatgattcgttggttgcattggtttgattttcgtcaatgtgaggtgaacttgctagtcccaatttcttgttgctatgagtaacaacatggtaactacctttgtattgctgcgcaaatgtgtgtggaagggagagatgaaatggggaggagctgatttatttcagtgcatcacctgagctacatgttctgtgtgtttgcttctggtggctgccagggcatatttgttttgttaccataggtttagcagagaaattacttaaaaatcctgattttatcaaagaaggactaaacaaagtataagaaaagcaatcaagtcattcttatatattactagaaaaaatgcccatatgctgcaacgggtgaagcttattttaaacttattatttttatatggtttagttaatat

SEQ ID NO: 54525 - DNA, 5440 bp, Oryza sativa
cggtaaaaatatatttgatttttataatagtagagatagagatatctcactaaatttaaattgaaaataagtacgtttaatattagttggcaacttggcatcaaaatacgaagtaaacttaccttggtaaagataaagaaagaaaaaatcttagccgttattcctttcgcgaggcggcaacagggagcacgcactctaccgtcgatcttgactggtcagcggaagcgaaccgacctatccaacggtcggtgggagatgtagccgccagtttgaccggtcgctgaccccggccaaactcacacgcaaccttcgcgccaaattttcttgccctccaagaacttttcgcgccataataagtacctcctcaagctgcttccatccattaacctccgtacaagtaatggcaatggcgaagcaccaggccgacctcgtgaggtgctcgcggcagccgggcgccgccgtcggccgcgtctgcgcggcgcacgacggccgctgcgtcgcctgcgactccatggtgcggcccgccgcgccggcccgcgtctgcgacggctgcagcggcggcggcggcgggcacggctcccgcagcgagaggtgcctggtgtgcggcgccggcgccggagaaggaggtgcggcggcggtggcggatgcgtactactgcaggtcgtgcgtgcagatggagaaggatcgcgacggctgccccgccgtcgtcaacgccggcacggccaggagggacgccgccgccttcttcttctccgcgaggagcaagcgtggtggcttcagatcaacaatggcgtgatcttgctctgccatggacgcacgtcttcccgactccacgaactcaaacagtttacggctggtgattttcatgtaacaattgaattatatttctgcaatatagcatatctccattaaatcgatcgacggttttactgggagtaatatgtattgacccagaaattattgggtcctatagtaacaattaattgcaagagtgagacacatgaatggaaatgatcagcagaatagctgctgaggaactcgtgtaacatctcacagaatataatagaaatccctagtgaacgtgtattttcatccctcgaggagatgcccctggttgcttctatgtcatccaaatagttattaaattttttttaaaaaaatgaaaacgtagattaatataaaatatatcactccacaaacatgtaagaccaaattcgatttctacaagtttcaacaaacttatgaaaaacaaatatattatcaaaatatatccaatattaaatttaatgaaactaatttgatgtttcagatataaatttgatcaaacataacataacaaagtttcactaataaaaaagtcttaaaacggagggagtcactaccagagagtgggagactaccgtgtacctcagttggttaccgagagtgttatatggaacacggtaacgtttaaagcataccgtgtgtgaacaaggaaaaactcgggaagtggctaaaaattccgtgtgacgaatcgagaaacacggtaagtgtgggacccacagtttctgccgttaagcgcgcggaatatttggtctgcgcgcgggatcgccgttggtgcaggcggatggcgcgccaagatttccgttggcgcggctggctggcgcgcctgattttcgttgccgcgcgagtaacaggagaatcccgcgcgagttacagccgaaggcccatatgtcagcccaaaatagagaccaacaaaaccctagcccttttaatcgatcccctcacttccccaccccctgccgcctcattctcctcgccacttttcccctttctgatttttcccctctcttcttcgcacatggcaggatagctgtgcgccccagcgtcagtccgccgcacggccaccgagcaacgctgtgcattcctggccgtacgcactccctgcatgtccacatccatctgctaggctctccttcgttgtccagcttgagcacacctcatcttccatccagctggtggtatgtatatgttgagtttttttcttgaatcgtatgtaaagttgggtcttggttctagaaaacccatccattttctcccaggaactagaaatagttcggtgtatgatttctaggaactgtatctcattttaatttcttgtaataccacaagtaccatatgaataagttgttgtgctttgtaaataaaaacaatattagactacagaatggtgtgggtgagagttcttgcactgtcagaataatgtgttttcatatttgtgtacttgttgatggatacatattggttaggcaaaacttgccctcttttcagaaaacataatggttagtatgagtgtttgccacggccctacttgtttagatcgatgttgaatggttgaattgggttggaatgacagcaccatgttgtgtgatgatctgcaatgctatggtgtactacatctttgtatcgacattttataataggcattattataccatgttgctactatgtagtttttgacctgtttaatataatactgcatatcttaattttgtagcaatatgtggcgattgagcttgggctgcagggaggattccaatccttcagatcaggctgtcagcgctgctaccttgccgagatgtagaacaaggtcctcaggttcccaacaacctgataattcttctaatttggatgagatattggctggcgaagaaacagatgaggaaatgttttttcgtggtcccacacggatgccaccgcgacctacccgagatgaggacaaacctgtgatgactccaaaaggagataggtaaataggctaattttggtatgtttcattagttgaaatatgaaggcttgatctgtttgttcattgatttgcacaggcaatggcaggctaatgattttgggggcaacattagggtccccactggcatcctgactgtgcttattaagcattttttccctggcattgtcaattttaaaggaagagatgagccagcatggagttggaaacattacaggattgcaccggatgatccagaaagcgctatactgaatcgcttgccaagccgtctccatcgtgttgaggaagatttctggatttgttttagagcattaccttctccaatatgaagtacactatgcattttattgtgtcttcagttttcatagtttatggccaatttgtactgtacaatagtaaagtatcttagtaccacacttttcaatgtcaagcaggctaactttctgtagttgcagctttacttcaggtgggcagagcgaacggaacaagctgctagaaaggttgtccgcaattgaatcaagcgccttttttcggacctgatttatgaaactcgtatcctggccgtgctcaattaccaaaggaagattttaaaggtagaaacttctcgggatattgcttgcaggacatacctaacagaggaagagtacctacaggtgctatggttgttcattgataatttgttgtgatctactgatcagattagtaattaataaatctgtgcttctcctataggtagaaccatggtggttcctaaaggcaaaaaatgcgtggcgggagttgatacgattgaagtggtgtaatcctgaatggcaggctagctcacatgctcataggatacggagggagaaaatgacatggccatctcaccgccaaggcagtgctaacttgagtcgtttccaaaaaaatttggtatgtgcatctatgttgaaacatgtagcagatcatggtataatatatatggtacccatgttctgttttgggagaagaagaaaaagcgggtagtgtcggtcgagtaccccatccaaacccacgacgtcgccccgcgcccatccatctagtgtcggtcgagtacgagaccccagcccgcacgtgcaccgccgtgctgacaccagtcgccacgcacggaagaggattggctgctcgtccagcaaccctccctaggactgattcgtctcaggtgttgttgtcttgctcctggaatcctcattcggccttcatgtttcatcatctttttgattagtgaccagttctagaatttactagtcaggttgcggttgtactaagggattgcagaactaggttgttatgccatgtgaaagtttgtgtgattgatgatctgaactaatgtttgatattttatttctcagtcatacaaactaaactaggcctttcttattcttgaacctttcatgaatagaaggacatttcctaacataattttattctatcactttgtcataactaggtacaatggaaactgatcgcagttggatgtacaagggccgtcgaaagcgtggcgaagttactgctgagtggatatcgaagactacagaatttcttgacaaggcattcagcagggagacaggacgtgctggtgtgttgtgtccttgtaactactgcaacaacacacgtcctcaaacaagagatatgatgatgaaacacctttgcaaatttggtttcagggcagcatatactgtgtgggtttatcatggtgagacatatcctgcacgtgaaagcgatatatgccaaagcattgaagatgaagatagggtggcagagattgatcggatggatgagatgatagatgatgtccatgatgcttatgtctcagttgaggaggaagatccggagcctacagcgcaagctttctttcaaatgctgtctgcagcaactcaacctctccacgaacacacacaggtatcacaacttgatgctatcacacgactactagctgtcaagtctcagtatgctatatcaattgctggatttgatgcacttttaaatgtgatatgtgctctcctcccacaaaggcacaaactaccagcaaacttgtatgaggcaaagaaagttcttagtgcattgaacatgccatatgagaagatagatgcatgccctaaaaattgcatgctctttaggaaagagaatgcgcagaagacgcactgtgataagtgtggagagagtatgtatgtggaggttgaagacagaaatggtcacaagaaacaattaactgttgtcaggaaggtacttcgttatcttccattcatcccaagaattcagcggctatacatgtctgaatcgcaggccaagcaaatgacatggcacaagaatggtcatcggtaccatcctgacaagattgtacacccagttgatggtgaggcctggaagaaatttgatagaaacttcacaggcttttcaatggaagcccgcaatgttagaatagcaatagcaacagatgggttctgtccatttggtatgggttcttcttcgtacacttgctggcctatgtttgtcattcctctaaaccttccacctggtgtttgcatgcggcagcacaacatgttccttaccttgataattcctgggccaaattatcctggcaaacacattagtgtattcatggtacccttagttgatgaacttatacatgcttggcag

SEQ ID NO: 54526 - DNA, 6174 bp, Oryza sativa
catatggtatattttccggttggtgtgtgcatggaaagatgccatgcccaacatgtatggaggcactccaaggaaaaatgttgaagtttggtggaaagtactcattctttgattgtcatcgccagttcctcccaattgatcatagttttagaagtgattcacattcttttctatcaaacactacagttagcaatgaaccacctcttcgtctcttaggtcaagagatccgtgcccggttagataaccttgtccctgctgctaatggagataagtttgtaggctatggcaaggatcaccattggacacatatatctagtttgtggagactcccgtactttcataaactagtacttcctcataacatcaatgtcatgcacaatgagaagaatgttgctgaggcaattttcaatacttgctttgacattccagaccaaacgaaggacaatatcaaggctcgccttgatcaagcagcactttgtaacagacctgaattgaacctcatccaaaaacatgcatctagtcagtgggtaaagccaagagctgacttttgcttgaatagagctcagaagaaggaagtattagaatggtttcaaacattgaaattccttgatggctatgggtcgaacctaaggagaggagtgaatttgaaaaccatgcggatcaatgggttaaaaagccatgattaccacgtaatgatggaacgtatctttccagtcaagttccgtggatacttgccaactcatgtgtgggaagtgctagcagaggtgagcttcttttatcgcaaactttgcgcaaaacagtttgatcctatagagatggcaaacatgcagtctcaagtaattgttttggtttgcaaattagaaaagatctttccacctggattttttaatccaatgcaacacttaatgattcacttaccatatgaagctagcatgggtggacctgtgcaatttagatggaattaccccgttgaaagaggccaaaagtatcttaagagcaaggttagaaaccgagcacgtgttgaagcttccatagcagaggcttacatactagatgaaatctcaaacttcacatccatatactttgctgatcaagtgcagacaattcacaatcctgttcctcgatacaatgttgctactcagtctactgattgttccctaagtctattctctattaggggggattctactagccgtggagtccctcgacacctaactcgtgaagagtggaatgctgccatattgtatgtgcttacaaaccttactgaagtggatgactacattgggtattaactatgaaattgatatgagttacttctagttcatagctgcatataattttactttaaatcattgtgtgcatttttatcttgcaggaaattcatagatgaggaatggactagatgaggtgtcccaacaaggcaacaacaagagaatatcttacggaatggtgatgggagagatcgtcctaatttcgtatcttggttctatcaacaagtaatttctttagcccagactttacttatattatacgcgtagcaatgcatatcctttcagatcagattaggaaatctagctagcttacttcgatgtaatatcttgcatgtgtatacatactttcctaactgttgaacattaagttctttcatgaatgttcctgcaactaacctaggtaatccccatcaaaccaataaagtattactgctaaaactctaaatttggtgacttcttatatcaatgctataaatttggtcctacaatagtaaagcacatttggattagtgcaagttcctagtatgcatatggctttttcatagtacaatctgagttaattttttttcatgcattatgaaaatagtattgaacatgtatgtacatgtcattaatatggagacacttctcaattgatcatctgttaggtcggaaatctggaaagaataaaatccttgccaatttctaataacaaaaagaacctagccaattaataacttgataacttcagttttgcaattcaagacctcaataattaatagtgccttcttccattttctttctgttttcattagtttgcagtttaacgcctcttaattgcatttgtgtcaataacctaataatacttatgtttttctataacataaccttcaatattgccataatagaacattatgccacaatttattgacacattatttcctttcatttcactgctagagtatgttagacgaaactatgagtgatgatttgaggcaagtagctaaaggatgccacactcgagtcttgctatataatatgtatgatgtgaatgggtatcgattccgaacacacaaatatgaacatgagaggccaaatgcaactacaataaatagtggtttggtgactataggacagggagaaaatagtgacacaactgagtattatggttacatcaaagaaatagtagaaatcagctttgatggcagaaaacctctcacacttgtgctcttcaattgccattggtttgacccaagcaaagtgaggtatacaccaagatatggtctggttgaggttgctcatgcgtcaatccttccaaaattcgaaccatttgttttgtctcatcaagcgacacaggtgtattacatgccgtacccatgtaaatcgtgcaagacctcactaattggtgggttgtgtataaggtgcagccaattggtagactacaagtacccaatgatcaagattacaattatgttcctaatagcaatgttgtccactatttccaagaagatggtctatccggcagttttgtaatcgatcttggtcaagaactcaataatgatcctgagcaagttgccattagcagggatactgaagatatttgcaatgacaaggacttgaagcttctcaatggatcatctattcaagatgaagatgatgatgacgaggatgatgaatcttattgcacttcctcatctgctgaagatgatgaggttcccactagtagggatatcttatttgacgagtatttctaaggtacattgttcatttttttgatggagactataatgccaattttttatatcctgtgcctccccaaatgaatatttcctttgtcaactatgcacaagaattaacctttcataaactggttgcgtgctgtaataatatttggcagtcatcttactttcgtaaaatttcaggcatacaattggatcattgcaaaggattgcagttgattggtgctgtcaatacacaaatttggagttggttactcactagcctctaacatttctctattgcctccctgggagaggttctaagaactcagactcaccttgttactattgcattatagccacttcagacagccatttatattgtgttcttgtatcattgtattaaaaaaatcatactgggataatatacagctaatgttcacctgacatttgtgtggttccatatgtgatgcttgtctgtcatgtttggatgatatgtatatgcatacatgttagttgcctgcctactgtatcagtgcagtacaatcgtgaatgtgtgaaaccctgtacaatgagctacataatcttaccgtgtattcatctcaaatgtcaccgtgtgctaaatcttacgggaagaatttcaaccttcccgggtcactaaaaactctcggtaaggtgtttcatgttcccgtgttttatggatttcttcccgtgagttccaaccaccccgtttcactccgttccgtgcatgacatgccgttaactggaaagttaccggcagggtgttttcacatggtaagctttcagcacatcctgagttcgcaagcagtttctcacgggaagagtgacacggtaaaggtgaaaggctgccgagtacaccttcccgagagtttgctcacaggaacgacgttaccgtgagttttagccctgttaccgagttgtttaggcacacggtagacttccattccctggtagtgagtatttattataccaactaggaagctagctcgcgcgaatacgcaggcatgtattttagggttgttttttttacacacgtttgatcattcatcttatttaacatttttatataaaactgtgaaaatataagatatgtgcaaattacctttaatgataaacctagtcacaacaaaataaataattattattacctttttaatagaactaaatggtcgaatgttcgtaaagaattgaacaacgtcatctattaaggatattataatttcttcaaaattattctttagtgtcattgcttatttttaaatctatttgttagatatgcatgtttatagatcaatcctcactctgtcccaaaacataggtatctttggattttgggacggtctttaggatgctactttgacaaataatatgtatatttataaaaataaattattatatataaaagagttacttgtatttaatatcaattttacgggattgatattttatttattttcagtataaatagtaaaagtaaaatgtttgacttggcagtattctgaatatgcttatattttaggatggagtaaatgtatggtaccgtaatcaacatgttaattgtttgtagcttgcaatggtaaagaaatacatgtgccatatatttcttacaatataactcttatttttgggcttgattaataataataataataaatattttttatatatttagttgttagctagaaaataggagatgagatgggaggggagagttggagagggcgggagtatacatacgtgcgctaattaggaggaagggcagtacgctactttttttttctaagaaacagttcgctacatttttccccactaaaacataatagatctaataactaatttaattagtgggtccatctttaagtgccacgtggcattttaagaacatttataggagttctatgtggcggcttgagagcgtttataggaagtttaatttaatggacttttagtatataatagatggagtagatagatagatagatagatagatagatagagtactagttggatgtacttatattataaagagggtcccatgtcgactagaatgacgtgaccgtggacgtcgttgattaggccagttgtattatgacaattgtagattatattacaaatctatatatgctatatagttagcaccaaaagtttaatatgtattgggccacatcacttacaaaattagagtcattggattatttcattcttcatcacaatcatccaatatatatttaaatatttacatttattcctcgttagttcctagataacttaatattcattaatccacttagtatagttattattactcaaaagaaggcatccaaatggtcatgccatttgtcatcttatcgtttgatggtgtttttacggttcagatcaactaacaatctattttataatatattgcatacatcactattgcaccacaacttgtggagtttcatctagtttatattaaataacatatgccattgttgccgctgccttgcgcctctctccccctatactcatacttgcttcatggtaccgctactatataaatcttaatcttaattggtgatggttggaaaccccacaaagttgtcagatttcccaaccagcaactataaggccaaggcggcactgatatagaggggaaataggtgctggtttagaactaacacctttaatttgaggttccacaaataaaaaaagcggctcgatgcaccggctcgaatcaagcagctccccttcacccgatcaatcaaagaacatccaagaacactaagaacactaagaatggcccgacatcgtggagggcaccactgccgcagccatcgggggtcggtagcctgccaccgcacgccgccgccgctgcctcccttcctgtcggatctggcggaggggaggtcgccgctgccacgaaaggcatgttcttgttgtgcaccatctcccacaggtcagtgtccatgtcgaaggcgcaggtgcccttgtcttcttgctactgctgcggctgcaccgatgccaacaagaggatgtaggagctgacaagggcatacggcgtgacgtgcacactattggagaaaccatctttggtcgatcgacccaaatccacaatagtcccggttccattaaaaactgagactaaaaacgatttttactaccgatttataagaggaacaagactagttgatttttagtcccgg

SEQ ID NO: 54527 - DNA, 8903 bp, Oryza sativa
aaccgggactaaaggtcatcaggacggttagtctcagttgattccatgtcaggccgtgtcagggccctaggatctttagtcccggttagtaacaccaaccgggactaaaaacctaaatttagtcctggttgatgttactaaccgggaataaaaatcaaaactcactatataatccatagtacttatcctcttttcctatccacacaacaaactcctccctctatctctttttttctctctaactccttacctctttccttcctctaagccttctctttcctttttttccttcacagtgaagaagaagcggtggagcggcacgaggaggaggccgggcggcggccggcgcggggggccacgcggcggcgggtggtagtgcggagggccgcgtggcggcggccggccggcacggaggggaggaggggaggcggcagtggccggctgacaattttttttttagattttgtgatttattgcatgatcctgtgatgtatttgatttgcatgtgctatgaatatgtgatgtatttgtgatgaattttttagaaattgtgatgtaatttttttaagagtttgtgatgtatttggagatggtctatttgaggatttggagatattctgtgatctgtgatgatttggatttgggatttcttgagtatgatttggagatggggtgaaatcaatattcaatgttaaaaacaatgaaaaagagaaaaaaagaaaaaagatctttagtcccggatggtaacatcaaccgggacaaaagatggctccatctttaatccaggttggtgttatcaacagggactaaagatcgatctttagtcccggatatttgaaccgggagtaaagatcgttatctttagtgatctttagtcccagattcgtagtcccggttggaaaaccgggtctataggggattaccaaccgggactacaaagcatttctccaccagtggcaccttcggtgggtcgaggaacaccagtgtgttgaggcagcataggaagactggcggtgacggtaggcagcaccacacgacgcagaggaggtcgtcgaggatgaagaaccatggccaatctaaggatgcttggtgccacctcgccacttgccgccgcccgccgcaactactgcctcccctcccgccgaacagggccggtcctgggtttttgggccccagggcaaaaacttatatggaggcccctatatatatatatatatacataaactaatatatatatttatatagtcatataaacccacaacatttaatattcgatgtgataaaattatctatatataacattttaaaacttcaaagagaaataaatagcagtagcgagcagagaaggtgatcgacggacgatcgacatgagcgtggctactggcgagccatgatttgccgacttgctgtttccgtttgcgagaagtcaagaagtcgctgagagcgcaggagcagtgagcgacgtgacgtgatcgaggcggcatgacacgagtggcgtgatgtgatcgaggcgaagcgaagggatgtagtcagatgaagatcgcttcggcttcgttgaaacaggcctgacgatggactaaaaattcattttctatattggactatttagctgtctaacttaatatagacccatggcacatgaactaaaattatacaatacgtagtatatatactatatgtgtatatagggggcccctagattttgggggcctcgggtagccgcacggcctgaccccccctagggctggccctgccgccggatctagtgaaggggaaggcgctgccgttgccgccaccgcctccctcccgtagacgcacaccgctaccaccgcctcccctcctgtcggaggggagggctctgccgctatgccgtcgatgccgagtcagggggtgagagaaccgagagagagagagaggagagtgcagtggaggagaaaggaggagaggataaggagagagattaggaggagaggataaggacaagaggccaccggttcggctcaactcgattttaggggtgcccttttttttgaaaaaaccaacacctatagtatattgtaggtgctagtttttcattaactgattcctataagaggagtaaagtacaccgtggatccttaaacttgtttgatcttctcatccctgtccctaatctctgaaactgcagatttggatccttaaacttgctaaatgtatcacacaaggtccaaatttgacacggctgcaaaaaggatccgacttgtcttccacgtgtacggccacatttcaggggctccttggccaggcgctctatacaatttgcagaaaaaccctcagacttaactaatatttattccattcaggccaccacgttatcgtctccaatcttctccactcaactgtttgctctgccaccgcgccgcgccgttgcctggcattctccgcaggtgtcggcactgttcctagccattctccacggtagccaccgaaccatcgtcgtcgtcggcaccgtttcctgccgttctcgaagatgccaccacaccagttgccgctgtccccgtcccccaaatatagcgtgggaaaataccccgctgtcagcacaattggcagaattggtgaatggcgattatgaaaaaacggacagatacttgattaataggcttttttttgtttatgatgtgcagccttagggatgtagcttggatggtgaagttaatggcagaagtagttctggtggttgcggcctaaactagttgagaagcagtgtgttgattctgtactttcaatgtttcagagttaatttgcgtgtagctttggattgcgaaaaattgtgcaatgatgatcatcagaatatgcagtatatagatatgtacaggtgttgttcatcagaatttatgcaatcacaacaattcagcaaactcttcatgttctgcagaatttagtcagatcatcgaatttatacagtggcaataatgttcatcagaatatgcagtacatagaaattatgttttgttgcatcagaattaccaacggcagaaccttgtcatgctaaaaaataaaggaacatctgcacatttccaaacgtcatacgatgggtttaaaatataatcagatcattgtccatgcattgccaaagcaaaatataatgagattgccaaatgttttgggggaaaaaaagcagagtaaacacaggttcattacaaaagggtgctttaactgatgcttgatggcatgaaaccgacctaatagcactgtttatacatgaaatcatctaataattaagcatcactagtttttctttgctgcagccttctttctagaagacttatttccatcaggcttctttgcaccaagagatgagccagcagccttctttgcaccaaagccacctttcttcccagtaccaccactagcagctgtagctcttccttccttggttgctgtggttagtggggctagtctagctgaaggttggttggacaagatatatgcactatcaggtaaaggttctgcctgcaaagctcttttactaggttgtgatgattctacagccatttgtgatagcattgtattggttggataaggctgaatacttggacatggctgcatcacatcctgtattaatagaacaagattatttgtgacgaacagaattaatatatataattgatgtttgtagaacctatattctgtacatacctgagtaacaacaggctctagatcagcttctgcttcatcatcaaccagtggcgtgatctttctctttggttgttgtttaggccttaatcctgtctttctcaattgacgccccttcttgttatggccaagttgttgacaatcggagcaatgcatctcaactccatgcttagacatttttggtccatttttgccctgaacttcttgtggctgctttctcctacatttctttggcctgccaactttcttatcataaactggaggttttacttcaagtccatctacttccactttgttttgtttgaacatggccaaatatggtagccataagcattcaggtaagcctctgttgtgtaacaagcagctaaaactgactcagcagggatcctttcattcctcaagcatgaaattgcatggcaacatggtattcctgtcagatcccatcttctgcagtcataatgcctagtttgaatgtccacaatgtaactaaaatgcttgtgttgcacataaaaaattcctttaccagctgggagtatgaaacaattgttggccatatctgcattctttgaaacttttttcctaatcttgggacatattggtccttgccacttctcctccatctccttctgcttattgtagtacctagtcattagccgccccttgatcctctccaacatacttaacacaggtaactctctagcttctaaaatgtacttgttaaatacttcacagttgttgttcaacaggatgtcacacttggggaagtcactaaagaaagctctaatccatgtattaggcgacatgttactcaaccaatcatatgcctcctggtttaaattcctcatttcttccatgttgacattccactcatctatacaactagacctagcacatgctcatagccggttcttcaaattctcacctttgaaatggacttgaaagttagaataaagatgcctaacacaaaatctatgttcagaatcagggaaaacctgttggactgctagtataaggccctacacaagtaaaatagcagaattaacagttgtcataagaatttacatgttaaattgaacaattcaaaagaatacaacttgcacttataccttctgcatgtctgtcattacagtccatggatatgtattgtcaatgccaagatctcaagaaaccacctccatgaagacaatgactccacctccaccacagccattgcaattggatatatgcagtcattaggatcaattccaacagcagttaatagttggccaccaaatttagtcttgatatgacatccatccaagcaaatcagtggtctacacccactaagaaaaccccttttacatgcatcaagggacatgtacagagtgttgaaacaaccatcattcaaattcaaataaaaggtactcccaggattggacctccttaactctgaaccataatcccatagttggttgtactgctcaacctcatcaccatatatagccctcaatgccaaccttctagctctagaaagtttgctcctagaaggtgtcaagttccactctctctatactgtccttgcaaagctgccaagagtcatcttctcatctgttctgaatgtatcaacatatatctctgcaagccactttcaagtgcatcttttaagaatccattccttttggcattcatgctctccaacataagaatccattccttttggcattcatgctctccaacataggtcttcaccatgaaagtttttgtccttctatcaaatgaagcatatagattccaaggacatccctctgcacaatgtgccctgatccttgtcctatcatttcttggcatcttgatctccactctttgtttcagactatattcagttattgcttttctcaatacctcaactgattggaataccatgccaactttgaaaattggattgctcgtgtcctatgacctaaacgatttgaacttcaatctcactagaccatcttcatcgccatcatagtctggaagttgtagttgttcctcatcaaaacctacatcatcagcagactgaacatccatggtttttgccttattttcactgattgttcccttcttcccttcttactcttctttttcactataccattaggtgatacatcatcatctacattatcctcaaataagtcatcatccccatcatctatttcatagtcactatccataaagtcactatcatcactatcactttcactatctctgtccccctcaaccaattctatggaattggctttgtttgaataaaactcaggaagcctttcaccctctttgttctcaacatctgttacctttcttgggctaagtaccttaggcaaaatctccaaagtgtcatcccagttattgttcccatatgtctccccatgatcaaagtacacaacaaaattcttcacagtattcacaaatgacttcattgcagcagtatctatctctcgtgtaatcaacctcagtctatctgcaagtctctttcctcgtagcaaccaataagtcttcacgctatcttcatagccaagcattgcaatgaattcacctatcgaaagcatattccaactttgggcctcacagtgatcaaaccaggtcaccttctcatctacgtaagaccgattctggccatgcccgagaaaaaaaccaccatgatgcacctcaagagtaaatgtatctgaatcagttcctacattgcacaatccatcaaccaaaaataagaaaacccgacaaaacctccactaaatttcaccaagcaaaaccctaaatttcactcaaccaaaaattgaacatttactaaaccaaaccacaaggacatcgatcaccaagtaccatgcaccaatcagtttacagattataggagaattaaaagagctcaccatagtagggcattggttccacttcttcgcgcaactgaagaaccatcgttggacttttttgtggatgcaatcaaatccacaagctagacatgcaggggatcaatcctctcatttgccggtttcaacatgaggaaaccgtcgccgatcagcaccggccactgccctagcaagccctggtcgctgccgcctctgtacgtgggatgaaaacatgaacagatggtatggtattgaaaggatacaatttggaggggtcttttgtaagttgtatagagcacatggggaacccatgcaaatgtggctgtacacatagaagacacgttggatctgctttgcagccgtgtcaaatttggaccttatgtgatacatttagcaagtttaaggatccaaatctgtagtttcagagattagggaccgggatgagaagatcaaacaagtttaaggacccacagtgtactttactcttcctataatatatttaaacgtttcggttttttaataaaatcgacatctatactatacatgtaggtttttctttagaactggctcttatagttgcttataggtgtcggtttttgtgtttttagcccacagagatggtaaatatgtactggttttagcacttctgacacctatagtgccgaccactatgtgcctttttgtagtagtgtacaaaatttcttgcctctatcacggtaaaaagtttacgtcctgttctctccatctccacctagtgattcagtcaactagtaatgtttctaccattatatatttttcatgatgttctctccatctccacctagttattcagtcaagtagtaatgtttgtaccatttaatattttcatggttgtcgtgatgttcaacggcgacggtggcctacgcccctcagcaccgcaggctccggcagcatggcggtgctcgccccacggcagcatggatccggcgatggggccgctggttgttggtgcgacgtggatcaggaggcacagcaaggatcgctagggtggaggtggggtcgccggctggaggtgcgacggcgtcgactgtttttcttgattgttgatgtttattgatgtttgattgtctcggatttgatctagatgtgttgtttttcttgggattattgattatagttatgtgttcatggatttgaggcatcattttgggatcatgtgcgcctcaaaggtgctggttctggaatcggtaattttgactagggtcatcagtgccgccttcttggttctagttggaaaatctggcacctatggcggtttcccaaccaacactaacgatgttttctgtagtagtggttactagcgagtgtgcgatggagaaggggtattctagcatccatatcattggtacagagttgccaaagaggctagattcgatgccttccagggtcatgtggctagatatggtagtacctggcttggcatgatcaagtttggtctctagggcattggtgacttggtgaattatgggtttcaagcaaagaggtagcgagctggagttgacataggttcctggctagggaagtcgacaaaagtggaggaggtaaggacgcatcattgttggagacaggccatggctagcatcggcaacccaaatctgggggtggtgatgaccatgaaaaaataggagcgatgaagccaacaactatatggaggagtgtccagagccgagtcttgtgggtgttgacatgcccgacgaggcggttggatcaagtggccaccaagtaagattgaaaagatcccacaaggagattctctggcagtgacacatggagagctcagagctatgttggtgcatcagaaccaatgccctccctattcacatcgctagatccagttggccaaagacacatagtgttatcgtgaacgaggtgggccctaggggtggtaacagatggaccagctagcgacacggcctgtacatatccgctccaaaggggtggtaaggaggaatggcacaatgtaggtgtctagtggtggtgactgaaggcctggccggcggcatggcttgtctcatgatgtgcttcggagaacatatcctatagccagcgctgcttcacctattcgatctatagatttgaataaacatgactggatgatgtggatgaatggagatggttggttacgttggtagataacacaaatgagcggattgatttagtttacaagaatttaccacatttgtgtagaagagttggtggacgcgtgtgagtgctgggtatgggtgggcaaaaaaaaaatcgagaccgaaaatttccacgtttggttaggaaagctggggtatgcatgggagcattgggtagggagtggcaaaagaaacccaaaccaga

SEQ ID NO: 54528 - DNA, 2915 bp, Oryza sativa
  unsure (1)..(2915): unsure at all n locations
taacaatcttacaatagtaagtgattctgatactcttgcatgtctactattaatgtgttataattaaatctcttacttattacaatacggtaaaaaatcttcacaaattttagccatcttcacctccactcccaatggaagcttggtgcacaaagctataataattagttgatcataggtgttgagttgaagttgacattggtttctggatagggaggccgacaaaaagtggaggagataaggacgcaatggtgttggacataggccacagctagggttgacaacccaaatatggggttggtgacaaccatgagaaataggaacgatgaagccagcaccaatatggaggagtgtgcggagatgagccatgtgggtggtgacatgcctgatgggcaggtggatcaatggggcaccgagcaagatggagtgatcccacaaggagactcttaggcagcggcacacggagagctcagggctgtgttggtgcttcacaaccattgcctcttcatcagagccgcatcactatatccagttggccaaagacacattgtgtttccatgaatgtggtgagccccagggaccataatagatgggccgtccagcaaaatggcctgtagatttgctccggaggagggcagccgtgatgtaggggcccattagtggtgatgaggtgcgcgtggtggagctaggtattggtgcgcaaaagaaaccgagacttgaaattgccatatttgttagaatagttggggtacgcgtaggagcattgggtaaggggtggcaaaataaaccgagactggaccccaaaaataccaaatgtgatcatcagttcctagcacggtcttaggtttgagaagatagatcccttgttcggtctttttgtttactacaccgggtgtctgaactaccaacattatacttatctcctctttattttgttccttatctagtcataccattctcttcgatctctcattcgccagcgccgtttgtagtctccgggtctttcatccagccgcaccctatctgctatatatatagaagacccctcttctccctcgttatcttccatctcccatctcctcccgcctcagattgccgttgcttgttcaccaaacagcactcccctagctctctgtatggctggcccatggccgccgcctgcctggcgcttactctaggttggtccgtccattcctatcacatgtgctccgggttccacgcatatcgtccagcgtggtcactttcactatggccgaagaaggagaatgaaagatatcaattttttttatcaagtttgattgtcattttcgaaggattgaattacccggatcaatatctcagtcatgactgaatgcccaccactagcgctgcgtgggggtttgggggcgtgccatatagtagtcatactaataagatagtaactataatcaaaatttgacatttatagcccgtacatatgggttattgtctaatgatccataaaagccaagctttcaaaggtacaagcccttacaaaagtttaaaagaaactggtggtggtgatggtgtgatcgactttatgacaagcaatgtcgaaggaaattaaaccaaagcaaatgatacatgtgtagacatgcatggagggcgcatccacaccaagcactacgcaatcacgcatggattgatcccttcaggtgttcttggaggaatccatggaacgaagctcccggatacgtttccgtatccccaggcggtacttcacgatagccatctggacatcctggaggatgtccacggtcaggtcatccacgttgttgcgacggcctgacataaggtcgcagacgatgagcttgatctccaattcacggttcttgcgtcgcagttcctctagcctcgctgttgcggcggcgatctgctgctcgaggatggtcttctcgtcgtccagcatcgttgcctgcacaaaacaagtaatgggatcgatcgacctctaactacctctatgtttggtgtatttgatggagtgatgttgtgagaagaaaaagcaactaaggcgctacttttatagccatatctgggtgacacaaagaaggaagttattaagtgcaaagatttgatatcatatccaaattaaatgcaaataaaagtataatgagtatatacttaaaatactacgtacacccgttgttttttaatttttatcaattttaactggcattgtattacattcacaagtattaagaggtcaactttttcgggctgtaaatatttgacagtgataacgatatttgagagggagcacaaatcgggtgtacggcgctgtttcacggcttatatgaaaatgtgcacttctagataaaaaaatgttgcaaatgattaaaatggtgaaacatagttgcataaagattaaacatttcactcatgcactagaaacatcaggattcaactgttgaaacatcaacagatgcacaagtatcggagtaaaaaaaatgaaagaccataagaatctctactaaaacattccgatcaatcacaaagaaacatataaaacatgtgagctgaaacatcgaaaaatcacaaaatgtaccaatgtagatctctccttggtcgcctgatcagagcttctattgatgaacatgtcagctatgatgtggagacccggtgctccataccttggatgaccataccttccttgtcgttggagtcaacggcaatgaccatctccttctctgtcgcttctttgacatggtggtgccgtcccctcctcctctctgctggtggcctcccagatgtcatggcttccttggcaaatcattgcgcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54529 - DNA, 2983 bp, Oryza sativa
  unsure (1)..(2983): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccgaagaacggaaagtcgatactatgctgaggcacccagcagattcagtgcagtggaggacaatcgataggatttaccaggaattctcaaatgacccaagaaacatgcgtttcgcaatgtgtacggacggcattaatcctttcggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcagagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcaacacccgatccagcggttgtgttccttcttccatgcaatcggccagaagatcattgatcccgagggactagataaactacaggcagaacttgtgagaaccctatgtcatcttgagatgtactttcctccaactttctttgacataatggaacatcttccggtgcaccttgtgaggcaaacaaagtgctatggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgaaggtgttggtactgttggaagaaagactattaggttggatcggaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgaaccgttcgttctcgccaaacaagttgttcaagtgttctacatagttgacccgtgtaacaagaaagtacatgttgttcgtgaagggaaaaggagaattgttggattggacaatattgcagacgaggatgattacaaccagcacgtccacggcataggtcaagaaatacctctagaagaggaggaggaagaagatgaagttcaatatgcacgtgtcgaccatgaggaaggattatttttgtaatttatgtacgtagtttatgtctacatgtctgttatctgtatgactctaatatgttcgcaatgatcaatagtatattgcttatgaaatagtcaaataaaataattaagtgaagcacccactagaagtgaaataaaataattaagcaagtataagcattggaaataatataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccagtgttgggcccgtcacaggtggtcttacctgtgacggctccacggtcggcgcccg

SEQ ID NO: 54530 - DNA, 22046 bp, Oryza sativa
ccgtcacaggtgaggccacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgccgccctctacgccctcctctccaccgccgcctcgacctctccaccgccgtcctcgccgccgccaaatccgccgccctctacgccctcctctccaccgcctcgacctcgacctctccgccaccatctctgccgccgccctctacgccgccctccccaccgccgcctcgacctctctgccgccctctccaccgccgccgcctctcgaccgccgccgtccatctccatcgacctctccgccgccatctccgccgccctctctaccgccatctccgccctctacgccgccctccccaccgccgcctcgacctctccaccgctgccgcctcactcactctttcgacggccgccgggacctcctctcagtcgccacgccaggaccgtcgtcgccgccaccgggatctcctctccgccgcctcctcctctcgaccgggactcgtcgtcgccgtgtgccgcctcctctgctcgtcgtctcctctccaggtacccctctctctctgatgcccatgaatggaagaattgattctttgataattaaggaactttattaggtttagggtttgaaatttagttcaaatggaaaaattgattgattggccgcagatttaatgttgttccgaggttatcaaaccatcacagaatacaaaatgcatggggaattttggtggattggtcagtgtagtccatggacggaaccgacctagacaccaaaattctccatgcattttgttttctgtcattctttgatgattaaggaactttgcagattatctaaactttgtggatttatataccctttttgtctatgaataggtgaattgcatgaattgttgtttatatacatgatttatatacccttgctgctgctgccacataaatgattgtgggctgttttattatctacacttgattgaattgaatggatgaattgctgtttacatgacgttagtagtactgtctccttttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattttaactagataaatggccagtgatgttttatgttaatacacccctgccactgctgttattgtgggctacttgttaatacacccctattgttgctgcccctgtggagtatctttgcccctgttgctgctgcccaatgtgttccttgttaaatggccagtgatgaattgctcaataagaacaaattatctacacttgttctttttttatgcataagaacagattttctgcacttgctcttttttctggattgataagaggagactatatacacttgttttctgtcattctttgatgatttatatacccttgctgctgctgcccaatgtgttccttattaaatggccagtgatgaattgctcaataagaacatattatctacacttgttcatttttttgcccctacacttgttcatttatatacccatgctgttgatacccctgtggcatatatactcctcctgctgctgttttatgtcaatcatgcaaattctgtacccttgctgctgctgttttttaaatttgcatgattgattcagtggttatatacctctacacttgttctttttttatgcataagaacatattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcatgaacaacatacgtcgatgtcgggcgggacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtttgggaggaattctgctctctcaagaccacccaagagtttagggaatcaagcgaggcacatcgcctactgcaacagcggaatgagcacccgcatcggctgggcaccgcaggatacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcatataaacgactatcttcttttctagttgggcttggttactgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagatcccaatacaggaaacggaaagtctccaaggaagagagggacgctcgtttgaaggccgaacttaaggttgaggtcattcaagaactagaagctagcatgaatgcaagggtggaagaaagggttaacaaggtcctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggcgcagcacagtgtgtcctactagcgagagtccacccaactttcgctcctgaagtcgctgagggcatggctttcaagccctcggttatagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttcttaaatgctactccttgtaagtgcataccttctatacttgtgatatgactggactatatctcctaattaaattagttctaatacgtacatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcatgcgacattggattctcctagtcatcgtacctaagtggagtcgggttacctaccttaactccaataagtccaaagattatgatttcagtgaaatcaccaaggccttaaatatggcttggggcccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaaccccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttccttattgacaagttgtgcaggtcgatgacattatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgttatattggggggtgatgtatctgtgatggatctgtgactggaatatatctgtgatgtttctatttttcagagggcatggctagcaaatcctgaggctagccaatatttagcatttattttttttctggaattaactcatcagtgacgggtcggaacaaaaatccgtcaaaggtaacataacctgtgacggactagcaaataaaggcccgtcagaggtgacctacctgtgacgggcctttacttttggggccgtcacaggtagatcacctgtgacagcttctaactacggagacctcaacctctgacggcctttatttaaagggccgtcagagatgagtcacttgtgacgggtcctaactcgctcaaggctagcggagaccaacacctctgacggccttctagtaacttgcccgtcagaggtgggtgtcacctgtgacggccggccacccgtcaaaactcaccagtgaccactgatcactgaccatgcgcgaagccgtcaaagatgagggtttgggcccgtcacaggtgaccttggccagtgtagtgatacatgattagcctatgtgatgctacattaaacatatgctaattatggattaattaaacttttaaaaaatatttagcaaattatctctcatttatgcaattagttttgtaagtggtctatgtttaatattccgaattagtatccaaacattcgatgtgacagggactacctcatgactccatctccctggatccatatgacatatattaggtcgtccactcttctagagtttctagttaaaaaggtctactccactgtcttaaagaaaaatcttctaaatttagacatagtctatatatatagatttatagttgtaagttcgttttttctgataacgaagatgtacatcgttagcatatagtagcaaatccagcacgttacaacgacagtgcaaactcctctcctctggcctttactcctacacaagaaccaaaagagcaagagagaggaccttgcaaggcagccaagcatccatgcagtgctgctgacctgcccgtacaaaaaacaccaagaaaccttttgaatcgacgatggccctgttgccgtagccagcaacaagcgatgacactttggatagggacaatgacacaaaagggcccgtctagaacaaaaccaaagaagaaacaggggaacatgaggagcacagggaatgatgaagcttgctccctatcccccccccctcccaagtcccaagagcttgagcttcaatacttcagaatcacctcccgagggacaccgggcaaagcgagagaccacttcttttccataaacaaagcaaaggaaaagaaaagggggacagaatgacagtctgataaacagatcccacatatcaataacacattttcattttttaataatgaaaatagattatatctttgatttttatcataagacacacaaccgtaagtttgctaaaaaaagggtaaagataaaaataaatcaaaataagagatgaggtgatgggataaatcctcaactcccctttattattgactagcgttaaaccacatagattttttttaagctagcaattttaatggaactacgtcgcttatagtggaataagaaatcttaactactgatttcaagagtgtagttacactgtgcataatatcctgctgctcctgtggtagcaatgtagatcaaaagtgaagctaatatgaagataacatgcataaggttagataattatttaccattaaaaactttatcattacaacaacaccaaattgactaacatacaacatattttcatgagttcatataagaacaacaatggtttccttaaaaacccttcataaccacgggtcacatcaaaggttttattagttcgatttatttatacgccttacttaggattcatagttttttttaagctactggctgctgatttatcacgaaaatgtgttaaaccgtgtatttttcttaaacagtatgtttacttaatataactcatctcatttttacgttaaataagcttaaagcccaaacctcatattcgaccgcagccatacatcaccgtgggcagcttgaaaacaaaaccggcctatgagtatgacattccacacaaatctcttaattagagcatgtacaatagcaggctataagccagctataaccacatatcaagaagaaagcggactacagatttgtagttagctgtaacacgaacttcaaaacgttatatgtgtatgagatgtgggaccggatattaatggtgtagcatgattttatagctaactattgtatgaatgggctattagattaactatagataatttggagccaatggttagctatatactattaaggtggtgtttagttagagggattaaagtggggctaaactttagtccctctcaaaaaaatataagtccctatataagtccctaccaaggacttatatttttgtgagagggactaaatttagtcccaagttcccaaacaacccctaaacttgctagtaagggggtgtttagatggggttaaaactttttagtccatgtcacatcggatgtttggacgctaatttggagtattaaacatagactaataaaaaaaactaatttcataaatgagagctaatccgcaagacaaattttttaagcctaatttatctataattatgaaaagtttactgtagcatcacattgtcaaataatggcgtaattagactcaaaagattcgtctcgcgaattagtccttagttataaaataggttttataattagtatatgtttaatactctaaattagtgtctaaacatccaatgtgacatgtactaacaggcccttactctttacgagtattttttttcccatgggcaaaaggatccatgtgcacgagcgcagcagcgagatgtacgtgttccaggaaggaagagtccaaacacgtacgtacgcctcgaaactaaacctaatttggcacggtgcacgcagcgaccccaatgccctccctccaaagtccaatcgaactcgccaagtggacgtctaccagtacgtgtaggagtacatccattgcaagccaagccaagcaaaccaaaacaaagcttgttgcaaaaggagaatcaaacaacagcccaaaattatagattggttcaacttaaaaaccctgttttcaaaattctttttgagaagggtactttttcactcgacctctagattcaacctgctaatgcaaccatttaaattggaaacttagcccctcaaacaactcaatatgaaattcgcttctttggagatttgaattcaaaccttaaggtactactcaagtcactgtaaccaatagactgcaaccttattttcaaatatgtgacagtgttaacttttctgcaagacacttgaccattcaaattagtttgttattatttgtttttatcaataatataatctaagaataacttatagttttacatatgttcactgaatttttgataaaaggaattgtcaaataattatgtttaaatgtcgatcatgccatatagtactagatattactacgtagtgtaaagataagacatcctttatctcaagatatactaagtaaggctcccatcggatggtctattcagtcaaagaaaaagccaaaatttgaattttcaaacttaattttgacattgattttgagatattttcaacgtagtttctttttcagcattggcttttaagtcaccaagaacacatatataaaagttttatctacaaattcatttgtattctctaataagtcgttttggcttattacgaaaaaagccaaacgataaggccccctttgaatcgcagggtagaaaaaacggaggaataggaaaaacacaggattctgatgggaattgaagtgtaaaacagaggattgcaaaacacagaaaaaatacaggaattgtcatttgattggagcgcaggaaaaataaaggaatcggatgagagagatagactcaaaggaaattttccaagaggttggagctcttgctaaattttctccaaaatctacatgcaatgtgccattccataggaatttcataggatttgaaaagcttcaatcctttgaatcaaagggccaaatagaaaaatttcttataggatttgaatcctatgaaattcctacataaatcttttgattcaaaggggccctaagaccttaaatcagtataagatatgatagatcccagtactaacagtccaaacaagttactagcagcgctggagtatcacattcgtactaaaagtttggaacggaaaaagatttttggaacgggaatttttttaaaaaaaacgtggattcgaaactttgaattttaaaccgtgccagatggcctcgaacgccacgccggcgcacgtggctgatcgatcgtcgccacgtcgctggaactactcgagcttgatcatcacacagcattttgggtttaaaagaattttttgaggcgaattgtgcgagatgctgtcgtaccatgaaaatccgtttattaatggccaagttgtaagcaagagtcaacttgttaacaatattatggaccggaacaacttgttaatttaggtttaattcattcacacctctacacattacctcaaaagaaaacagaacaacgttgatatgctgtccgtcaacttgattacttgagggctgtgattcggagtatcaagttgacaaaattttcctctaaccggcaggccaggttgacaccaatatgaattggtttttatttaatatcataaaaaaatggctagtgaagattgggatgttgtttggtttgattccaacaaagtcaatgtgagaataatatgtagtggtagtacgtttgtggaagaaaaaatggtaataaggctagattttaattacctttgctcaattacgcatggagagtgtttcacttaaaaagaagaacttgaagaataagggtgtgtttagttcacgtcaaaattgaaaatttggttgaaattgaaacgatgtgacagaaaaattggaagtttgcgtatgtaggaaagttttgatgtgataaaaaagttggaagtttgaagaaaaaatttggatctaaacttggcctaagcctaaattaatcctaagactaaattctagttttaggtaccaaaatttataggatgtatgtctttatctctgagaccgaagatgtaaatcatttctattatcttagaaaaataaatatccgaattatcaaacgagcaggcccaacataatagaactacaatcgacatcgacttgctcttacattttgtaatcctggagtgaccatgatggtcccagacgtcacgaagactttggaacacaccttgagtagaccaaagtcttggtcattaaggatgagctaatgtgatattccaactagtagactggtgtggttagtaggcagagatatccattatgaagcatgcaatttgctctaattaatgaattccacttgccacctttgtcaaagcctcaaaagggagaaattttgcataccaaaatacttctacattttgcataaattcatcagtgcaaaatgcagaaatctctgcacaaagttcagtttccgggggctgaatttaaactgaacataaaacgcagaaattcttttctccctttcagagcaatataaaaatgtgcaaagatccaatcagaggatgatcctgaaaaaaaaaatttagccaagaacaaaacaagcgtcggcataacaaaaattcattgcaaaaatatgaaccatttgtgccggcacaatcatatccacatgcagcattattatgcaaaggaataatgtactcagtagtatctcttctccaagcagagagcatcttcttctgcatctcatcatcatcatctgcttgtgtttgtgccggccggctgcagagtgtaggcagtgctcaactgcataaccatacttaattatgcatactaattatattatatatgtagtgctaattaattaatcataattaaactatagtacataatatcaatcactcacacttacaaaaacaggttattggcttaattacatgtaattaacagccatcatcatcatcatcatgatcacaagcaccccaaaggttaaacaaaaaagttacaaaaggtaaaaaaaaaaagaaaagtaaaaaaaggagggtaaaaaagagaggagaaaattaaaagttatttggatctctagctaaggtgaaagaaaggcttccatggctcaatgcaccttcttggagaagaaccccttgatgccgaagagcccgccgccgccgccgccgccggcggaggcgcgggcgactccggcgtcggcgcggcggcagctcacctggtggcggtacccgatgcaggagttgatgctcaggttgatgccgcgtatcccgccgccgccggtggcggaggtggtgtggggtttcttggcgccgccggttggcttgtccttgtggtgcggcggcctcctgtccgcggcggcgtgcttcgccgccggcgatggcgggcgcctgatctgccagaccgggctagaccggcccaccggcacgccgccgcctgcgcggccggggctggcggcccagcggcgaggaggaggaggaagggacgacgccaccgccgccgcctcgccgcgggagttgctgcgggagcacggggcgctactggccttccgcggcggcgggcggggcttttacgaccccacgccgcccccgccggcggagcggctccgggagaacgggcagatgttaatgttcagctccgatccgcctccgcctcccgccgggttccgccgcctcgtcggctgatccttctccttctcctccgccgccggctgctgctgcttcttggcgaatatatccgtccacctcttcgacccaccaccaccaccacccgacgccgccaccgcagcagtgggcggcgccctggacgcgacggccgcaccaggctgcacctcctcctcctcctcgtcctcatcatcatcatcatccgcgacggcgagggacatggagaggtcggcgtcgcggcgggggtaggggaggggttggagggggaggaggacgccgccggagaagagctcgtcggcgcaggagggggatgcggcggggtcggcgtcgaggggccagaagcggaactccggggaggcgctgctgctccgccgcctctgcgctgctgcggccatctcggatcggcgtggagactgcttcttggagatggaggagagatggttgggggggaatggcgaggctttgtatggcgtggcgtgcggggagggagggacacatggggaggtgggacccgcgcacgccctcccatttttctgatgcagttatgagaggtgggggtgtgggacccaccgggaagtggctctgtgggtggggtagagggaggggaagcgtgagggcattttggggaactttattaaggactcgttcgattttcatgcatgcttaggaagaaatatttccacttcatgtaaaaatgaagaagtttattaacatataattaattaattaagtgttagttatgaaaatatatttatttattttttcttaaacaacttctatatggatttttttaaaaaaaattacacagtttaacagtttgggaaggtgaagttgaagttgggctagtactactttaaaagaaagttgaaataaagttacacaaaaggaacaaaatagcaaatagtgctctttgtttttaaggccgagtttagttcaaaaattttacttcaaacttctaactttttaatcacatcaaaactttcctacacacaaacttttaacttttccgtcatatcgttccattttcaaccaaactttaaattttagcgtgaactaaacacaccctaactaacattgtcaggattcactttaggtaagtgtggcatgttatattttttaggcctataaattacaagctatacttgtatacttgtggtagagttaggtaaataattaagtttatgatacgtgaggctaggtgctcagaacgtatggcaagccatcaaatacaacgctaaggaggtgtggcaatctaaaatgtggtgtcacaagttgaagaagtgaacacaaggcttctgctctgttttttattaagatatagattttattttggtttttttaccattttttaaactacaaaactgtgtactttgtgtgaaaacattttatgtaacaattactaaactatcatataaatctatttttatgtttaatataattaaaacttaattacactaatgcgtgtttaatctttcatctctggtaaactcaagcagcgatattgatagtcatggtttcacttacctactcgactgcactaagcggcggttggccatcactcgaaagtttaaccaattcgtgtcgttgaaaatgtctgattaaggatctacgaggggctgaacatattgtggtcattatcagcatgtcttaccagtaattaaatcccatgaaattaacattaatatcatatcatccacctctatctccggtaccatgtccacggagtatacggtgtatacttgctaccactggtggagaaatcatatttggtcggtcgactaaatttcacaatagtctcggttgcaataaaaccgggactaaagatcatttttagttccggttaaaaaaattttgatctttagtcccggttggtaacaccaaccgggaataaagatcatttttagtcccggttcaaagaggttggtgggtcgagtcaggctccaattatctttagtcccggttggtataaacaattgagactaacgatctactaggaccaaaataaactgccgagccgtgcgccgatcttatctactcggtatcccctccccctttcttctctccttcattaagactcggtatcccctcccccttccttctctcgatcagagagaggcctccttcccttcctcccccttcccctctcctcctctttcccgcctcctcctcctcctccccctctctgtggcgaccgggcggcggtggcggagcgagccggccgcgcgacaggcggccgtgcggcgaacggggtgcggcagccggtcgggcggcggcggccgcgtggcaggcgaccgtgcggcggacgggtggcggcggcggccagtggggccacgcccagcagcggcgggcaggcggcgggtggccggcggggccgcaggtggcggctgtggtgggcggcggcaaaggcagcccgcgttgttttctttttttattaatttgtgattcactaagatgtacttttgtatggataattctgtgatttattgcacatttgtatggatctgtgatgtatttcatttgtttgtattttttaggatttgtgatgtatttgatttgtgtgtataagtaactttaagatttgtgatgtagatttaggatgttactttgatttggggtatgtatccaggagaaaataaaaaagaaagaaaaagaaaagggaaccatctgactgccgctaccctctctttagtcccggttggtgactaaatatctctctctttagtctcggttggtgttaccatccgggactaaagatcgatctttagtctcgggtatttgaatcgggactaaagatagcgatctttagtcccgtattcttactctcggttggctatagaggattaccaatcgggagtaaaaagggtttctccatcagtgtacagttcacgcttttttttagtaacgaataatgtagcctgccatgcatgcatatagggtgtgcttggttgcttgtattcccggagtacgtctggctcatttctcttatccaggttgatcagtttatcctggtttaacgtatacatatgcaagtgtttagttgtagcacagggctgatggaatggttgtatgtaggagatgtttggttggatagatatctattcttgtgagtggtgaagttaccatataaagtttgtggagcgagatttttttcaagtccctaaatctgtttatgggtgataaggttaatccacaatagatgttatagattaaattgtgttactctgggtctatgcccacctactaatatttttgagctcatgtttctgttagagaatcgatgtactacgtatgtatgttttactaagttgctccggtccataatggaatggcctggcttactagatcaaaatgcaagagagtgattattatagcaaaaatcatgtacataatttcatcggcgacactggtatatttgacaattcaaaaaagcatacaaatatacgtgctcatggcaagtcatttttttaccggatattgattacaaccgggacctatagcataggtgccgatttttaccagcggccgacattaattttgttggtgggcattggcggaagggtaataggtgccggttttgaattaagaccgatacaaatactcatctctcagctggattttggcgaaaaacgtttaataggtcccggattttgtccaaccggcatctttaaagccggtccttatacattttttttaaagtagtgtaaccacatatacaaaactaaaccactggtttggaacaaatgccgaggagagaagggacggtggtgaccccatccacgggttctgcacgcgtgggtgcaaacagtgcacctgtgagtgcagcctcacagcatgagacgaggtaggctgagttgcgaaggttgattcgaccatttcctctcagcctggctccatgggtctttttttgcatccatcgggtctggctctaagatagttgcacacaaccaaacaggcacaaatctaatctgctggctaggtgcgagccaggtgcataccgggcaatcaaacacacccatatactctttccattctataaaaaacaaacctaggatgagatgtgacttcctccatcccaaataaaaacaaatctagtacgagatgtgacacatccttatacaatgattgtaacaatatcaagtaaaaaaatcaaactaaaatttaaaattttaacaaattttggtcgaatttcaccgtagtcaacggctttcatgaaaaccaaaaaacctcaggagtggttttcagaaacgattcagatttatgaaccctgtacgttatatcttctttgaaccttttttttgatgatagtattacagatcgctgatgagaaatttgacatagcactgtcagtagaaactatatataaatatgccacagatcgcagtgcttgtgaattattgttagtttctttcatcggcataaattcccataggcacgcacggattttagttttatgtcgaaacaataggacactgacaacatacggatccgtttaattgtctgaatgtcttatcaatttcaccataactggttttagatatgcacgactttattagtgaaggtcagtataaccaatcaacaacgctttctttcaaaagaaacatatatatactgtagctttgaaaacggggtgtttcaactaaagcatgagagcagattagagaaactaaaaagttttcaaccctttgtggggaactctcatggatgtaatggatagagaatacacgagtatattccttaatatgcacctagaaaaagttgtactctaaactttctatggtttactcaaaacttatgccctacaaacttgacaacaattgatggtattagatgagctaccaactggtctattgttacctaagttggtcctgggtcctggcctatatgtgcaacatgtgcctaggtaccccagtttgtctctccatgatactaatgaatgtggaatatcttttagtacattaatctacctagctccacctcatgcattcttggtgaaatatatattgtgaaacccatatttcattctcggtacggtgccctcagtcacgctccactactacaaaatatcaaatagatgctggcattatatgtgccagagtaggtaaaaccagcacctatagcgcctttctccgtacatgagcccgtcagcccgccgaaatccaaagaaccgtcacctttattctcaatagatgccggtttttaaaaagaaccgacacctattactggtgtcagagaaagatgtcgggttttattgaaaatccggtaccttgtagtatccatcccatcagagtagttggcgcggggcccaccaaaaaacgagcatctttgttgtaaaaggaatatgtgtcagttttttttttaaaaaaagggcacccagtaataccgagctgagccacacgggaagccattcttgtccatccatccaccatccagagtcaacagagtcacgttcttatctctcatctctctctcgaactcgtctcttcgcctctttcctccgcctcctctctcgcctcgtcctccccggtggttgcagtaggtggcggcggcagcggcaggagacggcggtagcaggcggcgatgggaggagaggcagtatcggcgggcggcacactcccctcagccagatccagcgggaggggagacagcgataccggcagcagcgggaggagctaaaggcggcatcggcgggcggcgccctcccctccgccagatccggcgggaggcagcggcagcggcgtcggcgggaggtggcggtggcgtcggcgggaggtggcggcagcgggcgacggcaggaagagaggtgatagtggcgggcggcgccctcccttccgccagatctgacgggaggggaggtagcggcggtgccccacgagtgttttcttgttcttgttcttgttcttgttcttgttgtcgttttctccctacttcccgctctccctcgccatcctctctcgccctcctctctctcgctgatctcgccatcggcgattgtctaccatcagtagggcctctcggcggcttggcagaacggcagcagtggcctctccttcctctcctttgattgattgtgaataaatttgtttgatgttaatgtatgatttgtgattatctatatgaacaagaacttatctcattttcttttagatttttcgattattttttttggcttggaggcatcggctcgaattgagccgagctgtaacatcctcaaattttaaactaaaatttgactgcatcatgctggcttttgattaaattagtgtgttttttaaaaaaatctatttgattcttaaattggttcaagtattacttctttagaaccctactaacttactctaattatttcctttattccaaaccttagtaaatttgagcaaattctctcaaatttcaaattataaattatttctttagtctaccttaatattagtgaggatttgctacacttcaaaccctagtgaaatattcaaaattcctgaaaaacactgttcattgccttcaaggtgtttgacagaatgcctagcccaactaacttagcccaatccccacccaatcttgtgcaaagtctagaattgatcctaggggaccacatcccactcaaaaaccatggtttagttggccttctcctccccttgcgcgcaccgtcctggcgtccgactttgccacgcgccgagccgtcgcgcgtcggtctccggattgatcacgcgtgcccgaccgccttggcgcgctgtcgcctgtccgacgccctcagaccgtcgtcccgcaccaatcttgacgacgacaaagccgggacgacgactgccgcatgaaatcactgctcgacgccatgcgcgcccgtccaaagccgccgtcgagtgcaatttcgcttctacccggggtgaatcacgccaattcttgccgcacggttggattgaagatatacggtggtatcccctctcacaattcaaaccattcactccctagtcggccgttttcaccctcgccgccgccgcgcgtcgcgcctggattggcgccaacacgtcgccagccgaattcgcacacggtcaagccaatccttcgacggtaagtattcaaacgtggcctcctgccactcaaattgatcttggccgccctctcacaacctctgccgccccagccctatccaaagattgagctcatccatggcgatgacagtgcccgagctcatccactccttctaaccctataaataggaccccaatcccttgcttgttcatcatcgatcatcaacaaccataaccccacaactccgaagctatgcttccccaaacattccttcaaccactctcgcccatcggtcgaacaccttgtgcgcgatcgactccacacccctccatccatcctccgccctaaatatcccttagagcacctatatcctaccatgttctagcatactaagtcctaaccaaagccctacatcaagttttacctcaccacatcaagccgagcactgccgccctcgcgctgctctgttcttcgccgccgagaagtttttccggccgcaatttgtcatttcaaccgatctcggtgagttcttccgtttcaaccatctacatactacatagattccattttaacaatccttttgcactatcatgccaccccctgagctgccgacgtgagcacggccgccgccaatggaggcgctcgtcggcaactattctccgtgccttgccaaaggtcggcaagctatcggaatccatctaggcactctatagatgctctagaacccctcccctagccatgtctaactcatatcatcttgatcaccatcacggcctagccgtgccaccgccgccctagccgccaacccatccacacatcaaattaatctctccgccgccgctcgccgtagccagagaaccctagctccctcccctctttggccgcaaccacttttcccctccatcaccgccgtaatcgccaaccctagcaccgctggccggttttggggaacggctagaggtagaagaagagaagagagagagagagagagagagagagagagagagagagagagagagagactgacaggtgggacccgcacacagtaacatttcacttttatttgattttcaaactttagaagcccatatcttttaaaatatagacccaattccagtgaaacttggaccaatattcttctaaaatcattctctatcttttgatcccctttttgctatttttgcattttattttattttctctatttttcatatttttggattttatttgaattccttttgaatttgaattttatatatgtctaaccctaggtcttgaggattcttctgacttaatagataatatcaatcaatctcaggacatcgagcaaggcaagttaccataaaccttttgatcatttaagcctatattttacaaattatttatttatagccttctattcaatattctattttatatgcataaatcaatcatagaaacccagataatttagtattgcttactttgcttacaatttggttaaaataccttatacttagattgggacagtacgtaagatttggttgatttccgggtggctagtactatctcaatcgatataagttttaccaggtacttatgtcgaacgaacgagtacgccgcagtttctagaatggggacagacctagttattatgttaatcagcaatatggctcctctgtatagtggttcatatttttaagtcctcgcgcaggaggcaacaatagccgcgaagggcaactttaaccattaccatgtataggtaaatggtttgtgatactcgagtataaattatatggtatatttctaaaccctgatcgagatgacgtggtgtcatacgatcagttccccttaaatacctcgggaacgccaaaactcctcttgctgctgttaacaatacgttcagagcatatgaggatataagttcatggaacaggtgccacaattgttaatgacttaatactgggccatgactaaaaccgatgattatcagcaagtcgtggattgcgggtaaagcgtacatctgctggagtagaatatctttgaaactattcgaatagctgtactcatggagttgagtaccgggactcatgtggtaccctggttagaaatctaaagtctatatgttttataaatttttgctataactctttcagattgtttattactgctttttgcaaagaaccctactatatgttaatgcataacatatttccatgataacttgctaagtattgtgaatactcatccttgctcttataacctctttttcagatttgggtcaagaggatgacccttatgactattactacgatgaccccgataacttagagaatccctaaaggttatacctcccagttagaatgtatagaaacttccgctgtgtattaattagttaggtgagtacctattaatgtaaaacccttagtattgtaaaactttaacatatgcaatgaagaaccagatatattgtatgtatcaatatttactgatccagggattgatacattaatcatagtcggatccaagttgttagttcccgggtccgacacgagccaagccgtattttttttcttgcgatccatacaactcaaaggtgccggtttttgaaccggcaccattg

SEQ ID NO: 54531 - DNA, 1358 bp, Oryza sativa
agttggtcacctatgtttttggcttggtaaagacgacctaaatatattgccaagatagtacattattactagtgcacatgtactcatcggacatgtcgatgatagaaatgcacgagtcctctttgatcattttcttgttctcctctcttgtacaatcttgtttgcatgccctcaatggtgatgaattgtacgtagttttgctgtggcggttgcacactcatcttcaatcttggccggtaattaatgtagcgaacgtgtactgtttgatctgtctatataggctggcggatcaatcaagaccttgttgtgaagtttacttggtctaaaaccaaggagagatatgttcaccggttttggccattgttgtcccttgccacgatgatcgtctttaatttcatggtggttgtgggaaaaaaaagtttaagcacacgatccatctaattaactggataatgttccaacccaaatcgatcgatgataatgtagctagctagtccaggatctcaaggagtctctctcatagatactccctccgttttacaatgtaagtcattctagtatttcccacattcatattgatattaatgaatctagatagatatatatgtctagattcattaacatcaatatgaatgtgggaaatgttagaatgacttacattgtgaaacggagggagtatatatagatcacatgcattctgaaacctaactagctaagtagctactccctccgtcctataatattaaaacctatgactggatgagacgtttcatagtgcaatgagattcattgtactatatgaaacatcccgtccagtcctaggttataatattatggaacggagagagtagctactactacatccatttttaaatatatgacgtcgttgacttttggataaacgtttaaatatttgtcttattcaactttttgtgtgaatataaaaaaaattaagtcatacttaaaaatacattagacaataaatcaagtcgcaataaaaaaataattacataaatattttgagtaaaatgaatggtcaaatgtatcttaaaagttaatggattcttgtataaaaaaacggagggagtagtacttttttacaaaatggttgatgaaacactagaatttcgagctcaattgcatgggaggcttcttcacacatcctctccacagaccacagtacacgcaggcaaacatgtatctaaagactcaattgagatcctctgtgcagtactgcagaggacctgcatccctgaagactatatactgccagcatctgcatgcatgcatggtacaaccaataggctccaaattaagcacatatagctccatcgatctccatcgctggagagcacgta

SEQ ID NO: 54532 - DNA, 23323 bp, Oryza sativa
cggttgctagaatatatctttgattataatttcattacatatattttttactattataaaaattaaagatgtttgtgtcggtactttggtacgtcatccatgtatgagttagttttaatttcgttcgcttttggaaatacatatccgtatttgagtagatttttaagttcgttcattttttaaatatagaaaggactcctaattgtagctcataattttctaaaaaaatatatctaatcaaattcctatagtaaattacatcttaactaaaccatataacaataataagattaaaatagtgttcacctgttgcaacgcacgggcattcttctaatataagataaatatttaatgttattaacatacttttaaagagattacttccaccgtttcatattataagtcatttgatttttttcttagtcaaaattctttaggtttgacaaagtttatagcaaaagttagcaatatctacgatactaaattagtttcattaaatttaacattggatatattttgatacgaaaggcctcatcttttcacttatgcttatacctattagctaaaatttaaattttcaaccttaaatttggagttttttcatcgtagtttattttttagcctttgcttttagatcattaagaacatgtatataaaaattgtattcataaattatttttcgtttgcaaatatgatgataagcctaatgttgaggctgggagtttgttttgtattgaaaacattattatatcttgctgcaaacttggtcaaactttgaaagtttgactaaaaaaagtcaaacgacttataatatgaaacatgagaataattattcatacacatacttttaaagactcgtgtttctagtgtctttaagctaaatattttagaagttattgatagttaaaattctaattattcaacatcaattctatctatccaaaacattaataattaagaaactggagagctcctagctaagagataggtagatacaaatacgcatagatatattgagagccatgtgagccggccctagctagctagtagaacacacaaacacacacaactaatgctaccatgcatgcatatatatggatggttcgtactagctactacgtctttttagcttgtttgttggtgatccgatccaatccataattgcgagcggcggatggccggccagccgccgccgccgacgattaccccggcggccgtcagatttgaattgttcgccggccggcgtgtgcatgattggccggttgccggccggttgggatcttggcatgggttgcccatgaatttgcatgggcctgccatgattgtgtgtattgtgactgatttgatggggtgcatctagtcgatcatcgattaattcatcgagataagctagcacgatcaaaatctggtgattttgttaatataatcatacctgtgctaattaatggttgaggtgaaatggcattatcatgttggttgattttatcggttcactgttgatacgattagggaggagataagccaccgtttccttcctgatcaagaaaaaaaaagttaaagataaattatgttttgtgcggtcggtatataacaaagttcctccgccattatattatctttgtcaaagaaagaggagagataaaagggataatacatgaattgaagtcacaattttaaaatcctattataagtcgcccgatcaacttgacgtaccaggaaggtgttcgtacagtgtctctgactagtttctgacatctagaaagaatttcgctacatcgatagaggtcgagtttagttctaaatttttttttcaaacttttaacttttgcatcgcattaaaatttttatacacacgtaaacttttaacttttctgtcacatcgtttcaattttaatcaaattttaattttagcatgaactagacacactcagaaagtattgaccaccgattcatgattaagtcgacgcccctacttttcctacgacacgactggatcataagaacaagaagaaagaataacgaaagaaccgcaagcaaaggaaattaatagacgaataggtttcaacggcttcatctttagatcagttagattaattccacatttagcagggatgatcatggtcagactaagaccgagattaagtaaattaaactccaacatatcttttcattaattgtgtcctgttttaagcatttagtttgatttggaaatgaaaattaaggtcaacgaattaagatagatcagatcagttgtttgcctatatggtagtacgtggttttggtgaagtgtcccatttttgccctccgtacactggtcggtgcaaaacgccagtgtcattttcctatcttaattcttaccgtgtggagaggatcagtactcgtaataggggcgcacggtccaagtggaagaatcgtcaggattggccaattaaacctcgggctggatcagctggtatcatgtacacaattcataaatatttaatgtttgtttaaaggggaaatatctaatgaaaaacatcaaataagtgaaaaagccgtgaaaaccatatctaaaaccatatctaaaattcataaaaatgactagagataggtatagacctgaaatacattcataccaaaactcaacttcaattgagagataaaaaaaagacaaattttaggtgaatagtgttatgttattattcattcaaaaattttcttttttgtcactccataataaagttgagtttgaacttgaaatttagtgagaatatatttcatatctatacctatcttaggtaaatttttttatgaatttacaaaacttttaggtctggttttcatggattttcacttatttgatggttttcaccggatatgtccccttgtttataataaacttttaaaattttatcttaaacatcaaagttaatttcctgcgagcactccctgtttttgtttgtgtagtgtaaattttgatttttcagttcttgtttgtatatatttgtaaatgctaaatacccatgtattgtaacaagtatacgttttccctctctcatagccttgataatttttagtccaaaatgcatcagtgtttaggctgctttctttcctagttttctcaactcaactctctcgttttccacgcgcacgctttttcaaactgctaaacggtgtgtttttttaaaaaaaattctatatgaaagttattttaaataattatattaatctatttttcaaaaaaattagttaatacttaattaattatgtaataatatgtattttgttttgtgtgccctcctcctcccgaacgcagccttagtagccctacatgtcagctgacggtgggagtatgtggtgacagattctcaccaacttaatttattaatgctcaaaatttcaattggtgggtgttgatagattcaccgctcaccagcactactcgagtcttgtaaaggtgtaataaaattgccattgcattgcaccatataaatattttgaccattaattcctgttctgtaaatttaacatcatatattcgtgccaaataagatcagatccaaattattccccctacttattgaggacctattttagttcgaataaaaaaaattaacatgcgtatctgttgaactgaattcgtcagtcagatggagtcagaacactggtccggagatatttctaaaacgccaggctgctgatatatataattgagcattcgtcaaagtaaagaagagtatatgtcatgtgctcctctgacaagagagacgaaaaaaacgagcacaagatcactgcaaatacgacgtacgaattgaagctagcagctctcgagcaaacgggatagtgtgtccgagctcaattatttgtgttgtttgacgagttgaaacgcgtattcgtatgtcgagttgcaagtcaaatttctcgagatccatgcacagtttgaattgaattgagcgtacgcccgccgcacagtttgaaaaggtctccccctttgagaatatggtttgggaattcaattagaagcagttcatttgtttttggcaagttctaagcattcctaattcattgttattcaaatatagccaatattttgtttgtaaaaaaaatcagagtaatgcatggccggtttatgacttcggggttttgggcacaaagaaccatctgaaaagagaagtccaatctgcacacttgaaaagtaaaaaaaaaaaaagcaatgaaataatatgatttaatttaaaaacttttctcttttttttttcctgatcatggcggtgatcgggtgatgcgtggcccatccttgatcctggagcccacgcgcttgcctacttgatcatcaatttgcccactttttccacataaaaatacaggcaatgcatacaccttatcatgagctatactcctagctagcaagcaagcacacagaaacattgtttattctttttccaagtgtatattccttcctttttccagctttttctcccattttgtaatgcctgcctaaatggagtagctctatgtatatcttttttctaaagaaacaaactacaaacgcattcgctcacaacacgtgcactcatcccacacacatacaccctactcctatgagcacctcgggaaaactgagtcgacatatcttgagattaacgaagtcaccacggatctcttgctgtcgacgggtacatcacctaccattgaaagaataattaaccgtaaatatgagtatctgtgtcaaatttaggatttgaactcgggtagaccaagtaacctgaccagctacgctcactacgcagctctatgtatataaatgcaaatatgcaatgaccttgccttaatttgggacacgtgtcacagcatgtgctggatctcattagcttgcaaacactcaatgtgcattatgcatatgtgtcaatgtgtgtgttctaccatcacccatcattggtacattttgctacatgacaagtagtaccagatttattaacttggttccacatcttggtggagtaggtcatatgcatttacaagctctttttttcttttcttttctgttgatcaaatgattgatcaagtagatgtgcacattccttttgggagttaaaaaaaatgcttacttaattacattatacatgtatgtctctgtctatctgatcctctgttatgtagcatcattgcacaatgcttggaatctacttaattggtgaatcatgggggctatcaaaagaattaaagggaagggtgagagttgtgcaccagagactatgattaggagctaatgaggggttgttagtttgtacttattgtattctacaaattgtattattgtactagatactaaatacatggctcatcattgggaacccttttcatttgaaagaagggtggcctgcatggtcccctatgaacatgttatttgcttgtcaagacttaggtttgttgggtgagcctcttttgtgtgacagcttggatgaatgtccaaggaaagaattaagaaaacatcatgtagaatatataggtactaacaagtactcccttgatcctacagccatgatctttgcataaaaagaggatatggttcaatgaaagcaaccaaatacacaactctgaagaaagtaacaatgagagaaagtagaaccgcatttctcttttgtgcttttggttcgtgaggatattttaataatgagagggaagaaaaacaatatacaacattgaagaaagttaagtagaaatgcattattcttttgtgcttttggtttttgaggctattgtaataatgagagaaaaattagacatgttttgcatacacccctcatggctaagctcaactatcaggatcacaaattcaggtggcaggtgcctttcttccctgtccaattcaggaaccattctgctgttgaacacgaccatacatgcagctctagatcctcaatattttttcttggccttccttctcagcaaccataaggacagacaggactggatccatagcaaaatagactaataccctaccaagtgaagtgaagttcatcacaaagaaagccaggaatgaactggactttgttctgaagtggctacagacaggtggttgggatggcaattttcagaaactagatttgatatgccttaagtatactgcccaaatctcattcagtggtatcacaatcatgcaacactgccagctgcccagctttaaggctaaaggctaccccatggtaacagtaaattaaccagcatttggatcatatttgtaagttccaacaggttgtcttgagctttcctctataatcaaatcacagcaagtttcggtgaatagttctgaaaggagcgcatctaattatagcaaagatatggtgttaccgtattatattataaccaaccaagccaactccaataaaattatactaccttcattccaaaatactccctctgtttctaaatatttgacaccgttaactttttagcacatgtctgaccgttcatcttattcaaaaacttttgtgaaatatataaaactatatgtatacatataagtatatttaacaatgaatcaaataataggaaaagaattaataattacttaaatttttttaataaggcgaacggtcaaacatatttaaaaaagtcaatgacatcaaatatttagaaagagagtataatcatttttgggcgttttaaaatgtatctggatattggaaaacgcacataaatgattatattttagaacaaaggggtagattagtacacgggcatggcatagttgtaggcacatcattggaagagaatacagagcaacacatttaatctttcaatcagcacaaaacctttcctggtttcagctttgaaattgttggcacaaaatgtaaaatttctatctgataccatttctaagctggcacaacttaaataacaaatagtagagttctaagtatctctcagacttaaattgactgctaatctaatttgaagctaattaatgggtacagggattagtgaagccaggctgaatgggagtcgagcagttaactggttcagtctgaagaaaggggaggaatgtcttcagcgatccctttaccatcagcggcgtcgtaatagaagaaattcttgatcggatcacccttaccagatattgacttaatcacctcctgttaggcaaaaacagagtgcaaaacaatgagaactgtgcataaacacagatgaaattcctgtttggaacagaacaaaattaagttcctgctgcttttgaagattaacatttgacaaagtacagaatacttttcttggcaaaaaaaggaatattactacttttggactcctttcagacatcactgagttgaggttgctaaataattcagaaaattttacattgctacagaatgttcaaatctttcttgtgctagttctttcattgtgtataattccttgaaccatcaatacaaaatccgtattccaccaaaaggctgtagataaaatatttacatctttgaaggtgtccagtgagagtaccgatccaattccatgtgtaactatcatctaattgtggcaacacaatatccaagtatgcatcttgggcccctggactgagaactacacattcatgctcccaaaattgtatggctgagctagggaatcataactgataattagaggacacagcacttctgctagctttacatcgatcttacgtagcaaaaggatagtcaaacttcagcacatgtctgggcaaagtgtctgtcatgggaattgggcctggaggctgtgagacccacaaccaggacaagcaaggcaccctcagccaggggccatcattcatgattataaattaagttgtctttcaatatgtccgaaaagacccactaaggaccttaatatgtagttcctaagttcatggacccaagtaatgtggtttaagtgaattactgcaggagtaaaatgtggatgcatagtatttgttgaggagtttatttttttcttttgggggaaatggttattgtgaagttagtagtttacttcaattaccatctactagagggtaaatccttaattgccatctagttcaaccacatatactcaattttcacattcaagtaatggaacattggtacctacctgaccaagaatgccgccaaggattgcacatacaggaggatgttgcttctttccagctgctaaaagccgttccaggagagcagtaggaatttgagactcacttaaagactgcagtttatttaccacaccatgaaaaaaatcttaaagaacatgattgaaattaaggaacacaaaaacttatataccattttatcacacatgtccttcctcagagccaaaactgcaggtcgatcagaaagtgatgcctcacaagcattgcggccttcagatgactcataattctccagtactgcaaaaggacatttcaagaggacatatgcgcaggggcagggaaaaacaagttagaaagctggctgatttgtttgagtatttggggagataaaactgcactaatgaatcttcaacagtgctgcaaaagtctgacatcctcacctctcatggcaaagtacagtttagttgtttttcttggtaaattcttccagggtacggagatagcttcctgtataaaagatcatttccaatgataaacaaactgtaacattccaaactgaagcatccaaaatggtgatatatggtggcatatggcaacaaattgaacacatatttaagtgatgatacacataaagaaagctaaaaagtcaaggtcaacatgctacgctactccattcttctagggatgtatgcaaaatgaacaaaccagaaagcatcagcacattgtctagtgtagatttgaactcttacaaaattattccaaaaacacctataacccagaaaggggatttctgtggaaccaatttaattaccacatgaaatgaagacctccaatagtaaggctgggctacatgagcataaataagtgtatttttctatgccgtgaaaagaggatttggtaatagtgttgctgtgctctacatcaatcttctgtagatgtatctacgtattcaagtcttatccagattgtcaatcatacttagtttacctactccttaaaaggagtaaggagatggtgttggtatgctacactgatctccgtcaatatctatgtaaataagtatgtcctttttaggatttgattaactgcaaattggcacatgtatacatgtagattgccggctgatatggttttactttgttttagattgaagatgactgttcttagtattgtaaaaatataatatatgatacacatttattcgaataaataagcactctggcattctgatagtcaaaacaaaaaaacagcagagtaagcattttgtctatttatttttttgtcttacagaaaatcatttttttcagaggaaaacataagtttactattattaaaacatgaagacactattcaaattgtttattttttcaggttaaatggttttcatgtatatataccatgtagcttgtataaggtgcatcataaatattccacagctacatttatggcagccaagagagaacaaactacaggggcaatacaaaacatgtaatattaaatgaaagatgttatctcaagttggatcagcttcctctcaaacatataaaaaaaagatcagcttaacaagtcatttacctggagacttggatatgccaactcctttggtttgggttcacctccaaccttctgagaaaaaaaaaaacacataccccttcaaaaaagtatccagggcccaaactactgaacaaagaaaataattcctgaaacattctagtgatcatgatttccaaagcataagtgcttatatattcatagcgattgaaccaaaactagcattgcaagatgaatccttggtacaaattacaaaacttaatatgctagaaagtgtcacattaccatattttaagcaccaaaactaagtaacctttctttgtatcaccatttcaatgatgcagaaaaggaacagatacaataacttggttgaaaaccagtcagtgagagcagattagtacactacattttattaccaaaaaaaagtacgtgctcctttgcaattctcatccttaatggcaccttcatcaggctaagtacatcagatttaatatgttaacatgaacagtctgacataatgacatcaattttgagttcaaacatatcatagaaaaaaaatgagtgcctctagagtacatgaagaaaagtactaacaagtacacaaaccacatgcatgtacacaggaaggaatattggaagcagtatatgagaaacattatggagaaaataaaccaatttaagacatctgcgcgatgcttagtgcttacagatatatatgtggactgctggaaaaaaattaaactgaaaaatcaacagaacatatagcatgtcatatatgcccatacctgaacatagctatggttctgcaaatcaacaaatatttcaccacaggaatccttgcactcaatggcgtagaatgcaatatgcttgcttctcttccggcagttgtcgttaattaacaactaaagcagtacaacacatgcagaaatgttgtgagaactgagcgcaataaagagaaatttgttgcagaattttagtttaaaagacactgagtgacttggaacttgcaataggatgaagaactaaacgggagaagaatacacacctttgttttaataggcgcacagctaactacaattatgtcaaacttgtcaaggaattctccatcaattaatgatggatcacctaaaggaaatagcagaaacagtaagaaatttgtttttagaatatgctgtgaagatccaaagaattagtcattgttatggccacagatatatcagaattctctcagtaacatatatgctgatttcttggtacaatgatacactatagtaacatgtgcctgttactaaaattaaatgatttcttacaagaactttccttgttaaagtgcagctaaaagtgtaagattacaaattgaaatagaatctcttctttaacattttattcaaagattaaccattaggacgagagcaattcaagaatgcaagaaggcatcctactttatgtacttctaattctgacacccaaaccaatgaagaaaaccagactaggctcacccttttcgactgcaactcggaccattggattgaaatctttcagggactcacagcaaacctcagctcgtgatctaccaccatatatgctctcatcatgaggaattaagaaatttgcattgagatcatcctctgtgactaaatgatcatccatcaaggataaactgccaactcctgctagaacaatattcttgcagaactacagggtaagagagaaatggcatttagtgtataaggctgccttcgattatgagttaagctttatcaatatatccagaagaactgaggtacttaagtacctagatgaatatacaattgagtcaggatgcagctgcttatgatactctatgactacagaaatctagtttctaaggcatatactttaactactacctccgtttcaggttataagactttctagcattgcccatattcatatagatgttaatgaatctaggcacacatatatgtctagattcattaacatatatatgaatgtaggcaatgccagaaagtcttataatatgaaacgaaggaagtagtaaatagtataatagcaatcatattcttaacaaagcgaagtgcattgatcagataatcatgggatatgactgtaaaagaaaaggataaatagacatatattggaacaacgtaagctagcataaataaatgaaagaatttatctacagaaaattgagcctaaacgttgagaactaaaagcaattaactttaacagatggtacaacaggggtcctacaaaagagaaaaagccagcctaaaaagtaaataagaacattgagattttatctcgcaggcaatgcatccatagcactagaaagtctacaagaacaacagagcaataatcaaatgcccagaaaactaatgagttataataacgaactaaaagcaacaggtaaacatgggcaatttggcccatgaaactaacccctattactccataactcaatgcaacttcgtttcaatgctttgaatgcccacgcggtgtaaactacaaacaaaacgcaacaattggagaggaaaatcttaaaatacctacctcagtagtagtaccattcatgccgcacacgagcacatgagctttacttagcctgttccaagcagcacagattcagtagtcaaaaacagatgaaagacatcaaaagttttggttccgaagctaacaaatacgatggaatggaagaataatttgggggtgaaagttacgagaaattcaaggaaagcaccaaacaagctcaaaaaaaaagatttaggaaaattcaatagcagacacaagatacgaaaacagcggatatctctgtcttcacttcaaaaatacaaacacttcgggctcaagtttttcttttaaagaaacaaacaacagccattcgttctaacataaaccatgaaatcccccaaaagaatgattttcttttcttccttttctgcaagaaacaacctgcgattaaaagagaagaaaaagaagaagcatcaactcaacaaaatttcctccacataagcgaagagcgaaagaaaacccgggacttttaggggaagagagagagagagagagagagagagagagagagagagagagagagaggcggagccggggatacctcttctgggcgtcaacgccccagacgcggatctggcggtcgtagagcgccgtctcctgcgccgtcagctcctcctccgcgccgccgccgccgcccatcgccgccaccgcccggatccctagcctgggacgccgcgaatccgatcagcagccgaaggagaagggggaggagcagcagcaaagcgagggtttttggcgttcttggctttcgctgctgctagtagatgatggctttcacttcattctatttctttttctctttttatttgtttttttttctgttcggctgcgatttgggctttgggccttgggccttgggccttggatgaacggcccagcaggtagtttcggccctgaggtgatgatgggctatatgggctgatgggccaggccctatggttgatggtttgcgtcactaattaacagcttgtttggttaggggaatataatagagggaatgagagtttggagtgtggagattgttagggcatcactaatgtatatggcaaaatgatccatatgaatgggacccacataaatagtttttacctatggtaatctccacaatgtatatggatacaaggtatcattaggagaagagagaagagtagagatagataatataatttattccatatgggtagtccatatgtatatggataccttttgttatttttttctatatgaactagttgcacaatggtaataggtggttgaatgaaatattttattgcttatggactacttttacaccacattgtggatacccttatgtctattgtttgatcggtggatatataagagttttttttggagttgggaggggcactttgagcaaactccatgcttggaaggcaattcccttttttttagtacaacgagataaatcttaggcaaaatttgctacaggacacgcaaaaaacacgtaattagctgagggacatcgtgaaaatgtgaaactgcccgaggacactgcaaaatatgtgaaatttgccgtatgacaccgaacgcattattttattattttctagctgaaagtggcgagtatttttttcaaaatgacaagattgcccccaatggcaagtatattttcttcttcagtggcgaggcgaggcgcgtggcgagctcggcggcctaggtgcggaggacggcattctcggcgtcgacagcgaggaggccctgggtggtgaggccaagcacgatggcgacgtgcgcgttgtcgcggcggaggtgcgccacctgtgcggtgaggccatcgaggtggcgctgcttccgcatccgcaactgccgcaccaaccaccgctgacgacgccccctccccccgccgctgccgacaccgtgctcccccctctcccgcttgaggaagccattaagaaccaaccaatcgacggggaggtggacgggcacggcgtcaccgccagacactcggcacccagccgcgcgcgccgccacatggcacctagctgtgcccgccgccgcccaccttccgcccttgcgtgccccgtgagagagagagaagagagagaggaagaggggaaagggatgcgcctagccaccgcacgccggtgcttcccccctttaccgcccacatcgcgccgacctcgccgcatcacgcgttcccggtaaagtcaacgggaaagggaaagaaggaaagagaaggggcaatccgtgcatttagaaaagtatctcacctcttttgacctggaaataataaaataatgcgaccagtgtcatatgcccaattacacaatttttgcagtgtcctcgggcagtttcacgttttctcggtgtccctcagctaattacgcgttttttgcgtgtcctgtagcaaattttgcctaaatcttaccgtacatcatcacttcgaattagatttatctacatccgtactctaatagagatagggtgtgtgttcgttcatagggggtgggtgtaactgcgttgttagcgtctgtatttgtattgtgttttaaaaatttaaaaaaaaagagaagagattgggagtaaaagttaaacaccaatgaccaatcccttcaccaactcccttctccaagatcccaattggcaagtaaataaatttaagcactagaaaaatttcggaagtttttgttcttgaagaactttatttatcagatttttattcaatatatattttttcacacaattttgcaagaatacattcatattgctatattgcctgttgaattcgcgatgagcaccttgccgccaccgaatggcatggctatactcatgtaaaatcgtgtaattcagatagaatcgtgtaaacggtatattcatgtaaaattgagtgaaaaaaatattttgaagaagaaaaaaattctatgatttttacatgtacattatagaagatcttgtaaaataattcttgccttccaaacaaaattagcagtaattcaactcactgtaactcgttgaacatcacaatcagaagagacgcacctgcattgcatggcaattctttttctttctgtcaaactttttgagcaaaaactttttgccaaataatgaacaacaaaaacctgattggcaaaagtggtttgaatctaatttacagcaacgaaccagagaaaattcgacgcatacctgcggaagaaacctatcaaattcgccacaaacttaggcagatccatcacacaaagaacgcagcagctgttcatggcaaatcagaccacgccggaaagcatgtatatatgctgctgttatgctccagtgttagatagtatagggagagagatactgcgaataagccttagggacgattggaacttaagtaaacttgaagagatagagatggaaaataattctatcctaccataacgaactggatcaatacgatcttatccatatactagttcttcagagaaatgatatggtgtgaaccgactggatgcgtccgaaaaaagcaggcgatttttaatctgacccttcgatttccaccggatgattaatatctgaggcgattaattaatatcttggttaattgagtgagtacttgaagaaaccaaaagacagaacaggcatgattattgttgctggttcattcagcgattattcagttgaacaggtatatgaacaggcagggaaaatgaaaccgttattttttgtaagtattttctgcctactaaaagagagatcatttttccctaaaaaatagaatgagatcattttgcacatgttatttatggatctccactcctccggtccaatatcattgaatgaaggaataagtctattctgcctccctcaactcttgctcttggctgaatcccacctcttaactgcaaaattgggtataatgtctcctacctttgaaaactaatgcaaattggttccttcgatggtatgggagacggtttcgactgacgtgacaactttgaccacgttgactgcctaagtcagctctgtcaaaacttcgtctatcctatcttcttcccttttttactacgacgaactaaatcttagcgtacatcatcacttcgaattcaatttatatccatccttactctcatagagatagggtgtgcgtgtattcgttcataggggggtgaatgtgcgttagcgcctgcatttgtattgtgatgtaaaaaagaaaaaaaaaggagagattgggagtaaaagtaaaacaccaatgaccaatcccttcaccaactccctcctccaggatctcaattggcaagtaaataaatttaagcactagaaaattttcggaagtttttgttcttgaagaactttatttatcagatttttttttcaaaatatattttttcacacaattatgcaaaaatacactcatattgctatattgcctgttgaattcgcgatgagcaccttgccaccgaatggcatggttatactcatgtaaaatcgtgtaattcagatagaatcgtgtaaacggtatattcatgtaaaatcgagtgaaaaaaatattttgaagaagaaaaaatgtatgatttttacatgtacattatagaatatcttgtaaaataattcttgccttccaaacaaaattagcagtaattcaactcgctgtaactcgttgaacaccacaatcagaagagacgcacctgcattgcatggcaattctttttctttctatcaactttctgaccaaaacttttgccaaatgaaccataaaaaatgacgaaacaaaaacctgatttgcaaaaatggtttgaatccaatttaatttcgcatgcatacctgcggaagaaacctatcaaattcgccacaaacttggagagatccatcacacaaagaaagcagcagttgttcgtggcaaatcagaggacgccggaaagcagctgcatatatgctgctgttaagctcctgttcttcagagaaatgagatggtgtgaacggtgaaccgagtggctacatatgaaagaagcaggcgatttttaatttgacccttcgatttccaccgtgtgattaatatctgaggcgattaatatcttggttaattgagtgagtactggtaggtagaaaccaaaagacagaacaggcatgataattattgctggtccattcagtgattattcagtttaacaggtatctggagagagagagagagatcattttgcacctgttatttatggatctccactccggtccaatatcactgaatgaactcttgctcatggttgaatcgcacattccaatcgcaaaaccgggtataacgtctttcctatgttggaaactggtacaaatggagaccttcgttggtttgggaggcggtttcaaccgatgtgatagctttgatcctattaactgtctcctgagtcgttatgttggcaacttcctccatcctatcttcttcctcacctctccccctctctctattccctcttcgtcctctctttccccgacgaccgatctgttgccgtggcggtggcagcaaccctgcatcctacctactctactgatggacggcggcgcggccgatccagggggtgccgctccatgtcactggtgttggctcctcctccggctgctctcaaccccacgtcatcgctgctgtcgccgtcaaactaccatcagatgcattatgtgtgtcctaaccagatcactcactcactcactcagccagccagagagaagagagagagagagaagctgagagcagcaagaacgcaaagctagtgcagtagtactgtagtaccagtagtagtattttttttcctcaactcagacgcactagtttgtttgtccatttcttggtgtccaccacgccgcttccgccccagccgccgcagcgccatccatggagagtgtcagcagagtcacgagcacggatgcatctgccatcgctggttgtggccaccgccatgccaacacatcgatcgtcgagggaagagaggagagagagagagaggggtgaggaagaaggtatgatggagaaagtcactgccaagtggatccataaggtgactcagcaagttgatgggggtcaaagctgtcacatcggttgaaaccgtctttcaagccactgaagaagccattttataccggtttttaaagatggagaagacgttatacccgaatttacagctgggaatatgaattaacttaagagcaagttgagggagccaaagtaaacttattgcttgagtgaagaatttttttcatttttagattttttttaatatttacagaaataatctatcggccaaaaaaattgcaaaaatagaccctgccgcccacggcgggtcgaccgcgccgtctgccgccgtcggccaaaattgcaattacccccttgccgccggcaatgggctaattgcaatttttgccgcccataaagaggttgcgctcgtactttttgtatttgggccacttgccgctccagtagagggcggcaaaggacccagatgcaaaaagtacggccaaacgatttttctatgttatgttaataataaataaagaagtatttattggtaaaacttgttaatattgttataaaaatgtattgaagttggttgtttcgcaatttcatatgttaagtaaggtattattttgtaacttattcgacgtattagtactcggataattaataggcctatcgcagtctcggtcgtagaaacattatatggacttaaacaaggagaattatgtaacatgaagaaatagtagtacaatttgaacatgatacaactatttccattgtggttatatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaacgcgctttagttaccctgtattgctctggtagttcaagctgcacaacacggctaggtggagttagaacccttctggtgtctatccattctttgtattgacatctccttggtggttcctaggaggaaagaatagatgtaaagcgagcaaagttagtaaatgttgtgagaaaataaggattcatgtaatcaaaatattcttaccatgaaatcgtcgtcaagaatatttggacaaacaaagaaccttcgacccaatgttgtaggctttatggaacgaagaacctgacaacgatcaccacacctgcatcttggacggagtgccgtagttagcacccgccagtcgctctattgttcacgacattgtcgttcataagctgcttttctctgtaagtattgctcagtactttcggatgcgaaataccagtgaccttcttgtaaacaagtggttaggtcgagaacgggattttctgtatcgatccactcgatgtatgcgcaagccgtagtgcgggtctgctgaatagagtagtgttacgaagaataaagcgattgcccatacggaatgaataagcatatgcagataataaaatacctcacggtcatagttagggcacctaaaaaagcgccttcctcgaatattaggattcctcgaagccattagttggcatcgatcaccgcataggcagagaggacgctggcaccaaggtggtagtaggtatcctgacgtgccatctgtgaaaaatatagtgtttcgtgttagaacaattcaaaaagtagtaatgtcaaacaaaagataacttgtaaaattatgaaataataataaaatcatgagaataatgatgtacaacaagagtacatgctatttaaatatagaaaacgttactaagggtacataacgatgacgtgcaatttaacatatatgtagagttcgataatataacataacataacataacattacatgtcgaagtccgacattacatcagcatacctaaagacactaggtgccttagtctgacgttacatcacgagacctaaagacatgacatgccgaagtttgacattacacgacgaaatataaacacatcgataagttcgaaacaaattacaagcaaagccacatgccaacatagaacataagaactacaccacgtagccagacgtggcacgacgacgcctaggacattatcgagtggaggtagtgccttcacccgtagggctagctccatctgctgctgatcctgatagtcctgcctccgccgcacttggtttctccttgtctttaggacaatgcttgtaggtgtgcccacgttcatcgcatttgctgcaacgcttcaccctgccagcctccgactcgtccatatcgttgcggatgcgacgagtcttcctccttccagccttgcctcggagcttcgatgggtcaggaatattgagtacttcatcgttagtctctgtgaactccccagctatgccgaacccataaatctcgccgctccatgtatgatatattgcttacttactgaagtactgtgaaacatatactgcatctggtatgccacactctgctgcggcagcaatgacatgggtgcatggcctatggagcagcttcggctttgcacaagagcaatgacatgtgccatcggctttgagaacacactcctgcttcactctcttgcggtagatacccttgcctaccttatcttgacatagtatctcaaacctgtgctgttgggtaccttgcactagagctcgatgtttcatggcctttttacgcaactcctctagctttttcttcatgaaagttccaaacaaaatgttgttgttcggcatagagggaagaactgcctggaaccgatccctaaaatacctgcatgtcccatgtaaaatgaacttcactatgccaactagtggcagtccacggacaccgcgcatcacccagttgtaaacttctgccaaatttgttgtcattattccatatctagcaccacctgtgtcatacgccttggcccatttctcttttggttcatgcagaatctactgagaaaatttccgaatctccaatccagttcttctaaccaatgttggactatccgttgggagaggtccaagagcttgaggagggtcagcatcggcggtcgatggagccgctgcacgctgatcactgcatttggctgtcaactcatctaatctcttccaaagctcattgaattttttctcctggttctgattgcatagcctcttaaacatgttcatgagctccttgttcttgaattgcatgaagaaattagctcccatatgacgcatgcaccacctgctctgtacatcttcccactcaccagggtatcctcgttccatactcccaaactgcaactcttctatcgctcgcagaatgccagcgtgcctatcatgtatcaggcacacatttggcctcataccaacaacttttgttttaaccaatttcaggaaccagtaccagctatcagtattctcactctcaacaaaagcaaatgctaagggcaatacctgattgttcccatctacccctattgctgttagtatctggccccgatactttcctgtcatgaatgtcccatcaatgcagagaacaggacgacagttcacgaatgccatcttgcatgcatgtagagctaagaatgctctttgcagcacactcttgctaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcgtattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatacgcgtgcactctccagggacaactatctttttccttaacacaccgaacttcatattgcgaccggttggacttggcaacccaaaactctctatgaagtgacactgcaaaatgttttaccgcctccttcatatcttctgctctactataaatcgctccctgaataacctcattttctttgtactcccatctcacactatcctcttcagagacgaccagctcagaaaaatcctcactagcccattctgttggattaatatccgtctcatcatctgacgaatcaccttcctctacacgctcgttgtcagaatcctccctctccatttcatccacaatggcaccgacagtctccccctcgtcggccactccacctggttgaatgcccactggagctactacacccccgtcctctcgtgcgttgacctcctccacagaagtctcatttacttcagcacttagtccctcgccatcatccatgttcatctgcacacatggatccttcgggtgaacaaacggaaccatagctagaggccacccgcgttgcaatgcattttccacataccatctccatactcgagagttttgaactggcattagttgccaataaaaaccctcagctgcccgacttactatgacattgattgttatgtcacttgtctgtggatcaactctcaagcccctcattaaccatccttttatagaaggtacactcctctcagccggtctatcaattcccctttctgatacaataaaatctgacagatctaccccagttggcccgtaacggacatttcctgggccatggtaaacttggaatatttgtttgtttgacatatctgtcaacgaaataactagatcacattactctttcatgcaataaacatctacaacgtaatatcttcttgtgtttgccaatgcaacggtaaagtattgattccaaactagcagatctacgtagttaccgatatctataatacacacttctagattagtacaactaaaaccctaaaaatataatgcatttattcaaacaaagttttaaaaaaatacacactatttaactcaatagtcacatataggatctatgaatattacctgaaatcggcgtctgaatctggcagggcttcgccccttcttctcttctcctcccctttcttctttttttttcgctggatttgagggggaggaatgagggctgggggctgggcg

SEQ ID NO: 54533 - DNA, 7726 bp, Oryza sativa
ccggccagagggcggcaaggggccgcctgcaaaatggccgacccagactggcttttttgcattcgggccccttgctgccccaacagagggcggcaagggctttactgcaaaaaaccctccctccgtcaccgcccatccctcccccgtttgccacgtcagcttgccaccctagaggtgggcggcagggtctatttttgcaatttttttagccgatagattatttctgtaaatattttttaaaaaaaatctaaaaatgaaaaaaattccttgagtgaaagcaatgcaaaacacattaagcccgttaccagcccattggttaatatccttgcaaagtgaccacgggaaggcctcggtagtggcagctgtcctggtttagatttattggttgtgagtatgttaagttgtggttttagttttgttgattaactatgtatggtttgtctcattcctctttaaaatgaggtatataaaatacaatgttaacggcttggtctgtatgggtaaaaaaggtattaccaattaccatatagctacactaaacaagctaaaaaggatagattacagtactgcaatttatttttgaaaacaaatacaaaagtgcaattttggaaaagaaaattgaggtaacatttttttaaaaagtataaggtatcatactttgcatttaaacaaccatccccttgagatatactctgttctttcataggtatattaaaggatggaggtagccttttgaatttattggtttcatatacagggagaaagagtatgtttctagacgagagggggtgattgtgatatttttttttatatgctctcatgagctcaaattaacttgacagattttctattcagtctcccctcatcaatccccaaacatgaaacaaatataggtgagaactgacactgcgtgccactgatggtaatgaataattaacatactgcagagtggtaatatatataagtattttcatacggttacctgcaatgcaacacagattcccctagatcaccaattgctgtggcgacctgacagacatatacatgtttagttcagcacgacaacaattggtaattaagttatattatcattgttccattagccttgaccacattttaatcatgcctaatttaagagggatcatggacatccatcaagcaaacgaacggatctttcttgaatgcttgatacctacgacaggcatggtcctaaacctacataaaaatattgtttcaattctctagtgattactcacataggaccagctaagcaataatctcctactaattttttcatgcatggtcccttgcctgtctaattgtctatctatctactatcaattaatccccctcaaatgctgacaagcatatctgcatatgcacagggatacacatcgaatcattgagtgaaaacagggagttcaactctcttgaggacttcaaatgggacaatcaatcgacttctacctatgcaaacaacttggttagcttacatgatgatcgatcatcttggtcaaagctaaaggtgcctaaagaaaattaagaatttagttgatcatacaactagctaggagagaattacttcgattaggtctaattttagtccctacgagagcccagttaatatatatggcatcatttcaatctaaataaaattctccggaacacgttaaggcgtgtgtgttttctaaagataatgaaattgaatctgagctctgtatcaagatgtacatcatatcagccacaaaaacacactgaggtgcgtatatgacagtgtataatctgttttttagataatgtaatcctcttaatctgaatcacattttttatgtgattacatgcatgcattctctgcatctgaatcatgagaggtgtcctacctgctgcaagttcccctgtcctacctgctgccacatatgataattaaaccgtataggccaatctaacaaaatttaaaattatatgatgaagactaacgtggcgcatggaacatgcagcaaatccttgcagctatcctgatatagtgatatagctgattttttttttaaaaaaaagctactggaatactctactctatacgtacggtacgagttaggtacatgtatacactgacatcctgagttatccacattgtctctgcagaaagcttagctagaataagatcataggagtagtaggcactccaattggcagccattgcaaaaacatttggaaaaaaatacacaatatacgttgtttttaattagcttcaagagaaacatgagaaaaagagggcaaaatggccccctcttttattaaaaaaatgaatttttagaattttgaatcttgacattattttaattccacatttcaactctaaaacttactaagtttaatattgatgattcaaaggtttatgatgcaagatataatatccaaagtgtatgtttgtcacaaaaaggtcttttattatctctcacacttttttttgggtaaatctcattgagatctcactatccgggaccgatatttttccaaaaaacataagaaaaaactctggtcgtcagaagctggtttgttaaaaactgaaagaccaaattaatgaattcataaagttaggctcaaatttgacaattgtagaacttttatctggcacactgaccaaacttctctgaaattgatgtaaacatgtgtgtattctaaatttctgattaaacataagaaataaacagctggccagctgggtgacacaaactctctggatgcagtgttatataccttcacgccaccaccgggatgcaagaataccaccatttggcgtgaacaaacaagtcaatgcaaggacaatattaggaactaacttgggatttgttttggacatttgttgtgttaaggtttatttgcttcttgtttggggaacttttatttgttattcaattgctactttagtttggctgctggatctatgattgagttgttggaaaaaatcggttgattagacaacttttagtctttcattgagtaaattaagggatgcttagtggatcctgatgttgataggggcttaaatcatgaataatgaccatttaacccggggatagcctgatcctttccccttctcctcctgaatcaatttacttgtcattatagcaaatctcacattaaattgctaaatatgccaaattatattgctacatttattaattactacctccgttcttatttatatgacgttacgtcatataagaaattatctaagggagtatcttaatgaaagtttcttgtgagaatactaatactaatatgtttgaattgatgaaaggtggaaaggacaagacatctctaaaaatacttcgaaatatgtgagaatggcaatattttgacaaaaaaatgaaatactataacgacaactgaattgaaacgaatggaataataagatttattcacttcttgtcttgcactaagtacagaacatctcacagctgctcctccattgtttcatatgggcacaaacactgtaagtttgttattgaggataaatattggttgatgaatttgggtaataagagttaataagatagaaaattaattgggttcagtagtagtaagactgtgagggcgtgtatggttcataactatattactcacttccattttaaattactcatcattttaattaactttatgctaagtcgaatattcctaactttaattatctatttttagaaatttatatagttaacatcataaaatctatgtttttgcaccatgagataatttcataatatataattcatgtatagttaaactatacaaatgtttagaaattaatttatagtcaaagttagaaatattcaacttaggacaaaactaacgacaaataattaaaaatgaatgaggatacttataactttggcaaacaagctttgccaaggtaaccactaacataagttggggtcatccttgactgagatatctaaaccccctactcattagtgagggtaagccataacccaaggatggcttcaaagccataaccccctccatatagctagtaagtgtaacacttggggaaaaaaagcaacattttttatgtagaaaattatagggtgtattttatttgaaaggggtctttaagagaccatgagttacgcataaaatatattcataaaatctgtagagccaatgttttatcaaagctatttgaaagatgaatccatcggtattttttttgtcaaaatttacaaagtttgacttctcaaaaaataatacgctgtataattcttctacagagagagggtatatatataacaatagcatttataagaaaaactattttttttcatggttgacctgtcacatgcaatttttattaaccatgaatatgctattgtgcttgatcacttattgctctccgctaaattcctccactaccttgcagtcgactgatcacttattgagctttacagtgtgacaacttgtatatatctactaattcgtatacattgagcctttcatgcatgtttcttataattgaactcatcaccatctgtttaatctgctatcccttggaactaaattttaataaataattttatattattgatgaggacatcactgtctcggatataaccatgcttatgttaaggtttacttaacaatataaaagtgcatataatctatataaggtttacttattatatgtttgaacaaacttactacaccatgagttttgtatcttctcatttacaaaaatacttgtgtgggtgaagcaaagaagatcagcctcacgaagtacttggatgatcaaagaagttgattggagatcaaaccaagattttccccaagtctactcctatatcaccatatcacttttggtctatagaagtcaaaagattaagttttacacgttttggatttagattcgggtctcctaaaagtatcaacttcaaatggacctagccattaatctgaaaagaatcttgagttccatgagtactagttggaaagtttatggagtttactttccaatggttttggtctcatatcaaaatttctcctcagctgtcgagaatccgcaaaacaagccacatacctcatccagttcgagtctgatttggacattcaaccctataattgtgtcgtggctaagcctaaggagtgaataccctagggctaatcctacgatgtccctaattatatttattcagtagcctgtcatcgtttagagtcgggttttccttagattatttatacaattgcagtttcactgttagtttggttcgtggaacccgaactttgagatcttaatcattcatctacatattgagttgcaatctgacttgtttctgctagtgttctttgattcgcatgctgaaattaaccttctcggcaaggccaactaggcagtgcacagttgatagagaagacatgatgctacgattgcaggatttggatcgtgttgatcggaagccggattgtgtgtatcaagttttcccaaatcgagagttatcaatacctatcaaaagatcgagacctagttactcatcagttaatctccctcattgatactaattatatgattatcacttatgcatgcaaacattactctaacatgcactaattaaccctaaagcatgctaattatcactcatcaaagctaatttgtcacttgatacccttatcaatccttcttcttgtaccttcactaggcatatttctcagtacaaaatctaaggggaatatttctcaagttctccaaacagtggccacgcaccatctatgtttcatcctaccacccaaacgtatggatgagacctgctctgtccccagctggtgccatgaaccaaatcataacttagataggctgggttggcatataaactatgcattttaactgtagtatatatatatatatatatatatatatatatatatatatatatatatatatatatatatatatatatatattagtccttttcaagtgagaaagaaataataagtggttttaacaataggactttcagcttaaccattttatccaaagcaagaacaaaattaagtgcaattaattgctaatatatgcccgcatggactccaaatggaagggctatatataggctaatgctgattgtgaagttaaagtgttatggttgatattagaacataatctttcattgcacggccatgtgtgtttttgggatcatagtgcgtatataacatatatagtcatgtatcacaggatttcctactctatcaatatatacgaggcactttttttaaaaaaaaaatatcgcgggatggttctaaacattgtagggcatctatagcatgttgttgtgagcattattattgccatttaagggggggatgaatgtaataattcaatctcttagtagttagatgcatggtcattgtgatatgttatcagtgggattgatctcatatgaagaatttagataggttgaggctaacatataaacccacatattccaacaatttcaccttaagggttaacaattttgccaaattatctatgcaattctaaacaattgggcattcaacagttttccaagttgccgaatatatataccttttgaaatgtcgttgcataatatttcgaaagcgttttcaaatatttttgcatgatatctcctcaaggcactacaagtcataaagcaaaaatttccaaaacccaaaaagaggctggtacaaagtggaaaaaaaagtagtaactcgtgcgaaagcgaaacctattccgatgcagatgcgtgtacctgcatttacacattacttaaggtagctaagtacacaaacatagtcaggtttagactgaaaaattattgtgacttgacaggccacattaagtatataccaacttgtactaattattaatcgttgaaagcaacttggcttaaaaattacaagattagatacaaagaggactaatgatcaatatgctcaggttatcatcgtgcaccaaaggctaaaacttgtgtgttacagctcaattgttagttaaggtactaaccgtttttgtgagcaactgcacagttagttcaagtccacttctatagtatcatcattctcatatcaacaataattaattaactaagagtttgtcctaattaatattgccttattagctgaaaattacctaaattactgatatttattactgcataatcattttattgcagtgctagattaattgttcacggttataaactaggccatccccgatccccaattttatatgatttgtatgataaccatttgttgtaatttggctcatatttttctgagttacccacaagatttgataagaaccagtagagaagaaatgactccaaattaaaaaatatatgtagtcaaagatagggaagaacattgcttttaattaagaacgttataattagtcaacaatcatgcatgttgcccagataatatgtgggctcacattcagtaaaaaaaaatgtgggctcacacaaatcttcatactttcatgttacaagagtttgattcccacttacctcgtgtgaaaaaatagtttgacagtgcagggcacctactaggctgtgaaggcttttcgtctcggtataccatatctctcatggttcttactcccaccatattttaatatatgacactgttgactttttaaccaatatttaaccatttatcttattaaaaaattatataattatcatttattttactgtgactttgatttatcgtcaaaagt

SEQ ID NO: 54534 - DNA, 11016 bp, Oryza sativa
tcattacagatgtctcatattgtgttgtagtgattctgtctagctttagtgatcaaagatggccctccattagcatttcaatggccctttgaaaaaaaaatcaagccttgaaaaatggatctcctcaacataaatatatttttgttttgttttaggaaataacatcaacatattttcctatagtcactccaagtttgcaacaaaagacttggtataaaaaaattccaaagacggcaattttcaaataacatctaaaataataggaatttcgtatagtctagatgcacttttttacaagcactataaatatcaccataaatgcttttactttatgtatagatgtttaagagatggttttgacgccttttagagatatacagggcctgtttagatcatttggaatggtaaatagcaaatagcaaatggcaaaagttttggtggcaaaagttttggcattgcaaaagtactagttggtgtttagatgcatgttaaaattttgccattctagcactaaagtgagagagagagaaagggagtggtcccaaagcactttttggcacaatttgctactatagactagcaaatgccaagtgccaaattaccaacttttgctactagtgtttagatccaaaatggcaaaaagtgctacaaaatggtaaaacttttgccattttggaggatctaaataggacctaaatcctagcctttgcttcgatgaaattagccacttattacacaattcactcaaaacagagcacatacaatccaggaactaaggatgtaattaaagactaaaggagacatattatttattcaactctggttgtaaatcttcacccaaagtaactatagtagctagtatgttatgtcatggcaaaactacaataattaatcaatgacttgttggatatgttttgaactttggaacactgtagttagcaatccggatcccatgcagctagctgctactgatttcttgacatgcatatgcagaattagcagcacggaaagaataggacggaaggttcaagattcgctaatatattgttaattgtaccaaaaatactatatatatagcaaacactgtagaagaaatctgatagcgttgaggatgtgaagtttggacgaaccagggaagataatcaattagcacataattaattaaatagtatctacttacacactggaaaataatttattcgaaatttttcaagaaacatctatataaatgaaagttttttaaaaataaaaaaacaataataatctaggtagctacgatacgaaatagtgacgatgaatctgtataattatttagaccgttggataaaattaaatttctagatctatctatcggatctcagttcgatctttaagggtcccttggatttttggataattcaattcctttataattttgtttcctatagactctttgatgaggatatgaatttttacatacaattgtattcatatgattaattccataaaaaaaataagtaagatgttagatctcttgaaaacgggaaatttaactatttgccactcttgtgacatgacaattaacgatttgccacaccctgtcaatgacatgtgggccctcatgtgtctatgacatgtgggcctagtggcaaatcattaagcaacatccgtaagagtggcaaatagttaaaagcccccttgaaaaccttcctttaggcccttttgattcaaaagaaattcatataaattttagaggattttatttctataggaatttttcctatataaccctttgaatcaaaggaatgaggaatcctataaaattcttatggaatgtctctttccatgtaagtttttgaggaaatttaacacgaggtaaaaactaatggaaaaaatcctttaagtttttatctcttctcaaattccatgttttacctgtgatctgcaataatctaaacatttgcattcttgccagaatcttatgggttttcctattccttcgttttcccattactataattatttaagaacatcatatctattcctgttttctatgttttaaatgttttaaaatcctgtaggattgaagatacatgctacttcaattcctcatatgttttaaataggtccttagagccacttaggctggcgagtaaaaatgtgccctatgcaattttaacattttggtagcagtgtagacggttaggtaccaacatcgatcacgatcacagcacaacagagagaaaaaatatatatatatatatattgtgtgagctgtgcaaatctccatgagctcatcatccatatccaccaagagcatcaataatttttatctcccaaaagcagtacagatggatgtagaccggtatagtcagccagcaaaggtcctcttgtgcacaagccatgaggctagattctgtttacccaattgtttttctgccctagcaaggtgagacagagagaaggaaaatattttaaaagagaatcttgtccataaaagaaacttttgtgcaaaatccctgtgaaattttaggcaccatctaggctcgtgtgtatggctcagagttgttccgtaggttcaattagttatctacagtactaaacaacatccaaagagatcattaattagatagccttatcgatcaccggctgatattctcagggagcccaacaattagctgatttaggttagacgctaagcatgcttagaagagcttcttactttggattatatgtagagctggatcggtttccattatccaaaaagagctagatctacgattttttttttttttaccgtccggtagtcacccatgcggctatggccggcgcataatcatttaaaaaaacactccactaagcgctatagcgtataaactgttttagaatcgcgacccctcgtagaatgagaagtttacttaaaacagtttagcttttcttttacattctaagaagttgtacactactataaaattgatctttgctgggtcggccaaaaactataatagtccggttttaataagaaccaggaaaaaaaagcctgttaaaagctatgtgatctttagtcccgattggtgttatctttagttccggttcatcccctgtcagtggcctgtcacggggccaccaaccgggactaaagatcactactttagtgagtaaagattatttagatcttttatacaatatataatccttaagacttatcctcccaaactactcgtcttcatattctcccttatcctcctcatattcctattcctcctctctcttattcttatcctctccttctcctcatccctagagcagatcgaggagcggatgtgcggagggcctgtgggcggccggccaggggcggcggccggccgcgcggaggcggcatgcgtggcggtgaccggtgcggcaggcagcggcatgcgcctctgccggaggggaggcggccggcgcgaaggatgtatttgattttttttttgagaattttttattggatatgagatgtctttgatttgtgtgtgatgtgaatatgtgatgtatttgtgatgattattttagaacttgtgatgtaacttttttagaatttgtgatgtatttggaaatgattgatttgagtatttggagatatccttttgttatgtgatgattgatttagggatgatttgtggatggaatgaaatcattattcaatgttaaaaaaaaatataaaagcaacctgatgcctggctccatctttagtccaacctgacaccaaccaggactaaagatccatttttactctggttgttttaaccgggcatctttagtcccggattgggtatcccggtttgtaacccgggagtgaagggcctttccccactagtggtaattgtagaattcaaaaaatgaactaaaaactaaaaatctcagttttacaggttctcataaactaactaccaacaagtcgcctctcaaaattttaagatactccaaacagatctaagttatgtttggagagtttaaagtcatgtttggagagtttaagatttaaaggaatagttgattaatagccggtttccctaacttcttgctcttattttatttcctaaaattctatagctatatatttttaaaatttagataagaatttagactgttgactaaaattctaagaaaagctgcgaccactataagcttttccaaacaacaccctaattgcttttggaatctgcagcttgcaatggtagctgagtggagagagagtgagagggctgtcttccaataggaagcacacacaacacaaggccatatgtggagtatatgtatctgcttcctttcatcaccatccttttgtagccttgccttcctgcacggggaaaagcagaggcactgccggctcctctgcaaagatttgctccttccattggtggaattttaggccaaaagttgcaagattgtatatacacagagtgcagcaagaaaactcgcaaataaagcgacgacgacgaggacgagcattggtacttggtgtcacttccctccggttggtaggcgcgcccggccacttgctaaattatgcgaaatgggccttcaccttgtttgaaaatgcaaagcagggataagagcaagtttgatagtacggctaattactggttccaaatcatttatagtcaacttaatggccaattcatataatagttacctataaacatatagtacacaatcaatatccggtctcatctgtcatacacacatgcattttgaagtctgtgctgcagttagctaaaaatctgcagcctgctgctcttatctcttcttttttatctttttaaaatatgtttatagttagtttatagtttgctatggtacctaatgaggaaaaaaaggtttagggagatcactgtagttcactagagtttaatactgccaactagagctttacagacagatctatgtataattggacacgaattggatcagctaattgctgcgtggtgtcattgatttgacttaaataatccctttttccttccactctgctgttagttgattggaggagtactgtactggtgttgattagtcaattggtctaagaaatttgtgcccttaaataggtccatgagaaaattcacccaaaataaaaggctccattgggaagaggccaaatggagagagaggagagctggagagagaaagaaaaaaaaagagacttcggactcgtttagttctcaaaaacttttctaaaaaacatcatatcaaatctttgatatatacatgaatcattaaatataaataaaaagaaaaactaattgcacagtttgtatgtaaatcacgagacgaatcttttaagtctaattagtccatgataaaccataagtgctacagtaacccacatgtactaatgacggattaattcgtctcgcggttttcaggctagttatggaattagtttttttattcgtatccgaaaactccttccgacatccgatcaaacatccgatgtgacatccaaaaatttttatttcaccaactaaacaaggccagtcattcatcactcatcagtgcttatagttttatgattttatcaccaattgtttgtttaaagcctgaaaaattttacaggtggcaaatgtacttcctgttctaaaatagtggtgcagtagagattagctcaaactcaatcttaggtggacaattcagaggtgtgattgtttcagaaaagttaacacacaagtggttggacccagcaagtgccctccatcccatcggttccacaatacttgtccaggaacaaaaagacaccagatttaagaaaaaacttaacatcaaattgctaagcatgttccccaccaaaacaaataaaaaagaaaatggccatacaagttgcacgcaagtctctggtagataacatgctgatatatagtccgtgatcaaataagagcaatcccaataggtagtgtgaaacatggcgtactggtatattaactacttcaaaagtacatccgatccgttctcctataagagcaggtataatagcaggctataaaccagctataaccatattttaaagagataaagaaagagagagaagagtagcagtacggactccaaaacgtaatgtgtgtatgacaggtgggaccagatattaatagtatagtaagcaactattgtatgaattagctattacattggctatagatggtttggagttagcagtaggctatactattaaacttgctctaaggctgccgttcgttccacccagctcccaaccctctccctcgttttccgcgcacgttttcaaactgctaaacagtgcatttttttacaaaaaatttatatacgaaagttgcttaaaaaatcatattgatctatttttgaataaaatagcaaatatttaattaatcacgtgctaatggaccactctgttttccgtgcttaggatatttgctccaaacctcccacaacgaacacagctcgaaccaacccccctcccccatctttttttaaaaaaacgctccaaaaaatcaacccatattgaaaaccgatatataaaaaaccaaatcatatttctctccggatccgttgcaacgcccctgacatataactagctagtatagggtagagagagtatgcgtgaaacgattgttcagatttaatctaacacctgcaattaatgtataaattttgtaggtgtggtttctgtaggagttcctccagggtgcatcatactagtgataggggtgctagtatatatagatgaaatttaaccattcattcatatgaatatttttttaaacaacaaatgtgaaaatttaaagaattaccccaccataccattgagggtcacatttgagatgagttgcattcatttgatgataccaattagaagtcccatcgatatagagggaggggtacaataaatagtgacatactccctccgtttcgaaatgtttgacgccgttgactttttatcacatgtttgaccgttcgtcttattcaaaaaatttaagtaattattaatttttttcctaccatttgattcattgttaaatatatttctatgtaggcatataattttatatatctcacaaaattttttgaataaaacgaacggtcaaacatatgttaaaaaatcaacggtgtcaaacatttcgaaacggagggagtagagtgcatgatggaaaaaaccagtggcatgcataatatctttgtctatgcgtgtctgatttctctaaattttccctcctacttataatttttttttcttatgcatcagactaatccattttatgaaaaccaacctatgtggatttttgatggtgccatagcaatatcccctctggtataaaatataagtctattattgtaactttatcgacacttctcattttaatacaacttaatccaagacctttttctggacattttacattgctatataattctactactatcataaataaattaattactcatcttatctgatctgagtataaatgaatgacaaggaagataaatttgttgttttatttaattactcctcacatacaagtatctacttcctcaatctcaaaatataagagattttagttggatgggacacatcctaatactacgaatctaggcagtattaggttgtgccccatccaatcaaaattttttactatattttaggatggatggtgtagtagaatttgtacaggaggatttactgatttcacttcattcaagagctctttaagccagggttggccacttgggagttgggactgaaaaattgcattggtttcttttttcaatcgataaaaagtactgtactttatgtgcaactacaaaagtagttaaaactatgaaacagagggaatattgctagtggaataaaacatcgtctttgccaaaatttctatcgcagtactgacaacgtgacatggtaacctgtggtggctttaattttgttcgagattaatggtagattccgccgtacatgatattatatatgacacctcaagcttaattggccaagagtgttaaattttccccaattaggtaccatgtctagtagcttcccaaggtaaatggcgtttacgatgatttggacattgtggtctaaatacttcagtcgatgatcaattcaaaagtactagccatactagagttttagattaccctttattaaaatagtatatccaaattggagaatcgaaatgaagcccttttttctcagtctatatggacccttttgtataataggaattaattccaatataataggtattctttgtttgttaaaacaaactttgactgtaaaattttctaacaatatttcgcttatagtaacagattcgtggtaataagaaaatattttcgaactttattctaaccatatcatttttagacaaaacctaaaaattattggatgaacagttaagtcaaaactcaaaattggatagttaacatgtgccttatatttctgaagagataatcgaagaaatgtcattaataagcgtccaaatattcaagaaatgctattgataagtgtgagttctaaaaaaaataccatcatacaaacgattttgtcccaaaaatgccatcaccgtcagggttccgtccattccacgctattaaatacattgttcatcctataacactttaatggcgcgggatggacggaaccctaacgaagatgtcatttttggacaaagtcgtttgaactatggcacttcttggaactcacacttgtcgatgatgtttcttagatttgggcgcttgtcaattgattgtattatctcgtttttgaaaggagtgcgtaattcacaagtaggtcaatattttaaatacgagtcttcggaaatacaggtcaatatataattttgatgcacttgtctgacttttttttttgttgcggggatcacttgtctgacttaatgtttgcttttacatatgacctcgttgattaggaaattttaacatcctcgtgtaaaataacagagtatctattcctatgtcaaatttcaaccagttccttgattcctatgaaaaacgagaccttgtatttggaaattggaataggaggaagtaaaaaattggtgtaagaatccttgtgcctcatttttaagttgtatcctctgtcttgcatattcctgtcaagaaaagaaatgtacgttttttttaaccttgtttgcaaattgtaatcatgcatcatcgtccacaagtatttcaaaaatagtggtcctgagcttatttttatggatatatgtacgggaactgatccaaatagatgggaggataatttaatttaattaaccgtatgtccgtctgaaaggacgacaatgcctaatctatccaatgaaacaaaaaaaaaatcttaaataacattttgttgccttttcaaatcttcactccagtaaaagtctggtgcagtacactagagaggaccacattatcacactttctccctaacatcataatttgatatctggatccaacaatcatgaatgcacatgaagaaaagaaaactttgtagtgttgaacctattagatttatttttatgctaccaattaaattattttcccacgtctaccaagattaaaccagtaccttcagccttcaggcattgttcctttaatccttcagggcattaattgggatttagatgagattaattctatatctattgtgatgtggaatcaatccatacaatttttttatgagggttaaacagatttcctcttcgttccaatttaatttgttttcatgttgtggacataatggttaacaatttcgtggactttgtcacaaaaaattcgaagctcttccaaaccgcacggttaatgttgattttcaaacaaaattcataacattatcaaactttggtcttgtttggtagaactttagatctatttttgttagctaagtatttctagctctagaaatccacggtctgaaacgtaataacattgataacatttatataatcattttatttcttatttaagatgaataatagaatattaaatcattttgattcaaattacacagtacaaatctagtgtgtatctagtctggagccatgctaaagggtgtattcttttctccctttttataacttctactccctctttttacgtgtatgtttaacagcacgtgtatgttttccgaaccgttaaacgttgggttttttcagaaaagtttctatagtcaagatatttcaaaaaaaaaaaatcaatccatttaaagttgtaactaatttacttattaattgtgcattaatgagctacatcattttacatgcgcggacccaactcctcccgaactcattaagattctgataagcacaacttctggtttctaatttattttatgaaatctaaaaatatagcttctcagaatctagataaaaaaccggattgtttagggagcttctggtttagaagctaaaaaaaaatgccctttatctcactttcggcttgcacttttacctcccaaaaaaaaaaagatactacatccaccgctatcaaaatccaaaattactggaggactagtctgcaaaaccccaaagccgaccagattaacaaatgtttccccttcaaaggtaagggagggttaattaagaaacgaacagtgataggtcaaatcagagattagccctccaaatcactccctcacactcattaatcccttcttcttcctcctccaactccaactcactctcctcgatcgaaatccatccttttcgcccatatatactcccccaccacctctcccgagctcggacacgcagagcccgatcgattgccacacgcgcgcgcgcacgcagctgcatccactgttgcacgaccctgctcgccactgtgtgctgccgctgttcctcgtctccttcttcttctcctccaatcgtatgtgctattgcctcctctttgagcttcttttggttactttggttgcttggttggagctggctttgcttgctagtgctagcttgcgttggaggaggatgagagtgtttgttgctgttgttgttgatgtatttcagttagcttcgtggcttcgattttcttgat

SEQ ID NO: 54535 - DNA, 1945 bp, Oryza sativa
cttcctgtattattccgcaactcatcgccgaatctttcttatgattgacggggtggagcgggtgttgaaattggcttcatgcttagagaccatgcaaattaagttttggttcttcaaactgggttgtgtttcagtgagactgaacaggaagcagtttcagttcacaagatctggatgaaactagttaaggtctagtattgtatagtagtgttgttcagtgggtactcccgttagcgttcgggttatttcatgggttactcgctagagcgtgggcatgcaaaaccgaaagctgttacctttggttgtgttatactctctcctccctgattctcagtttctttgctgtgtttagcgtagtaaactattctggagtttcatgacagtaggagaaaacaaatagctgaacatatttttgggtggattatatggtttctaaaaatatttggagttctattacaggcgtgtatctgactgaaagtggtacgagaaagtaaaacgtagtatcatttagtgaaatcttgactgaactgttaaccatttgactgcatcataactgagttggagaggttcagacatccagtttaatatgcactgatgatttccgctttgttctcagataataattctttaacagtttttcaaactagactcttgtgtgaataaacagtgattattatcttcttaggccatataatttctcaactactaaattaagcaatgacatagaatgataactccacttctgtatcaaaagagatcttgtgatattttatatcagaattcagaatatgacaatactcttctaactcaagattcatctcattgtaaaaataagcgcagtaaggttttgattgtgctgaataggattgttgctcaagccaaataggtcctctattctattcggactttcctagatattaccatctcatctcccacacaacaattctattttccaattggtgggatgtgctaattccaagagcttgatcaggttcaaagcttggggaaacaggctaacaaactcaattttgagataataaagatccaattgtcatttccattccatgttgcgatcccctcatccttcttccatcattaccaaacctcaagagaatgcaaaatacattatcattgtgtatatagttggttgaggacaacaattataatcatttttacttatactgcaaaattggttttccactcatcttgttcaattcctggaacctacaaatgatcattactttatgggtttattttacctcttacatgtctcatccaattaggctgtgtacatattgcattctcatgtatgataccagaatatatctgttctagctggctgtattttgggtgttctatgatctgtgcttgacagtatagttactgagagaatcaccacagttgagtcatcttgtttattttctgggtataactaagaaacatcttgtttgttaaatcaaatttctggcatgcatctacaatatttatgtctttgtttctctggttcaatcttgttggtctacagttactgaagacgccaggagataactctagttgagtaatcctgtttacaaattctcctgtcatatttgaagtgtcgttatatcccttgtagtctagaatagataagtcatgctgattgatcaaagcatccttcaatgacacattaggaaggaagaaatcatgccataaccttgatctcctaattattcattcctgtatgacactggttagtaagataacaccgaattggagcaatggatggcacagtacaaactgcagagacctcatagtaacccaatggaaaatctgataattgttgtcatcctctttttactggcatattgtcagactcatcagtaagaaaaaagaattatttacctcagtgatctgttgtgctcaacctttgtgcataaccacaccttatctgtatttgagttagcag

SEQ ID NO: 54536 - DNA, 17438 bp, Oryza sativa
ccaaagaacaaaaagagaaatggaggagcagactaactaggagtgaagttcctcctcatatattaccatctccatcgagagcccattcaatggtccttgttgtgtgtcttgacaacccttgaagcttcctcttgagcttatggttgtgtcatttgctcacgctaatgttataaataccttttagatttctcaagatccaacctcctgattgtcactactctctcctcatcacaccatgttgcagcaattttgcagaagcaggatggaagtaaatgtcccctctgtttgagggtatggtataatctctaccaaagtatgaacaactcaacatctcaagttacattggtaatgaagcgtgtttaatcattgttagggaagagtttggtttactgctactactctctctaccatcaaatttatacttttctttttcacaaatccacatgtgcttaactagtagatcataaaataaatcaaaacaccatcgtcatccgcctttgctttctgatctggaatcctcatgataatctaaaaggcaccctatagtttctctcgtaaataggaaaaagagattggtctacaatgtttattttatggacctaacaaatggtgaatactagcatatatcgataataacattatattcatatgatacgcattacccaaaaaacaaaggaactctacttttaatataagggtatttgtatggcagacagctaaatatagctttgtagcacatgtgtagaagagtaagtttcacaaaactacatatacttctgcaaactatcatcaaactatagatttaagccacaatatcagaaaactatacattttaatgtcaaatatatatgccaatctagcacataatttaccacaaaaagtacatttgagagttccaccttaggatggttatctttgatggaacttttaaatctgcaactttgtaatgaaatcagttctaaatctgtagtttgtcaaaaaaaattttttttgaaaagggtatactttagcaatattgtggtttaattctgtaggtttttttttataaattcaattctaagtctacagttttgcaatacaacgttgtgataattttgacattgtatttgtagtttgtgaatttttctctttataaatgattatgactctttcttcaaataaatataatgtgtttgatgccaaggaatttcttttttctagttgtcgttatttgattcagctcccacacggaccagactcaaaaaaaggtacctttatttctttgggtttggtgagctcttactcttacgtgcatttatataggcaacaattgttataatgtgcgaagacatgaaaaggttagatttacataagaattgcaatgataaatttcatattaccttgtactccaactaatggtacccctgtcttttctctcatttagtttttttttttttattgagggggggggggggggttgggaatggggggcatataggacgacgaaacctcgataagaaatcgtgctgtgtttgggggcatggtatctcagagtagaagggagcatagaacaaggaattggaaccaagaacacagaaaacttgatcttgctgtcaagaacagacatacagaattttgctgaacagatgcaaagcttttaacaagaactttcaaagtcgataacatgagtctaccctaagtccctaatggtcaatggtcaacacacagtatggtggcttaattcatactgaaaactcagatcacatgttgggttaacactgataggacttggctgaaggctctacttgacttggacttgacacaaatactcatcttctattaatcagagcgacatagttaagctagtaatataaaagataaacaaccaagtaagcaaatggacttggtagataattgaaggtgtgttccatctaactaggagtctaggactgtttgtcgacctgagcccacaccatgtcttggagagacataaactaaggcagaattttccttggatatcctgggctgccagtcctaggcatgacattagcatcctgaaaagcagttctgaactccatattttttagcttgcatgatctttccttttatcttctagacgattgtttttcttattctttcctcttggatcccatatgtgcgtttgtgcttggcttaatatgaatacatggattcacaattgacacgtttagattgccaatttcatgcataaacatgtaagtttgatacactaattggcagtagccaagcagatctgcatatatacaatttaatgcatgtgaatccaaccagcccgtgtaagcgtgtcatgctgagatgcagcagccatgagcaccctctgcccctctggtgcacgcgaatcagccaaggtttttctgggctacaacaatatacttgacagcatgacattcatcaataacgctacccaatgcccaacttgaccttgagtagctaggaaactgtggttgctgtgcagagcacacatgagagccaatagtttgatatatgttgtcccagttaagtacaagatcaccaatctaattttaatgtggcatttaaagaaatgccactctaaagattgactttgaggatatgccacttcaagaatacatttttttttaaaaaaaatctgataccactttgtaacctacaacacaacaacatatgaggctcttcccattcactgaaactaaatttgaaatcaggtaaaccctgagagttcctaacttgctgtagttatttggcatgaccttttgtaacggtcttcaaaggtacttgcatctgtatttttgggcagcatagtcatgccctttttcttaccaatatgacaggcaaacaattatagataatttattcttctgttagttcaggaaatggcatcaaatacagatgcattgcttagagtgaagataaagcaacatttctgtctcccatattgacatgtaaatataaccagagatactaattataaccacacaagtttcaaagagacaaagacatcaccacagcctaacagaataaactatatcaactggtaaaaaagacttcagcagctagcaatttgtagactttcctgctacattgctctagcctcatgctctcagatgcaaccctccatcctttcctccctgatatatctacttgactagttcactcgttctttttctggaaaacagaccacatgttttttcagttatacgcatagaacattatcttgtgtacgatgaggcagctgcccctgtaccaaacacatgagccatacttgtccttagtgagaatgatccctctaataaaatattcttaattttcagtggcaattcaccatttcgaatgatcttgtatgaaaaagttgtcagcagaatttattaaaaaccagatatataaaatgaactgaaaacggtttatttggattcagattccatcttccaaccccctcattaaaaaagttgatgttggagcatcccaacagaaggtgctaccaggcattgtagtctccatttatcaacgggagaacaataaacgagaatagccacaggataaagtggtttccagctaaattacatggatctgttcgatatatttttaaatttcacattacatggtgattaaccttgcaaattcaatctttgttatcaatcaatattaggaactaattattgcgatcagatagaaccacaaagacatctgggccggtacaatttctactacattccatgagagcacacaatgtgacatttacaaagataaatattgtaaatgccgtaatatcaacactagagtgaacatgtatttcaaaatttggcaataattgcctgagaatttcaagcatagctcagagcaaagaagaaagtgaaactatttgcttccatgcttatcataattttcttgaacacaaaatctcatggtccgtgtctttattttgtccatctctctgatattggctttgtattattttgttcatctttctgatgttggctttatatatgaaattacacttagtagctttttgaaacaaattacacttgatatctggtgtgcattctaaagctaagattaactcctagtataactgaatttatattacctaccactggtttatacatcatggactagaggacaatcccaatcgaattgcagaactataagtagtcagttttatattttctacttttaactttagaattgaccacgaagtctatgctgctaatcagcagtgcactataagcatagtgattaagggacagtcagttaaaataatccatttctgttatgactactacttggctaaattttcttctgtgaatcctacatggcgtatgagaactatgcaaatacaactgttagtgtgaatttgaatctgcagtacaggttcagtgtacatgttctgaatatgttgagggccatgtaacaacaatacaacataactctgtatttgcagatttcacaatctggctgagtttgacgatgggaaaaaaagttgccggaaacggctggatggtcataacaggcgtcgaagaaagccacagcatgatgcattgaaccctaggagtttccttccgtatcatcaaggtttgtacattgcaactactgagttatatatgttgaaaaattgtagtgatccttttcctggctgtttcttgattacatttcgatactgtattaccgttactgtatgtagaattggttagctgttcattctctgtctgcagttataacaaactacatctttacctacttatattgtcacaggaaataatgtacatattatgtatcttttaggtctggcagaaaaaggcatgcttactgtgcttgaagaattgaacattgcttcgatatgcttgttaggttgttagaagctgaaaataatcgatgtcaaatggaacccaatcatgctcagtctttccccattagcttattagaaaatttctagtaaaccatagcacaataatactaagtcaagatgagtagatttcgatggacctctattaaactaagatttttctcatgttcattcactagagctatcaactttttcttgaattgcttgcacaagaaatgtatccaatatattctcttgactaaaactattttgtctttgcagcgaatcagttttcagtctacccgcaaacatttccgatagctgatcagaacgccgacgccttaatgcgtccgcttgatcgtcaccctcccttctccatctcattctcagggaccttccgggaaccgaagcagttcccctttatgcaagatggcgggagcggcctcggcgcagcgcgccacgatctcctgcggcccttctcttccccagaagatggagccaacattaccacaacccgcagcgcatgcaacggcgtcccccacgggctggacccggagtgtgctctctctcttctgtcatcgtcgctgcatccctcccccgctgccggcatctccagcgcaacagctccaccgcagttcgccccctcttctttcagcagaatcgccgcctcgtcgcaagccgtaaccaccgcattcgcatcagatggaggatcagttgccggtgaccatgtcttggttcctgctgtcacatatgaagatccttcccaagcaatgccattctcttggcaggtgtagagcagaggctgtgattttgctgttcctgcagagttgctggtgaaaatgactgaggctttttttttgattgtgtgagcctgcagaattcaggctggtgaaaattgtagataaataacagctcaggtcctctggttgatggtggtggtggtggtggtggttgtgcagattatttatcaactaattgtgccacgtcagtattcttctacatatctgtgattattgttcttgaggtgtacatatgtatgcattgtttagcatatctgtgattgttttggtcgagtcatcggagaaagaggcctctgtccctcatcttggacaccaggcgacattgttatcaatgggccgggttgtgggtggcctattttgcattgcaattgcatgtaggaactccttgcaggaaaaagtccacattgagtccctcaatataggttgaatctgattcttatccctgaagtgcaaaaccgggtatgataataacttccctaattgttaaaactggtagaaaaatgatttctagagtaatattgatgatggtattggctgatgtgatatgtaatatgtaatatgttaaccacgataaaaaaacgcttagaaatctaggaagatggggatattctacagagcctgcatgtcagtcgtatggggcccatatgtcatcctcactcttcctcctatctatcctttttcctctcgctcctcttctctacagcaataaggaccccaacagggccctcgatttagcgccgctgacgggttcgttagtcttatggatctttgtggtaacacctaatgcagttgcagtgcaaagctcgggtcaacttagttggcggctccagaaacctactccacacttcaaaatttcaaaacgccgaaaactcaatatacatatgcaaaattttcttaaataattcactaaaactaccttttctttttagtttaagaattaaaaagtacaacataaatagtctaataggtcatgtctatatagtggatttgggccagaaccacctcctagaacccacccattgtagttgagccttcttcccgaccccttgtacgacaatctccctacactgcgttgatcactcgccatatatatatatatatatatatatatatatatatatatatatatatatatatatatatatatatatatatatatatatagcatgtctcttttttcctgttagttaggaaagaaagccgatataaacagctccatattagcgaattgcctctgactactcttcccaggctggtcaaactataggattaccattcacttagtcaacttattggacagacgggtcaaccacttgaccgaggagagtaaggttcgtcaccacagtcccagccatacatataagaatccgactaatccgataaatatagcactagcacttcatcttccagcacctcatccactcggaccaaggactctctctatggctctagaagtcctgtcggctgacataagacggaacccccagtggtttgaaggcacgtagccacagtgtctaagattgagcagggggtacggtttcggaaatgacatattgaataggtctatatatatatatatatatcctggtgattaatcagatacaacaaaatggatttaattagtgttcttgcttgcagcgagatttgcaggagatgatggatagatcgatcttacggttcgtcaatgaaaggttgatgatggtgctccggccgctcatggtgttgtagaaccgcctgttgtcctagagggatcgaaatacccggttttgtggttgatggatacgaatcagacccgagagagtctaattggactttttccttccttgcatatggcgaggtgtattgacattgaaggcctagaaggcccaaattgtagtatgggcccagaagtgaaagcctggcccagtttagaaattgttgagggcaatttaagctggaaaacttggatggaacatataccgaagatcatgcagaatggtattgacatatctgtacaaaatactttcaaaatccctgaaaaaagattttcataatagagtgatttatatatctaactaacccgtcaacaacgagacgcgcttatgtagcttcgttaatcttaagatgtaatggtctagttaattcttggacatgcatatataagggtataggatgcatacacgcactcatatgggtgattgtgcacattggcgtctgcagttgtaatctatttcaaaaaataatattgttttcagccaagaattaatataaaaatgattcttaatcccggagggcatggagcgtgcaaaaataatcttgctatcaaaatacattcatttcttgagaggaattggtggctcgagttggccgttggtttcagctagagcaatgctaaccattggagattaacagtttaattaagcaagcaggaggttcaccaccgacatgagatcaacaaatcaaacgtggcagggccaatattaaattagagtagcagagaacagattggcatgcttctctgcaactcgatccgggtttgaattgatatgatggacattccaacaacttcatttctttagtttatggagtatgtctctttttgaaagagaaaaaaatattttgtgtccctacgttctcttctcaatcactggacgcctcagagtttatagaggatataatcatgagttttcgtattaattaatccccacatgccaattgtacgagtagccgttagatttcttaggaacaaccatacttaggctctgttcgtttcctgtagttcccaactcccccatcttattttccgcgcgcacgcttttcaaactgctaaacggtgtgttttttacaaaaagtttatatacaaaagttgcttaaaaaaattatattgatccatttttgaaaaaaaaattagcaaataattaattaatcatgtgctaatggactgtttcgtttttcgtaccggagggatgggttcccaacttaaccaaaagaacagagcctaagtataatttataagcaggggcggaggcaagatttcaccgagagtaggactgagctatgctgtttcaaaattttccactgagtttctatctaaattttggtattttgccattgaaattctttgccacgtgtggggcccaagcccaagctgcccccacacgtggctccgcccctgactgtaagtaattagttagccttctcaccgaaatcaaagccctcgctaggaagaaattccgttagcctcaagaaaaaaggggaagaagaaattctgtttgagaaaaattgtagggctggaattaccaaagcacaagaaagaacagtttcacccaaatttgaaaagaaaaaaaaactgaattttcaaataaatttaaacaaatcaaacgaaatttcaaatggaaaaaaattaccctagtaaccaatttttgtttcctcaaatgtgaaaccaaaattttaatatttgagtgaagttcaaaaattttgaagaattcataggtggatctgaaattaacagaatcacatataagaaaatggtatttttcaccggaatttttaataacaccttttgactgaattaatttaaaccaaatttgattaaatgaaaaccaccacatttttaagcaaattatacaaaagttcaaatttagttgttttttaagtatatgtcaaagtgggtaatttttacttcctttcaaaagaagttgacataactaaaattattttgttgctgtaattgtttttttttgtggggaggcttatcaattatagttactggcgagggcaatattacatttcaaaaaatatatatgtttggtacatagattaatgtataaaagcagcatttaaagatggaacaaaatttaactagggacacaggaagaattggacggaaaggcgacagggcgtaaggaagtttctctttgttaaaagtcaggcatccatgtcattcttttcgttgagatgtggacatagtagccacttcccctgctatatttgtatagtactcccttcgtccctaaatataagggattttggttgaatatgacataatttgtcatatccaaccaaaatcctttatatttagggacagagggagtagacaactatacatgcttgatgaagatatatctagtgcttgggcgatcccactctagtagtttaattaggccctataaataatggattaagattctgagaaacggttggttgatagttagttttttagaaaactaggtttcacagtttctgagtttaatttattctctagactctatattttatattttaagaatctgagtgaaaatcttgcattgtttgcgggagctgaagactttaagagaaattacagctgctagaagctctctcaaacagagaattagactcatttctgcgggatatcgcacttagtcatggagtaggtactactacaattacatcgaactaaggaacatactgtgaatggtgttatttcgcactttccatgcaagatgtgaatcatcaagaaagcgacggccaaaagcaaataaaacccaacaaagctaactttcttgcaacaaaacactgcttaattacgaaaagaaaattcatacttcaaagttcaaacctgtgactacgaaccaacaaacaaaagctaggccattgatcggtgctaatcaagcttatgtgtgcagcatattagcgcagtagctagactagctaggtttatgttctatacgtgttccacactgatacaattccaaattaatctcgtctgcagagtttggtagtagatgccatcccagcataatatactataaaatccatccatgtgtgtgcctgcagctagactcaattaaagaattaattccacattacaaaatttaagaacatttggatggtacaccatggtgtagtagtacatactgtactgtgctagctcgaacactgcatttcaaatgggctgagaaatagtgcaagtgaatggtaagtacaattcttaattaatttgtgctcaaggttgggtgaaacatcaacaccgggaatagtttctatatgcaagtttcgtacaatgttgattaaatacaagatgaaagaaagaaaaaaaaacatattctcatttgcccatcctccttggaaaaaaagttaaccccagctcaaaatataccatctatttccctcgaaatgcagaaggaaaattaaatccaaggtaaataaccaaattccagaaacctgaagcaaacattgaaaagagaaaacaaaaaaaaacaaatcagaataattaaccacatttttcatatgaacttatcatgagtaattaaccatcttaagctacaagctcaagtaagtttacattatataaactaaaactcagagaacagtagtaatcaaattgctagctagcccaaattaagaaaatcatatatatatataataccattcttgcataaatgctagtaattaatttagctgatcgatgaacatttcacatgccagagccagcatggtacctcctagctagctagctagctagccgaggtacatgtggacgttgacggcgaggaggaagatggcgatgagcgcgaagtagatgatggagtggacgaggatggagaggccgctggtctggaagttgccgaactccacgatcctccccttccccgggatctggaacagcagccccggcgacagcaggatgaacagcaccagccctatgaacaccggcccccaatccgccatcgatcgcctactctctctctagctacctacctttctctctctagttcttgatctctctctctctctctctctctctactgacagaagagaagaatgagttgtgatccttcttcacacggttgcagggaagatatgcagatgtgattcttgtactaagtaggtctctctctttcacacacacactcagcttggaagacttggagtctctctccttttgttgtggtaggaccaatggcagtggggagggggtgtatatatggccttttggagtgagggaataagtagaggagagggcaaatggggttgtggggatagcaaagggaggatgatcctctatggaagtttgtttgattggtcatggtgtgggtttgtttttgctcttggcaattgatggattgatggtgttggttttattttattagaggggtacggtggtgctatatgtatctcgcgcgcatgtgtttgttatgtatatatatatatatcgaatataataaaatacacttatatggatacgtcactatctttcattaaggttacacatgtacaatgttatctcgcatatatatatatatatatatatatatatatatatctaagattaattagtcgtgtaactaggacactctgttatgctttgctatgtgcgatattattcgtttttgtttaaatttacgtagtatatgtgccgttttagtttcgattgtggcattttagttgcatgaatcttacatacgtggaaagatggtggatcaatcgtgctattttgtcgtcttcaatatgggtactatcttgagtgattgatattggtagtttgtttgtcctgtcagtttgcaatcggatgtaacaatgcatcgactttcactttagttgttcccctctcgatcgagttatatgaactcttcataattcatcatttatgtgatgagtcttgtgtgtgaccactaaaagaagttgactacatctgtgtcagctatttcagattgtcagtcgtttgtactagagtttttaagtaaattattctagttcatctagtttttttaaaaaaattaaagttaagaggtatatattgacaaggctaatgcatttattgtattattatctacaaatattttagtagaatatccatcaatacacatgtccaatatttgctggttaaaatactaaggatattctaaaatcaatccatttgtcgaatgttagaaatcaatcagattttttctaccattacatttacatccaacggactacaaaagaaaataataaatacatatttacttacagattatttttatcaaaattatagtgcacttatatgttatattaactgaatttacaaatgtaattttagttatataggactgtagttttatattacaatgtaaatattattttatctatacagccaaattctcctccatgctcaattggctaagcgttgtacatggtaagcatccgatcgtgagattgaatcctaccaccccaaggtttggtggtaagctgcctcagtttttctggatgttgttagcatgaatctcaccataaattggagggttgaaaatcaagtgatttccaacgaaaaatctgttgacaaagatttagcaaaatcgaaaaaaaaaatcactactttgttgaactctctataaatatgaaataaaattaaggctttctaatcaaagacaagaacatataaagtacacatataacaaaacacacattctaattatcgtaccagttgatctacagtagcacagtactaaccactttgggtttatcaaccaattgatctgaacacaccaccaattaactactccttgagcacccaatcatattgagccatagaagatcacaacaaggtgatgtggaagggaaggtgatactcagtgctcaactgtagctatggctatagcagatggaatcaaaagcagttgatgacagattccaaacccagtcatatggtcaccaccccatcttcttcctctgccattccatgcaagcaacaaccatgtcttcttttttttttccccttttttttttcttcacacaagaccctgtggctacttgccctcgtcctcacgtgttgtcctctacctctcattggtgaaaagcatggaataaaggtttcagaaagagaagaaagaagggccaaaagaaactactcatggtataatggtggtttgattcaactctctgaagaaattttgcatttgcatgaggatggttgttgcagtgtctgtttcagtgctgagcctgcagatttggtcagatggtgcaagaggacaatgctgaacttaattgcctacatggtttgttaggctcctcgtgatgatcacaccgagtgtgtacgtgttagtttttggaatgtattagacaactaattaatgggattgcccttccatgccaggcagactggtagccacggcaaaatgggtcattaatcctatgagcattttgtgcatattctgctaattaatcccattaatgttgaattatatatgctctctttcataagtagtttggcttgctactttttgttagagaacacacatgggtcatgtttggtggccacaatttttggaccagggacgacgagacgtctagtttactgattcttattttaagcatatctaaacatatatagataatttgcatcatatcatgtctatcactttatgtatagtttattaggtcctcccttttcggtcgtttgtgggtgaaagaatatttatgtgttcacaagcttggtttggatctcatcaagtacctcttctttttctttttaaacgaagattagcacatgtaattcagtataacttggagtatacggtttttggatctattgctgcctaagtgaaagatgatggaatgagttccttttgtgtgaaaagactgaagaaacttgtacaggagaataaagcaagtggtagctttttttttttgtgaccttatcaaatgttttactccatgaatagatttatcaggacttctcctttcaactagattaattaatttccatttttttgaccttataaaatgttttactccatggatctgtttacctgggtttctatttcaaccagattaattaacttccatttttgaaagattatgaaaataactattgaagtaattttaagcgcatcgaaaataaggactaataattggtgcagacattccaggccaataggacgcattgtatacgaagctggctaggatgtctcaatatgcttaatcaaaacagatttctgttttttcttttttgcggtgaaaacagaattctgttggaatacctaaatttcacaaacaggaattcggattcaaaaaaagaaaattctgtaattgacaatagaccaacattatttcctttccttatgtaaatctaagttgcaaagtggggttgacaggatgaagcggacagcaaaatgcgcagctcaaacatacaaacatattggtaatacacattcttttgaagagaagattctcaagagctttacttagtgtagtaaaacaagcaccaattaataactgaaccacttttagtttgatttcaatagcaaaatgaagtttaatgaaagggataaccttgctagtcaacgacagactattgatctacatggaaatgacgaactagctagctagctctagatagtgatggcatacatccacaatcctgatcgagcaggggcccatacaattttcctcaaattatggtgaaacatgcagtgactttgtttctgcgcaatctcttataagcaactacctaaattaaaacttttaggtggtttattgtttttctccggcgtctgatagtttgtcaaaggttgctgataaaccaatgcaggtttgtgcgcgggtgctattggctcagttccagcttaaaagccttgatgatttcaaatgtcacaatttgatttttttagttacttttaggagcttctaatctgtcattatcctgatctcttttcatgattgcaacgaagacaatgtaaaaaaaaagtctacctgaaattattccaaagaatcaaatcttaaagttagcctccaaacctgagcccaatcatgcatcaagctcttcatctacaacaaaatagaaaaaagaacacttggatggaattgagacctgtgttctggtctccctaaaatatggtatgtgccttgtcatctcatgacaccaaacatgcaagtcatacacaaagcatgagagaaaataatttttgtgcaaataattcctttgcagctaacatacatggggaccaagtaggtgcaacagtatacagaagcttcctgcatgtgtgttaggtgcatgggctgcatcaacagtataattggccattgtccctgtgtgcttggggtgacaagctagaggtatggctttgaacggctacatatgcatatatataatatatatatgtatgatgttgaacagttgataattccagccaattatttgttgtttggatgcaagtttggggtttggtcctcatgtgcactgttttgcatctgtggaagatagctgcactctactgtgttgtggatataggatggaggagagctcactcattccaagaagggagaaatgggttggtgtgcttttcaatttacataacacatgttctttttagcttattcaccgtattattgaaataatgaaatttattagttgttggatccacactttctgaaatatgtttttttttaaaaaaaacaattttctctactatactattgtttagacgatttattttaagctattgttaagtttatttcttaaaatatctaattatctctataatcaaatcgatactttcctaaaataacctgctcaacaatctaggttaaacagggatatgctgagttggatactttttttttcttttttaactcatatactatggcatgctagatcatctctagatgtaaaaattccatggaaaacagttcagttttattgaaattaatagtgaaaaatggtcaatcatttcaaatggacattgggtcctagcaaaagtacatggttttctttggactgcaccaccactacagaagatacggatgattatgtcttcgaaaaacaaaacctattcagaagacttatgattgcacacccatgtacaaacatgtctttatacataatttattagttgtcttattgttttttctaaaggacacactgtgtgttaggagacgtattcgcggctgtacatttaagtatggtgttgcatatgtagccatgcgcatgtaattgaaaaacacttgaggcctaaactgatgtaattaaggccaggcccaacacatgacagtgggcttcttgggcgttgttcacttgggcccaaatacgcatcactctcccctaccacaggttataattgggcagggcaacgaattcctagcttaattaattctgcgattaataaataatccaactcattaatgataaacgagcaaatttaattggccagcgaactcggagacgcgcgaaccatcgcaatggccggccgccggtcgtcgccgccgcggcggacgatgtcgatgggtagcggctccctcccccgccgccccaccgccgcagccggcggcgctggctccatgcttcccgggctctcccggtcaatgtacgaagaagaatttggttgagtcgatcggcggcgcgaatgcatgcgacgttgttaattctcatggggcgccatggatttgacgcaggacgatgggcggcggcggcgtcggcggcgagcggacggtgaggcggctgcggctgtcgaaggcgctgacggtgccggagagcacgacggtgctggaggcgtgccggcggatggcggcgcgccgggccgacgccgcgctgctcaccgactccaacgccctcctctgcggcatcctcaccgacaaggtcacgcaccataattatttttggcaaaatttacgttcaatatatgagaaattactctactaggttaaaaaatcgagataccatgaaccgtgcaaaaaagaattaaaaaaattgcaatttataaaatttagaacaaatgtcacaaatctagaatgtcctagagcaaattttgtctaaattttcccattattgtgaaaaatacggtgccacgttttttcttacgtaattactttctctctatcatata

SEQ ID NO: 54537 - DNA, 13390 bp, Oryza sativa
agatgctcaggccgtccctctctaccatcaccaccgcggaatcaacgtaatgtctccgttataagtttcaatatatatcattagatgaccatctcgatattctatttttctcttttagattatgcacggcagacgcacacacccacatacatcactagctacacacgcaatactgtactcacaccaccttgcaaatgcgcctcctaacacacgcttaaagagacagaaaccaacggcatatccctaaaatcacagaaaccaatggtcaattgaaagtccttctgctgtcttgtatgtgtgtaatatttgtgggtaccaggatttgaatcctgatgagtgaagtcatgcactgcatccacgacttcaccatcacaccacgggtgcttccccgccatctcgatattatattgcactttagttattgttatgcaattctactttgttttgttcaaattgcacattggatgatcagttggttgatttatagggtcgtcatcgtgtcgccgggcgattcggtgctgacggcaacgcagaagatggtggaggtgcacgcgagctcggccgtcgtcgccgtcgggaacaaggctcagggaatcctcacgtatgtgactgatcacaatcttgcttgcttactttgctttggtcatccacaaagttctctctaaaattgatgtgtgtggtgcaaattaaattaacggatttttgttgatgtgcagctcaagggacatcttgatgaggatgattgccaagaatctccctgcggattcgacgccggttgagaaggtaggacaggattgataaactgataattgatgaatcacttgctcttaataccttccaagaaccataaaacatctcaaaaaacatatattatgcacgaatttgatatgtatatacgttttatttactaggtgatgacactggatcccgaatgcgcgacagtggacatgccaatactcgatgctctccggatcatgcaagagaggaaattcttgcatctccctgtcatggacagaggtaggtaaaatgtagactagtaaatgaaattgtttggtatatatatgatgtgatgattgatctgcgggttttgccgttgtcggtttcgcaacagatggatccatagtctccatcctagacgtgatcgacatcacacatgcagcattctccattgtaagttcttgattggccatgtatgattgaagaaaaatgttcaggtttgtaatttgttgagatgtctctccactgattgcaaatgagtgggtgggtaggttgaaggcaacggcgatggtgccgtgaacgatgacgcggcaatctccatggtccagaggttttgggactctgcaatggccttgggacccctagacgatgagattgaatcacaatcccagataaggttgctgtcgtcatcctgaaattctcgtttccgcaaatgtacactggcatttccagtatgtgtgaccttgctcattctccatcttcccaatcggccagcgaggcatcgaggtcgcagatgatgtcggacatccacaacgagcagtcgttctcgttcaagctccaggacaggcgaggacggatgcaccggttcagctgtggtactacactagtactcgaaccgtgccggtttttgtacagtgttttcatttctggctagcaggtattgttgcactgtagctcatccgacaaaccaaaacacattttcgattttcttgcagaggtgcagagcctgacgccgttgatcacctgcatcctccagcggctcggccccgacctcgaccgcgaccacctcctcaaatccttgtaagcaatgtcaatccagtcccaccattgcccagaaaaaaaaaaagcttgaaaatgcaaacaaaagctgcaagcaagtcgttaactgaacaactggtgctgcgtgtgttgcagtacgaagacgaagaccgtgacaaggtggtgctggcgtccgacgacgacctcacggcggcggtggaccacgccaggctcgctggctggaaggcatgcacgaactagacagctgatcgatctctgaatgttcctgaatcctgatcatcgatcatcaccgtcctttgattcttgtacctgtgcttgtggatctttaattgcagggcctgaagctgtacctggactactccggtagctccggcgtccgtaggaagagcgtggttcccagcgtcggggtcgggggcggcggcggcggccgcagcagtggcggcagcacggcggtgatggacctgtcgagccgggacgcgtgggcggcggcatacagcggtgtggccgccggcgccgccctggtcaccggcctcggcctgatggcctatctccggagagctagctgagttccaagagttgaaggtttacaaagtgatctttcagaaagcttagacgggccgggctggaaaaaaaagctgtatggtcatgaaggctgggctgagctgggccaaaagcccaagatgtatgatgaatatccttagatgggcttgggctaggcccatcagaaaggggtggaaatgaaaccattgtgtatagatgaaagtggtttgatgaaagatgaaagggttaattggatccatgccactgcaaatagagaaaatctactccccggtatcccgtggtgtcgggatagctcttcaaccttatccatccgaccacccgcatcctcatccacccgacgcaatccccatctcactctcacctcactcccctcctctctctctctctctgaagaaggccgagcggagacgaagccggccgggaggaaggggtcgtcgtcgtcgtctccggcggccgaggaggacgacaatggcactgtgccggcgaagtcggccaaccctcagcggggtcgccctcgagctcgccttcccttgctgcgccgctttggctcaccgccctcgtcggtcggatgtgcgccggggagtcgtcgccccggggagggcagaagcgggagctcccctcgtcctcgccctcggcctcggcgtcaccgtcgtccccgctgcggcctgccgctttgcgcctccgggatgaaggctggcagtgtgcgtcgacttgcaacaggtatggccgtcaacctcctcctcagctcctcctcgagacttctcatactctctggctcgggcctcgaccctcaactcgccgtgcctcctcggcgctatcctccgccgttgcggccctccctcccccacatctcctcctcgttttgacggtaccctctgataccccacaagtatcagcctggtacctaggtaccacccggtaccttggcacgggtatcaggtatcagtcgatacctagtcggtaccaaaggtactaggtaccaggtaccaaccggtacctaagataccaggtatcaggtatcggtcgatacctagtcggtaccaaaggtaccaggtaccaggtaccaggtaacaaccggtacctaaggtaccaggtatcaggtaccagggagcacacgtggacagagaaaaggaaaagggagagtcacttaaaatatcccattgtaacagtatcccgttgtgtagctgccctcttgcaaatatgccaaattaaaaaaataccactacttttcgcgatattgactagatgccactaaaactttgtaaaattggaaccgtgccactccgtcgcgtttttcatccacttttccgttatccccgttaatttctaattttctatccttgccagctaactccggcggcgagcggtggtgttggaagcggcggaaggaagcggagaggcgggaagggagagacgccgccgaaggccgagtgccaccttccccgcgttcttcttcagccagcttgactggaagatgatctccacgatgttcatgctcgtgtcatcctgcccgagctccgaaagatcgaaactacaatcgaaatcgaatcaagggagtcgggcttgacgaagacctcgtcgcagtcggagcaggagaagacggtggcggcggcggcggcgagggtgcgcgggtcgagcaccgagtggcagtggaggtagaaatcggagagattcctgatctgcattgccctaaatgagccaccgatggatgacaacgacgaggacagtgccgatggcggcgaggtcgtcgtcatcgtcgacgatgtgctaattaccgacgacgcggagatggcggccgcggcagcggagtcgccgtggtactcgggaccacccatcagcgacctgctcgacgtgcgtgctgcctccgccaccatcgccgccgacgttccggcgccggcggcctctccccctgctcgccaccgagctctccttggttctgcagatcgatcggcacacgtgatgctcacctccgccgctgtcattcttgccttctgctgctgtagctgcagccattggttggcttctgctagcccctaggctgaggaggacgaagacaacgacgactagaacacaaccgataaaattaaagggggcggcagaaaagtggatggaaaatgtgacagagttgcacggttctaattttataaaatttaagtggcacccagtcgatatcgtaaatagtagtggtattttttaaatttggtatatttgtagtagcatggatccaattaacctatgatgaaattaggggaacaacacttcttgcagatcgaggagatggaacagtgtggatttggcataacaaccttttaagttgtatgtgaacagtaaacgttttggcccttcccctttttaaccttatggtttgctaggtagttctccaaacagaaactggagttgaagttgattgtttgataagttacggaatgacattgccacctaatttgttcttcaacttttacgagaacatctttttttttaacatcagattccaaattttctacaaatacatcagtataagaaattgacaattgaatgcccgaatataacaaggtgcattctagtataagaatttgataatttagtattttagagtagcaacttggctaagcatgtgttgttttggttaacgagtactaggtaagtttttttcacgatgtcaatatgtgtcatcacatagcaatcctacaaatattactttataatattaaatttaatctttaagaattacattattgcgcatccaatttgccacaggtatggatttttttctacaccttctcaatctcaactgaaatataatattttctgcaaagtaaagtttaattaaatttcagattttagaatgaaaatttaaatatgcttatacaaatccatgctagtatattgtcaaaattaaaaataatatgtataagaaaatattctcgaaacaattaagttgccatatcacttcttaacctattgtaacaaatttgcacccatcttgcaagttgttacactcatatgctcacttataaatttcctacactaaattgcacccaattaccaagttattatattaggatgctcatttcccaagttgttatattaggagacttccttctattctcgaggaagttgagaatgatgttttatatctgctaattgatggctcaggagatgtgtcttacaaggagctaatggctgttgtcttgtgatatattgttaaatttttagaaaatggatctaaatctggtctctacatccaaactagatacacaaccaacataatacaagattacatgccttgcaaaaggacttctcaaaccaagaagattaaaatagaacttagactcaacctgctaacaagaaaaacaatacaaccacttaatcgacaagcaacataaagggacaactagccaaagtgagatagcttccatcttttcttcatattccagccaacctttgagagaacttccaacgttgtagcttccaacaagatgcagccttcgttcaccttatttctaccgtcctctttaagcaacaaagaccactgttatacagtacactcctttgatgattatttgaaaaaggagttagttttggagccattagaggctgcattattcctaaaaacatactgctaacataaagatgccaactaccaaaatgattagcaacactagtacatggtttaatcccaaaggttataaacatgacattccacataaatattgcaatttggcaatcaaataagagaagttgtattgtttcattagaactataagaacaatacgtagtactaccctcccatctccatttcacctaataatcattggtcaaaatgaccccattttagataccataggaaaggaattctaagttttcaaataaaagatttcctttgtagtacatccccttacatatgagagctctatacttcgcgttgatagaaaagactccatttttgtgttctttccaaataaaagcatgatcttgttatgatagtgtaatacatgtcacttctgacattaggttgtaccaatctattatctaataccaaatccctcctaaaggagacaactaaaggcacccatcttaaaacatccaccactttagcatttttaatactagttatataatataatgagagataaagcttgtcaaaagaataattttccatccaacaatcctccccaaatctcaaatgttggccttgtcaaatgtggaaatgttaaaaatatattagttggtttttttcatgtgaaagacaatttatgttcctcttcccttcaaaagaaactatctatgcacctcaagtctactattgacattttatttgcggagcataagttaagtctggggcaagtgagaatggtgcaaacaatatgagaggtgagttcaatggttttctctcaccaattatgagagaaaatacattggcatattatgtttcatttgccttgctcagcttcttgaattaatagttttggccattattgtaaagaagcatgtaaaaaggaattgaggaattctttgatatgatttacatatgttctattaaatgtgattggtggatcttccaagtgaagggatacggtttgattcatcaacatgtggcacataagcaatagaatacaacaatttataatagagtttgcaaaatttcataggtgtcgtgtgataccatgaaacatccttggatccgtccttattctgctaccaatagagttaggatggggaaacattaaggattaactacaagacatgacacttgagaggttatacttttatggtctaaaatttggtacatctcaatacgttagtacaaggaagtacaaaatttaacccgacaacatttttaagggtcatgtcaggaactcttgctattcactaaaggagggtgagagcatcccatccctggtcggtcatacagctcaatggcttgccttgccaactgagcatgcgctcgtccgcttttaccctacaacttaaggagcttaactgaataagcaaatccagaaggatattattaagaaatcttatctttgtgctagtttagaaatccttttgatttgctattcggatatcatatcttatctttgtgcttaataaacacttcctccttcgtcatccaaatgtggctataaaagaagccgttgtgttgatttctctttctcacacacaccatcactgatatcatcaaatacaccaagaaaaagagctagctaagtatgttgtcaatcccattactaggtttgtgctggaaacgatgctggatggtgagaaggtcatccttgagcagaagatcgccgccgccacggcgaggatgaatgagctgcgacgcaccaaccgtgagatggaggtaaagctcgtcatctatgacgccattgccggcagccgcaagaaccttgatgacttgtctccgaacttcatcgacgacctccagaaggaggttgcaaagcgccgcgaggaggtacagaagcgcatgcaggaacttttttccatggattcctccaaacccacctgaagggattggtgcatgtgtaattacatggtgctttgagtggatgcaccctgcttgcatgtttgcacatgtatcatttgcttttggcttaatttgctttgaaattaattctcatcagcagtcctagttggagtcaagtcacaccatcaccaccatatctgttttcttttaaagttgcaaaggcatgtgtttagaaagctcggcttttatggatcatttgctagtaacccgtaaatagtatgggctattattattaatattataaatgctaatttttttatatatcttgacatgttagtatcactactgtaagtcacgccccaaacccccaccaatcactatgggtaggcgattggttgtcttgatcgagattctgatctgggtaattcgatcttttgaaaatgacaaccaaacttggtacaaacaatttaacaaccaacatatacattttattttcaatcttcggccctagcaaagtgaccaagctagatgtgagcgtagaactaggagcgcatgggatggggatggccggaagggagtagatcctgggcgggcagtagcaatgggccagccatatagagagctaggagacccactattttgtggataactaagggcagatgaaatccagagagctgtgctcctagtgatggaatctgagccaggatgagaagggagattgaatctgagccaggacgagagggagatagaatctgacgagggaggagaggggtcttctatatggcaaaaagggtgggctggatgaaggaccagtagactagcaacggttttggtgaatgagagatcgaaggtaacggttgactggataaggataatgttcacatatcgggtagttcgggtacctaatacagtagaccaaaagacctaacaatgaactgatgacaacatcttggtcttggtttcttttgcccacctatacccaatgctcccacgcgtgccctcatctctcataaccaaatgtggcaattttcggtctcagtttattttgtccacccattctcagtgttctaatgtgcctagttctcttacacaaaatatggtaaatttccatgtgccacccagtcagcctgtttataagatatctaccaacataaccaaccatatccttacatccacgttatccactcatgtttcttcagatctagaggtcgaataggggaaacagcagtggcgatgggatatgttctccagaacaaatcaggatgccatgccaccggcccaaacccgcccacccagtgctagggggtggctattcagtctagaccaagatttcggtccaggtaatctcgtctttttaaaatgacaaccgagccttgcacaagatatttagcaagcgacaaactaggtaaacgatatttcattctcggtctttggtcacaatgaagtgaccacgttggatggcgagcatggcacctagagcgcatgggatggggatggctggataggagaggtgctaggtggggagttctctatgggacactcttaggttgtgttcttcgcccttctttctcaaatcatctctctcgttttccatgcacacgcttttaaaattgctaaacagtgtgttttttttcaaaaaagtttatataggaaagtttatttaaaaaaaatcatattaatctatttttcattattttaggttaatacttaattaatctcactctaatcgtttgctttgttttccgtatcaggaggcgaacacagccgactgagttcttttccaagctttcccagctcatctcactcttttttcgcgcgcacgttttttaaactactaaatggtgtattttttttaaaaaaatattagaatgtttctttaaaaatcatattaatccatttttttaaaaaaaatagctactccctccgtcctagaatataagaagttttagggttggatacggttattaagaaagtaggtagaagtgagtggtggagggttgtgattggatgaatagtggaggtaggtgggaaaagtgaatggtggagggttgtgattggttggaaagagaatttggtggagaagttattatattttaggacaaatcctaatggctaaaatttgttactccttccattccaaattaatctacatatagtttttttaggttattcttaaatgatctacatatttgtgttcattcattaagtctattcgttatttgtgcattggagtaaatggacattgatgcatacatccatgcacacaagtatttataacccacatgcaatattttgatttgctattggctaggaaatagtggggatggtgcatgcatcaattctgttgctagagtaaatataatataagagagttattagattttcttggtcttgttgtacctatataaaatatgtagatcaatttggaatagagggagtatattttgggacagagagagtaatactgaattaatcatatgctattcgaccgctccgttttacgtgcgtatgagatttgttcccaactaccaggaacgaacaagcttcacatgaattttttatacgatctacaatcttgataatacaattggctataatcagctgccgcattgtgttggttagcttgagagcatccatagaatatcaaagttgtgttaataggagatttgctccggtccaacaaaaaaatatcttgagctaccggtaactcacgataccaaatcgttggatctaacaacgtccatcctgcccagctaaatcctcgatcggaaacaatttagtaccgtgaggtaccggtacctcgaaatatttttttgctggaccagagcaaatctcaaaatagttactccctccgtttctaaatatttgacgccgttaacttttttttatatgtttgacagttcattttattcaaaaaaattcaagtaattattaattttttttcatatcatttgattaattgttaaatatacttataggtatacatatagttttacatatttcataaaagtttttaaataagacgaacagtcaaacatatgttaaaaagtcaacggtgtcaaatatttagaaacggatggagtaataaagttgggggctactataccacatcatcccatccgaacgtgatgatacctggtatcacaatctttagtttggaataacaatggcaaaatcacaaagctgaaaaatgcaagggtagcaaaatcacaatactaatggggacaaaaacgtaatttgtcccatcatctgttttcaaaacattggtccaaaccaatgtgcatatcattaggtaccccacttcgtaaatcgatcttgtactcgtactacgaatgaagtacaagcacagtacttcttgcagtagtttcttgccggtctccttccccgacatggcattgggattttctcgtgaaacgggacggacgagagttaattaactactccagttgcccttgaccgtagcactacatagatacgactcgtagctagtaagatatactcctatatcagtaaaaatcgaatcattttaattaactactagtaagttgaccagatcatcatctatttcgagttttgttttcacgtgacctgataataacaatgtgggtacaagctgatcaagtcgtctgtcaggacgatctgttattaatgatgttcagaaggagatcgatctggttccttgtgccactttggggagtgatcaccgaaatctcatatcgttaattatgacattttcccatgtattattatccaattccttaagaatagatctcgtccaactgttcacaatcaattttgttgagaaaaaacttagtttgatgtactaaattcgatcatatatacttatatatattctcgaaatatgttccctcagtattatgattttcgttgagttttgcagatatatcaaaatagttattcttgaaagaagatgcctgatatgaccaaaaagaaaattgcagggagtacgttgacatagattagttagttagtttttcttaagcacgaatggattcttttcgattgtgggatttgactgattcaacagcaaagctagcaaaatattagtggcatatcctaatgtctttctcgatatgcatgagaaacgacggctcaagctattgtattaggaaccaattgtaaattataatactcctacggtttttaatacatgatgacgatattgatttttttatgtttaactattcatcttactaaaaatatgtgtaattagcatttgttttttctctgctactctcaataacatttatttaattaacatttattttatcattagatatacttatgcatgatttatatttttaaattttaaaaaataataagatgatatcttaaaaattaatggcgttataaattaaaatcagaggatgtagtaattttttacctgattggtacgaagttgtcggatcctctctagattggaggggcgatctacgatccgtggacaagcagttcagaagattgaaagttcgtctattttaataccataaaaatgtacgagggaggtgaactaaattgagtctcatgggcaagtatatattgtacaaaagattacaagacttgtgtttaaggaatcttagagaagtaagatgaaaactatatctatatattaccataacaacttgaatcctccctgtaatccttcctattcctatccctatactacctatactcttaacaatgattatatgattccctcccttccatttgtagtgctggggtcttttaaaaattaacctccatcaacctcttcattgttttttttcatagaagaaccttcttctctaataatgaaagctgtccatttgtgtcaacgctcatggctttgttaaatgttaataaactttggtcgactgtacttcagctgtcccggccatgcatcagagctcatgaccaaacagccatgccgcaaatgcagatctcccattacagacgacgggttccaatggcgctcactaccaaataaaatcgattccccacattattatctttatctatatactgcaaatgccttccttttctagtgtgatttgcttccactcgtggtattcaaaagcctagttttgatgctagacttctcccaggtatggagtcaacggtattgagaaacccgaacgattaatagtgtttttcggtagtagaccaatttttttttacgttgatggttatatcctgagaggctgccggacctgcccggagatggctctggcactgccttctccatccaagaactaaaatcgtcagtttttttttttgccaataatatattatggtcatgcattgtaacaaaaacatcatatatttgattttttcccccaaaaaatctcagttgtcacgtgtttaggctagtggatcaaaatccaaccatcgctggtcctttttcttctactccaattgaagagcaaattaaggcctggcaaccgagctgtcatcctccccttctagcgatgacggtggtgacaagcccgtcaagttaggatgttcacgctgttggaattgtgtgtgaacaaaagaccccatgtgaagaataattcttagaaaattctcaaaagacccacaatatga

SEQ ID NO: 54538 - DNA, 2038 bp, Oryza sativa
aaaaaactgaaaaaaatggcttaattggatctatgccactgcaaatataccaattcgaaaaaataccattactattcacgacatcggctacatgtcactagaatttgggaaaattggaatcatgccactcccgtccaattttctatcaacctctgtcatctctctccctcttcctttcttcgcttctccgccatggacgccggtgagccctacacctcggactcgttggtccttgccactgcagctagccaatggtcccctctccatctctcgctgctcctccaccaacagcagccgcgacccgtccgttccttgtcatccccaccgggggacacggcacccttgtggcctcgccaccgtcatcaagggaatcagcagccagggagcttctccgccatcagaatggtaggttctcagtaaggtcaatgtatctagctttaattaacaatggttatgttgagaggaacaagtatatttggaaacttaagatgtcgcttaagattaagatctttatgtggtacttactaaagggggttgtgttaaccaaagataatttggcgagaaggaattggaatggtagcttaaggtgttgcttttgtatgaaaaatgagtctattcaacatctcttcatggattgtcattatgcaaagttcatatggagagcagttcagttttcttttggttttaaccttccaactagtatatctcatatttttgatgggtggcttttgggggttgacaagaaaaagagtaaactgatacttgttggagcttttgccatttgttgggctctatggttgagtagaaatgatttggtttttgacaaaacaccatctattacatatatgaaggtaattttcagggtaacgcactggctacggttttgggcacagctacaaaggtgtgaggatgatggggaattcctaaaagttgcatgccgcaggttggcgtcgatggttatgcaactatttgccaattatgggtggaggttcacaaatagacttcaataaatgtgttctccttattttggcttggttacctttgtttttgtttggtgtgttcttttatctgaactacactcttttctggagtgcaactttataataattggctgtagctctttttgagcaaaggctgggatgttatattccattatcttaaaaaaatggacgccggcgagcccaagagggcgacaactgaggggaatcggcaaccggggagccgagggcgaagctcagcgggacgagcggcacgggggaaggagatcggtggcggcggcggcgagggttggggacgacgacgcggtggtgggcagggtggcgatcagcatgggggcggtggccgggacctcgccgggggagcggacgacgacgacacaggcacagctcagcccgctggctccgagacgaggggatcgacaacgacgatgcaggcgcagcccggcccgccggctctgagacgaggtgctcaacaacgacgacgatgcagcgtagcccggcctgccggctccgagacgaggggctcgacgacgatgacacaggcacagcccggcccaccggttttgagatgaggcgcttgacgacgacgatgacgcagcagcctggcccgccggctccgagacgaggggctcgacgatgatgacgcaggcgcagcccggcccgccggttctgagacaaggcgctcgacgacgacgcagcgcagcccggtcggctggctccgagacgaggcgctcgacgatgataacgatgcaggtgcagcccggcccgacctccatctctgagatgacgacgacgataacacctcctgccgtgtctatggtggtggagagagaagaagggggaagagaagagaggggaggaaggtagggcccacgtgcagctgggggctaacggagatttttgacggaagatgtgatggagtggcacggttccaatgaagagaactcgaacctccatgctctttagcacgatattttgatttctccaattttcagtggcacgtagccgatatgttgaatagtagtggcattttttcgaat

SEQ ID NO: 54539 - DNA, 14549 bp, Oryza sativa
  unsure (1)..(14549): unsure at all n locations
gaatccaattctttccaaagcgatttagccaaagattccaagggagaaagggtagaggagatcccgaggatcatttcccctctatcaattcggccggagaaggaaaggaacgtccggatttggaaggagacggcggcggcggcgcgcttagggttcgggccgggccgaaacggcggcttcggggaagacgaacctgacaggtgggacccacctgtcagcgaccgaacgcgcgcgcggcgcggctgtggactgggccggactgggccgaggagagagaagagaggttttgggccgactttcggtccaaagccaaaagaagactttttaaaacctttttcaatttaaattatttcttaaatgcaattccatttattaaaaatactttcttagctcaaataaatcccagaaaaatctaggaattatagaattaagcaaagtatttaatgaaattttatctgggcccattttatattggaatttattaattaaaattagatcttctctccaagactttttaaaattatttctaaaaattccaattaaacaacaatttatatattttgaattttcagggtgtgacagatttgcacctcctctgcttcttagtttcaatacgaagtttgtgatcttaatgtagtcttctctactgcggtttttgttggctctttgccttaagccttaccctttggcgttgtacaggggcttgtctccttgatctgttgctttaatatatgtttaagtttaaaaaaaagatggaggagaggcatgcacaccactgagctcgtcggaaagagagagaaagaggatcgggccagcgccggcgacggtggcgcagccaccgcggaagaggaccgggccgacgccggcaatggcgacgctgccaccgcggacgaggaccggaaagggtgaagaaggggggagggggagacgggagctcgaggtcgatcagcgccgccgcttgggccatgccgctgccgcggtcgttgggggtggaagagagggcgccggcgaagataggagaggggagagggggagtagctcgaggtcgaggctgcgttctcggtcgatccgcggtgccggaggaggaggaggaggaggaggaggaggaggaggaggaggggaggcacggcggaggtggtgctccgacccagacggccgccggctgacctcgccgtccaacagtactacgccgcggagcttatgttaagggagggggaggaggaggaaaggtgntnttnnancnngtgctnggccacnccaccggtcccgttcggcttggttggcccggcgccgtcttccgcccggctttctgtggtggggaaaatttgaaaagaaagaggggataaagagggaaggtgaaaagtgaaaagaaaagtagtactggtgggaaccactataaggaacttgtactgtggaacatgtgactaacattgttcttggtctaggtggcatgtgaagcccaccaaaactttgtgacatgctatgaaagcccttaggactttgctatgtgtaaaagatagttttattagcaagttttaaatagtttttctctgaaattactcatccaatcttcaatctacttacaccaccaaactcattgtaattaaatctccacaacaagatcttacatgattatattctgaccaaaagaatatatgtttcagttggaatccaactacgttgcacattttaactttatatgttctaatgaatttttatcaaatgttgcatgtggtgtgttacgtggatgtgacttagtccaatgttttattgattcatttgaaaatgttgcacattgtattatatgaatgtttctgtaaaattacgtaatgtttcaaccatcgcacctcgatgttttatatagtatataaaagtattttacttaaaaatataatcatttttactcataatatgatcatgcgggatctttttataaggatttaattataataaatataatggtataatcggattgtaaattagatcaataatttaggagaaatatcatttaaaaattgataaaagatattgcatggatgtgcgtcaaacctacgcatgacagagaagacaggagagacagaggagagaacaaggagtgcagcatgcaagcatgcagagatggctacaccaaatagatattgcagcatggagaagggcgctcgactttttcaattttatcaggcacccgacccatagtcttgtcggtacatttatgcgtgtatttgggtatcatattgtaggatgagtttttgacatttataaatatggtgtattaaccaggcaacacctaccacacttcaaaagtatttgtccacaattattttttatcagtattgtttctataattttctaacatattactttgctttatagtatgtcgtacttaattcatccttatagactttaattatttgtaatctttttccccgcaaaaaatatatttataatcttttcatcatctaaaaaggggtaaaataattttgtttaaaaagcattttatattagtagtggcagaggcctttcaagccctaaaacaggaactcattccagctcctgaactagctatgccctaagccttatttttctcaggttgtttgtggttgagacaaatgcatcccatcaagatattgtggctgtgctgatgcaaaacgaccatcttatcgcttttctgagtcacgcactgggtccacgacatcagggtttgtgtctacttatgaaaataagagcttagctatcatgttggtgattgaacattaccgtctgtatctccagcatgatgagtctatgagccagaatgcatcgagaaggtccaggaggagtacgtttgttgatttttagatcggcaataacagaaggggtagcacagagataatgagttagagtattcggagcaagtgtgtgccctcaacttcactgtcgagcacatagaggcctcccaacgcgtgccacttccccaaacgaacgactcctctgtctcggcgtcgcacacggtgcaagatggctgcccactgcccgaggacaatgacacgcacttccacagttataccttcctggcacatcccactggcgcattggaattcccgacgtacgacggcaagggtgattcgctcccgtgccgctgcgacaggttcttccatggccaacaaacaatagagaatcgcaaggtttgatatgtgtttttgtatctaaccggggatgcctagttgtggtattgcaggcttgagctcaacgccggcgccccatcctggcggcgatttgtccaattggtgcacacccgttttggcccaacaatgatagatggccccctcagcgaactcatggcgttgtggcgcactggcatggtggaggattacatcaatagcttccttgcgctggtgtactgcgacgctatgctctcggagaatcaacacgttcaacttttcacggcaggcctcgtgaacccgctcaagacagatgtcacgctctgtcggtttcgctccctggattacgccatcatgctagcctgggactacgaacaacgcgtccacacttatcccattcccacacgggcgggccgcgcaccacgcttgcactccctacggcgcccgtggctgtgcctgtggcgatcgcgccaggcgacgcatcgtcctctgccgacgttggcaagcaacccctggtgactgccctccctcataagcatctctccctagcagggatggcccagtgccgctctaagggcctctactacaattgcaacaagaagtacgtcgccagacttcgctgctagaagtccttcgtcattgagttcatcacgttgggtgaatcgagcatatcgttgcatgccttgactggtgtgcactcgcccaagttcaacacaatcaagttccttgctcgcactggtgcgacggatctcgtcgccctcctggacttcagctccacccacaacttcataagcaacaccacggcatgacgggcgaacgttccgctccacccctatctcggcctcagtgtcgccatggtgaatggagaccacgtgacgtcgcccggtcggtgtccgcccagcgcgtcaaaattaacaattgtcctgggtgcaccttcgacatcgatttctacgtgctgccactgggggctatgacaacgtcctgggtgcacaatggttcggtacactcgggtcatcttgtgggattctcctgctaattgctcgcctttagcccagtcgataaccgcgtcacataggtgaggatcgacactctgccaccacccgtccactccatggccatcgacggcacctctggcgaactcatgaacaaactactcaatgacttcatcaacatcttcgccgaaccacaaggcctaacatcagaacaacacatgtgccatagcatccgcctagagcacatggagttcgccgtcgtcgtgcaccctgtcgaaacatgatttcggcaataataaaacggggtaacgcacgagacctaaaagtggatggatgcagagacaaaggatttagacaggttcaggccctctcaatgagaggtaataccctactcctgtttggggatttgaatccgccgagtgtgtattgatctgacgatcaggttgtgtcatgcccctagaggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatacatatatgttatcccctattactagtcggataaccatgccgtgtgggtatggggtacccataatctccacagtagcccctgagaccttcacagtcgaaaatataatcttctctcgaactagattactctaaagccgagtgcttcaatcatcttcgccatggtctcccgagtacttttaccaaatctgaagactgtggagggctgaaaaataaagtcaggtgcatcgaatagatgcacctaataggtgtagcccccaactatgtgattagctgaacaaactaaacatatagtcaaggaataaattatccaattaaccgagtggtttttgataattatagtcaaccaagtgacttgataccaatatatagcatatgcggtgtgaatccccgaataatatgatccaagtgatataccgactgcttggcaaaatatgatgcgtacaacctaaagttgacaacatctttgaaagttcacatagcaaaataattataaagaagcttgaatgctgtgaataaagaaatttccaaagtattgggcatacgccatgcgcacactgctttaacagatgtgcttaagtccctaaaagacacatggtttcaccacacctggaaatatatggcatatatggtataacattcgagtaagtaaactcataaaggatttaccaaccgcctgaaaaatgaccataatatataatcagcctaagccataatattggtcaataaaaatgcacacatacgtggcaaaaagcaatgatattgtatccaatcaattgcttgataaacccaaacagcgccatgactatataaaaaagtcagcgggacagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccgaagcaagtccaaattgaagatataatacttgtatttgagctagtaagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaagtaatgaagtcgcatagccatggaggcgaagaaaccagtcggcggcagacagatcaactatcaatgaagatgaaagcgcccggcgataaagttgtgtagccatgacagcgaaataatcagtcggtgacagacgaggcaaatcaaaggcgatgacgaaatccaccaatcatgaagatgaagaaaatagtcggcgacgacaaatgcaactgacatgatgaagatgacgatgtcggtgatccagtcaatagcagtgtcgcaaccaatgataatgacgaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttataactgttgtagatgcttcacttggaggagagttgatgttgttgcccaactcgtctaaaccgaaatatttgaagttgctgaagtagagtgtctgccccgaagcaaagatgaagataatgactcctggagttgactcgttggctgattaattgatttcttcagcgtgacataaaatttgttaaattttgagccttgtatttgtgtagcccccgactctttgattagttgggaaacaactgaacatagagtcgagaactgtagcatcttgtcatcgaatagttattgcttgattgaagatatgtgttgaagatgtccaagtagaaatcatgaatgttggagagccacttgttgtagtaaaataacacggcatcgcatgccgagatgtcgagattcacaatgtcgcgaccgggaaaattgccttttcccgaacgctagtgtattaatccccgtcccaggaaaagccggggtacaccatacaaacatgatataaaagacacatctttattatatcggtaatatttacattattacaaaggcacttaaggcctgacaaacaaaaataaacagcagcggactagcggcctacggctccatcttcacaggcgctcaactggggtataagccaggactccacctaagacatcttctccaaagtttctcttactgaagggggaaaagattgagcaagaatgagtacaaccacagtactcagcaagccacaccggagatgcataattaatgcaagggaggtacaagggaataataatatagggattaagttttgcagtaaacagcatttaaaagtcacttagttgcccaaagccattttgtaaagacaatcctagagctacacagtattattaaacaaggccgtgaaccctcacgaacctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgcaaacacgtgccacataccaccacggtatacggacggaagacgtgacatagttcccaacccatcctagccataaacaagagtaccgacccaatcccacctacggccgggatacccgggacaggtaggcagaactgagcccctagcagcagggcaccaaccctctgccgtatgacatctcgactaccgggccgcagcccgtgtagccttcatttgccctggagaatgtccatcgacacccgacttcatccatctccaatccgtgtacttttgtttaagactagactgagccacaaactaagccttacccattagacatgtggaagtacggtagtgctttgcaacagaggcccgagcttaatccttatagtggccggggtgctacttcccacaactggcatgcacccaaaccccaccaaaaacaggttttaggggttttgaaagaggacgagaggtgtgtgtccaattccaacataagccaaccattccatagtgtccaaatgatatgagaattcccaaagtctaaagttgtaaaaccacctaaggttgcctaattaatcagcgaagcatctacctaaattcatactagtggaaccaggaatagagtacccactagttggggttttgtttattctagggtgaacaaggtaataataacaataacaataatagtaaggtcataacaaaggtaaataggcatggctaaataaaacagtgataacgcgggaatttaaataaagcgataatgcattaatttaaattaaaataattttgtaaactgggatttcaatatgctcaaggatgatgtgacttgccttgctcgctttcccaaacgacggcttcgacttccacgaagagcggatcttccgaagctgcagcgtctacacggccaacggaaaagaaaaggcttttactctaataaactccatacaacaagcaggaacaaagcacaaaaatgggttctttacatcttaaggaaaaattagagacttgaacggtccaattccgagttcaaatggccaagataaggccatttgaagtttatatgctctttaaatggatatttgcgaatttcttcatttaaattttaatttaaaaacgaattattgcgtcagccgaggggagagggcgcgcggaccgggtccatgggggtgggggcccacgcgtcagcctctcggtccacggtggaccgggagcacgcggctggcggcggtcggcgccgtgggtcccacgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggtgcggcggagcggcgcccgagagagcggagagaagggggaaagcgaacggcggtcttcggctcaccccgggacaacgacgacgacgagaacggcggccggagcggaagaaggcggcggcgcggttcgggatgacgatgacggcggcgctccgacggtcggcgagcgaaacggaggcgcggacgaggtcgacggcgatgcggcgatgccgagggaggtggcgccgagccgggaggaagaccggagcgacggcggcggcgaaccggagcggaggaaggcgacggcgcggttcgggatgccgagggcgacggtgctccggcagtcggcgggcgaagcggagcggcggacggggtcggcaaccactcggcgaagccgatggaggtggcgccgagtcgggcggaggaccggagcgacgtcggcggcgaaccggaggtcggcggcgacggcggagagagaggagcacggcgcgagcacggatccgacggcgagagcgagcggcgagcggcggaaacggaagagcggagctcggggagcaattatataacaccgagagggggagagcgcggccggggagagaggaaaccgcgcgcggagatctcgggcgccattgaagacgccggcgaacttcgcgggatgaatccggacgaatccgagggagagagagagggaaaagagggggaatcgggagagggaaacgcggggagtaattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagcggcgggcgggcccgcctgtcagcggcgcgcgcacgggggaggagccgatgggccggggggaaagagagagagagagggagggaatgggccgagccggcccaagaagggaggaggagggggaaaagacttctttttagggttttctttttataaaacctttttaactttgtttatttcttttcaattattatttgtgctctgaaaattccactaaaatttgagggctccttttagaccaaggagaatttaacaaaaattctccgggccatatttgaatttttcttggacgtattttagtgtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccagggtgcaccttttggctgactcagactaggttgcggtagttcagtgatgcttccgttccagaacttctcatgcttcatatcttcggagtcaacctcagacaagttaccacttcacgtcatgcgtcaacactagcttgtcattactaggatactatgtttgtcatcataagaatatcatgcttgttattcacttctaacttgccatcaactgtctcatattagctttcctggtctccggtgctaggtacttcggctattcgatgcaagggtcaaccactctaactataagttatgcttcccaagagaaccaatttatcccacttgacatactttgacgtcttcccaaatagttttactgctggatttgttattgtctgatcgtgatcctgccagatctgaagcttcgttgttagaggtgatcttaatctgacctctgtagactatcttcgaacatatcacttggttcataactgggaatggctctcacgaacaagcagctcggattcactttctttacattcagtttacttcccattattatcttcaggttgtcctcagttagcattcaacgtattcctttacacttttaaccttgatgtgttctttcccattggatcatctcccaagacttggcattacctggtaaccggtgcttgcacttttcacttcgtgtagcatctgataccgagttgaagatttcactccttgccttcatagaaacatttttacctaggtcatcttgcttacttaatgacaaggtggctgttgtggggcaattacaattaggggtcttccttgagcgatgcagagcatgtttctgtttatcaatcacctttcggcctacttctttcatgctagagaacatctttgtcaatctctttttatcaatcatctttcggcttatctctaacaggtggtattctttaatgtggattgcggacgcttctggggacgatgaggtcctttggcttgctgcctttcagtgaaaccttgatgtggtgcgtcaaaagctgcactgactaccttcagggaaatacattgcctgctatctgtatctataccactagggtttaattgccgatggtcatctttagtgcttcctcgagatggggagcatccaaattgttcttctgccacatcacctttgacctttttctgataccagataaactaattaccaaccatcgactattatgttctcaaatattgatgtctcctggatctccttatctgttggcaggtatatccgatcttatcaatgtagaggtatggcgggtacccttcggggtttcctccaacaatccttatcttgatctgtaaaaggcgtatccaaactcctatcctcaactactgtctcgttggctttttaacccaacacagtttaattgtttttcttttccatccacaggttggctattaactcgaggttagaatatagttcctctgacacgagaccctaggtctcctttgtcagtaaacaattatacacatgatcacatatccgcatctttcaaacgaatcctcatggaacttgtctgtattacacatttctccctcattacatgaatacggggcactgccttaaacaaaaagggacggtgcttaacatcggtacattgtatctactatgggttagaattaacatgaggcctcacaggtacggcgtttgctccagtgaccacaaggcgagtgacttgtcttcttcttgcataatggccggagtgatggcgcaggttacgcttcggctgtggacaatctctagagaaatgtcctggtcctttgcagttgtaacaaatcaacgtcttctttactgagctgtccatctggggacgatcattttgacttggagttggaattggtggttgggaatccttgctaacattggcatcagtggtaccattattgctatcaccattggagtccttcccagagtcaaaattgctagggttgtcattctgggtgccttcattgatactatcgtcgatatcttggtgaatgatgttgacattgcacgcttgatctaagtggtcatgaatggggcaagaaccatggttgttggtggtatcatcagcattagtattgctattgttgttgcctgcattgcgttcatcttcttggggcaggaactcttgatacacaacagaagatccggtgatctgaagtggctcagtgcgctgtctttggttaccacctggaaatactgggttgttaaccatccttctcttgcagttcgtcatccgattatgctcactttcgagttgcatggctttgtccacaagtttctcaaaatcttcataatcctctagaagtagttgcactgcaagctcatcttttaacccctggagaaacttctcttgtttgtcttcatccgtttccacatcttctggtgcatattgagccaaacgatagaactcgtgcaggtactctgtgacggtcaaatctccttgcttcaggtagcggaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggccatggcaaaggttggaggccccgttttgagaaattctgataacttgcactgttgctggactgtaggtacttgaacgttggttgcccctgctgggttgttccgattctgtaatagttgaaaggcggttgccaacatgttggtttggttaaccacaatttggattagctctggtgaggtttcgttgatgcttttctcattcccattggcttgggttcttgagtcatcggatccatcattcccatagcctttgttaccagtgttatccatctgtcacaaggtaggggttgagagaggaagcatacaaggaaagaatataccagagctagggacaggaccttaaaggaactaactctttttattgatgtgttgtttgttatgcttattctgcaagttgattaaacaaacaacctaacatggtcacatcacaacccaccgatgcaaaccacgcactacacacacaagcaaggaacacacgactaacaacactaccctatagggcggcttaggttctgcgacgggttttccaagatcttcactcctgcttcacagctggcttcactgcttcctttgctacgctagcggatcctgcagtcttccggagcttcggcaaacaactgacgatatctttttcttcacaaatctgaccaactagtactaattgaaatttgaagaaggaagaaaagagtaaaccttttgcaaatagcattaggggaagaagaaaagaggaactttcgcaaatagttttatttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcggtaatatttacattattacaaaggcacttaaggcctgacaaacaaaaataaacagcagcggactagcggcctacggctccatcttcacaggcgctcaactggggtataagccaggactccacctaagacatcttctccaaagtttctcttactgaagggggaaaagattgagcaagaatgagtacaaccacagtactcagcaagccacaccggagatgcataattaatgcaagggaggtacaagggaataataatataggg

SEQ ID NO: 54540 - DNA, 17298 bp, Oryza sativa
  unsure (1)..(17298): unsure at all n locations
cgggatgaatccggacgaatccgaggaagagagagagggaaaagaggggaatcggaagagggaaacgcggggagtatttcccctctctttaatgcgcgtgggaacggcgggatgcggcgcaatccgcggcggcggcggcgttagggcacgggcgcggcggcgggcccggcgggagaaaggcgatgacaggtgggccccacccgtcagcgagagcggcgggcgggcccgcctgtcagcggcgcgcgcacgggggaggagccgatgggccggggggaaagagagagagagagggagggaatgggccgagccggcccaagaagggaggaggagggggaaaagacttctttttagggttttctttttataaaacctttttaactttgtttatttcttttcaattattatttgtgctctgaaaattccactaaaatttgagggctccttttagaccaaggagaatttaacaaaaattctccgggccatatttgaatttttcttgtacgtattttagtgtttgccaatttcttttcgaattttaattaattctattattccttttagaagatgatttttattttgggataaatttatcaggacgtgacacacaacaacgttgtggttggtgaagtagtaaaacttgcgaagtagcaacaatagagtttgccggtgccgaagataataaagatgaagtcgctccaccatgatgacaaagttgtattgctgtaatgaagtgaacacaagtcggcggcaacagaagcaaaccggtagtgaagacgcgcagttgtgaagataaaagcaccagtcggcggcggcataacacgagtcggcggcggaagacgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggtagcttgtgttgaagatactgatgcctattagtagtgacagcgatgtagccagccgtgaagaagatagcatcagttggcgtcataacaggccagccgtgcaggcggtgacaccagtcggcggcggatgaggcggccggtcggtgaagacgtagacgcccaacaacggcggcataataggccagccgtgcaggcggaaacaccagtcggcggcggcgaaggcaagccggccggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgccctacaacggcggcataatagaccagcgagcaggcggaaacaccagtcggcggcggacgaggcagccggtcggtgaagacgtagacgcccaacaacggcggcataaaggccagccgtgcaggcggaaacaccagtcggcggcggcgaaggcaagccggtcggtgtcacgtcctgataaattcattccaaaataaaattcattttctaaaaggaataatagaattaattaaaattcgaaaagaaattggcaaacactaaaatacgtataagaaaaattcgaatgtggcccggagaatttttgttaaattctccttggtctaaaaagagccctcaaactttacttgaattttcagagcaccggaaataattattaagcaacaaaaacaattaacaaagtttattaaaaagaaaaacctaaaaaaaaataatcctcttcctccttttcttttgggccaattttggcccaaagtctcccctctctctctttcggcccgcggccgaagtctccccctcctccctctctttccctcctctcccgggcctcccctccccctcccggcccagctccctcccctcccctctctctcccgggcctcctctccctcctctccgcctgggcctgcctcggcccagcagcccggcccagccgccccagcctcccgagccgccccccccctcacgcgcgccgcacgcgcgttgcacgcgcgcctggccgcgtgggtcccacccccgggtcatcttcttcctcccgctcggcctcctctctctcccgtgaaaaccctagttcgttcctccctcgaatccgcgcgatttaagcgttggattccaaaattaattgggggaaattaatcccctttcctccctctcccttttccccctaatctcccctttaatcgtgcactattttgaccggaacggctgcgtcattcatggccgccttccatggccgccgggcgccttttccgccgccgttccccgctcctcccgtggctggctccctccccacgcctataaaatggaatccccattcttcgttctatcgttttagccccttcccgagcctccccgtggtcgtaccacccctccccgccttctccttctctctcttcgacgccggccggcctccagccgcctctccctcctcgccggagcgtcgtccggtcgcgccgtcacctcctccagcgtcgccgccacctcctccaccccggcctgccctccgtttcccgcggagacccccggaggcgcgttcccgccgtcgcccttctttttcctccgcgccggccgcctccagccgcctctaactccctgcctgagcgccggtcaacgtcgccaccaccttcctcggctccacgacgccgctctcatccccggcatcacatcctcctcgcccgaacttcgccggaacaccggcgcccgcgccggcttctccttcctcctcggcggcatctcctccggctgcccctttcgccatgcccgtgcgtcagccggcgctgccgtcccctccctcggcacggtgacgtagccctccacctcgtccacccctcggtttcgcccggaagccgccgcacatcgccgcgaatctctccatccgcctcgccggagttgttcggccgcccgtccctcctcgcccgtgcaccggtcgaccacaccactaccacctccggcatcgcagcggcaaggttgtcctcggcatcgtttcccctccatccaaacccctccgcggtccatcatcgtcgtctccgatcgttctcgtcgtcgacgtcccgtcggtcgcccggctcatcgtctcgcggcgccgcctccgtcatcatcatcgctgcggcgtgttccacgccgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtcttcgtcctcgcctccgcgtcatcaagcctagtgccggccgcgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggttccctctccctcgctgccccgtcctcgtcctttcggtgtcgcccgtgcccgttgtgcggttgtcggccccggtacccgtgtaccggtgtcggtagtcgttcacgcgtgcgagtggtgaccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacctgttttataattgcaaagcctaattacaaaaatccgcaaatctccatataacagcattaaacctcggatgatcatatcttggtcatacgaactctgaatcgacccgttcaagtctcctaatgtttgttataacctaaagaaccctgtgctttctttttatgtattgttattgcttctttataggtttgtagctttgcttgtgtgtgtcgcgtcccaaatcgactctaaaattcatcctcaaaattgtgcaaaagaataagtaaaattcatgtgaaagcctccaacaattaaaatgtgcaaagataaaagtcaaatgaggcttgtaggatttttgtatatttcctaaaagcctaaaatgcttaaataaattttagtggaattttcagagcacaaataataagtgaaaagaaataaacaaagttaaaaaggttttataaaaagaaaatcctaaaagaagttctttttcccccccccttccctcttgggccggctcggcccattccctccctctctctctctctcccccggcccatcggctccccgcgcgcgcgcgcgccgctgacaggcgggcccgcccgccgctctctctgacgggtggggcccacctgtcatctccctgctggtgccgagccgacgcccgcccgtgccctagcgccgccgccgccgcggattccgccgcatcccgtcgtctccgcgcgcattaaagagaggggaatcactccccgtgattccctctcccgtttccccctcttttccctctctctctccctcggattcgttcgaatcgtgcccgcattcgtcgccggcgcaatcaatggcggccgaaatctccgcgacggattcctccctctccggccgctctttccttcccccggcgctatttaaacgttgcccgagctccgctctttcgtttccgccgctcgccgctcactctcgccgtcgaaatcgtgctcgcgccgtgctcctccctctccgccatcgccgccgagctccgttccgccgccgccgccgctccggacttcctccttactcggcgacacctccgtccgcttcgccgtgttgccgccgaccccgtccgccgctccgcttcgcccgccgaccgccggagcaccgtcgtcatcgtcatcccgagccgcgccgccgtcttcctccgctccgtccgccgtttccaccgccttcgccgtcttggggtgagccgtggaccgctccgttcgtttcccccttccctcctctctctcgggtgccgctccgccgcgccgttggtcgccggcggcgaccatcggggcgcgggcgcgccgctcccgtcgccagtgccggagaggccgccttcgggcgcgccctcgcggctgccaagtgggcccggccgtcagccgcccgcgcccgcggatgcggctgacgcgcgggacccacggcgccgaccgccgccagccgcgtgcgcccggtccaccgtggaccgagcggctgacgcgtgggccccacttcccgtggacccggtccgcgcgcccgccccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtgaagttatttagtgttaaagcctttttcttttccgttggtcgtgtagacgctgcagcttcggaagatccgctcttcgtggaagtcgaagccatcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttataattattaccttgttcaccctagatcaaacaaaaccccaactagtggacactctactcatgacaccactagtttaattctaggtagatgcttcgcaatttaattaggtaacattaggaggttttacaactttagactttgggaattctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcttaaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaaatgtggaatggttggcctgggttggcttgggacgagctgggacccagggtcgggttgccagttcggtccgaatcatcgtaggccttgggttaaggcaggttcgtgagggttcacggccttgattaataatattgtgtagttctaagatcgtgtttacaaaatagccctgagcaactaaatgtcttttaaatgctgtttactgcaaaacttaatccctatattattattcccttgtactcccttgcatttattctgcatttgtgggtgtgtcttgttgagtacggtggttgtactcagtcttgctcaatttttcccaagtccagaagaggagctccttgaagatgaaggctttggtgtctagctcgtgcctgccgtcaagtgcctgtggtcgtcgccctagtcttccgctgttttttttgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagccacccttgaccctaggacgagccgtagatcccaagccttagctatattttcaaaaataaaaatcctttgttatttgtgaaaacccgctattctctcttgtcttgctgcttcatttatcgtcaaaatctggcctttaaaatgttgtttctctttttgtttttgtttgtagatggccggcagcgttacccgtcgtggtttgcacatgactggcttcgtcttggagctgcgaggcatgtgcgtggtcttggggtatccacacggagtggattaccaggccaggccgctcccggagcaggagggtgaggatgcagagcctcacgctggttgggaggtcactgcagtgatcctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccaccctcgtcgcggaggagcccgcgactacgccaccttccgagacgccagctcggaggatgacgctaccgtcgtgcatctggcacgcatggtggaggcgtacgacgcggctcgtatcgacttccatcagatggtgcgccgtggcatggtggagaacaacatgaagatcctggagctgcgccaagagaatctgcagctcaagaaggacctcgacgcgttggaggcgcagctgcatcagctcaagatcgcccagggagaggacagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcgttagacgagcagttagtaggcttgcgcgtgtgtttttctctcgtttgtcttgttgagttgtgtggggcatggttatgccggtgtgtggcataactatgtcggagcctgtctttatttgtttgcctaagcaacttgaaccttaatgaaccaatttaatagcagtgataaatttaagaataatagtagtcgtgggtggttagttttaatcgtcagctctccttctctgtttgctggttctgtgtggggttttcagatggtgacgaccaggagaaatgttaacaccggtgaaggcaaccaacccgagggcagcaaccccaaccaccaaggcaatccacctccaccaccaccaccagacaccaacgccattctcacccaaatcctcgcccagcaagccaacatgatgaatgctttcctccaccacctccaaaatccgccacaacagaatgctccaccaccacccccacaacactctaaactcgccgagttcctccgcatccgcccacctaccttctccagctccaacaaccccgtggatgctttggattggttgcatgccgtggggaagaagctagacacggtgcagtgcagtgatgaggagaaagtcaccttcgccgcccatcagctgcaggggcccgcatctctatggtgggaccatttccaggccacgcagccagaagggcaacctattacttggactcgcttcaccgccgctttccggagaacccatgtgcccgctggagtcgtggctcttaagaaaagggaatttcgggagttgaagcaaggcaaccgctccgtgatggagtatttgcatgagttcaacaatctagcccgttatgccccggaggatgtgcgggaagatgaggagaagcaagagaagttcttggcaggaatggaccctgagctgtccgttcgtctagtctctggggactatcctgattttcaacgactggtggacaagagcatccgcttggaagccaagcacaaggagctggaatcgcacaagcgccgcttggcgaatttccgcaatcagcagggtgctaaccagagggtccgctacaccaatccctacccagggggatcctcctcgcagcagcagcagcagcagcagcaacctcgctccgcgcctcgacctcaattcgtggtgcgcgtcccacagcagcaacagcagcagaatcagcaagggactcgtgcgccacgtcctcctacgccaactgtgcagcctgttcaaggtcgcagggacgcttcaggtccgcagcgtctgtgcttcaactgcttcgagcccgggcactttgcggataaatgcccaaagccaaggcgtcagcaaggccaagcgcctccccgctccaacaacggtggcaaggatgtcattcggggtcgtgtgaatcacgtgacggccgaggacgtgctgacaactccagacgtcatcgttggtacgttcctcgttcattccatccctgctacaattttgttcgactctggagcttcccactcgtttatatctgtgccattcgtggggagtaatcagttgggggtagaaaggcttagaaaccctctgcttatcaccacccctggaggggttatgacagcaaagtattatagccctgccgttcctatagaaattcaggggattccttttccctcggatctgattctgctagacaccaagaatttggatgtgatccttgggatgaattggttggcccaattccaaggggtagtggattgcgcgaggcgcactgtcactctgtaccgagggccagaacaaccggttgttttctttgcacctccaacctctgtcagaagttcagaacttcatcagataggactgtcagaaatccccatagtcagagagttcggagacgtgtttccggaagagcggagcggcgcccgagagagcggagaagagaggaaagcgaaaggggcggtccacggctcaccccgggacgacgaggatggcggaaacgacgaccggagtggaggaaagcggcggcgcggttcgggacggcgaggacgacggtgctccggcggtcggcgggtgaaacggaggcgcggacgaggtcgacgacgacgcggcgaagccgaagggagcgatgccgaagcgggagacggtccggagcgacgacggcggctgaccggagctcggcggcgacggcggagagaaggtgcgacggtgcgggcttgattccgacggggagagcgagcggcgagcggcggaaacggaggagagaggcacggngaacaattatatagcgccgggggagagagagaggggccggagggggaggaatcggccgcggaaatctcggccgccatcaaagacgccggcgaagattgcgggagcgattccaaacggatccgagggagagagagagagaaaagagggggaaaagagagagggaatcacggggagtgattccccccactttaatgcgcgcggggacggcgggaggcggcggaaacggaggcggcggcggcgctagggcatgggcgggcggcgggagcggcgggaggaaggcgatgacaggtgggccccacccgtcagcgagggtggcgggcgggcccgcctgtcagcggcgcgcgcgcgggggagggccgatgggccgcgggggagaggagagagagggagggagagttgggccgagccggcccaagaagggaaaagggggggggaaagaagacttttagggtttttctttttataaaacctttttaactttgtttatttcttctcatttattatttgtgctctgaaaattccactaaaatttgagggctccttttagaccaaggagaatttaacaaaaattctccgggtcacatttgaatttttcttgtacgtatttttagtgtttgccaatttcttttcgaattttaattaattctattattccttttagagaatgatttttaattcgggatgaatttatcaggacgtgacaaatccaccccccttacaagaatctcgtccccgagattcgaggaggctagcaagaagataggttgggcggtcttctcttcttgtctgacttcttccgctctgtcttctataacaaacttgtctaactaaacttctccactctggactgcttggctcgatctcctgttgcagatggaatcttctcttcacccgacttgtccctggttgaacctttagctgacttcgactgggttgcggcacttgaagatggggcttcagttccagtactttgcgtagttcatatctttggagtcaaactcatacaagttacccacttcatgtcatgcgtcgagatcagctcgtcattactaagataccatgcttgtcatttgcttctaactcgccaccaactgcctcatactagctttcctggtctccgggtgatagctacttctgctatttgatgcaagggtcgataactttgcctttgaattatgtttcccaagagaaccaacttatcccacttgacatactttgacgtcttcccaattggctttactgctggatttgttgttgcctaatcattatcctgccaaatctgaggcttcgttgttagatgcgattttaatctgacctctgtagattatcttcgaacatatcacttggttcataactgggaatagctctcacgaacaagcaactcggattcactttctttacatttggttcacttcccactattctcttcatgttgtcatcatttagcattcaacatattcctttgcaccttccgccttgatgtgttctttctcgatggattgattgctaggaaagtgcgttgagcgatactagtgcaggtgcttttattctagtagcatctgatacaaagcccaaggttgaaccgagctttaggttccactgttcaggttttacttcttgacttcttggtcatgtcaccaaagtttccatccttgtccccatagaagtacttctacctgtggtcatctctcttactcgtgaattcacctactttaatgacagggcaactgttgtagggttgtttgctatcgggagtcttcctcgagtgacacaaatcatggttctcgttatcctttatcaatcacctttcgacctacttcttttcccagtaaccaaacatcttttccgatctcttccattaatcacctttcgacctttctcaaccaggtactcttcgctccgggtgttgaggatgcttctggggcaatgaggtgcttgggcgtgcggtctttcagagaaaccttgaagtagtgcgtcaaaagctagactgacgattgttgcctttgatccgaagagacacatctgaaactcttagtccgaacaaatgcctctttggttgatcacttgattttcttcgccatcaatcgctaggctatttgattcctaacagattatgggtttacggaaatgagaccctaggtctccctaatcaacaacaaaatgtgcaccactcacagcacttgcactcttaacatgggtccttcataagcttatcaaactcattcattatctcatgtttctctgttattacatgattgacggggaacaactataaaacaaaagtatttgaacactgatataagagtattatggttgcttctgactagcgctaggcttatcaggtactgcatttgctccagtgaccacttggcgattggcatgtctgcttccttaacaggtactacagtttgtaacagacaataactttcttacgctcgggttcttcatcttgtacttgatttctttggctgctgtgctggaacatccaaaggtacaatgccgatactggcctctgtcttgtcaactgatgactggggctgaaattgagcattgacaccttgtggtaatgcactcgctggagttggagctgttgcaacgcggtctataggactgcttcgggatgcatggatgacaattcgctgaggagcaagcttctgattgcaaggagttgcgtggactgacgtgctggcagctatgtttctcggtctggggcacttgtcggcgaaatgacccattccttgacaattgaagcaacagatatcttcccggacttggcattttcttttctattatcaggttggttattaactcgaggttcgaacatagttcctctgaaatgagaccctaggtctcctttgacagtaaacaattatacacataattccatatcagcatcttccaaaataaccctcctagaacttgcttttattacacaggtctcccttattacatgaatacaaggccctgccttaaacaaaaagggaaggtgcttaacatcggtacattgtatcctcaacaggaatcatccataaatatagcaagctcactgtttatagtcatgactatatttatttattacatgattgctgcaaactttctattacacaatgataagtagcgaactgaaaaccacaaacggggctgctcattttgattcaggagagatatagctggcattgtcctagtgactgcatccttgattggttctgtgatgatgtggtaggactgcgtattgctatcattcacaggagaagcttccttctgattgctgtttgaagcggatgacggttttctgcttggtatcgccctcttgaggttgattgccctttgcttggcctggagtaggtcggggagagacacaacttcttccatcgacgacaattctttgctgaggctgtcggtgcagagaatggttggtgctaaagatattattgctatgatttattgcagagttaggtggagcaggaggagcattggtgttgtggatgatatcgtcgatgttgctgttggagctgactagctgacgagacaatcgtagggtcgttcgttggatttctgcggtcttggtcaacaacacactgagttggcaatccttgggcacatggtttgtaccttcgcacacaaaacatgtgaccttgcgggtgggacactcccctggtggatggtcttcttcacaataagcgcagagtgtgagacacatgctagcaacgtgtccaatttctccacaacgggtgcatgcttttgattccatctcttcctcaccgagatgtcggggagactcatcttcatcatccgaggagacttgatctgacccttcactatcagatactctgccaccatggcttagaaggtgctgggtcaactgtcgtgcacctcggaaggtatttcctctttgacgtctaggaatagttatccctgcggaaggccattcggtgctgctaatagccatcttacgtacttcttcttcagttcgcatcggcgcttttctcttctgattcttactcttcttgcctttggcttgcttagtacgtgaccccacgtggtacgaaaggctaggaggaaagcaattcccgggattccatggattctctccattgggctctctactttgcacactaggctgcaagcttgtcttggtgtgaggaggctggtttagtgatgtctgccctgctaaaccaaaggaaggggcttctttggcatatacccatggacaattcagggcatagtgtccttgttctctacaatcgtgacaaaaggggacatcctcttctggcattggaagctcattgacctgggtggcaaatgctcgatcaaacacatactgattttggtcttgacttccaaccaatggtagctgtgaactaagcggcatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccagaactagagacaggaccttaaaggaactaactcttcttgctgatgtgttgtttgtttcacttattctgcaagttgattaagcaaacaacctagcatggttacatcacaacccaccgatgcaaaccacgcgctacacacacaagcaaggaaacacacgacaaacgaaacactagagggtggcttaggttctgcgacgggttctccaagatcttcactccttcacagctggcttcactgcttccttcgcttcactagcggatcctgcagccttctggagcttcggcagacaattgacgacatctttttcttcacaaatctgaccaactagtactaattgaaatttgaagaaggaagaaaagagtaaaccttttgcaaatagcattaggggaaggagaaaaagaggaactttcgcaaatagttttatttataaaatatgtccttaggttttatccacttggcttatcctacagtcgagatggctctgataccaccttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacttcttctccaaagcttctcttactgaagaggggaaagattgagcaagaatgagtacaaccacagtactcagcaagccacaccagagatgcataattaatgcaagggagtacaaggggataataatataggggttaagttttgcagtaaacagcatttaaaagtcacttagttgcccaaagccgttttataaagacgatcctagagctacacagtattattaatcaaggtcgtgaacccacacgaacttgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagttcccaacccatcctagccataaacaagagtaccgacccaaccccacctacggccggaacccccgggacaggcaggcaggattgagccccctagcagcaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgagcttaatccttatagtggccggggtgctacttcccataactggcatgcacccaaacctcaccgaaaacaggttttaggggttttgaaagaggaagagaggtgtatgtccaattccaccataaaccaacaattccatagtgtccaaatgatatgagaattcccaaagtctaacgttataaaaccacctaatgttgcctaattaatcagcgaagcatctacctaaatttatactagtggaaccacgaatagagtacccactagttggggttttgtttattctagggtgaacaaggtaataataacaatagcaataataaggtcataacaaaggtaattaggcatggctagataaaacagtgataacgcgggaatttaaataaagcgataatgcaataatttaaatcaacataattttataaactgggattcaatatgttcaaggatgatgtgacttgccttgctcgctttcccaaacgtcggcttcaacttcccgaagagcggatcttccgaagctgcagcgtctacacgaccaacggaaaagaaaagggcttttactctactaaactccacataacagcagaaacaaagcacaaaaatgggttcttgacttcttaagaaaaaattagagacttgaacggtccaattccgagttcaaatggtcaagatatgg

SEQ ID NO: 54541 - DNA, 797 bp, Oryza sativa
cctctcggtccacggtggaccgggtgcacgcggctgacgccgaccggcgccgtgggtcccacgcgtcagccgcaccgagggcgcgggcggctgacggccgggccccacatggcagccgcggggcgcgcccgaaggcggcctcgccggcacggccgacgggaggcggcgcgcccgcgccccgatggtcaccgccggcgaccaccggcacggcggagcggcgcccgagagagcggagaagagagggaagcgaaaggggcggtccacggctcaccccgggacgacgaggatggcggaaacgacgaccggagtggaggaaagcggcggcgcggttcgggacggcgaggacgacggtgctccggcggtcggcgggtgaaacggaggcgcggacgaggtcgacgacgacgcggcgaagccgaagggagcgatgccgaagcgggagacggtccggagcgacgacggcggctgaccggagctcggcggcgacggcggagagaaggtgcgacggtgcgggcttgattccgacggggagagcgagcggcgagcggcggaaacggaggagagaggcacggggaacaattatatagcgccgggggagagagagaggggccggagggggaggaatcggccgcggaaatctcggccgccatcaaagacgccggcgaagattgcgggagcgattccaaacggatccgagggagagagagagagaaaagagggggaaaagagagagggaatcacggggagtgattccccccactttaatgcgcgcggggacggcgggaggcggcggaaacgga

SEQ ID NO: 54542 - DNA, 7553 bp, Oryza sativa
tttcgtgattagtctcacacttctcaccatagtaaatgatgcttaaattggtaataatttgattagctcctggtttggaatggtacattcctggtttggagatagacctgtgcagccgggatggttgttcagaatggatgggcctatataacagggtatgttgtatagcgttggattaatattgcttaattaatacttaactgttttattaaattctcaaatgtttgctaaatgctgcttttgcaaatggatccctattacgccatcctttgttatcctgtgcacttgcatatttgctgcgtgacttgctgagtatgtgatatactcaccttgcaatcattcatcggaggaagagttctacaatgaggctgatgctgtggaggattaggtgtagccttggtcaagctgcctgtggagtggagccgtctgcgccgtttatttattttccgctgcttagatctttattgattgagaggaactatctacctctgtaatgacattttattcgcttattaattagagtaataattgtactctattatcaatttgttattgtgcctcggctgattcctggacgagggttcacacacatgtaagcgtttggaattttggatagaaattccgggcgtgacaaaatcgacgaggagctgcggcaatgctgcgacgattgcaaccttcggtctcctttggcgtgcagactgcttgacaaacctgtaatccccttcggtcacctccacagaaactgcacaaattggagatttgatattgagccgtagattttggtgtaggcttcaccgggctcaaccagaattcaccatggagttcgtcgttgtatctgaggagcttgagctcaatccgaacaacaaactgtggagattatggataccccatatctacacggcggttatatttagactggtaataggataccgaatatagatataatatctttatttgtatctcgggtttgtttcttaacttgtacgtcaaggaaataccctgaggtttagtcggttacgattgtattttatctgtattctcgtattctgttaggggtatgagttataccttataatacggactccttcctctatataaggaggggtccgagtccttcctgggacatcaattttctaggagatcttacattcaataatacactcggtggtttcatccccggacaggagtagggtattacttcttgaataagaaggcctgaacctgtataaatcctttgtctccaaacccatccacttttccagcttgatagccacccccttttagtattgccgaaatcttgtttcgacagttggcgcgccaggtaggggttgcgtcaagcttttcgccgatcagtgcaatgggttccgtctccggcatcgacgacctcgtcttcccacccgggcaggcgtttcggttcggcagcctcgagttcatcaccaatgacttcggcaagatctctctcctcgattcggaattggaccagtcgggagagagccggatctcggtcccgtttggagttcctaacgcggctgaaatatactccaagtccatctcaatcgagtcggcttcaaaccactcggacgagatcgcatcttctccaacgtcatcagatcgagatgatggggcttacccaccgattctaatgaagctccccgacgatttggcggccgtcttcaccaccatgacgtccccatcccgtaggcctaggcggaggtcggcttcaacaccgatatcgcatagctccagggaagttggcgtcatcttccagccactcggctcagtttcgacggaccagctggatggctactggagctctcccgccgtcgactcgcgtccgaccgagatcgtggactacaatgagttcggctttcacaacaacgacccagatctcgacgacttcgatgaaagcttagaagacaactacacccctctctatttcggcgtctttatggccgataacgagacggaggagcaacgccaagcccgggaaaccgaagcacgacgcgaggccgagcggcgccgactggaggaggaacgtgaagcacaagaacaagaacggctacggcgtgagcaacaggagcgtgagcgggccgcaaaggaggctgaagaccggcggctacgagccttggaagcagggcaccgagcgcgagatcttatcggccaacaagacgttgaggggacaccggttttccgcaccccacaacagaatgctgttgccgcgatcaccctcctcgacaccctcctcaagagaacgagctcaatcagtctgaccacgtcgtcaacatcttgaaccagaccaagaccatgattgcggcttcggtcccagttaactccggaagcgtccgcacgtcgagtggcagctgagtcccccatcttcgatctcacgactaccaccagccaagccttagcatcactggcgcaggatctaatcgcaggagcaggggtcacgacgagtgatctgtccactcgcctcccgaccatcatagggagcgccgagtggaatgacctcgttcgccacctcgtcgtcgccccgtcgatctttgcgacacgatcatacagcgccgggcagcccgaggccatcatcattcgctagatcgccacgacgacgacctagacggagttgccgctttcaccaacgacctgcgtcgagtggattggccagccggctttaagccgactggaatagagaagtatgacggttccaccaacccggaatcatggcttaccgtctacggtctcgcaatccgcgcagcaggaggagatagcaaggccttggcgaactatttaccagtggctttagcagattccgcccggtcctggctccatggattgccccgtggtacaatcggatcttgggccgaattacgcgaccacttcatcgccaacttccaaggcactttcgagcgccccggcacacaattcgatctttacaatgttattcagaagtccggagaatctcttcgagattacatccggcgattttctgaacaatgcaacaagatctctgacatcaccgacgatgttatcatcgccgcattcaccaaaggaattcgccacgaagaattggtcggcaagttcgggcgtaagcctcccaaaacagtcaaacttatgtttgaaaaagccaacgagtacgccaaggctgaagacgccgtcatcgcatcaaagcagtcgggctccagttggaagccaaaaaaggatacaccggctacgggagggggtggaagatcatcaaagcgttcgcgcgtcaacacgttcgacaagatcatgaactcccaatgcccgcatcatcctaagtccaaccacgcggccaaagattgtttcgtctacaagcagttcgcggaacaatacaccaagactacacggaagaactccgacgaaaaacaaagcacgtcgaagaagaaggacgatggcgaccccccggcaggtttctaagaccaccgcaaggagcttaaccacatcttcggcggccccttggcttatgaatctaaaagaaagcaaaagttgactgaacgggagattaacgctgttcagcccaacataccccaatatcttcgatggtcagagacagcaatcaagtttgaccgctcggatcatcccgaccgagtggtccacccggggcgataccccctggtactagacccagtggtccgtaatgtcaagcttcgcagaaccctcatcgacggtggcagtgcactaaatatcctcttcgccaaaaccctggatgatatgcagattcctcgctccgagttaagaccaagcaatgcgccttttcacggagtcatcccagggttatctgcaactccactcggccagatcacccttccggtcacctttggcactcgggaaaacttccgcacggagaatatctgcttcgaagtcgccgatttcgagacagcataccacgccatactcggacgtctggcgttagccaagttcatggccgtcccgcactacacttacatgatgatgaagatgcccggtccccgaggagtcctatccctacggagcgacatcaagcaagccgtcacatgcgataaggaaagttgcgagatggcccagactcgcgagatggcgtctgcccgagaagatatccgactggctgcgaccacggcaggcgaaggagaagtgcctgcgaccaaggtctcgaagagcggagaaagcgatgctaagactaaaaagattcccctagatccttctgatcccactaaaactgctgtaataggcgccgagttagattgtaaataggaaagcgcgctcgtcacctttcttcaaaataataaagatatctttgcgtggaaaccatctgatatgcctgatattcctagagaggtgattgagcactccttgcacgtcaaagaagacgctaaacctattaaacaacgactccgccgcttcgcacaagacaagaaggatgcgatcaaggaggtattaaccaagctgttagcagcaggcttcattaaagaagtcctttatcccgactggctggctaacccggtcctagttcggaagaaaactgggcaatgacgtatgtgtgtcgattataccgacctcaacaagtcttgccctaaagatccttttgggttgcctcgcattgaccaggtagtcgattcgaccgccggctgcgagctactcagttttttggattgctactcggggtatcatcagatccgactgaaggaatccgactgcttgaagacttcattcatcacgcccttcggggcctattgctacatcaccatgccattcggactaaaaaatgcaggagcaacttatcaacgcatgattcagagatgcttctcgacgcaaattggccgcaatgtcgaagcttacgtggatgatgtagttgtcaagactaagcagaaggatgatttaatctcggacctagaagaaaccttcgcaagcatccgcgctttcaggatgaaactaaaccctgaaaagtgcaccttcggagtaccgtcagggaagctgcttggttttatggtgtctcatagaggcatacaagccaacccggagaaagtcaacgctatcctcaacatgaaaccgccaagctcccagaaagacgtccagaagctgactggatgcatggcggcgctcagccgattcgtttcacgacttggcgagcgggggatgcccttcttcaagatattaaagaaaacagacaatttccagtggggacccgaagcacagaaggctttcgaagacttcaagaaactcctcaccgagccaccagtcttagcctcgccacacctacaggagccgttgctactatacgtatcagccacctcccaggttgtgagtacagtcttggtcgtcgaacgtgaggaagaagcccatgtccaaaaagtccagcgaccgatctactttgtcagcgaggtcctagccgactccaaaacgagatatcctcaggttcagaagctgttatacggtattctgattactaccaggaaattatcccactacttccacggtcactcggtaacggtggttacatcgtttccgctcggcgatatactgcacaaccgcgaagcaaacggacggattgctaaatgggatttggagttgatgtctttggacatatccttcaagccccgaacctcaatcaagtcccaagcattagccgacttcgtcgccgaatggaccgagtgccaggaggatattcccgcagaaaagatggagcactggaccatgcattttgacggatcaaaaaggctttcgggcactagagcgggagtggttctaatttccccaaccgaagaaagattaagttatgtgctttggatacatttttccacatcccacaacgtcgcagagtatgaggtgctcctccatggactacggatcgtgatttccctagggatcaagcgtctaatagttcgaggggattcacagctagtcgtcaaccaagttatgaaagagtggtcctgcattgacgacaacatgacagcatatcgacaagaggtacgcaaattggaagacaagttcgatggactcgagcttagtcacgttctccgacacaataacgaagccgccgatagacttgccaactttggatccaagcgcgaggtggccccctccgatgtattcgtcgaacacctttatgagccgaccgtacctcagaaagaaacaactcaagttgcggacactcaagacatagccatgattgaagccgactggagagagcccctcatacgatttttaacttctcaagaactccctcaagataaagatgaagccgagcggatttcaaggcgaagtaggctttatgttattcatgaaaccgagttatacaagaaaagaccttcaggaattctgcaacgctgcgtatctctagaggaagggagacaattgttgaaagacatacattctggaatatgcggaaaccatgccgccgcacgcaccattgtcggcaaagcttaccggcagggttttttctggcctactgcagtatccgacaccgacaaaattgtgcacacgtgcgaaggttgccaatttttcgccagacaaatccatctaccatctcaagagttccaaacaatcccactgtcttggccgtttgcggtttgggggctcgacatggttggcccgttcaaaaaggcagtcggcggttacacgcatctctttgtggccattgacaaattctccaagtggattgaagctaaacgggttgtcacaatcacagcagataaagctcgagatttcttcatcaacattgtgcataggtttggagtgcctaatcggattatcaccgataatggcacacaattcactcgcggagtttttaacgacttttgcgaagacttcggaattaaaatttgctatgcctcagtagcgcacccgatgagcaacggacaggtcgaacgagccaacggcatgatacttcaagggataaaagcgcgagtttttgaccggctaaaaccctatgctggaaaatgggtggaacagctgccatcagtactttggtctttgcgtactacacctagtcgggccacaggccagtcaccttttttccttgtctacggggcagaagcaatattgcctagtgaagttgaattcgaatctttgcgctttcacaattttcgcgaagaacgctacgaagaggaccgagtgaatgatctgcaccgattggaagaaatccgcgaagcagctttaattcagtcggcccgatatttacaagggttgcgacgctatcataatcgcaacgttcgatcacgagcttttctagtcggcgacctggttttgaggaaaatctgtcacgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatctccacaggcgctcaactggggtataagccaggactccacctaagacatcttctccaaagcttctcttactgaagaggggaaagattgagcaagaatgagtacaacc

SEQ ID NO: 54543 - DNA, 3074 bp, Oryza sativa
  unsure (1)..(3074): unsure at all n locations
caaggcctacgatgattcagaccgaagtgccaaccggaccctgggtcccagctcgtcccaagccaacccaggccaaccattccacatttttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagatatgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtatccaaatgatatgagaattcccaacgtctaaagttgtaaaaccacctaatattgcctaattaatcagcgaagcatctacctaaattcatactagtggaaccatgaatagagtacccactagttggggttttgtttatcctagggtgaacaaggtaataataacaatagcaataataatgccttaacaaaggtaaataggcatggctaaataaaacagtgataacgcgggaatttaaataaagcgataatgcattaatttaaataaaaataattttataaactgggattcaatatgctcaaggatgatgtgacttgccttgctcagagggaacggccttccgaaccttcggcgacgaccacgaaccacgcttcgggaacctccgggacgacgaaagttacgcgaagcacacaagcaaagctacaagcctacaaagaagcaataacaatacataaaaagaaagcacagggttctttaggttataacaaacattaggagacttgaacgggtcgattcggagttcgtatgaccaagatatgatcatccgaagtttaatgctgttatatggggatttgcggattattataattaagctttgccactataaaatatgtgtaagcgctagcctggaaaagacaggaaggctgcgccgtagacatgcagacctccactatttgctttatctnatnataaccccactctaaggaccgcggtagaccgggtacacagagacggtccacgggtcgatggaagtggaccccgtgtgtcaaccgaggcgagtggccgacaaacggactccactagacaccacacggcctgcacacgtggaaaccacgcggctaccgagcggcacactaacgcggacactacacggtcaccacccgcacgcgtgaacgactaccgacaccggtacacgggtaccggggccgacaaccgcacaacgagcacgggcgacaccgaaaggacgaggacggggcagcgagggagagggatccttaccaccacgcgacgaggcgtggggacgacaacgacgaacgggcgcggcggagacagctcggggacgacggaggcgaaccgcgagggaacgacttcggcggcgatccttggacgaaggcgagacgcggctggcacaaggcttgacgacgcggagctgaggacgaagacgaggacggggctgccgcggcttgcttgactgatgcggacgacggatgagaacggctcgacggagggacgaacgccacgacgaccaggaatgacgagaggacgacgacgacgacgaccggggccggcgaggaggcgacgagggcagccggcagcggctgcacgaatgcgaggatggcgtggaacacgccgcagcgatgacgatgacggaggcggcgccgcgagacgacgagccggcgaggatgaacgggcggccgaagggacgtcggcgacgatgaggatggagaggccagcacgggcgacggtgttccggcgaaacagaggagcagctggaggagaggacaacgcggcgacgtcgatcgggtccgcgacgtacaggagccggccggaggcggggaggtactggacgccgacgtggaggccactccggcgagcttcgagcgaggaggaggtgatgccggggatgagggcggcgtcgcggagccgagggaggtggtggcgacgtcggccggcgcacgggaaacgcgacagtggcggccggaggtggaacagtggcggcaacgccactgttttgccggcgaggacgcgtctccggtgctttcccgcgaaacggagggctgaccgagggagaggaggtggctgcgaggccgagggagaagacggcgcggccggacggcgctccggcgaggagggagaggcggctggaggcggccggcgcggaggaaagagaagggcgatggcgggaacgcgcctccggcggtcaccgtgcgaaacggagggcaggccggggtggaggaggtggcggcgacgctggaggaggcgacggcgcgaccggccggtgcacggtcgaggcggcacaggcggctggaggcggccggcggcgtgggagagagaggagggcggcggggagagggctagggaccacggggaggctcgggatggggttaaaacgatagaacggagtgaggggatcccattttatagggtgggggcgggagccgggctcgggagagggcagaacggccacgggaataacggccgacggccatggaaagcggccggacttggcgcgtccgttcccggggattgaaggcacaaatcaagggggaatttgggggcaattgaagaggattcaatggggattaaaaccccccaattaattttggaattggccaattgaatcaagcgg

SEQ ID NO: 54544 - DNA, 4366 bp, Oryza sativa
gacctgcaggcatgcaagcttgccccatgtgctgcacaatgggtggacctcatgttggagccatggacaaagtccagaacgttagaaagatatactcctatctagaaaaaaaaaacacttttgtactttcttttttcttggtcctagacgtatggatgatcttatgctgccgccatatctatataccttgcccatatgataggagcactcgagcaatatgcatgtctcacttaaataattagggcactaaactatgttgtttaacttaagaggggtcaataaacctatcataatattttaagggactctgtttggttagttgtctcactttatcacgccacacttgagttatgtttagatatgtgtttgcttcttatcacaattgagtcatgccactttttttagccttagaaaccacatgtcttttaaatttaaagccaaccatatcacaattgtgcctatctatttcttagccacacttttggcttaagttataatttgtcaaagtttagttctcaccaatcaccatccaagcttagtttggctccagttctttcagcttactggtagattactaataaatatattcaggctagtttaatctccattatgaaaagaacaccaaatctacttaggaccatgagttcctactattagaagaacaaatatgcatacctatctgttatagcactttgacttgtttgatcagagtaaaagggaaaatggacggtggtgatcatctgggtgtgtatcgagtattgtgccccactagcaagtgggcctccactacccctgtatatgtgaaaggagaaggcccactttctgtcatggaaagagaggggccacaagctgtcaaaacagagatggcccgttggccattggtggacagtgcctgacaaaacaagctgcaaagcctgtttgaactttgaagtgaggtgtgaggaaaaaaatgctgggtcccaaggcacagcaactgggatacgatacccagatgtgattgtgttgtctccaaaattcatagggacagtactccactccgttctaaaatatactccctccgtcctaaaaaaagacaaaccctggtttccgtgtccattatttgaccgtccgtcttatttgaaaaaaatatgaaaaaaattaaaaagacaagtcacgcataaaatattaatcatgttttatcatctaacaacaatgaaaatacgaattataaaaaatttcatataagacggacagtcaaagttggacacggaaacccagggtttgccttttttgggacggagggagtaaatgattttgagatgtgacatattctagtattatatctgtccagattcattataccaggatacgtcacattcacccaaaatcctttatattttagaaaggagagagtagcaacaatgcggcaaaagcaatatatgttaccatcctaatattatttcagagtacctcgacactataaaaagaaatgataaattaatattataaaatatccggtgattgcaatttcagaacaaaatttctaaatttttggtaatttgaccaccaacaggcaaacacaatatcgacagaaattatcggtttttccatattttttgaaatttgatcaaagtttattcaaaaatcaaaattttttaaattttcaaataattttggtcaaaagttaaagtagcaaaattctcgaaatttcggttgccacttaaattgtaaaattttggctgaaaatgaaagtgtaaaccctggatatatcatggtgtcactttctaggattagcaaaactcaagtgtgaatcatagtaggtacgatatagtataggtggattggcatattgtacagtactggcgttgagcttgaggagagggaggagagtagacagaattcccagctataccactgtcgagataaaagcatagatgaacagggagagagaggtaaagattgcctatggaaatgacaatgacaatgtcgccgagatccatggcaagacaaccctccgcgcgtggctatcatctctcacggcggttgaaggttgaggtgattgtccttggcgatctaaatgcctgttatctcccatagttctccttgcccgcccactcttgtcgtgccgctctcgcttggcttgttcaattcggtgctcggagatagcgtcctcacttgcaattgcttaccttacctatgaagctcgaggtcatcagtgtggaggagctcgagctggagcatgagatcgaggccatggcgactagatctagctaggaaaaaaaaactcaagctcaagaggcagtgcagtggctggtacaatgtggatgaatcatgaacccagttggaagcgccgagatcgacacacaagcttgcctggcaacgcttgatgcgggaaatagagagggtggcatagagttatttgctgatgaccagaacgatggagggagggaacctaatggggaattgatggtattttattttaatgcaataatgtgaaatgttagggctcaataatatagccatgtaccatgtacatgcttaatctatctgtgagagagctgcaaagatgatttaaacaaaattggagcgattggaattaattatagctacttcacattttaatcttataatttcaagataacagtcaacataggggttaaacaaaaacaaatactccatttcacttcatgttaggctttaattttgcggtcaccgacgaagattctttttcacgatgaaaatgccatcgttgagtgttaccaataggtgagaaacatggcatgatcatcgaggaaaaccaacttgttggtgggtcatggctcatgtgacagatgttgctagaagaagaggggctcctttcacattttagacaacaactttatgcgaacaatccgcataaatgtgatttatcaaaataaacagaaattgcaagattatttcacaggtgagatagtgtcctacaaagaattagagatatcttaaaatgcatcttataacctatatacatacaattaattgccccgaaaaaaataatttgtgaaactatataaaactattttggacaggtagagtaaactttactccactatacatacaaaacattgatttaggttgaaatatacgaatagacaacaaagagttttccaagaaactttttaagccacccgctacttgtataattcgaaatgatttcaacgttgggggtgtgtttcagaattttagagattagtgaactgagttgcatattggagtattaagagcccactaaattttggtatctggtgaataaaactttatagtcttgtaaaatgattttatttagttttgaacataatttgttttcggcaattaggcaaaatttgagttgcaaattttgtacataattctcttcccatgccacaataatcaatggtgcaatgcaacttaaatgccacgcctagcaaagtggtgtaactcaaaggttttgctttagaactaaggttttgcagagtaattttaagattatcaaaggaggtttaaataaaaaattggtacctcgcaaaaaataatgccacgcatgcctcacttctcttaggttttattgccatcacaacgaaatgaaaatttcacaattaataatttataaccacactggttcgcaatgaatttttagtatgcagagataatattttaccattaaaactattggttataaatagttcatagtgaaatgggcatatttatttacgagtgaaatacatgatcggttcttaaactttgataggccaaatgctacttaggtatgtgaaatcttgcagttcatacgtttagatatgtaatcatggcttaattatcaccttaggttcaaagtgtgtttgacagatctcatgaacccgacttggctgtccacgctttgcatttggccccctcaccgtgacaaaaataatgcatatagcccctcattcctaccgtggacatccaaatatccattcagggtggtcgtccctccttccactccaattcaccacttcgacaatatttttgtcacactgaatttcaaaaggggttgaatgtaaaattttggcccatatggacagccacgtcggtgtccgatcgagattggtgaaatgtgacttggacttgttatgataaattaaactactattataggtctaaatgtgtgatatacaacatcacatatctaagtgatatatgatccaagtttaaataccaaccatgtatttcaccctttatttatttcaaacaatttactaattaaaaagtcaaacagtgtttcaacctaggtcacatacctattcaaaaagctgaaaacacgacccgaaacaatgtccagtctgaagttcaagacttttcaaggttttgtttcataaaagaccacagttgtaaa

SEQ ID NO: 54545 - DNA, 22334 bp, Oryza sativa
ctaagctaattataatcgccccactaatcacccctactaatcaaaaccaagccttaatttatttatgtaatgactagctgctgcttacgtaggcgtaattaagcttagcactaatgacacgattaagccgttggtggcgatcgaatggtggcgcgcatgtgccgcccaggaggcacgggagctagcatgcaccttcacccacgacgacggcggcgagtcggcgacgccgctacatgcagaaggggatcatgtggtagggcagcgccggggacaccagcggcgcgtgcccgccgccgccgctgcagttgctctccggcgaggacgacgtggccgacgccgaggagaaggagttgttgtcggcgtcggcggccttggtcgggttgaacggcgggatgtcggccggcgcgggcggcggcgggtggcgccaccgggggagcgggccggcgaggaggagtgtctggagcagcggccccgccgacacaacggcctccactagccggcccttctccggcagccgccgcgccagcgccatttccagtccggcttagtcgcggggggtttccggaagcgccgccagctcgtccgccacggccgggacggcgacgacgtgcgcggcggggaggctgctgacctgcggcgtcggcgtcggcggcgcggcgggctggctctggtggtgcagcaggagcaggagggagtggcagtgccgccggagctcgtcgcgctcggcggcggcggacgcgacgagcgcggcgaggcgcgccgcctcggactccatccgccggagctccgcctggtgcgccgcgcgcgccgcgtccagctcggccagcgcccggagcagcgcctgccggagctccaacgccgtggagaaggccacctggtcgccggcgccggcgacgtggtcgaacggcgcgagctgtgggtcccacgtgtaagcgagggtgggctgctggaggtggtgaagaagagggtggccttccatggtcgatcttgttgggtttttggcctttttttgtggttgggtttagaagaaagatggaggaaattaaagagattgatgtgttgttgatatgatatgagtgtgaactgtgtgagtgtgtgtggatcttggttgtgttgtgtggtagggtatatatagaggatctttttctgggtttcttattgatttctttcttggatgctggtggttttattggttcatgttgtgattagaacaaagtgttgtggggtatgtgtaattatcagatatttttgtggtgctctcacgtttcatacaccataaataagtaaacaaattgttatttggaaatatggttgttcattaggcaagtactagtgaaataatctcacatgctatattataaattttggttagaatataaaaataattttggtgaaaaatattatctattactagtaagtttcagatgtagtataatccaaggtcaaatattggagaatatcacaaattattttccaatttgatattttaatgtatatattcagacaaattaaagaaaacatctttgttttttacttacataatgaaataatcttgaattaagtctggacatatgaatccatttacttggtgtctatttagatattagattcaaatcacaatctttttgccaaaaaaaaatcaaaatacaaccagcaagaaaatcctatttatgacagatagttttggaagggtaattactttgtccattggttctttccttttcatgcaacaatttattggttggcaaggacacaatatctttttagcaaacaacggagggcggaagagtatcgaagtagttgggccacccttcaatagtatttgttatgatgttttttaaatagctaaactgtatgttttatgcaagaaaatatactgttttaaaaatttaaagaaacttatttttaaagtttttaataacaaatactcgattagttatatgctaatcatgcttattgttttacgtgggactaatcagcacggccataactcaaagtggaaattctttgggtgaaatagaagagacgacattggtcaggttttgtgaagggacgagaaaagcggctccaattttcagtccctcgaagttggactattcattttaataatcaataggccacataatcccatatatttttcgtagacactttacgccatttcctcaccatgtatacttttatatattttttagtaatttttgctgctgatacacaaaattgcaaagtgggtataatttaatacacgaccttataaaatgttcattcttgtacataaacgtacttgtgttatccatgcgaatcaagaccaacacgatatatcataaacttgtgttatccatacgaatcaaggaccaacacagtatttcatagctaattttgcagggttctaactagaatgttacataggaacatacgtgaggaggatggcacgcagtggcggagacaaatttctcaagcctagggctcaattaattagttttcatatgcttgtgtttcctcttctaattttttaatttttggagtgttagttcaatggagatttagggctaggagtagggctctagctcatagctaccctactcatagttccacccccgatggcatgtatatgcctacatgccatcctcctcaggtatgtgcgtatgtaacattctagctagttagaacctaatgtatatgtatatgcctacgtgccatcctcctcatgtatgtgcctacataacattctagtcagacccctacaaaattagccatgatatatcgtttttatcttgatccggcaaccgcgagcttctctcccaagccgcatgtctctcctcctcaagtcgtgccggatctggtcacatgtccaaatggtggatctctagatctagtgatgactgatgtggccacaatggttacgatgatggcgctagactcttgaattttgtggagttttgttagggatcttgtatttttggaattctttttggaacttctttttttttggcaaaaaatcttttgaagttgataatcaaaacatactccattttcccaaagacattgtttttgaaagtcaaaaacatatgaagaaagaggttacaaaactattatgcccactaaatgcagagaaaaaataatgagggggagaagaagagaggaagggagtaataatgtttggatagctaaaatgagaagaaaataatgaagtggtattaagaggtccagtggaccccatagctagacaagtctgaaagattaaaaaaaaacactctttttggacgaagggagaacctgcctatgagccgcttgcgaaaatcaattttcgcatgccgtagtacgcccgtacatgaaaatcatgaattttcacatacgcatgcatccaggaaggtggctccaccacctgtgaaaaatgagttttagctgtacgtgagggaagttttagctgtatgtgaaaattgtttcggtagtagttaattccatttttcaaggaggtttaccatctgactttggtgatatgtgtcttagtttacttgttttgatatcactaatactactggttgggaaccccttatatttgccaatttcctacatggtaccaattttgatgaacttttacccattattataggtgctagttatatggatagaacgacacctatgatattcgaaaataataaaaaaacaattgtattataggttggatctaattcctaaccccatttgcaatttccccatccacattacagatcaacaagaacataagagcatatgtacacatcaacaagaaagaaggcacatcacagaccaagtagacaagaataagtacattacagataagaacaattcaccgatatatgttccaccatgtccaaccattacatgttcaatattttggactcacggtccaaatggattagccaccgccatcatcgattcctcgagccaccgccgctgctatcatctccttctaggccttgagcacgtgcgcgtttaggtcagatgtggctagatctagtgagccccgacttagaagagcctagatcgtgtggccccccaacctccatgcagccagatccgacggttgaatctgatgcttctgggaatggcatggaggagagggcgtcaccaaggagaggaggaggaggatgaggcaaacggagaggtaggaggaggggcgacgaacggggagggaggaggaggcaaggcgtgggcggcggacggagtgacggcaaagttgtgtgagagagagaggaggtgggagagagagagatagagatagagatagagatagagaggaggaggaggagaggataagacacacttctctcctcactaaaaatatattgctcccaacctactggctcggctctactagatttttatggtaccagtacctataatatattctaagtgtcggttttttaattaatcaatacatatagtattggtatcggtttttttctctagaacaggcatctatagtgctcaaaagtgttgattctatatttttcatcgcagggaggtgagaaacggttcataggtaccggttttaaataaaccggtacctatgagtcactagtgttggttgtcttcaaaaatcggtatgcactttccctttttcatatgagccatctaaaatatcatagttgtgaaaatcaatatattttgatgttctggaataaatgatttttaaaaaataaaatacatatttgcgccaacctgtttgaagtaaacaaacatgagttcgcattgccttctgaggacggtatagttaatatatactacttgcttgtgttgctcttctttccttagatcatagttaattaacaacgatagcaacttgtttttataatacctgaatgttgctcgtaatcgtcgatcgtacagcggaaagtttgacaaaatgaacttgtataatgtcataggtgtacggtgcttactcatatataagaactaagatatgaatgatgaactcatcatcagctatatatttactatataatgtatagtacgtaaaagtctttgttcaagtatactgtaaattgtccacccggtttaagcttttgatttgaactgattggttcatttgaatctatataataccagaactagtggagcagagtataactgtttgtttacacgataaaaacatataacccccttttttttaacctaaaggactgttaattacaagtgaattgctggtccttctgattaaacttttgtgtttgcatataactcaatatggacttttgcacatggttgctgcttgtcaccctcagacactgatctcatctatgtggtgatgaccagtcatctgccgaagcttctcatgataattaacaactaaaagtatgcaaatgaactcactctgacctgtcacttagcttgagccatccaaatcacaagtgaagtcaacaacggaatagagacctgttgcaccagaaacatctaattcagcatgtttcatatttactgaagacgtatgaaaaacggtagactgcagtataatccttttatatatcctttgagagcgtttaattatctatatgtgcaaatttgcttcagttagtttaattagttcaacgagcgtaagcttgatgttacttgataattaaccaatacaccatttggcatgctatttgagttgttgattaagctcatgaggcttgaaactaggttcaaaaccaatatgcttgtttgtgacttgtgagcacacacatgatacatatatatgtgcaaattactaaagagaacagagttgtccaatttactgtgatttgtatgacaacattgctttcatttcaccttttctttttttcctttttgtgcatgagtcctttgttttgcccaacaagggaatccaagataggaactaccataccatcactcaaagccctagccaataatgcatcttggtcctaggttctgccttctgtccctatctctccctaatcatcatcactgcatggcaagtcatctttcattcttgcccaactttagcttgcataaataaatatatactgtatctacaaaaaaaaatagttgtttttacctgtttggtatctagggaaggcagagctttgcaagtggctcaaatgtgaactttgaaacctgtagcaactagaaaggggctatccctgggcatgtttccattgattacatcctcatatcattttcacaggtaccagcttgacagagaaaaagatatgccaaactaaagctgcattcatgtcaccctgcatagtagtatagtacaggccacttacacacacagatattatacagtctctgactagaagaatgtccttacctgcatgtgtagttgtgagttggtagcttgcaagggtacttgtcatgctgagcttcagatgtccattggcacatgcatgttgacactaaagtccccttgtctaacatggacatggtcagattatgtagatcctagagcttcaaccttggaaaaatggtggtggttttgttgacaatatagcgcatccattcggtttatttcacgctttcgtagctgtttatgttgtgcttatttagcagggcaaagaaaatttctgctagggccctggactcatgtgagactcgttcagaactcagttgatcaggtcagcatgatcatgttgtgcacttgacaatgaccataatctaacagcttacaaacctatgactcatcactgacatgtggtcatcatcagtaaattatttcgttgttaatagagattatttgtgctgtagttaagcttctgttctgaatcagataaagatagaggcagtagcagaaatagcatgcttaaagattgcaggttgtgtgctcacactggaattcctacgacatgagacagcaaagcaccattgcaaatcctgcaaaattcatgcaagaatccaaaacatttgttaggtacaactgacctaaaagaggctggaaggtgtgcaccaccatcatccatccatacagcatttttccatctggacagctgtttcaacatgtattctagcattgctatacatctagcagcagtgtgcttgtgtactcccattagagaatcatgaaaggactagtttttgtaatttagtgttcatgaagcatataagaacatccatgctaattagcttgtacctccactaacattataatcaccaaaatgcataaaccatcttcctcagatcatttaccatgtgtttgttggattatcttgatgattcaactgcaatcaagctaaaaaatgcaagcatctttactgtgtttctcaaaaaaaaaaaatgcaagcatattccactcctatactaggtgcaatagctagccagctttaatattagaggagtccagttaataatcaagctgctatatatgaacatgtgtaaaagtatttatacgtggcatatctttgtgctgcatgcaattgcaagcttactgatgaactcttcacaatcttttgtttctaatcacccagctcatcccagcaggatatgatcgatgcagctccctcttaatttaatttctcacgtcttgttcatcaggaaaaagaaaaaggagagtgcaagaaaagtgaggcctccttctgcatgatccaagtacgtattccccatctcaccagtatgatggataatgacaccttggatccccattattacttggaataaattagggttcttcctaccatgatgtacatgcattctagaggtagaccccttgacttttgagaggattagtgcgtgttgatgtgattaatttgtgccaaatttagaacagtaggaggatccaacttgagtaatataaaggccgttgtagcaaaataattagagggtcgatctcgagctaaatttaaaattatcagagtattggaccaaagctgcaggaatgctgcacctgagcccaatcaataatgcatcatgaagataaaaaatcaaccaagatgcatgaaatgttaggtttaagaaagaatcgtattattacatatataaataaattaatggtaagggagtaggttcagttgtcaccactgatagggttgctttagaaaaaaaaatactagaggataaattaattgctgcaagcatacatataattgtttgtgagagaaatggacgtagaaaggtggataaactgtttaattagcactagagctaggagaaaaaattgtcagaaagaagagcacacaaatcattagatctgttatttttgttttaagtgaatatggacgcacataaatcacacccacactagcagccagctattagcctgtccatgtcattttagtctgatatgtaagagacagaaattggaaagagactgaagtgggcacttaatcaagcatcgacgtgcatatgtgcctaggcttcttctggatgatgaactagtagtagtaagacagcaggggttcaccaaattagatctccgatcagtgtatcatcaaataagattgttggaccatgatgaacataaaactgccttttaaactcaccagggtcattattgtagatcgtaaagggcctttcccaccccaaaagctagccattgaggtgaggggctctcccacatgtaacttaggtccttagattctttgtccttctacaactaatgtgggactattcaacaattttgaattcaaggtgatgccttttgggctaaagaatgccgtagctatatacattcgagggttaataaatatcatttttgctcacttgatcaggaattgtgtgctagtctctgtggatgatattttgttctatagcaagaacttggaggagcatctgagccatctaagggaagtgttcaaaatagtagcacatcatcagctttttgtcaaagaaagtaaatggtcctttgctcagcagcatcggcatgtgattggaacaacagggggtggcccctgatcctaacaaggttctagcggtaaaggattggccgatgactagaaatctcaggcaacttgtaaggtattatagaaagttcattaaaaaaacttcatgtaaattaaaaaagttcaacaaaaactcatcgttttgcttatgcaacactactcggttggtccattgaaatcgaaaacaatccataagcagcaacagctgcaggaataagtccactttaactccttcaatatagctcaaatctaactcgtaaccctaaaccacaataccagatattttgacctctcaactattaaaaccggtgtaatttgattctctaagcggttttagatctaagcggttttagagtacggttttgctgacatggggctttgacccagttcaacaggctgactcagcatgtgggacccacatcttaaaaaaagaagtcaaattacatcgattttaatagttggggggtctaaatatccagtattgcgattcagggatatacatattaaagatgagctatattttgagggagccaaagtggacttattccacagcagcacaagggccaactcatgggccgttttttctggcccttacactctgtgctgcctctgcctgtaccaatcctctttttgattttcttttaacgagttgtctttttcgacgcacagtcgtattaatacaccaactgaaatacgagtacaatttctgtacaatacatacgtacatacatacacgtattctttagaagtacatacatatacgaagcctttcagtttcaggtgggacccaccccgcacaccacgacaccgtctcgatccccccctcctctcctcctctcgccggcgacccctccgccgcttccttcgccggaatcgatcgatcccatcctgcccaagccgccgccgatttcacctcaccttggtcgtaagtactactatctctgatccggtcccgatccagatcggaattcttccgaccccctaccctaatcgcacgcgatttcttgatttcttcctctctgatcccaagctaggaggtcgccatggcggggaggcccagcatcccgaccaacagctctgcgctcatcgccatcatcgccgacgaggtagttacagccaccccccacctcctcccctttccgccttgctctttgcctttgcttggcttggctgattgtgccgcctctaccgctgctcttttgctacatctagtagttaccggtgttctaacatgctcttgttgattgaggataaatacccaattatgtcataagcctactgatgattcagcgaattgtgttctaacatgctcttgttatttgcttttattggttcgtttttatctttccgcgatgtttgctttcttatttgaactacactcatgtggagtgctagtttgtaataatgggctgtagctccacttgagcaaaggccgggatgttatattccattatctaaaaaaatgctcttgttgattcaggatacatacccaattttgttaagtctactgatgatccagcgaattgtagtaatgcctgagtccggctcagtgtgttttcttttacctgtgtacctgactgtcatttttcatccatcccacccataccaatataaaataaaagagagtataatacctccactttatcaaatccaatcaaatattcatctcttgatttactcccaatgtatccactacttttacaaactctgatgtaatggttgcttaaaaatgaacttattttgggacaaacgggggagagacaaaaatgaccttatcatgggatggaaggagtaattaggtagctacaaaccagtgccttctgttacatgtttgtgatgaggaaaactgttttcaacatcagatttgcgcataatcattctgtggtttctaaactctttgccaaatatgaatttacggcttgtcaaattgctcatgattaataattttggtggcatttgctagcttattgaatttgagtaacatgtaaggtttcaagcaggaaacaaatataaaaatgtaatgctattacatactgtttggtaagagcttgctgatgccaaatacgaggaatgaaagttagctgatgctcaagaaaaattacatcaaggacccttcgcaatttcattctcgcttgcttaaaatatactcctgatgggttaagtcaaggtagcaaacagtagtagctaaccagcataatttgatgagaactggatgactaaactgaatcctcttaattaacaacgggcataaaacctcatactatctttatcaatataaaacatatgtaactctctctaaatgtttccaggttccccagtaatttagccatgattggagtatctgacaggagtgttttgtttcctgccctgtgtttgcaggacacggtgactgggtttttgttggctggagttggcaatgttgatctgaggaaaaagacaaattatcttattgttgataacagtaataactttcacttgctaatatgcttaatttctctatcaatatcttgctgtttgttttgtcctgatttctgcctcttacaatagggacattgcatgatatcctgttgatcatctcatgtgcacaagtcatattatctttacccatttacatgttccattacctgactgccaaatcctttcttctaacttgatagctacaaatcagtgccttcttcatgataagacctaatttgttgagttctgccaatttttttactataatgctgcatatgctcattgaatcccaaggcttattttggtagggggtgttcaatcttcttgaatggttgtattaatcttgataatttcctgcttaatagagttattgacatgttccgtatttccacttggtagctggcatattatttgaaataaaataagaaagtggatctcacccagtcacatgtcagagacaattaatttcttcattattgtaggacgtgaatttcatccctgagcttatggtttcatctttatgttacccttatgcattttattatgttagcagacttcctaatgctttagtagtccatagacttcacacggctgaattttactctgacatgttacagaaacaacagtcaaacaaattgaagatgcgtttaaggagttcactacaagggaggacattgcaattgtactcatcagtcaatatgtaagtagcttgattgtatacatcaggttatttctttgtttatataatgaagtgataactgatcagcttgtcactaagtatcctggcctcagaaagtcacaatgattggaaacaaaactattcaattctaaattaagtcagcttgtcactaagtttcctggcctcagaaagttagtgactggaaacaaaactgtttcaattctaaactatttccgcttgtcactaagtctcctggccatagtcagccttgtttctttggagcgctctcctgagttttcaaaatggcatgtcccaggagcatatgatcaatgaatttcaatacaaaaacccatcaaaatgatgtgatttttttttaattcttatgtgatttatctaccaatttactggcctaaggttcctgcagctttgcattatacatttataatagctgaaatcgttaacaaattatgtgcagtctaaaatggttcttcgtgttcgacacaatcacacaacctgatggttttctatttttcatttggcaggttgcaaacatgattagatttcttgtggatagctacaacagaccggttcctgctatattggagattccatcgaaggatcatccttatgacccagcacacgattctgtcctttctcgcgtgaagtacctattttccgctgaatcagtggcgtcagataggcgatgagaactggttatgtccatgcaacatgggagagctactcggagcatttaccctttgaaattgttattcattttgtgcctattgtaaacactattttgtttcaataatgagatgtcgaccaaccagttgaattacagcaaaaataaagacgacgttcatgttgtgttttcatgtttgtgaatctgttcggtgcttctgtgattagtttggtgggctctgttttcaagtttgggttgacattaccacggtaaatataatcctgagtgacaaactgtaatcaattttggcaatcgcttgcaatcagataaatgtgcataatctagcataatctgaaggcctccataaagaaaagaggtgtttcaatttatgagttttgttaccacaagtccaagtgtttttcagatgatgagaagtccctggaggtgcaattgatgcaagtaaaacgtacagaaaaccaaagattcatgccaagtaaaaatataagaaaaaaaatcatccaatgataagaaaaaaaaaaccaaagattctcacaactcgatatgatccatgacaagccggatgacagtaaggaaagtctccgctacgaccgactagtgttataaaaacaagttaataaaaattgcacgtcgcaaactggagtcaacgattatgcaatttttcattaattatggttggaggtttaaaaatagaatttaataagtttgttttattttttttctattggtgttagtagtggtgtgtgcctttatcgatttggatgcgttttttatgacttgtttgaggtgcgattgtgtttggatcaaattttgtaataatggtcgtacctctgtgagcaaaggctatgattctattacattatctaaaaaaactatgattgaaaaactacttttaagtactattctcttcattccttaattttttgaaaaattaaaatttaaacattttgactaactgttaaacagaaagaaataatattttgacaaactgttaaacagaaagaaaatatgtgttgtgaaagggcatgtagcctagtggttacaagagactcagtagcacttgatgttttggttcgactccccatgggagtaaattttttaggatttaatggcgttgagatttcagtgataggcaacgtaccccgtatattagttactcttccgcatatttatatatcatcaaactagaagttaattttttcctaatataatgtcatttatattacatcctctttccataattttttataaaatcaaactagaagtgagaagctgaaaaatctattttttttaattctcatcagctgagcatccatcatttgtttatcagaatctcgagcttcccaaacaaaacgtagatgcacacaaattaattgctcatgcaacaatgttctcaacctggcttagcagtggatcgagcgttattacatattgtgtaatggatcgaatcgccccggccgatcacgctgtcaattgttcagttgtcacgttgatctagcgctggcctcgctctcctcgtggcaagttggcttcagtgcttgcgccttgggccatgaccaaacaaacattaaaaagaaccaatcctacttcttctattttaaaataaaccaatcccatcctagaatatgacatatcataatacaataaatatccatattcatggtactagtacgaggttgacttattttaggatggagagagtacgtacatacgtccgatatttggtacggcattggacactacaatccgtcgtactctgaagtctgaaccctgaaacggattgctgatcgagctgtagaggcactagagctggcaactaacccaatttggggtctatttggagagtttctagccgctgtagtttttttcagaatcaaaagttgtcccaaacggctcagattgtcatatagattatgagaatatgtagctatagaattcaaaaaataaattagaagctaaaagcttgaatttagaaacatcttctttaaattcttaattagaagctggcaaccaactagcagattcttatattattaagcttcctaaatagagccttggtttccattcgtggtccccattgtaacagtttgacatactcgaatgctcaactcatggccagcacaaggtcaaacctccgaagaacatacctctcgagtactatcacacatgcatatggtctggactagggacgaccataccagcattattgtttcaggacagatggagtacttcgtgtaatcccatgataccatccttattgtttcaggaggaactgacttgattgtttgctgcagtatccgtggtaagttaatgcacaataatgtcagctactgtggtccgagaacggatctacagccactgcttaagttataatcacattgccaactgtcctagtttaatactactaccttcgtttttttaaatagatgacattgttgattttttattatatgtttgacataattttatcactgatttgcaaatttttttaataagacaaatagtcgttcaaaattcaacggtgttatctattaaaaaacggagggactatcatggctcagttggagaggcgggagccggagctagcaattacccgaagcatgctattacctaggtaatagcggcatccaggggcgcgccataccgtcgcataaatgggcgcagcccccgcccctgtctcccttgattttacccatggctcaagctgcttggttgctttcctgacaacatctaccaagaacacatgtctttatggccacactctgcctatggctcgaacaacaactggagtattgctttaatagtattgtacaccttgtaccgtcaacattaatttttgtctagcactttggataacaaatataagctttgttcataatgcaaaccacatattatatgtagattttgtggtctattaactttagtgcttagccatctatgatcaccttaatgcagaaaattaaggtaactaatcgtaatttgacgccatggatatcatagtggaagcagtcatagcagtcgagctaacgaaatcactggcttgatcccgaagggttcgttggtgatgagcagcggggtagcgatagccttctggtcaccacttacactgccctagcatagccgcatgttttccctccaatacctcagtgatcgagtagagttagggttttcggggagaatgaatcgtgaaccagtatcccgtttcatggctggactcccctttttatctagcgccgtgggagatcgtgggcaatccaaataaaaggaagttattggcgcttccgatcattgcatgttttaatgaaggaaataatcgtgattcaatcgggttaatcacgcacgtcaacgggtgggactggttatgcgtgactctatctggtttccttgccgagagataaaaaatccccaacattataaaaataaacaaattctaattcgatattatttaatatataatttgattcttattttaacacttactattgggcatcttgtatctagggtggaggccactagtggtcgtcatcactaccgcgaaggttgattccatacccctgattgataaattgggagggagaatgccgtgctggaaacgatgtttctttagttcaacgggatgaaacactctagttaagtctgtacatttggcaatgcccatttaccatttaacagttttgcatactttgaaacaggtattcaaagaatagactggtttaggagagcgttcctgtaggaaggggatgaaccagacaatgtgagagagggtagcagtcgagtaaattggtaaacagtatgccatcctaaatgtttggggtgtttgggtattcttgaatcttgatctctagaaatttgcaagagccgttaggattcgatggctctagttcagctagaaagatgacattctgccttgggtcggcctggacttatcttgcactatggtggacaaacaactcacaactctttcaacatgcccttgaaattacccttggtgatggcgccaaaactagtttttggaatgacaattggttgaacaatacatgcccgaagacaccacccatttcaaaacttacaaaaaaaaggaaagaacaggagtgttcacaatgaactttcctaaaacaactggatcttttccttctgacaaatttcctcaattgaagaactagttcatctcggatatttgatgcaaggcatccagttgtcgacgaccatccaaaatgacataacctggaaattcaatgttcctgttgcttattcctcatcaagtgcctacaatctccattttttgggttcaatgccaaataaatctttcattcatatttgaaagaccaactgaaccaaagcatcttttttgattttctaaccctgcataaaaatctctcatagtcgaaaacctcattggccatgtaattggacccgcagcctctacacccaatccttcgaagctttgaaaatggattttcaatcagacttggattttcaaagcttcatgtgaagtcatgaatcctctacacagagcctcctaatcgggttttcatatatgtctctgctatcactatatctcattttatcttttcattgaacatgtgtatgtctaaatataaatcttctcagatatgtgtttacgtaatcaacagaattagccatatagtgtcattttggccttggtccacacgcacaggacaagttcatgcactaaaacgagcattttataaattcgtgcactagattgctcccacctgacaagttcgtataccgctgatacaatttactttatttctttttcttcttttgtttctttattctagtatgctaaacctttttctccttgctaatatattccgacagagctcttgccaccattccacatcaaaaataaaattacagtattgcttgcttttctctggttgatgactcactacttctagtttatagtttatatagtgtacaatctgctctatctcatcgaagggtatcatattaattgtttgtatggtactggattgcttgtataggtggttcctatttactctgtgttcgatcgaattggtccagttgaactctcttatctaacatccaatgtaaattttttaattataggaaacacgtattaacctctctaggcgatatctatgatcctcaagggaccatttcactatatacattgttgtgtgattagcattgggttcaaagatatctttcaggttttttccgtaatgaaaatagtttagatatctggcttctgccgctaacacgtagctattgagttctattcctgaaataaaaggagatagggtgatgggacaaaccccaactcccctactaaaatgataaccaacttaatatctgcaaaaaatattatatacggaatagattctagtaaacggtcactcataatgggataaaagaccatggaaaccgcgatgtcttcaattagtaaaatataaatatgggcttactacgtatgcaatatagttatgttttcaaataggcttatattatagaaatattattttgttatttccctccttaacatgcttgtttccgtgcggatccatagtatataacaatttgcgttggtcatctttggacttcattattcaatgagcgcttccacatgcaaatatacccatggatctgacctagagaaacacagacgatccagttgacaaaaatttttcttttgaaacacaatacaacattgtcaactcatataatcacgtgtgcactaatccctttgaatgcacacaagcacatcctatccctatgatcgcttctgaatattggactgatttatcttaagatttataaagttattatggacgtctagctatcgaccgaccagtacatgtggcatatcgctgaaacaataattagccgtaaatgcaaacccccatttcaagtttaggacttaaactctggtgaaaaggtttcaccatcataaatcgaatcagtcgagctacactcgggagagagaatggaaaaataacaggctagctaagggtgaggctatatttgacttcacagagatgcagcatggtcgagggttcggaactactaatagctgcaacaacatgcatatatacatgaggcatcaatctctgcccttggctggctttaagcatctaagctcagaaatcacagtagccaccagctcgtaccaaaatggcaatggatttcttccattatctgatggatgtttggaaaaaatggggtatccaaattcttgtcacctggagcctcatgctgcaggtcatcctcctcctcctcgcggggacacgccgccgtgacgcccccgccatgcttaggttcctcctctggctagcatacctgctggctgactccaccgcgatatacgcccttggccacctctccctcggctccgtggcgagcgatcactggctggcatccttctgggcgccattccttctgcttcatctcagcggcccggataacatcacagcctacgccctccaggacagcgagctctggcttcgccacctgcagatccttcttctccagctccttggagctagctatgtcctctacaaacatatcatcatcggcgacgtgactacgagaggacacgagccctttctgctggccaacgtcttgatgtttgtcgtcggcctttccaagtacggcgagaggatacatgcgctcagatgtaacaagctgagcaacatctggagctccccgaaggaagtatatcgtaataaccaacttcttcactacctgcaggatcgagatcataggattagagaagaagaagaattatctctgcagtatgctcactccctgcaccacatctgcaagcgtgggatagtcaactttgtgattgaggaaccattggatgtggagaaatctgaggggtccagaaccaagatattaatcaagaagatgctcaacgagaaggacaggaagacgcacataaaaatgtggaaggtgatagagatggagctgtccctgatgtacgacatcctctacaccaaggcgggcgtgatccacagctggtttggctactccatccgggtcttgtctccggtcaccatcttttcctccttcatcttgttcatcgtcagtgggaggggtggcagcagctgctgcagcaaagccggctagcagcacgggatcgacatcgccgtcacatatgtcttattggttggtgctttcctgatggagacgacgtccttgataaacgctctagcatcgagctgggcacttggcttcttatatggcatgccatggagttggctcgagaatatggcatttcatgtcagatggtggcaccggctccggcgatcagtcttggctcttcgccggagtgtcgaagcaaagacaagaggctcctggggcagatcaaggaagtggtcaggcagcattggccagttcaatctgctctacttccgcgccgcgcaggtcaaccaaaccaactactggctcagcaagtgtgctatgaaattggggttcggcattggcaattggtggaacaacacttgttactcgtggactataatgattccagacaaggtgaagactagatcggtgagtttggtctccaagagtgatctcaatacaatgggcttgctcaggtataagtggggcgagctggcactcaacaacgataaaaaaaggatctggcctgaactgcttcaaaaactgggcgatctgcacggcgtcgacttccatgagagcatcattatctggcacatcgccactgatctcatcctcctagagagaaaaaacaactactccggcgacagtaaaaatgccaaggaagttgaacgtgtacgttcaatcagggcactgtctaactatctcatgttccttgttgtgactcgccccgacatggtacctggacttccccaaaattggttataccaacagacctgcaacaacctcgatgaaatatgcgaagatcggcgttatcaactcctttcttcagctggcaaggccagtaacatcatcttccgagtgctcagggagctgttcagaggccataatgataacacagcgtcagttcggctcaaccagaccaacgaactcgctaaaatcttactcgagaaatataatcctacagaaaaatttgaccgctcagttcctcgcctgacgtatgcacgcaacgtagctcatatagttctaaattgggagtatccagatgacctgaaggatacaggcccagtgaaggtgctgcatgacttgtggatggactttctcatttatgcaagagtcttaagatgactgcatgcgacccactctttttttcacccacttaagtctcttcaagttccattctctccatgtcctccccccactccttttctcccctctcttccatagaaagtctttcaaacttcacgtgtagatttttataaatattaatataaaaagaaacaacatcatgaaaaaggaaaagattaattaaaatcattattattggaaactagttacgtaaatgttaaattaatcgtgatttttttctccaaatccagcacagcggcgcacatgcacacgcctccccagcatttccttgcattcagaaaaacgtaagtgggccggaacatgaaccgcgcgcgacgactcgcgatgacgtgggctgaaagacgcgccagatcgctaacacgtcttctttaattaggtgtagcggaataccgcatcgcactccacatgggcgtcgcgatcgtgcatcgatgtcgcttccctgagcccgagtcgtcttgccgggcccacctggcagtgggacaaatcagtcgcctgatgcacgcgatccgtattgcctccctacgagccaatcaccatgcgtcgcacacgagaaaagctaatacactaccagtcgcgccccccaccccccccatgcgactcgacacttggcgcatgtggagagggggacgaggggtggtggacggtccggttttctgtttattttcttttcccgtttattttagggttttttatacaaactttgtatatatgtgatttttttttctgattttttctttttttataatatgtaggtatataaagtatacgcatgtatacaaatatatatatgtacgtacataaattttatatatgtgtatacagtatacagagaggagagactagagtggagtatttttgtagtgtagcacgcgcgcaataccgctccccggccgccgcacgggaccattgatccacgtctccaccctcgccccgaatccggagatgccacgcctcccgccgccacgttgtccgcgttcgtatggattcccactgggccacctccatgccaagctgggccagctaccttgcctgtctccgtattgggccatgtcttgtctcggcccaccaagccaggtcgccatccgtttgctcaggccagctcgagttgggctccctgcctaccgaggcctgccagcccacatgcagccatgcacagcccctgtgcaagcccctttttcttctcctccgtgaacttgtgaaacccattatgaagatctcccgatatgatgtccatccactgtgtgtcaccttgtatccaatcacgtggcccaacatccttgatcattctgtatctcaacttctttctgagtcaaatatatcccgatcccgctgctgacaaagatagattccaaggatcttaacttcagtcccaccctgtcacatg

SEQ ID NO: 54546 - DNA, 21449 bp, Oryza sativa
tttttaggtatagatattgcaacttgacccacattagtcacacaaactcacactgacaatcgccaacattccaaatcaaatttatcacaaaaactaacccagggttcccaacttccttgccaattttccatcacaaataaactaaaatcacaaattatttccggacaaattaacctgttcacactgtgattcttcacaagatttattagtaaaaataaccagagtactgggcatatcgtcagactgttgtagacccctagacaagggtaagaaagatgcatgaagtaattgtatttctgagcgtaggcatgcactggcatttggagaaagcttggtaaagggaaaatttgattaatcaaaaactacatcacgagatataaacactaccagtggcaggatctaaacacttaaactctttatgaagaatactgtgccataggaaactgcatattgtttcgaacggaactgtagcttatgtcactggcgtaagttggaccaacaaggacacccaaagattcgcaaggaattataatcaggctgctgatcaaagagatgttcgaagggagagacatactggaaattctactaggagtacaattaattaggtatactgtagaaacaaaagtttcatcccaaaactttaagggtatagatgcttgggctagaagggctagaccaacttctacaatatgatggtgttttccttcagtagaaccatttcgcggatatgtatgtgggcaagatacatgataagagatgctgtcttttctaaaggaatgtatttttttatactctcctccccaatcagtctgcatagctataattttcctaatgaacatgcattcaactagtttttggaatgcaagaaacttatgaaaaacttcagatttaaatttaagcaagtaaacccatgtaaacttactataatcatcaatgtgtaggatcgaatcacaagaactaagccaaccagagagaggggggggggggtgaatggttggtatacccaaaaaccaaaaacttttagcggaaataaaatttaccctcgaaatcgatggatcacgatctgaccgaagtagtagcgctgaccgaagtagtagcgccggtctgaccgcctggatatcgtcggtctgaccgagattggaactccggtctgaccgccagatcagctgccgctagctgtcgccgccgccggtttgaccgctcttacggcgctagtctgaccgccagtatatcaccggttagactgccgtaacccgatgaaacacaaattgaagaactctcaaagtagatgacaactttattgcttctctatgtgtttacaaagtgcaccaacagcactccttacaaaaatctcgactaaactcgaaacactaactaaactagcaactcaattgctctaaaaagcgatatcgggaagcctcacgctccccctctatttatacatgaggtaagcagcctaaatctacgaaccaaactcatactaagagtcctaaacaccttaggaaaccctctagtacaagaaagaaactttacataaccaatcgtaccaaatttggactccttccaaattcgactccacatcccatacgcacacaatacctccatcgtatgccatatggaatctacatcaaccacgtgcatcaactctagtgttagtaacccgcatgatatctgaccaccacggacatcgccttaccaccaagccgactcccggtccatcaccgcaaatactctcccgaggcatcgagtcacctacacatgaaacaaacaaagaaaccatattccgagaccaagctatcaccaacttgactcattgttagcaaacaacagtattacatacgtatagtatccatctaaaagccataaccatgaaacaatcacggatatccaaacaaacaacccgaaaccgaaaccgacacagcgtcggccggtcagactgcgggcaagccggtcttaccgctcacatagcgccggtctgaccggcaaccactgcctggtctgaccgatcccaacaaaacagcaaaccctgttcatcacctaaaaatcaattatctccaaaaccacttcgataataatctctaattatcaaaaccaataatcacagatgccaattgttcatcacagaataagaatcaaaaacacgttgatcttacaatctccctcttgatgaacacattggcaaacccattaaaaatgttttggtgtttggaaaaataaaaacagcacacttcgtacaaatgtacacatcgtgctcaaaaattcaaaagaaaacttctccccctttttaaaagaaagaaattcccaattgaatcaaaaacgtgctcttctcaaaaactcttttcttctcccaaaactcatctcttctccccaaaacttatctcttctcccccttttgacaatgatttcatcaagcataggaattatgtttattaaagtataagagcttaacatacatatagcatatcatgtcatgtgttgcaataaaaagaagatgaatccatctataaaataacaagcatgcattaaagtataaccatgaaccaaagattttacaattaagcttgaatcaacaataaaaattcatgatttcatacgatttaaaatgcaacatcttaacaagcacataggttcaagaataaacactaaacacatatacctattgcatttatcactctttctgaaataaccttaagcacaaaataacaaagagaatttttaaccttttcttttcttgagcctttttcctcatatttttctcttttttatattccgggtacgtccctgtcgtcaagactgtttttacggattcggcacccattattttgcttacatcgaatacgtccttgtcgtcaagactgtttccaaggattcggtattcattttttttcatatttttattctcttttcacaatgagcaattaaagctatttgaggaataacaagtcaataaagcatatatatagagcatttaaaaatcaaaccacatgctagcatcaacattgcatatttacttaattcaagtgtagaatttaagtgtcatgcatcatctcccttaaaagcaaaatctaaatctcatgaaaagactagaatacatacaagctatgttagagacaaataaaccttcaaagtattactagcatgcacaagaaaataccatatgtataaacatagctctcttttctcaattttttcattgtcatattttttgcttgataaaactatgaggtacaaactccccctcaaatcatgctaaaagaaagtcataaaaagcactaactccccctcaaaataccctccaattctcccagaacaaaactcaagaagaaatcaaggattttgaaaaaaacatccaattaccaacgatatcaccaaaattctcaaatactagcatatgaaaaagctaataaacaagagagtagaccataattatgtcaatccaaaattaaagtgatgttaccttgctatacaatcgtcatctcaaagttaaacgcacatggggagtatgccgtcaaaatacctacaaatgagaagatgtcgaggcctccgtgttggggttagaaataagaaattttggaatccaacactgagtcacacgaccactagaaccagtaggtacatatgcactaataaaatcagaatcagacttaccagaaaacttacccttttgcttcacaaaagtccaatttgaatttcgcgtaaaattgccccgaggccggtctgaccgccgctgtgcctgcggtctgaccgggcctggcaaccggtctgaccgctggcctgtctgaccgactggtcagtgtcggtctgaccgtggtcttcgaattaaaacccgatttttgccaacgtcgttttgtaaaagcaatttctctttcctttttctttttatgggcaagtctaaaacaaaaaccaaccaaatgtccatcttttccacaaaaagaacaagtgtacatttcacgataagtttgtgaagtagatagttttgaaattgatggttttgcaacaacagaaggttttgtattcaaaacatttgatttcgaagaagatgcacttaaagaagacatgatgccagtagatttaaacacagtgttcttaagctcagattcaatcaaaatttcacctctcctagcaacacccaaaacagtaggaggatgtctagaattatgagcataaggatcaaaacctaaaccacgattgtgtgtgctaaccttagattgatcaagaatcatgttgaggttctttttaccatcagaaaatctttgcaaagaacttttcaaataagaaacctcctgagtaagaatagcacaatttttgcaagcatccaaaagacctttttgttttctacaagttgagcaagaaaacacctcatcttgtttaacaatttcttccatgtgtttaacatgccctaaagcatctttcaacttcatctcattcaaaacacactttgaacaatcttgagaaatcaaaacatcattgttttgttttgccttatttgcacatgaagcattgaccaaagaactcgcacagaaagcaacattgtattttttcaacacattctttgtcaaaattaactcatcaacaacacgagcatgtaaagcaaatccaagagcaaaagaagattccaactttttagatttttcaatctcaaattctaattttttgcaattaatagaattgacatctcgcaaagcattaatttcagaaaacaaaacttcacaagatttacattcatcatctttaggaatcaaagattttaatctagaaatttcagcatttaaaatctcaatagtgtgatccttctcatcaagtgcaatagaacatgtttgaagtttcttaccaaatttgtaagcagtatattctaattgatcataactaagcttttcctcattatcatcatcagattcatcaacatgagaaatagcattacgagcaataaaagctagatcaacaacttgcttacctttgccctcatcttcatcttcagatccatcaaaaacttttatgagttcttgaattaaccactgcatgcaatgcttcttcttctccttctgcttcatgttcttcttcttgttcacgtcatcatccttgactctcccatcatcttccttcttgcctctcccaagcttaggacaatgcgagcgaagatgatcaagtgcacaacactcaaaacaacgattcggttctcctcttttcctgttcctaacatttttcatagctcaagaaaatttgttagatagcaaaaccaagtcctcctcttcgaactgttcgagttgatcatcggaaatggcattaaataaagcaagaacagaagactttgatgaaaaaacaccaacatccaaagaagatgaagacgaaaccaaagcactagacttagaatcacctttacgagaaagaatattcatctcatgagttttcaattttgtgtaaagcgaatccaaagtcaaagtagtcatgttcacagactcctgaatagatgtaactttcatctcccaaatagacatgtcaagaccattcaaaaagtggcgagaaatctcagattgtggataattagcatcataagaagaatcaacagatctaagatcactcaaaattttattaaacctagaaagatagtcatccaaagcttctccaggtttcatctcaaatttaatgtactcctttttgaaaagatcacgatgaagttctttaatgttattttgtaccttgataaaaattattcaaagcaacccaaatctcatgagcagtttgaagatgagcaacacgatcataatctgaacgagaaatcctactcaaaaaaaatattgcgtgctttgcaatttagttcaaaagcagttttttcagcagcagtattaataacttcaggaatcacataaggaagagaaacttttctccaaatatcataattctcagccataatgtaagattgcatcctactacaccaatgagaaaaatccgttgcatcgaaaatatgaggcttagttgtaaacttattagaagtagccatggcaaaaactctagatcgataaaaatccaaagaagcaatcaaggctctgataccacttgtaggatcgaatcacaagaactaagccaaccagagggggggggtgaatggttggtatacccaaaaaccaaaaacttttagcggaaataaaagttaccctcgaaatcgatggatcgcggtctgaccgaagtagtagcgctggtctgaccgcctggatatcgtcggtctgaccgagattggaactccggtccgaccgcctgatcagctggcgcttgctatcgccgccgccggtctgaccgctcttacgctgccagtctgaccaccgcttgccgccggtctgaccgccaatatatcgccggttagaccgccgtaacccgatgaaacacaaatcgaagaactctcaaagtagatgacaacattattgcttctctatgtgtttacaaagtgcaccaacaacactccttacaaaaatctcgactaaactcgaaaccctaactaaactagcaactcagttggtctaaaaagcgatatcgggaagcctcaagctccccctctatttataaatgaggtaagcagcctaaagccacgaaccaaactcatactaagagtcctaaacaccttaggaaaccctctagtacaagaaagaaactttacataaccaatcgtaccaaatttggaactctttccaaattcgactccacatccgatacgcacacaatacctccatcgtatgccatatggaatctccatcaaccacgtgcattaactctagccttagtattccgcatgatatctgaccaccacggacatcgtcttaccaccaagccgactcccggtccatcaccgcaaatactctcccgaggcatcgagtcacctacacatgaaacaaacaaagaaaccatattccgagaccaagctatcactaagttgactcattgttagcaaacaacagtattacatacgtatagtatccatgaaacaatcatggatatccaaacaaacaaccagaaaccgaaaccgacacagcgtcggctggtcagaccgcgggcaagccggtctgaccgctcacatagcgccggtctgactggcaaccaccgcccggtctgactagtcccaacaaaacaacaaaccctgttcatcacctgaaaatcaattatctccaaaaccacttcgataataatctccaattatcaaaaccaataatcacagatgccaattgttcatcacagaataagaatcaaaacacacgttgatcttacacaatgaagctcacataatacttccttccccccaactgactagagggtaggaccccagacatacactataagacttaggataaggtaattgatgactttttgtcttttaacacacatcatggactgactgattactagactcactagaacatggcaatttataacttctgttgactttgtcgacaagtactgaggaaggatggcctggacggttatgccatctttggaaggacggcttggtgactccataaacatgtttgatcgacgactggtgtggtgaaaaagcaggtagaggataaagtcctttataaccgtgacaactaagcggaattctccacatggtatgatccttgataaagaaaagttagagtataattcaaggaaggcaaaattatcataagcatacctatgggctgaaacatgtttttttttttggctctaggaacgtaatgaacattattcaaatagagattatgattgtgggtcttaacaacaaaacatccaatatgactaatctccatacctgcaccacttgccatttggatttgttcagtgccattgtacttctcacggactgtcaatttttcaagttcaccggttacatgatccatagcacccatatcaagatatcagttagtatctacaccatatgatgctgctgtccctgcaaaaacattcatccggctcaaacaatttatcatatatcgataccaacagtccttttgtagcatagttgacatttgggatggttgtcgctattgccaccattgttgcggcctctagagttgtcatggccacatccttgcttattgttgttgaagccagcgcatccacgagcattgctacgcccgcgtgctgcgttccacagcccctgttgccatgttgacagatccttgagcatcgtttccgtgatgcaatgaaagcctctgctcaaagcttaagagctgagcaaaaggttcgcctagtgtaacccgatcttgccaccccacaatagaggagaccacgggttcaaactcctcatcgaggctagcgatgatgtaggagatgatgtcattgtcatctatatgctttttagaggcgatcatgtcatcgacgagggcgtgcagtttccccgaagtatgtcgtgattgacatatctccctttttaagcacggcgtgtgtcctggaagagaacatttcctcctcaatataccatgtggctgctactgctagagatactacaatctggactagaatatctctagacatggaagaaagtaggtatcctagtacctgtttatctttggctatccactcttcctagtcgggactggaaaccatgatttcttttgcgccctccttgatcttgatgatgtggtggaggctttacttgctccggtgaggtaaccctcaaggcattcccctctgatgatggcgagaacttgtgccctacgtagggcttggttttctttgctaagtttctccgagaccgcttggcttactaggatttacgatcaaggatttgaacgaactcgccatagtggcgttgctcggcagattagatggtaggggatcggtagaaactatttcctgctctgatctatatagaaaaataaagaggaaagcggtaacttgccctcggttcacctgcatgttaatataggatggaaatagcctccatcgtgacttacaaggaaagcatacaccaaccaatcaaaacaaccagcctgtatatgatatcatctaccacatgagacaattactgaatacaagatagagatatctaattaaactacgttatctaactgctgttgagatatctcggttgacacatgactaggtcccccatcatcctcagacttgggaaatttgatgtgctccacaagaagccacacagcagtgaggaactcaccaccagtgctcagctgcctggcatgtgactcctcgctgcagtggtgcgccgcatagcacaacatctcgaaccacaccccagcaatcaaccccagcatgttgggcacattgcattcgttgcgaagtaggtacccagcgactgcagtcccatcaaggtaaacctggccgtgttcattatctgtgctctcactgccaaatttttggaacaacaagcttgctagtttcttgctttttgagcggttgttgtctccaccctccgagctactggtggagtgctcctgccagagttcaaccaaacttgcacatacctttgggtacagacctatgcgaattggcccaggtagcatatccgggtgctgcagaaggaggtacaacatgtagttggagatctccttgatcacctttacaacaggtttctctgtatgttccacctcttctttgaaacaacataggtagacatcggttgcgacatgccacacaaggatgcttttttcaaagtcaatgtctaccgtgctccagctgagttcctcatccattttattctcatagaggatgcacatacgccgtgcattcctgatgtcccctcggcctctcttttgtatctcttttagcacaaactccttgatatcacttgaaattgaggttgtgtttgagtaatgcagtttattaaaccagttctcaagccccactttcatggcaatcctgcctctcagatccgtcatatcacgggtacagaaatctagcaagttatattgtccaatagaatccagccataatctacttcgtcctgctttcacaatctgacgagtaaacattacagaattgcagggccaatcccatttcctagtatgcaagaacgcacatgtccaagaagaccctacagtcctcagcaatgttgtgatctcaaggaggatagccccgatcaacaaagcataagtgacggcaaaatcaactatgtgataagcatctctcctactgaaatggaatagcagcagtgcagcaactgtggcaggtagtgaaaagactcgaatgcaacggccataccaggtgtgtataaccgctgccttgctgtataaaatgtcatacatgagggatagctccatctcgattaacctgtacatgtgctttccaccatcaatttgcatggcttactcgacagcacttctttggggctctgacatcgaaagagcatcaacgaataggctcttgcaaaaatcgaacatgtaatgagcacccaacagagcctgctttagatctctgttcatcctctcttttctggcctgctcaaggtaaggattgtgagcacttgaatcatctaaaaaatcaagagagcttcggatgctgtccatgttagcacacatgaatgcccataccctcttcccatacttgacaacaccgacggcaaacattaggatgatggcctcgaccaaagtcctactgccggcaatgtatctgtagagaacataagcaacacccaacacctgcactgtgaaagttaacaggtggcgcaaccagagctggttgtcctccaaggaataagctgtgatgttatccgggccacccaggtgaagtaagaggaatgttgcccagaacgcattcagcaggtgctcacgtgagctgctgcttgtggtcatggatagctggccaagcgtgtagatggcagtggagtcagcagatagataggaaagccataggatgatccttaacactttgtaacctttgtgtcgacggatccatgacaagaggtggaggataacttgtagagtgaagctgaggatgattagtatttgaatttgccactctttccagagttgagctagtcctccggccattgctcctcggctcaactgcaaacaacatcatattagtgaaatactccatctaaaaccagtcagccctatacccttccataaaatgctcactattccttgaaaggaaagaggaatatgggtactcagtaacattctagcagaaaaaaatatttttttacgagctttaagcgctaaagataaatatttcgtcaaaaatattttgcgaaagataacatctaactcaaaaatactatcataatattaaaagcttattattgtaatataaaattagttatcaaggatttataagttaaatattttttgtctgggtatataaagtactccctcctttttcatactgtaagatattttagttatgttctaaatcatacttaggataattgactaagtttaaaaaatacaccaacatctaaaatatcaaagtaggttaattaaaatctacgattatatatgtcttgataatatatttattgggcattacagaggtcgttcttatgtataatatatatttctctaaatttcatggaagttttaagttgacttaaaagataaccaaaatgccaaatgaggagtatatcaagataaactgctgactaccttgtcgttctataggtgttactaaataacaacatgtcgaaccaaatatatataggggtaaacagagcactgcactgcagcagcttgcacgagagctgataaagtggaaaccacaaacacaatgtcaaatcctactttcagaagcatatcggaattcgcagtatctaaattaaatgcaactgcagggtgtgagcaattgtgttctaagttaacaatctggtatatatgaaaatttctcaaagatatattggtctaatctcttgagatgtttatagaagtaggatgtgcgtatgtggatttctagaagtgagtgtgcatgtgttatgaatggttacgtttgtactatgacttttttattttcaaaaaaaaaaaaaatccatgaacacattggtagtagccaagcgaagtataacgattgttgtaaaatctgaatagatcctgcttcctgccccgatgtgtctcacactcttgatgtgtactaatatcagagagaccacactggggaataatcctaggattgatttgtacttgtctttcaccatggcctgaacagcccccagccccaatttacaccggtctaattaaccgaatttaaccaaacagaaatcgtccgtacgttggtgaatcgcacattcagagaaacaccaattggaatccaacaatataagagaaccgatcacaggcgcaaaagctatagggctgtcagctggcaaggcattacaaacgatcactgcaaacatgctatagatatgcagtagaagcgtagaatataatgttcatattcgacagaaaaatcaagtgaaacgaaactaagagaggcgagaagaaggcaatatacacgtaccggcgaacgggtctagaccaaaataatcgatgaatttaccggtccctctggcttgaactgactgactgtctcccaattaagctcctattatactggagtggagtggcactactggacactaagggtgagttcgagaggaggggaaaagagaagattgggaagatacgcaaaaagaggtgagccattagtatatgattaattgagtataaactattttaaacttcaaaaatggattaatatgattttttaaaacaactttcatataaaaatttttggtaaaaaacattccgtttagtagttcgggaagcgtgcgtgcggaaaacgaaacgaactaactcatggactcctcctgccgaaagctccctaaggaagcaagaagagtagtatgttaatttgaatgcatggcttaatactggagtggtggatcaatccattttaaattggtactccctttattttaggttataagacgttttgactttagttaaagacaaattgttttaagtttaacttagtttatagataaatataataatatttataatactaaattagtgtcatcaaatcaataattgaatatattttcatagtaaatttggctcggattgaaaatgttactatttttttctataaatttggtcaaacttaaagtaatttgattttgattaaagtcaaaacgtcttataacctgaaatagagataacctgaaacagagagagtaactaactttgggctttcaataagtctctgcatgtgctcactttattatcctttcgcaaggcaaggctagatgactgtccaagtgagctttgtatgtgctaacatgtgcctgctgctttaattcaagtgatcatcagaccatatgtattgatgtgatcaagaagcaactaatatttttttgttaagagttttacccgtcgtcgtgcttctagtcagggaacatggccaaacttcgagaaccgccgaacagaatccggtaaaaagcaaattaaccatggaggctaagtatatatgtgtcggttattaatttatcctagctgagttaaattagcctggtttcgagttaattatccaactgtcattaataaggttattagcgaatagattatcaaagtaattagtatattttatttattttatttgttgagtccgaaaaagacttcgtgtgggcctgcgtgcatccctttattagggttgattggctgtgtaacggagtttttttttttttttttgtcgttctgttgagagatcttttggaaagcttatggtgatcccctctgggaaggttggagaggaaactaggtcaggagattactttcttgttcttgctgcttggtacatgttagtgccctctcttctgctcttgttagaaaacagggtagaagattattgtatcccgggttcggtgttcaactatttgtaagccgagctctcgattatttggtttattttgctgctgaattctatttaatttacatatacaagtccggtttaatgcgtcaagttactcactggaggtgtgcattaattagtggcgatttcatgctgcctcacaattttagaaagttaacttgtttaattgctattggtaccataaaaagggacatattcgggtactcgctgtcggtgctcatcatctatgttctttgcaactgtaaacaaatatgggcatgcatagaatctagtaggtaaagaagtcgtatatataaaaagtgctagaccaataaggtgagtacactgaaagttggattaacccagttagaaggaaaagaatgtgtgttgctaatttattgacattggtccccatgctggtggttataaaatttttggccatcccctttgttaatgggtatgttcaatcttctaatacaataatgcatgcacctagggatttgaattatatcttatgcttgatcatctacgaagaggctcttgcaaacattgaacaggtaatgagtgcccaacagaacatttcgtagatctgcgaatagaggagagtcaagggatgacacagactgcgtgcagcttctcttttctgtccagctcaagataacgatggcgagcacttgagcgctcaaacatgaggacgatggcctcgaccaaggtagagaacacaagcagcacccagaacttgcatagcaggtggcacaaccagagcctattgtcctcctaggaataatctgtagtgttgtctgggccacccatgtgaagcaataggaatgttgtccaggatgcaatcagctggtgctcacctgagctgctgctcgtggtgatggatagccggccaagcatgcagattgcagtggagcagcagatacatagaaagccagaggaggatccttcacagtgtgtaacctttgcaccgacggatccatgacaagcggaggacgataacttgtagagcgcagcctaggatgactagtatttggatatgccactctttccaaagctagctagctctgcagccatcgcacatcggcttaactgcaaacaacatcacattaatgaaatactgaatctagaaccggccagccttgcatcattagctaaaatgctcgttttttttttggagctaatacacttgttgttccctgaaaggaaagaggaacattctagtagcaattttttttaaatcaaatcaaaataaagtttcgtgagctctgagcgatgtttgaaaagagaatccaagcgctaaagattaatatttccttaaaatttgaaaactttgtcaatccataatttattaaaaattttctattaataaataaaaagggtagaatctaagttgaaaatactgtcataatgttataagtttgttataatacaaaattaattatcaaagatttaaaagctaaatattttttggctggatatataaagtactccctccatttttatattgtaagatgtttttgttatgtcctaaatcatacttagggtaattgactaagtgtatagtaaaatacaataacatctaaaccattaaattaggttaattaaaatccataattgaatatgttttgataatatatttattgggtattatagaggtcatccttatgtataatatatttttctcaaaatttcagttaagttcagagttgacttaaaacatactgtaactaccttatcgtgttatcaatatatttttagaaggtgtcgctctaaagtgttactaaatgacaacatatgtccaacgaaatatatatacagcagcttgcacgagagctggtaaagtggaaaccacacacccagtggcacgccttcgggcgatcggcttgctgaagaacaccactggtctgctaccttcctggagcacagggcccatgtatgttctcgaagtctctctcgacgatgaagtccatgttgaagtctggtagttgaagcactagggtggccatttgggcttcctgtagtgcatggaacgccgttccgccgcctcttcccagctgaagaccaccttgcggagtagtgttgtgagttgcgtggcgatggagccaaagttgtagatgaagtgacggtagtagcctacaagcccgaggaagccacgcaccgcccacgccatcttggggatcagccaatcctagaaggccttgattttctggtggtccatcggcacacggagcctgagatgacatggccaaggcaggcaatggaggtgaggccgaatttgcacttggagcgtgcgaggtgggaatgatgatcctgcagggtttggaccatgccgagctgtagattaggatgtcataaaaaaccaacatgaaccatcgaaggaacggaaggagtatgtcgttcatgagcgtctggatggtggcagaggcattggtgaggctgaacgtgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagtcacgcagcaaatatgcaagtgcacaggataacaaaggatggcgtaatagggatccatttgcaaaagcagcatttagcaaacatttgagaatttaataaaacagttaagtattaattaagcaatattaatccaacgctatacaacataccctgttgtataggcccatccattctgaacaaccatcccggctgcacaggtctatctccaaaccaggaatgtaccattccaaaccaggagctaatcaaattattaccaatttaagcatcatttactatggtgagaagtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggataggagttgtgacaatacccctcatacaacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattagttaattaaccaatcacgattgtccatcgtgaactatcattaagccatcattaaataatagtgagtcataagttatcccataagtgtgctaatgtttctaagcagggctaagcaattatatctaatatctagttgaaccaatatacataaagctcaactagtcaaattataataacccaaggtatcaaggaataaagtaatcaagaacaaaagggctataacaatgaataggttaattccacccaatgacattcgaaaatagatgcaatagttgaatagaaacaatagctttaaataggatcaacatgctcaaagggttgtttgggatctgtgtgacttgccttgctggccttggaactcttcaaactcttctccgacgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaggatttattgcgtcagcgggctagggtttcggtggaccgggcacacgggcggaggttcacgcgaacggacggccgagatcgaaccaatccaaaacggacgaccgagatcgaacgggtccacgaccggctcacggcggtcgaccccgatgacgtcagcggtgacgtcaccggcagcggcggcggctcggcggagcaaacggctcgggcggcgcacgctcgccggcgaacggcggcgctaggacgcaaacggagggcaccagcacgtagaggacgacgcggcgaacacaccggtgaccaaaacggcggcggaagaacgacaaacgacgacggcgacgaggaggaaacggcggaaaccttcgggttgacgacggcgacgaagctccggcgatctccggcgacggcgaaggggcggacgaggatggcgatgcgacggcgaagacgacggcggccttccagagcgacggcgacggctgaaacgacggcggcgcacggctggagcggcggcggcgacggcaaagctagggcacacggcgctagagctcttccggcgacgagaggcgaaggcgagggtggcggcgggtagaggagacaccgggggtccttttaaaggggctcggaggcggcggcaaaggcccacggcggccggcgacgaggaaggaaagatcaggaagaacgaatccgagacgaactcgaatccaactctttccaaaacgatttagccaaagattccaaaggagaaaaggtagaggagatcccgaggatcatttcccctctatcaattcggccggagaaggaaaggaacgtccggatttggaaggagacggcggcggcggcgcgctagggttcggccgggcgacggcggctcggggaagacgaacctgacaggtgggacccacctgtcagcgaccgaacgcgcgcgcggcgcggctgtggactgggccggactgggccgaggagagagaagagaggttttgggccgactttcggtccaaagccaaaagaagactttttaaaacctttttcaatttaaattatttcttaaatgcaattccatttattaaaaatactttcttagctcaaataaatcccagaaaaatctaggaattatagaattaagcaaagtatttaatgaaattttatctgggcccattttatattggaatttattaattaaaattagatcttctctccaagactttttaaaattatttctaaaaattccaattaaacaacaatttatatattttgaattttcagggtgtgacaaacctaccccccttaaacagaatctcgtcctcgagattcggaagaactggcgaacagatacggatgagctgacttcaattcatcttctggttcccaagttgattcttcttccgagtgattactccattggactttgcaaaaacggataactcgatttctggttcttctctcattgatttccaagatacggattggtttctcaacataggtcagatcctcttggacttctatctgttcaagattagcttcttcagtaggtacccttaaacactttttcaattgcgacacatggaacacattatggactcctgccaaagattgaggtaattccaactgataagcaacctctcctcttctactaatgatcttataaggtcccacaaaacgcggtgccaattttcctttggtgtgaaaacgatgaacccctcgaagaggcgtgacacgaagatacacataatctccttcttcaaaactcaaatctctacggcgattgtcggcataactcttatgacgagactgagccacacgcaatctttcttgaatgatctttaccttttcttctgcttctcttaggatatccgtcccgaaaacctgacgttctcccgtttgatcccacaaaagcggagtgcggcacttccgaccatacagtgcttcgtaaggagccatctgtagactagcttgataactgttgttgtacgaaaattctgcatagggtagattcttatcccaacttccaccgaaatctaaagcacaagctctcaacatgtcttctaaaatctgattcaccctttcggtctgtccgtctgtctgcggatgataagcagtgctaaagttcaacttagaacccatctcttcctgaagtttcttccaaaaatttgaagtaaactgactgcctcgatcagacactatcttcttagggacgccatgcaaacacacaatccttgccatatacaattccgccaagcgacttccggaataagttgtctttaccggaataaaatgagccactttggtaagtctgtcgactatcacccaaatagagtcatggcctgatgacgttctgggtaaaccagtaataaaatccataccgatttcttcccatttccattcaggaatcttcaaaggctgcaacaaaccggcgggtttctgatgttctgccttgacttgctgacaaacatcacatactgctacgtattccgcaatttcacgcttcatacttgcccaccaaaatctttccttgagatcctggtacatcttagtactaccagggtgaatggagtataaagtatcacgagcttctttcagaattgcatctttcaaatctttgttgtcagggacacaaattctttcacccaaccatacagttccttgctcatcctccaagaaaccgatagcttttcctcttctcatattcttcttgatctcttgaatatcaggatcattaatttgggcttctctaacttgatcaattagagtgggcttcgcttctaaggctacaacgaaacctctattgacaattcccaaatttaatctttcaaattccttgcataattccaatggcaactgtcgtccttccgtagcattgcaataacctttcctgctaggagcatctgctacaacattagcctttcccgggtgataatgaattcccatgtcataatccttaattaattccaaccatctccgttgtctcatgttcagatccggctgagtaaagatatactttaaactcttgtgatcggtgtacatctccgtacgagtaccgaaaagataatgacgccaaattttcaacgcatgaactactgcggccaactcaagatcatgagtagggtagttcttctcatgcggtcgtaactgacgagatgcataggcaaccaccttccaatcttgcatcagaacacaacctaacccaagtttggatgcatcacaatacacctggaaacccttctttggatcaggcaaaatcaaaataggagctgagattaagcgacttttcaactcttgaaaaatctgctcacattcttccgaccacttgtacttcacatctttctgaagcagtcgtgtcatgggcttagcaatcttggaaaaattctctataaacctccgataatatcctgcgaggcctaggaaactgcgaatctctgaaactgtctttggttgcttccaattagttacggattccacattactaggatcga

SEQ ID NO: 54547 - DNA, 3629 bp, Oryza sativa
cttctgccaactcatgggctgccattcgatatggtctcttatggatcggagttgttccgggtaccaaatctattctgaactctatatcccttttgggcggcattccaggtaaatcatcggggaacacatcggaatactcccgaactataggaatctcttccaaagttatctggttcagtcttgcttaaagactcagaagacaatgcatgaacagttacaactcgaccatcattgctggtgagagttacttttctgttagcacagtctatcacacctttatgtctggctaaccagtccatccctaggatgacatcaaggtctttggattctaacaagataagattggccagaaatggtactcctttaatttctattctgaccgaggggctacgttgcaaagaaagtgcttgattacttggggtactaaccatccatggacatctaagatcttctacttccatcccatgatttcccgcaaaactcatagataagaatgaatgtgtagcaccagaatcgaaaagtactgttgcaggaactgagttaataaggaacgtacccaaaatcacatctggagcatcttgagcttctgcagcagcgacatgattgacacgggcctttgatgctggtacggtagaattgctctgggcagggacaaccttcacgcgatggggcttcggacacttgtcagcataatgtcctgggtctccacagttaaaacacaccacgggattgctgccttgctccctcttggcaggctgttgctgtgttggagctgcaacagggcgtggagcttgattgcggatgttgttgccagcattgttgttgaagaactgacgctgcggacgaacaacagacgaagaacctccctgtggcataggctggggtcctaaagtaagacgcggcttctgattactcccctgttgtgccttgaagtgagcaatccggcgtttcttttgctccatgcgattgttcttgtcctcctgacgaatagccttatccactaacttctggaaatcaggataatctccagtcatgagtgggtaagaaagctcatcattaagtccttccaagaacttctcctgacgctcttcatcattgcgcacatcttccggagcataacgagcaagacgattgaactcgtgcagatactccgtaacagagcgagatccctgagtaagcgacctgaactccttcttcttgagagacactactcctgatggtatatgcgtctttcggaaagcagcggtgaattcaagccaagtgataggttcagcagtagtcctgttaaggcggaagtgatcccaccattcagaggcagggccatgcaactgatgtgatgcaaatgaaaccttctcctgatcagtgcactgaagcaaatccaacttcttctctatggcatgcagccaatcaccagcttcaacaggattagtggtactagagaaaataggcggcctcacacgaagaaattctgctaacttgttctggggaggtgcatggttatttccctgattttgctgattctgaagttgttgcatcatcatgttcataagctgagtctgttgagcaagaacttgagcaagagtgggattctctccattgttattattggggttattgggaccattcccgttgctgcgagtattcaccatctggcatggacagggcacaagaagagaaaccggggaaaactacttaggacagagaattactttaacttttattgatcttaactgagttttattattacaaactgaagactctcacacctctaaactcaccaacttcctaacactcaaaagcaaacaaacgcatgcacttacatcccaccactgatgtaaatcacatgcaagacccacacacacaaccaaacttaaagcaagcaaactaacacaacgatctaagacaacgacttaacaagtcactctagttcttccaagcatcggaggtcgattgaaggttcgttcggctcgtcttcatcatcttgagttgctacccactcaatcttggaatggttgcgcttggattcttcttcttcatcatcacttatgatgatgactggaggatctgctaaggctggggcaacttctttctccaccacacggacctttggcgccaattgatagcgagggacaaatagagctctcttccttgcggtaagacgaaccctggccttctgcggcggcgcttctcccttcaatgcggctagttccttctccaaacgatccaccttgtcttctagcttgcaaatcttaccacgattccggtcttcacgatcttgagccgctaacacagtctccgcacgactttcatccatagcccacagcatctcaaccaaatgccttatggtagcatcattctcaattccttcagtctcaaggtagctgccacggtcacttccctgtggttgacgagggtggtagcgatactcagtgtcggccaactgatcactgtagcgatcacggagctctcctatggcgatccttgccacctcctgacatgcatggatgtagtttcttcctccagcttcgaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaatccctcgacaccaaacaggtactcaggcttgtagcgcggcatctaaatacaagtgaaaggagagagttaagacatctatccaattaacagcacaagtttttggattaatttgaataaagtttagaaattcaaagtaaaaggtatgtaaataaagtaaaccaagcttgcaagatgagttgaaatagttgaaaacaagtttacaaattttgtacttttgaataacaggtttcaaaagaaatgaaggagaattttaaaatcatcatgctaaatttattttattgcagcaagattaaataaaacaatattgtaaaacttttgctgataaatgagccattagtacagtaatagatgtacagtactaataacactggaataaattttgaatgagaaccattaaaagagattatgaagtgcatgtgccattagtttggtttaattaaaagagagagggaggagaacagttctacttttccaatattttagagggcttctatgggtaaccatttggcataacctagggtcaaggaggctctgataccaacttgtcacgcccggaatttctatccaaaattccaaacgcttaaatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaactaaataaacggcgcagacggctccactccacaggcagcttgaccaaggctacacctaatcctccacaccatcagcctcattgtagaactcttcctctgatgaatgattgcaaggtgagtatatgacatactcagcaagtcacgcagcaaatatgcaagtgcacaggataacaaaggatggcgtaatagggatccatttgcaaaaacagcatttagc

SEQ ID NO: 54548 - DNA, 876 bp, Oryza sativa
aggacgacgcggcgaacacaccggtgaccaaaacggcggcggaagaacgacaaacgacgacggcgacgaggaggaaacggcggaaaccttcgggttgacgacggcgacgaagctccggcgatctccggcgacggcgaaggggcggacgaggacggcgatgcgacggcgaacacgacggcggccttcccgagcgacggcgacggctgaaacgacggcggcgcacggctggagcggcggcagcgacggcaaagctagggcacacggcgctagagctcttccggcgacgagaggcgaaggcgagggtggcggcgggtagaggagacaccgggggtccttttaaaggggctcggaggcggcggcaaaggcccacggcggccggcgacgaggaaggaaagatcaggaagaacgaatccgagacgaactcgaatccaactctttccaaaacgatttagccaaagattccaaaggagaaaaggtagaggagatcccgaggatcatttcccctctatcaattcggccggagaaggaaaggaacggccggatttggaaggagacggcggcggcggcgcgctagggttcggccgggcgacggcggctcggggaagacgaacctgacaggtgggacccacctgtcagcgaccgaacgcacgcgcgcggcggctgcggactgggccggactgggccgaggagagagagaagagaggttttgggccgtgtcacgtcctgataaattcatcccgaattaaaaatcattctctaaaaggaataatagaattaattaaaattcgaaaagaaattggcaaacactaaaaatacgtacaagaaaaattcaaatgtgacccggagaatttttgttaaattctccttggtctaaaa

SEQ ID NO: 54549 - DNA, 3756 bp, Oryza sativa
cagcctgttcaaggtcgcagggacgcttcagtccgcagcgtctgtgcttcaactgcttcgagcccgggcactttgcggataaatgcccaaagccaaggcgtcagcaaggccaagcgcctccccgctccaacaacggtggcaaggatgtcattcggggtcgtgtgaatcacgtgacggccgaggacgtgctgacaactccagacgtcatcgttggtacgttcctcgttcattccatccctgctacaattttgttcgactctggagcttcccactcgtttatatctgtgccattcgtggggagaaatcagttgggggtagaaaggcttagaaaccctctgcttatcaccacccctggaggggttatgacagcaaagtattatagccctgccgttcctatagaaattcaggggattccttttccctcggatctgattctgctagacaccaagaatttggatgtgatccttgggatgaattggttggcccaattccaaggggtagtggattgcgcgaggcgcactgtcactctgtaccgagggccagaacaaccggttgttttctttgcacctccaacctctgtcagaagttcagaacttcatcagataggactgtcagaaatccccatagtcagagagttcggagacgtgtttccggaagaactacctggtatgccgcccaagcgagagattgagttccggatagatcttgctccaggaaccactcctctgtacaagcgaccctaccgtatggcagcaaatgaactggccgaagtaaagaaacagttggaagagttgaaagaaaaggggtacatacgtccgagtacttccccatggggtgctcctgtgatttttgtggagaagaaagacaaaacgaagaggatgtgcgttgactacagagctctcaatgaagtcaccatcaaaaacaagtaccctcttcctcggatcgatgatctgttcgatcagcttaaaggtgccactgtattctccaagattgatcttcgttccggatatcaccaattacgtattcgggaagaagatattccgaagaccgcattcactacgcgatatggactgtatgaattcacggtgatgtcgttcggcttgaccaatgctcctgccttcttcatgaacttgatgaacaaagtgttcatggaatacttggataagtttgttgtggttttcattgatgacattctgatatactcacaatcagaggaagaccatcagcaccatctccgtttggtattgggaaagttgcgggaacatcaattgtatgccaagcttagcaagtgtgagttctggttgtccgaagtcaaattcttagggcacgtgatatctgctaaaggagttgctgtggatcccgaaacagtgaccgccgtcaccgattggaagcaacctaagacagtcactcaaatccgcagtttcttaggtttggcaggatactaccggagattcatcgagaacttctccaaaatcgctcgacccatgacacagttgttgaagaaagaagagaagtttgtgtggagcccgcaatgcgagaaggcgttccaaactctcaaagaaaagctggtttcctcgccagtgttaatcttgccggatactcgcaaggatttcatggtgtattgtgatgcttcgcgccaaggattggggtgcgtgctcatgcaggacggtcatgtggtagcctatgcctcacgccagctacgacctcatgaaggcaactaccctacacatgacttggagttagcagcggtggttcatgctctaaaaatctggcggcactatctcattgggaaccgctgtgaaatatatactgatcataagagtttgaaatacatcttcactcagtcagatctgaaccttcggcaaaggagatggttagaactcatcaaggattatgatgtgggaatacactatcatcctggtaaggccaacgtggttgccgacgctctaagtcgaaatagccactgcaacactctcaacgtccgaggcattccacccgagcttaatcaacagatggaagccctgaacctaagcatagttggtcgcggattcttggctgcgttagaagccaagcccaccttgctcgatcaaatccgtgaggctcagaagaatgatccggacatgcatggactcctcaagaatatgaaacagggtaaagccgctggtttcacagaggatgaacacggaactctatggaacggaaatcgggtatgcgttcccgataacagagaacttaaacagctgatacttcaggaagctcacgaaagtccttattccattcacccgggcagtaccaagatgtacttagacttgaaggagaaatactggtgggtcagcatgaagcgggaaattgcagagtttgtggctctatgtgatgtgtgccagcgtgtcaaggcagaacaccaacgaccggccggacttctccaacctctccaagtgccagaatggaagtgggatgaaattgggatggatttcatcaccggacttccaaaaacccaaggtggatatgattctatatgggtaattgtggatcgactaacaaaggtagctcgattcattcctgtgaagaccacttatggagggaacaaactagcggagctctacttcgctaggatcgtgagtctccatggcgttcccaagaaaatcgtatctgataggggaagccaattcacctctcacttttggaagaagctccaagaagagctgggtactcgattgaatttcagcaccgcctatcacccgcagacagatggacagaccgagcgtctaaatcagatcctagaagatatgcttcgcgcatgtgtactagatttcgggaagacttgggataagagtctcccctatgccgagttctcctacaataacagctatcaagccagcatacaaatggcaccttatgaagcgttgtacgggcgcaaatgccgaacaccgctattgtgggaccaagttggggaaagccaagtgttcgggactgatatcctgagagaagctgaagctaaagtcagaatcattcgggataacttaaaggtggcacagtctcggcagaaaagttatgccgataaccgtcgccgtgatctggaatttgcagtggatgactttgtgtatcttcaggtcacgccattgcgaggtgtgcacaggtttcagacaaaagggaagcttgcacctcggtatgtgggtcctttccgcatcattgctcgacgcggagaagtcgcttaccagttggagctgcccgcctccttgggcaacgtgcatgatgtgtttcatgtgtctcaactcaagaaatgtctccgagtgccatccgagcaagccgactcagagcaaattgaagttcgcgaagacttgacctatgtggagaagccagtgaaaatcctggacgccatggagcgcaggaccaggaaccgagtaatccgtttttgcaaggtccagtggagcaaccacgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaattcatcctcaaaattgtgcaaaagaataagtaaaattcatgtgaaagcctccaacaattaaaatgtgcaaagataaaagtcaaatgaggcttgtaggatttttgtatatttcctaaaagcctaaaatgcttaaataaattttagtggaattttcagagcacaaataataagtgaaaaga

SEQ ID NO: 54550 - DNA, 2415 bp, Oryza sativa
attttatttacaatattagttaaaacagattttgctagatttggttatttgttcctaatggtagttgttgacaaaatgataatcgtaatttgatattcgtaactcattcaccatttgcatttcagattccttgagttacaaactgctggtgtggcgccatgcaaagtcatagaagtacatacctgcctaccttctttttgacatttcctgatgttacttgccgtcttggcctaccatggcccattgctgtggaaggcatatatcatgatatcggttcatactcagcaatcccttattgtctaaagttggacagtttttgcaaacatatttgcatttcttttagaaacacagtacaaacgcagacactcacaacacgcgcactgcgcacactcacccctatgatcacacacacgcacactctatccctatgattacctttggaagactagaccaacatatctcgagattgatgaagtcatcacggaggcacggacgccttgctgtcaacgggtacgttgcctactactgaaagaataatttgtcctaaatacgagaaccgggtgggttggttccaccacaaggattttttttttttttgctgtcaataagatggctgcgtgctttattaatatgtgtccaatgatgcctatcacgtgtggtcaaaattaagctgaaagccatactcttttgaactctgagtactagattacctcattacttgactcttccctgatgatgataaatcagggtcaatcagcaatctggtagcattatgatattatcaacttggtgtaattttcttccctttcttgattattccgcgagaaaaatgatgaatctgctagctttatgcgacagattttcaatcaacaaactcatcagtctaaattcttttggtttttttatatcaagcacggtgatcactaatcagatatcactttcagggggttgcttgcttccatgctgtggttcaaaggattcggtgttaggttacaggtaagatgcgttggttggcctgaattcttcgcgcgtgcgcttctgacagcgtcatctgggcatgggattggatcagatttccacagtcaccatttcactcatgccgattattataatccgtaacggtttattaataaccaaaaaagtaatttgtgaataaaaattttatatatgtattctactattcttagcgatttaaaagcaaatactggaaaataaactaagatgaaaaaaaatcccaaaatcaactctaaaataaagttttataattcatttttcgctgcggcttataagctgaagggtaaacgatagagttgttcacgctttcaacctgaagaaatcattcatggcattgatgcttttccttccgtccatgcgtaaacgatagagttgttcacgctttcaacctgaagaaaatattttcttagcttcctgatcattcatggcattgatgctttcccttcagtccatgcgtaagatagaaggggatctgtgcacgggtgttgtgtcaagttaggtgcaagactgaagacttgcaggacagtgaccccttgtctcacattctgaatttctgatgagtgaagtgcatctggtacaagagtggtttgttaaagtactaatcaagttgtgccattttgtaattcttttcgtaatatgatcacaaacctttacacttggcaaccccagtttgaccaatttgccaattgggttaaaggacggagattaattgtaaacgttaacaacgtaaagttcaagcttgaaattactttgagtttgtcaatatatttcaaattagttacatacagctattgcttttggagctttggtagttattaacagtatatatcactaataaaaaggtcaaaaggtcgatttaatacaattcatcgaatcaaattatgtttgtgtataaaaaccatgttatcaaatcatatcactaggcaccatttaagtacatactctgttttgcatgttatcacaagataacctagcttgtagagtttgtacttctagaagtgtgatctttgtgtttccaaaagcgagatcccatgcacactattgtcatatatttgtacctaaaaattgaccttaaattgggtggattgccaacgccaagtgggttaagaaaaaaaaggaaatgtgaacatgtatactcttttggttgctttccgtttaacttgagcagttcagataacattagggcgaaaatgcactgaggatcacattgatatggatgaaacatctggaaaagtaatctctatggtagtgtttggtttggggaccaagtgggatgggttagacctatccctttttttaggatgggatggttccggttgtgtgtttggtttgtggtataggatggttatagttttttgtttggtagaagggattgaggtgggatgggatggacagtgtttc

SEQ ID NO: 54551 - DNA, 6427 bp, Oryza sativa
caggcgggggagggatgggtggccgtggcggagtcgagtgggaggcggcgggagctaacgacgagcggcggcggccggtcgcggcgaagcggaggcgggcgcggagacgaggcgaggagcagtcgagcggcgggggccggtcgcggatgaagcggcggatgaagcggcggacgcggcggagagaacaggcggaggaggacggagcggcgccgggggagggagcaggcggaggagggacgggcggccgtggcggcgccgcggcggagccgagcgggagcagacgccgttctctccgtcgaagtgggatggattggtccggccgattttggcggaccgtttcgtcccggatctgggaggaatattcctctccagggaccatcccatcccactcacctctcaaccaaacacctctaaaagtgggttcatcccatcccatcccatcccatcctctcaaccaaacactacctatgctatcgcggcaattgttcaaagtcccgaagaaaaaccagatttactaacggattatctcatctaattgttggcttttctataactttgacgtgtggtcttttttctttagttaactgatgttgcattgtggtagttagaaatgcttcatatgaaagccttttctcgttaaaaaaaaaactagtggcagtggtggtcgtgattatttttttttccgattacacggaagatgcacattactagccgagtgtgtctctcaagatgttgaagaggccaatggcaaacttctaacgtcacaacgaattattgaaagccacccatcttctcgatatgatgttttaataaaatactcctaaaggtgtttcacaaaaaaaaaaactcctaaatttttgttaatattgcacaagagtctttccacaccacttttatctaatgtagaaaggcttaagatgatcaaatgggcgtgaatatgaggtatgagcttatgttaagattgttcttgcaaaaataaatgttaagattgtgtttttcaaacactatcattctatcaagttcttccctgtaagaaaggtggtgtttgatgcgaacagaaagaaaacccactcattcgttccatgcagcaagtatgattactttttatactatagcgagcgcccaggtttatatctattttacaaaacgattttgctaaaacatatggcgaagaatttttgggagaatatcagtccatttcttgtctgtttgatctgatgtgggcctcatttttcggcctaacctagcaaatgggcctttagcaagttaggcccagtataacttctgtcagaaaaaaatgggcatttgcaaatttaccaccggttttttaatattgtaaagatgccactcgaatgacagttctagtggcatttttgcaattttctagtggtaaatttgaattgcctaaaaaaagggtcaacttggcaggcctacagatagttggaccttttgaagcaccctaacgaggggccgcctaatgggagccccccccatccccctatacactgctctcttccttcctccaccccttcttctcttcctaatacaccataaatttaaaaaaaataaaaaacacaaagttgaaaaaacttatgtatagaaatactatataaaaaaatttgaattcaaattcaaattaaaaacaggtatgtaaactttgggtctataaactaatatttgaattcaaattcaaatttgaattggatatgtaaacttttgatttataaactttggatctaaaacttttaggtgtataaactttagatgtatagaaatactatatataaaaaatatttgaattcaaattcaaatttgaatcggatataattcaaattcaaatttgaatcgggtatgtaaacttttgacttataaactttgggtctataaactttaggtgtataaactttagatgtatagaaatactatatataaaaaatatttgaattcaaatttaaatttgaatcggatatataaatttttgatttataaactttaggtctttaaactttagatgtgtaaacttaaggtgtacaaattttagttgcataaatttactaaaataggaaagtaatgcggtgccaaaaaaggaaaccacgtggaggagaggggggcgccctaggggtgatcgccccttagcaatctcgccctaatgactacttcctctgttttctattataaaactttctatcattgccaacattcatatatatgtcaatgaatctagacatatatgtttgcctagattcattaacatctatagggatatggacaatgctagaatgtcttataacctgaaaatgaaaaggaggtagtataaaaaaatctaaactatttaagagagattttatttatgagaaaaggtgcaacagccaaaagcttctcaaacaggtgttccgacaatgcaatggcttgtgtggtttggttccaaaacttagccctgctaaaacatttataacttcaatagtaacttatacgtattcgaattgaagtcaatgtgtgccagattaatataacttgagaaaccttgccttactatgccaaaacttaagcttttcacattaccaatattttgtaggctaccaatccaacatgccctaaatacacttcctgcaatgcaactctcagtgtatttttcaattgatatgattgtgttttctattcaaagtcatacaagaaatacagttccttgattggtatatatgctaaagacggatgagcgacatacacaatctacccctccatttaaaaatatattaacttttcactacacttatctagatttgtagctaaaaattgttatatctagattcatagctaaaaattgctatattttaggatagagggagtagcaaacaatatatggcacgtgctaaaatgtgtactccctccgtccaacaaaagataaaccctgggttttcgtgtctaacatttgattgtccgtcttatatgaaaattttttataattagtattttcattgttgttagatgataaaacatgattaatactttatgcgtgacttttcattttaatttttttaaataagacagacggttaaacgttagacacggaaactcagggtttgtctctttttttggacggagggagtacttgataccatttatattaagggttaattagatacataccattaaaaatttaccagttttaaagtatgccattactatttacgtatttataacgatgacattgttgtttattgtaatctcaatgataccattaagatacgtattaacgaaaacactctcatcttctacctccctctcttccctcatcctgtcatctttctctgctcatgctgctgctgctgctctagatcgattgaagatggatggcaaggacgcttgctgcttctgctagctcgacaggaggccaaaaatggctgtgtgctgcaccggcggaaaggggacccacggcgacgagcggcggtgcttacgatgcaaagacctagatctagagccgctgcggacggagcggcttgccattgtggacgacgacggcggcgcctgggcgccgaagacctgatggaggctcgatctgcggctgctggttgccacgggctgcttgctgcttgcttgaagatgaaggggcgaatgagcttgctggggctagtttgctgcttggagaccacgacgaagaaaaagactcaaatcccatcgctggtgatgcctccctattgctccccgactgggtcgagccgtgcgcatctgccgtgggaattcggagcgccagacagcactgcgcaggccgttgtgccaaatgaccttgtcagatgcagtgatggggaagatgaacagtggagagaggagaggaagaaggaagatgggggtaattctgcccaaaaagtttaggaaatataataaaggggcaagtagtggcatatactcactccgtcctataatataagggattttttttacttgtactgtttggccactcgtcttattaaaaaaaaattgaaattattatttatttttttgacttactttattatccaaagtactttaaacacaatttttcattttttatatttgcacaaattttttgaataagacgaatggtcaaacaatgcaaataaaaactcaaaatcctttatattatggggcgaagggagtaccaaataaccacgaaattataatgctatggttacaaatagttgaatactaatggtatattttaaaaccaacaaatttataatagcatgaacccttatattaaaccctagttgtccatagctaatcttgtgatgattctaaagagttcatgaatgcgtctttacttaacataacatgggccaacttttatttggagtgtctctacgtgggcctaaaacaatagtggtttcaggccgaaaccacattgtcattaattaagcgtatcgattgttgttttgcctctaaaaaatcgtactcctagtatatctttttctgacgataaacagaatgcggttacccttggtacccactaaaactaaaactcaacgtgcaagcatgccacatcatcacctactaataattactattctagcccatttaaaatcccatgcaagcatgccacatcttcactcactagcaattactagtctagcctattttaaatctcatacaagcatgacatatcatctataatattatattatagagatcaacaagtatgtgtcaaatcatcttcctcacattattttctcagcatttcatctttcatcatttcgacaatatttaacatatactcatccgtgaatcccgcagcaaagcacggggtatcacctagtataatagatgattctccgtgttttgcttggagaattattaagtaatctttaatatatttctttaaagagtaaacatgatattatttattaacaacaaataaaactgtttatcaagccatatttgaagataaataaatttaatatagattgcaaataaaatattaggctattggccaatataagcatcgcaataagcgaaatataggaaaaatgatgaaaagtatattagtaatactaatcataaaacaaactaaataatactccacgctttgatgcagaatatatggatgaatatatgttaagtattataaaagtgatgatagattcgttaaaatattatgaacatgatatgagaggtgatgattagatatgtttgcatgttaatttgtagaattcaataaattaagatgatattgcattcttgcatgagttttttgataaataattattactagtggatgataaattgatgatgtggtatatttacatattgagctttaaatttagtggcttgtaatttttataaaaggtatagataaatatggaagtttatgcactagtgaagacagattgtgccagcgaatgcaggttttcgatcataaaggtcctccaagaaaaaggttttataaactcgattacctaaagattataattaagcttactcagcatatcaaaaggaagtacaatacgtgcttccaagaacactactacataaacgatttttctgtataagaatcctatagtttgcagagggaccgtatctggtcccatttaagaaaattgacttgcatttttgcagattttttttaagaattaatattattttaatggaaaatcgcaaaagtagaggccatccagggaaatcgcgaatttagaggcctgtcgaactggtgtagttcgataggcccctatcgaacggtgagcgttcgactggaccctgtcgatgtgcctatcgaacagagggagttcgacagggcccaccacccggcgccgcgcggcctgtcgaacagggagcgttcgataggtccctccaccgcccctatcgaacaatgggctttcgacaggcccttttaaaccgcgtgcgcctaggccgcgttgcttcttcgtttttctctagaccacatcgccagccgccgccgagagtcgccactgtgtcgctgtcggcgccggagggagtaaggggaggggctagcaggccggagaggaggcgccggccgggaggaaagggttggcgacggcctccaccagtgaagttaaggtatacattactaatccctaagtacgaggcatatgaaagtttaataaaaaatggcttgtgatttgttaattgtttcgcattgttcaatgttagtacatatgatttgttagcatttgtcattgctaaatattagtagagatatttaagtaatcgtatggttaaattagttgttagttaatacatgttattaatttgttgtgtgctaaaataggtagaaggtactatattttatttggattattaaagtagttgtttgtcaataatagttgtaagttagtacatggcaatgtagtataaattgtaatagggtaattatcgaaggcttaaatgattaaacgttagacaatttgtcatgttttatcaggatgggctgcaggaa

SEQ ID NO: 54552 - DNA, 1182 bp, Oryza sativa
tgtccaaaaatttagtagggaacattttggttgtgatccaaaatgccccttaatttaccaaaaagtgattaaatttttcatttcgaatcaaaggggcagctaagtccctgtttagaagagctcttgatattaattttccttatcccaactcctaatcttcaaggaattatatcctcaaataatcaggaccagatgtacaactatttggctatcagatttataccagatcctcaaggacaggattaaaaggaattggccataattggatgaatgaaatttttagaactatagataatgtgaggaactaatattgtaaaacagatggtttagactgaaatttattacaaaacttaaatatcatggcattgaaaaacacagatttaacgccttggcatgtacctcactagctaaatgtaggagctataagtagttgttgcctcacatctataacactaccttgcactatactcccttggtaaaaaaacacttttggatttgaatatggacgtagcatatgtccagattcaaatccagaaaatgttccttttttttaacagatagagtatatgcttgcgggtggcacccttgtcatgcactggtgcattggcacacccttgcatgagagaaaatataagaagaggtatagatggagtgctaactccaagagtgttacatttatttagggataaggtgagaggagaataaaggaaagaaggagagggtgagccactcttatacaagaagtaaggaaagagaaatagtggtttaaaatgaataaaataaaattatttgcacctaaatctaacatattacatctactgctaagcgagataacagccatcgtcatctccaagagaggtgccacatttggttacccaaatctccatttaaccatccatgccaaaagatttccacctattattgtgccttcgaatatgttgtttcttcatcgccattcaaccattcgtctccctattgttttcctaccttccccgtagtaaaccaagacataggtgaacttaggatatctagttgtgtctctaggacaatgttgccctgccctctttccaccaataccttggacctccttcaattctctagtgatgaagacttttgcctcgatggtgttccctctggctacaaagatcaattctcctccctctttccgtcattgctgcctgt

SEQ ID NO: 54553 - DNA, 5812 bp, Oryza sativa
aaacgattttttatggtgtaggtctatgattttcgctggcggaaaaataccaaaaccgccagcaaaattgtaacgagggagtaaggggcatcgacggctagcgaaaatggatctttgacggtgcccgcgttataccagccgccaacaaaaatatgtctattttcactggcggtcacttaagtgcgccgccagcgaacatggataattttcgctggcggttgtgttatacaaaccggtagggaaaatacagttattttttctggcggcccacttaagcaaccgccagcgaaaatagattttcgttggcggtagaaggaccgcttgcatagatggaccaccatctattaatatggaccacgcggcccaccaccaccaccaccaccaccaccagtccaccacccacccgccccctctctccagctcccctccctcccttctctccctcgcaactctcctccctctcttctccaccgtcgccatccatcctcaccaaccagcctctcctcttctctacccccaccagcactctctcctcctcccaccccacagtaggcggcggcggtttcggcgtggcgatgacgacgcgaggtgggcacgcggcggcgacagtaggcgcggctctcgggcgcctgcgggcagcggctcgcggggaggccggatccgccgccgccggaccacggggagggcggcactgacctcgacaccattgaccgtgctcccgctgctagatttgattttttttttctttttctttttctttttgcatgttgttctagatgatgcgcatgttttgatctgtgtaaatgatgtttgatctgtgttgatgatgattttgtatttcgtgtttaaatttggaaataagcagcgaatctagatgtggatttgaaatttgaaatcaatgaatcaatgggcggctgcatgggtatttacgttggcggctgtgcagctgcatgggtttttttttgggctcaatataaattttcactggcggccgatttaacactgtcttaagcaaacggcagcgaaaatggatttttgctggcggctggcttaagacgaccgccaacgaaaatggatttttgctggcggtcaataaccgctagcgaagatcttgatcttcactggcctttactttgtggcggctgcaaattccaccagcaaaaatctaaaatagccgccacgaaaaatagttttcgtagtaatgtatattatacaaattatctcttaattaataagtatatgacatggctaaaaaggtggcagtcatccctactataaaacttactcttaaaggttactctctccttttctcttctctctcagagttgctgcgtatctgttgcccttgccctaactaatagtagcagcagtaggcatcatctctagctagctagggagacaagcgattatgttaccaacctgaatgtccccggcggccctcccctttcccatccgatcaaaccaaagtgctccagtaattcctgacaataaagcgtaaagccactaataagaaacactccaatgcaagtagtaggcccagatttcctgaagaagcacacaccaatattcaagagaaagatgcatagtactctttaatttgtaaatcaagtattggtggcccctcttattacactgacatatctatatatgttttaggcttagaccatgcagattatcttcatatttttttagttggctttattcttagtccttgatactttcgtaggagaagcaatactatgctccgtgaagctacacttttaaaattggtagccagcgatcttttattctattttggatggcgtagtttctataaaataatgttataaattctacatgttttatattcagtattttagttggatatcatcagagtgagatggagtttgttccatgaccacgtggtttttatgtatctcttctcttgactcgttgaccgtgtgtctgttgatagagttcggggatgtaaattatttcccttattaagaataaattttaggtttaaacacagatactaagtaagcagatgaaaattaaaataagagaagaaaatgtaggtagagaaattatcatattttagaataaatttaaatgttaccaaaattatattgtagggcggataaaatatgaagcatgtatttagagcaagtttaatagtatagccaactgctagctacaaatcatctatagctaatgtaataactaattcatacattagttgcttactatactattaatatctggtcctacctatcatacacacattacgtcttggagtccgtactgcagctgggctacagatctgtagcctgctgctcctcccttttcctttatctttttaaaatatgtttataactggtttatagtctgctattgtatctgctcttaaatacgtatgtattcgtgtacaatagtatacttaagtaggtggagagagagacgacagagcacgcggaatgatagcccgatgatcatgcgcggccaaagcgagcgaatcgatccgagagaaagcagaatgaaataggcaggcagcatacagcagcaaaggcaacaacaatatatatactgtatgagagaaaaagaagggaaaaagattgtgggcgcggcgtacgagaggaggagaggcctgacgccgggaaacaggtcctcctgccggcgggacgacgtaccagtgcactgcagcgcggcaggcagagcgcgtagccaacgcccgcccaacagtggtgttgtgcctggctactgctggctttgctggattttccaccttttggtccttttacaaaaacttattctataaatgaatccaaaaaaacatattctaaaaatgatcatttttgcggtgccaacaatggtcatgatagcgccaatgacattggcactgtccccttcatccctcggtgaaagctaactcactaatgtgaagggaatagcgtaaatgttgttagcgtcgatgacctatttgaaaaataaataaaaaaggacatatttgtaaaaaatggacctatttgaaataattttttttattacaaataggtccttggcacagaatgacagtcactgaggacttatttgtaaatttttattataaacaggtcctttttcaaaaaattacaaattggtcctctgaattagcttccactgaggggctatggggatggtgccaacatcattggcgctatcatgttaggacaaggcgctacgatgttggtgtcacaaaaaggatcatttctaaaatatttttttaaaagataattatcactgtatgagtactaattactcgtatcacaaaatcacttcaatttttttcatattctaccctcaaccgtctttccactcttacctattgtcatggtcgacatcacatatcaatgcaggaggtccgaaacacaccgtgacgcggttggctggaagattgcggcggcaggtgcgtcacaggaagctgagtagcgtgtgtcggacggctacagtacaaggcttgcagattgataagattagcttgagtccgaattttattagcaatcatgttgagatttgtaagcatatttaaaggcaacatctatctatctattaattattatatactaaaaagtccattaaacttcctacaaacgctcttaagccatcatgtgtactcctacaaatacttctaaaccgccacatggcactttaacaaaccagtgggcctaataattttatctattataattttattgaaaaaaacccagtccccccctcccctctcctctcctcccaccatgggtcactaaaagtccattaaacttcctacaaacgctcttaaactgtcacgtgtactcctacaaatactcctaaaccgccacatgacactttaacaaaacaatgtgtctaataattttatctattataattttattgaaaaaaacccatacccccctctcctctcctcccaccatgcgcccaccctttcactagacgtgcttcctccctcccctcctatccaatctcttctttttttatttagttattaaaatttttgaacaataataaatcttaaataaccaaaattttcctatagttatttgttgttgtccattaacaattaaaaaaatataaggtgttctttaacctataagaaatataaaatttttatcgtatcctaaactttgcatatcacttagaattgttatgtaaattagggaaaaattgataatgtagattatacgatcaatttacaaaatatgcataaataaattaagttagatctattattataacaaaaataagaatacgtccatccgtacatgcttcatcttcccctcctatccaatctctctttttttttcctttagttattaaagctcctaaacaataataaatcttaaataaccatatttttttccatattacgttagatcttagtcacaaaataatctaattgtgattaacatcccaaaacataatacctccgttctaaaataccagtatgtttgttgatgaccaaatttggtagctccatgagttggattcgaagttggaaacgaagccgattttggaaaaaagcctgttcgggaaggctaactacgaacggcatcggctgccgctcaaatcggctacgttgatattggctgagtactgggcatgatgtaatcaaaccgacgccgccaatcttgggaaagtggccccgcaatcgtcattgggtgggattaaagctagtcattgggtgggattaaagaccttcatagctattgccacacaaggataggagtcctaagagaggcaattgtatctattaattaggacatttttcttgtttccttagagatattttggtaagggcccacctaaagggatcgttcgtattttaaattatgttagagataagagtcgtgtccagaaaggacttaccatgtactttgggtataaatatagcccgaccccatgtaatcaaacaacgtcagttcaatacacttcagcgcatcgccacccttttacttttcattgttcttttcgacgagtttttgctttcgagttgggctgcatcaggttcgatctccgacaaaaaggtatatcttgtcatggcggcttgcgctctcaggatcagtgcttacatcttcatgacactctaatcacatcttcgcaagctttcgagttatcatatttattgcataatctagatcgatctcgttatctgagcttcatcggctagcctctatcatggaaaatggccgataggctcagccttcgactttgatttaaattatgcggtatatctgccatcttgaatgagctttcatcggttcgattagatcttctgccactcttcacgcttaatgttgcatcggttaggttcgatctattaagtactgtcctgaggccttttatctaatctattctttgactgctaatagagatagtgtcggggtttcagctgatcttacctgatttagtcgttttatcttccttcttggttctaaatcgtctagatttaccccttatatgaagatcccatcctcttgaagtagatcaagctccctagtctctagattaggtcaagcttcctatatttcatttgtgctggtatcttggtataaggtggtatcggagtattagccgatacagattgggttcgctccatcggctatgctatgagcacgcacaatctcttctttggagcatgtttagatatggagcgatttatattgtctcggtgccaacaccgatctatcccagtcgctcgatctaagcatgccccatctaatggattacatgccgctgatatctacagccaatcgagtacaccgaacaatctccaagtttttacttgcctacgccg

SEQ ID NO: 54554 - DNA, 1603 bp, Oryza sativa
atattcgagattcaataaacctatatatgttgtcaagtggtaaagacgaaagtcaacttgcaatatagattaaacacaaacagaataggtcaatctcatgaaataaaataaagctgcatcgtaactttttgaaatcgaaaaaaaaacatgtatccataacatacaccctacatataatcaaagataaccacggctaatctcattggcatataacctatgtatttattgattcattaaagcatataaccaattggagaaattattagattaaaaactcatccttaacaaatcagaaaaaatattcgagttattttacctatagtagcaagctatcgtagggtgctcaactttgtagctaacgaggaagggaaattactatgttacccgcttattaaataagggttaatttgatccgtgccattgccaatatgcctatttagataaatgccattacattcgtctattcgtaattgtgccactcaaattttacaaaattggaaccatgtcatcgtcgtcacgttttccatctcccccctcatctgcaaatgggactcacccatccgattcatctttctttcgccctcacttatcttcatccttccccatctctctatcacggcgaggagtgaacaacgcgggcaggacgggagggggtcggcgacgggcgtacattaagtaaacggtggttgaatggaacaattgtactttagagtcacttatattttgggaaaaattgactcggtttatggtataaataaagacatctatggtatacaagaaaaattgttatttaatttaaaatcaaataaaaataagaaatgctaaatattagaaaagaaagatacatagtataaatgatatatagtttaatttgtagaaaccaactcaattgttgtgacaccatatactttctcataaattcaaaactacacagtttgatttaattttagtttagaattttttatgttgcgtgcgtaactataagaaaatcataactaacttcaaagtaatccctagcaaattggaatatagtcaaaaagtatttcaataaaaatcacccacaaataaattaacattggtaatgaaattttaaacagattaaataaaatacctacgtatgtgcgtgggctaccttcctagttagatggaataaagcaagccaattcaatctgattctctcatctctcattctctgctttctcaagctacccaagccagggccaccaatgtcacattcttatccaattcattcatacgccagggctcataacacctatacaccatttaataaggagacataatagtttttcttcttaaatcataatatgtactaaaaatatataattataattattttaggacggagctagttgaaatctgcgttgtactgtgtaatttaaaaaaaaaagaaatactcaatccgatcctaccaaacccaaaccaaacctgcttcttcagttcttctatcctcttgcaccttatgacaacaagagcatatattggtagtttatctaacccaaccaaatatttacccctatattatactctagcttgatacagtacttcttaccgtccttaattttccaaagccgaattattttga

SEQ ID NO: 54555 - DNA, 3122 bp, Oryza sativa
aaatgtgataaaagatgatgagagagaaagtatgtgtagggaataaagaatatagacaatttgtttattttggattttataaatacttgtttgaataattacatataataattctgaaagaataattagccgtaaatgccacccatgtcaaatctaggatttgaacccgggtgggctggttccaccacaaggaacctagccagttgagctatgctcacttcgctacatataattattgtatgaatggttaattataaaactaagttaatttaaaattaaaataagtacaacatattaaatatttgtttacaatgtaattaaaacatgaataatatgtagaatggatttaataataaagattgtatgaataattatattcaattgttgtatgattatttaatgagtttgtatttcgtggattttatatatttacgatttatatgcattttatgtagatggatcggtaacggatgtacgcggaccggcggtcaaaagagtttattgacggcgtgcattattttttgggtgtggccaatgataaaaagtgtaacggtttcataagctgtccatgcaacaagtacaaaaccagaaggagtattccactgcacgaagtattcatggcaacctgtttcagtgggggttcatgtgtagctacaattgtgaccaataaaggttttataaaatcacacctctatttgaatctcaaccaaaattatctatctggaataatattacagaaagaagcgaagagttagctaccaatcaccttaaccaagaaaaaataattaaaatttcagcgacactatattttaaatttttaatttaatgcgtgccaatatatataggaatgggtcctgtaacatcttaattagtacgtataccataatactcatgttatatataggccactgattataatattcagggtttcctttatggaaaaccaatgatatagggttttcttaaatttactctaagaatttgagtgaacttagggaccatagatatcaactttaaaatgaggttagctaatttatatttaaaaaatgagtaaacttcactccacatccgaggaatgatgtagactacgtgggattaattaattaatgctacttataaattgttaagtaaattgcacatcttttcccatcaatttacttctagtgatgaactaattatttgtgcaacgtttcgatcaagttgggcttcgatttttatttttctttttggcagctgcgaaagtagcgtaagatgtagaatgtggatgcttgaccctcgagcaacgcgtctaagcaacccccccccccccccccaccacattacttaatttctgatatgtatagtaggacgtgactacatatatgaacgttgcgttactccaatttctgatatgtatatatagtaggacaagcaactcaactgtatatgaacttcgtcgtgcattaaattaagtgatcacctcaagtcctcgaagaatattattcgctccgtcagaataaggttataagtgcagtcatgagtttccgtgtctaactttaatcgttcgtcttatttaaatattttttgaaaaacctataagaataagttacgcataaagtactattcatgttttataatctaataacaataaaaatactaatcataaaaaaatttcaaataaaatggacgatcaaagttggatatggaaactcatggttgcgcttattttgggacgaaggtagtacaatggaagtactcctagctagtaactaaatcggatcaggtttaatagtgaaggcaaataagcaaactaatgttatatgtacttactcccatcccaaaatataagtatttttttttacttcaacacggtctttgagatgctactttcatcaacaatgtctacaaaagtaagatattttaaataaaaaagttgcatattgtaatagtttgtttaatgacaaatatcaagtaacatcaaatttacattattgatcttttttatttttttgctattaataatcaaaatttgaaaagtttgacttgccactgttctaaaaatacttatatttaggatgaagggagtacttgataacatagacaacacactacgtctagcagccccaagacactttaataatttcacttcattggtttgcttttaatatattacctctctttctttcctttcacttggagctcatgtgtagagattgtatttcgtatgatggggctgctcattctctccccttaatttttttctccatctgaatttcgtcatatcaccatatgaatttactacggatatgtttggagaccacaaacagtttctctcagaatcaaaaactttcctgagtaattcggtttttatttagatttaaaaatatataattgccgaattaaaaaattctgactagctgtttctcatattaatctaaatctccttcaaacaaatcctatcttatttgttttgagcacgtagaacactaggcgttagtatatggaatggcttgccagcattaaaccgcgcgccgaggtgtcggtgccgcgcgctagcatatagctccagtcctgtgtggatcatcaagcgaatgcgtgtacgtgagaggctgtgactgtgagcaatccaaccacacgcgcaaacatagccgtacgtacgtactgatcatttaaacatgtctacttattatactaacgtataactcgtagtactcattaattcacggatcccaaatgtacattgtatactcgcgttctcaatttttcacccatcctaacacattacacacataccgatatagaaagaatactagaataccctcgttttattaaatcctaattaacacaattattctccaccttatcttcttttaatacatttatattgtactttcacaaacttcaatacaataataattacttaaaaattgagaagaaaaatatcttattttatgacgaacgaaatctgtatgactgtctcagtgttttggattcttagaatatcaaaaattgtgggtattaattgtgtgcaactatatatagtagtaaaactataagtagttttagtatagaaaattgtgccgttaacatagtgtgtgctttcatgtgatattggtttcgatcgctactacagaaagagctat

SEQ ID NO: 54556 - DNA, 9809 bp, Oryza sativa
ccacctccgccggatctgcccgcgggagcgctgatgccaccgccaccgccgcgggagaagcttgggcgcggagggtgaggaggagggggtagaggaccatgggatctgcccgccggaaatgcctctaccggatccgctcgccggaaacgccaccaccgccgcctccgccgaattcgctgtggatccacgggagaaccttggcggaccaccggatccggcccgcgggagccgctgacaccatcgttgccgcctcctctactgccgtcaagggagagacaaaagggggagggggctgggacgagaggggaggagagggagtggccgagagggagagggatgagtgagaggaggtggcgagtgaataaggacgcccccctcacctcccacgtgtgactttagccactcgtgccccggctctttctctctcggctcgtcccatttgataagtgccggttttttttaaaaaaaaggcacccataatacattacaggtgtcggttaattaaaaaccgacactcggtaaattttttttagaaaaccgtcacctataggtaccggttttttggattttcagcctgtggaggtggggaaaacgctataggtgccggttttagctgttccgggacctgtagtgctaatatgtatgtgtgtttttgtagtagtggatatagcttttgaagaatattatataatttattgggaattgattgtcaaagtttaattacgaggaattattggtcacttaatttccattactgacaaatgaaaatgcatctcatgaaagttcaccaagtgaatactccattatacctttgagcataggactgtaaactgctaagagcatctacaacggtctctttaaatccatctctccaaatgttaatttgactaatttgctaaaaaaaaaatagagagccaaatttacctttcacaataaccgcctctccatctaccctctccaatgtgacaatgggtggcacatgtcaatcaatgtacttctttctctctcccacatcatccccccacccaccccacagtccctacccatcacctcaccggtgacgagagcggagaaagggaggacatagaatggagctcgatagacaatggtgaatgaggtgggcagtggagggtggcaggctctgacatggtcgataacaaaggcatgggtggaagtgttgacgacaacgattgtgccgactgtgcatgcagtgcaaagggcccaacaagatttagcgatggtggagccggcacggagacaatgaaggccggctcaaggaggaggagacactcatggccaccccgagcatggaggggtccgctgactgatggggtggaagaccttgacgtgccccgtctccgcccactagacctggtgacagcccgacgtggtggagtgagggcattgtggtggcagagttctagcgagggcaagtcccgtcaccatgatggcaacggagttatggcaacggagagggcgcaacaaggatggggaaggagccaacaaagaatgaagtcggggcagtggagaccgaggtagaccgatggtggggagggcccatccccatgacatagtcatgcctggcgttaacgaggagggatgtgggctagatgacggtggaaggtagggagcttctgtcgacgaccgagggccaaggggagctgggagccagtagcacatcaggggtggccacaggagcttctgccagtagtggaaaacaaagccggaaagatcaatcgttggagctctagaatggtgggtgatgacacaggaagggttgaaatcctatcatgacgccaccatggccatggtctcctgcgatttgtggtaggcgagtggtgaggcctactattgatatggcaaaatggctctctaagtttggccaatgtgcggtgaggtttggccaggttggcaaggctgttggagacatattttcaccaaaattgctaaattttggcttagagagtcattaacaactcagttcgagttgctccaaaggctcctgctcgactactttttgtttaaactaaatgttttaatgttttcgaatacgtgtaatcaaaacatttaaaccttcactcactaatacatatatggggcaaaatttgctatagaacactctagatttgtagcatttgctccataatactttagctttgtggttttgttataagacactatacctttttggaaaaattccatatattcccctaaactcttgatagaagtccgtctaccatcttgaactttaaaaccgggcatccaaccctctaaactttgtaataccattcaaattaccccctaaggtggttttgggtatttgaaagcttaaatgagtggttttgaataatttatatagcatgttcacgtatcctcaatcatcaatcatagatttatatcatacagttatatcatattagttgtcggagtatgaaacttctctagcgaggaagcgagtactccctctttgaagattcaggcaaggggcgagttttgagttcaagtgtaaatcttgtgaaagatgaacatgggggattataaaggtttgggctgcacgaatgtgtaataccctactcctgtgtgtgtggactacagatggagaacgagttacaaactgtggagcttgagcattagtggaagtatttttgctatcaagaatcgaaccctctatccgttggcctagatcctccttttatatttcaaggggagtccatagcaccaatatattgatgtcaaagtggagcctactccattcaatttagtatgttttgtcttgtcaaagtcttttgaaccgaacagggagggatgttctcccttgttggctgacgggcaaggtgccctaaaataaaagaagtgcacttgcccctgctatttcacagggctacctgggtgcgtcgtatagatgcccccaagctcccccattgtcgatgggatgtgtataagacgggttagtatatgttacttcacattaaatgcgaggcttgacgatgaactgttgtttctaccccagatacttgggggccaaggacggattgttgatggtccttaagtaccaaatccgaccaccaatccttgcataaaagcaaatgaaataaaacattagacttagtggtagtggttattactaatcatttccacaagagttgagaaatattcgtttgtaggtgaattatggacgaaaaccacctgccatgtaatgaaatacatctccaaacaattggacacgagtacaaggattggagtgcccacatgtcaatcaaaaccgactacaattgagccaatccacggtacaacatgcagagggcccaccaagaagcctcacaaccgaaggagtggccgggagatgggaccaaggggtcggccaaaccacaaggtcggccgaaccgcctttgtggtctctcacctccaccttcaacgtggacggccctaattcatcccctattatggttgtgggtggaccaacctcgtagccgctttagtaaccatcataggagggctataagaggagctctcacttcactctcacaacacacaacataagtggagtacaactcactttcatatttaggctactctctcgtagagtagaatataggaaaagagtgaggggaagctccaaaaggagtgccctagatgtcgaagttctctctaggggagttctagaggagtgccggggatgtcgacactatctatgctggagtcttgaaggagtaccggagttgtcggcactttctccgatcttgtatctcgacggatgcttcatttatataagtaagtatttgtgattcccttttgtatttacttttcttatttaagatagattctcattattacgggtttgtcacttagtatttataaagaagcaagttcttggctgagtctagagtagtaatcgataacgtaaacatggtgcctagattagatataaccttcgtttgttgtgtgctccatggaaagtgaggtgggcggcaggtggtgacagtcatgtccctcctttgtattccttcacgtttgggtacatcatagagttacagggtagactcaacttggcggaccaggggagagctagtgcccgaaataactaatagagttgtaccttgtaagggttacggataaggcatacatcctatccttagggttacgcattgtacaaatacatatactcgcaagtatacgagaaggttatgttaatcgtaagaaatttagccgaagtataaggaaaccgtccccttgagtagaaggtgttagagtcctattcagaggggatgcagactttggtatctcgtacatgtgaagtcctctccgagttgtacttggaggtcaaggcacttaggggtataagtacaagcccttcatggggtacgtgatcatcgaatcataatctcaccaccagccgtagcagaagcaatctggagggctcgaagacccagccgccgatcgatctcggcaagttgatctagatagcattactcaacggttttgttgttctctattgtaatctctgtgtttctcttcataatctcatataaactaaattaaggcttttaccttacaaggggcctgaactagtataatatttgtcacttgtcttcttgatgtcgtatcgtgtagatccttgctccgcgtaccccaataccctcaaaatacagtctacgggtatcactgtcgacataccttaacttaatattaacatagttaacccgcagtagttctctctattctaagcctctcgtttcattgttgtccttggatgaatcctattcttagactatacacatacgttctctatgattcggtacccttggaatactataaagtgaagggctatagcgcgcggtatttgtgtgcttgcagatttatatatgactgtaacaaataccaacacatatgttccatgctcaggacaggtgtgagggatgccttgaacaactcgtgatggggaccctggtccctatttctccaatattagtattatattaacatccatttgtgtaagtgagaacaacaaaaaaaatagagtcaaaatgaatgattatgtagagattttaacatatatgtgcaattcatatatcacgtaatcaaactcatccaatatatatgtaaattagataaaagccactctgcaaaaccaccttagggttctatataaacaatattatatagtttaagggttgaaagtctggtttgaaaattcaatgtgctaggtggattttcaatcaaagtttagggagtagttagaccttttttttttccttttttgttatttttttaaaaatctctaaccattattttaatacattctctttgagtggggagataaaattttccaaaaaaaaaatttacccttgtacatgaaatctaaaaatatcttacaaaattcaaaacctattccaaattgtgaaaataaaaatatttgggagggcaacataatgagaactgcaaaaaaaaagagtaaatagtgttgaacaacataatgcctagatttcatcaaacacgtcgtattccccttttccaatcattttagaataggttggtacatattactcactccatcttaaaatatactccctccaccctattttaagtacaaccgtgggtttttttttccaaatttaattgtctgtcttatttaattttttttgtaaaaaattaaaaaacataagtcacgcataaagtactattcatattttatcatctaataacaataaaaatactaatcataaaaaaattttaaataagacggacgattaaagttggacacggaaactttgaatgagacaaatccgagcatgtccagattcagtagtaaaatgtatcccatctaatattagggctgtgtttagatccaggggtgtaaagttttggcgtgtcacatcggatatacggacacatatttgaagtattaaacgtagactaataacaaaacaaattatagaatccgcctgtaaactgctagatgaatttattaaccctaattaatctatcattagcaaatgtttgctgtagcaccacattgtcagatcatggagcaattaggcttaaaagattcgtctcgcaatttacacgcaatccgtatagttagttatttttttcgtttatatttaatattccattcatgtatccaaacattcgatgtgatagggtgaaaaattttaccgggggatctaaaagggcctagattgctatattatgagacgaatggagtaataatttttgcattcagaattcattctaagatataataaattttccacctacattctatttccaactaataccaattcttttattttatttttttattaatttttttctcaatcttttatatgtaatttcatcaattttcttaatattcgtgtccggttgaacggagctaataccagtggtaccacgagtacggaggtttatgccaagcatgttcacatgtcagctgtcaaagacgagacgtgtagcttaccttatattaggacggtacgtcgtcctacgtggaatggaagcagagatggacctgtactgtacacagcacaccggagccgattagcagcaggccagtctagtgtactcccttcgtactacgaaaacgaattaaccaaatataacatattcaaatataacatattctaatacgataaatctgtacacacgtatatttagatttataatattaggatatgtcatatctggtaatagattggttttttatagaacggaggaagtaggcggtcagcgctgggcgcatggctaaattggctactcctagtagggtgggtggtccgccgccggccggcgactgctccgccggaaggataccgacacgaccggccaccgcctcaaaagccgcgcgcgcaactccccctaccagctaccagctacagtatttccccatactcgctgctgcgcaagcagttgtactatgcttcgtaggtgcagcccatagggagaatgtctcctcttttttagtcttaatattttaactgctctttgtctctcaaatgtggatcaaattctcatattctaacccatattttttttttcaaattcaaaatcagataagaatggtgccgaattatataccacttatctcattttatgtcccatattatttcctatgtattagatattaactatggagaaacacttaaagtgttaaatagatacaccaagtaaaaaattatacaatattacatttgagcttgtaaaatactccctccatctcaggaaaaactaacttttgaagattaattgtgacaagtatttatccagattcatccctaaaagttgtttcttttggagacggtgggtgtaatgattaacatatcttttattatgtttgtaatgtttgtaggtggagttataatagattgttcatatgtgtttcataacataggatatgagggcatatcctaacccatattttactgcgtttcttttttttcctcccacgttcttcctatgagtctcaggtcgagcggtcggtcggaaaatacccttcccattttcatccatactctccatcctaaaatgtaatagttcttttaactacattatctttccaaccaattacaatattttatctttaaataaatttcacaaaactacagatactttggttaaattatcacaaaactatagatttaagaagatgtatcacaaaactacagatttagtactaaatttctcagagaactacagatttaagatagggtattgcaaaactacagatttagtaccaaaattatcacaaaactataggtttagtgtcaattcaatcacaaaacttagacatttataactcaaatataacactagtgctaaggatttaaactccaatagttgtactaaatctatagttttgcgatactccaccttaaatatgtagttctctgagaattttagtgttaaatatgtagttttatgaaacatctccttaaatctgtagttttgtgataatttgactgaagtatttgtagttttgtaaaatttactcttttatcttttaatttcctcacttactttagtttcttaaccaatcatagttctttttcatttaattttatcgatttttttaaaacctagtttgagacggagatactagcttggtagtattatttggcaccgtaaaacttgtttagcgcgtcccgtttcgctgtttttttttctccttggtctttagtgtcgaccttagttttttttttttttaccttaataggaccttccggtttatttgcacctggaagatcgaagaaggccctgctgcctggtcgtacgagcacgacatgttttggtacgagtaataatctgttgttgcctgctcgtacggcgtgtgtaggagtaataatctgttaagaggtaactgttactagtaattctgtccactggattaggaccaaattaccacacctgacgaagacacaaatctcttttatacaggtttagtattaattagtactcgtaggacataatatacaaaaatacctacctctaatacttatccccgttattatagaatcatatttttttctttatttttaatccactctttattttttttctatatgtgcctcagggtggctcattctcttgtccagagcgtttaataatcttcaagtcccatttacaatgcacatattctacagaaatcgattaggtttttatctggagcaattttaatcctacttagagcttacaaacttattatagtcgtcatgataattatagttttatataaaataaccgcaaaaaatatacattcagaacaacatcaatatttctcacacgatgacacggataagaagaaaagaaacctactcctaagggcatgtccaacaaaaggagcacccccaacatcccacatgagcaaaagtgatgaaggaccagactagggatatgcctcacattgtaagccataccatctcatttttacaattcagcacctgtcagtcggtcacattttgtatttaaacccttggattatttttattcacatataagtccaatatttcaagtataccccccagaaatcataaacatataaaaacatcaacccctcctctcctcaccatatttccccaatttctccggcggtctcttccccggcttcgcctctctctccctgcacctcccctccccgatggcgccgcctctccccggcccggccttctctccccatcaccggatcaagcggcggtggtggcggatcgaggcggctgctgcagatccacgcagcggcggccgggatcgagacggtggccgcggatccacgcggcggcgaccgggatcgacgcggtggccgacccatcgacatggcggtgcttggtatcgatgcggcgatggccaggaccacatcccatcaatctccgatgcgccgctgcacttcttctcccccaccggttagcctcgagctcgccggatccacacggcaacgacggcctcgaccttgactgtgatggcaatggcgcgggagctcgagttgatggcgagctggagcgacggcatggggcgacacagctacccaacacgcatcctggtcgattcctccgagcaaaaatgcgatgcctctgagaagggcgcgtggacctccagcagcattcgcgcacccctacagggatgcggctccttccgaggtgacgtgaatattcgctttcagaggtgtgagaccacgctccagggtggagcgctaggcatgccctaacatgtcttctcttgaattatgaaaaaaaaatttacagggtgatcatcatctcaatatgctcggtcatcactggcttatatagctgtgggccaccggatttcgcgaattccattttcca

SEQ ID NO: 54557 - DNA, 2899 bp, Oryza sativa
ggctctcctcctcctcctcttgccttctcttcttcttgttcttgcccaatcctagtagaagcgcctaacttgtcgtttgctgtggcttgggttttgagagccggaggaggcaggattgatttttccatgattgggttttcttgattgattggcgcctgctgctgcggtgcggttggtccaagaaccgggatttcccggcgcggaatccggtcatccaagaggtgagatgatctttctttccttgccctgcttctctcgcggttctttaggcgttcttggcgtttctgttcttcaattattattattactatttgttaattttgaagaagtggagcgggattgttcgcctgttcgttgcttttggcgagtgtagaatcctgaaaattttaatgaggtggatgtgagagtctgttctgttggtggtgatttttgtcccggccgtgaagaacaaccgctgctctactgggtggttcttgatttggttttggtccgttctgccagtgttgcttgttctttctcaactgcgaggtgtgagcatggcgttaaattccatcttttagtgtttatcctctaaatttctgaatttttgggggcggttggatggttacactccatcccgtatttgagggcaaagacaacttctatgttaaattctgttttgtttctctgtcaattggtcagtcagtataaatttggcccgttcttcacgccagtgaggcgaaaattgttcaatcggttcaatcttcagagaatttctttatggaaaaatcacaacttccgattagtggatcaagtctctttctttgcggtttttcccctgcaaatttttatgtcaagttttgaggcggtagcagcagcagtcgttttcagcatagaaatatgcacattggaggtatcgaatattgtttaatttgtttggtagttttgctgaggatattcacccaagaacatagtcttcccggtcagaaaaaataatctgatatattagtggcagtcctcttctgaagtcatctcagctgaaatctagcctgtttttcttgcgggtattttgtcgctggagttttaatttagaagtttaaattaaagttaaggttgtttatatatatacgcttattgctcctcaccaattagtacagtgaattaacaagccttaatttctttattaatctgatatacattgggggtgaactgctaaactctggtcaaaggctgcttgcctgaccacacacttctttttttctgcaacttgtgacaggtcaagtagtgcatgttacacggtttcttccgagtggtgcaagaactagaccttgtttaggcttaacgtctgatttgtttttttttaacttagaaattaagctacactaaaatacctagtagtagcatgtttttggttttggtcggttgcacattgtggtgagacaggaagtgcataacacttttccattattagaaaaagattaggttgtttttggatgatttccttgattttgggggtgctaaatagtagtagtgctgtttgattacatttcgtcaaaagtacttttttgacctgccttttgctgtgccatggccgatagccgtgcagggtttgtctgggctttatcagtgcacatatttttatggttctttaatctgtggttactctctgctagtggtttattacccagctgtaatcactgttcatagcgtggagcgttttgttaatgcctatttaatggagtgattcattttactttcctgccatgtcttggtaactgcaagccagatgtagtagtatattaaaagtttcccctcctagttttgctggggaccaagaacatgtccagcttgtctaaataccaaaagaagtcttcccttgcaaagagagtggaagtgtgttttgcactctgaaagtctagctggcatattctcatgatacttttctcaatttctactccattccaggtgcatctgaatagataagaagagaacataatctttgggcattctctgtggttgatctctgaaaaaggtatcaaacagcctgcaaattaggtctcctgctctttccatcaaaatgtcaggtatcattttttttcttatcttatttatatatttgtgatgggttgctgatgaaatggttgctcattagtttactaatgggtgctattgtgctttgtgtgtaaagttcggcgccgatcagagagtatggagggcctgttctcgtttgacgagaggaaagatcgaaggtcagatgtggagaactcggaggacgagcggagaaggctatccattgggtcactcaagaagaaggcactgaatgcatcaaacaagctaacacattcactcaagaagagggggaagagaaaggtggagaatcggccctcattcacaatcgaagatgtcagggatgaagaagaggagcgtgctgtcttttccttccagcaggagctttttagcaggaacttgctgcctgacaagcataacgattaccacatgttgctgaggttggtgttggaacaatgctgaaagattgagagctactgaagcatgcagttgtttgtttctttctttcttcctttctttttttcttttgtgctgaagctctttctagttttatttgcaatatgtgtctaaaagttgtatgccttcattatctctataggtttttgaaggctaggaaatttgacactgagaaagccattcaaatgtgggctgagatgctccagtggaggaaagaattcggcgcagacacaatactagaggtgaggctaaacggctaatgctgctattaattgatacataaaaattgaaaatttaacttcgccagatacttcctgaaggatattcaaatatgttggtccatgtacacattgttttgtttacataaataggagattccatctggcatcttaactag

SEQ ID NO: 54558 - DNA, 7330 bp, Oryza sativa
catggattggcgtatcatatgcatattccatctcactgttttcctgcattgactctccttacacagagacgaagattttgtgcgtaataaagagacctaactccagaattaacaacacatgtcattgagaaataagactcaggagtacatttggcggcaaaattatgcataggacatggttgatgagtgcagacacttggattcggtgtttggattggctcaaagaatgggtggcaggagcccagaaacagcaaaatatcagctccccttctgaatctaagaggcttgtctatccttgatgttagcataggatgttaggatggatggcaaaaagaaatgtagaataggtaaaaatgggaatggatgtgaaacatatgtcattgtctgcatctagaaacataagcatcgagttctctttgccaaacaaattttctttatgtgatcctgtggtatggcaaaattgtaagggaaattgtaagaattatggaaagtgccttgcatcaggaattgagaggcaaagagaaatgtaatcatcaaaatgattacattgtgaaagttgtgtcttctgctctagcaaagggatttgtcagaactgagtgatcactactaattgtttctaattaacctgaaatttcactgcgcaatggaagtttttttttcttttcgctgggctgcgcaatggaagttgagatcaattcatcagtagatatgatagttggacttgtttgatgttcagttgccagttgccaccagtcttctgtagctgtaatgtcatgccatgagttcagttagtaataagactttttatgagagattgtacggtgaatgagcttcccattctgttgtgtcaagaaagtggcaacatgatggcgcagtccttgtctgtcctcgttgcattgcttttacgtacacaatgtgacatcagtcagacatactatctctggcagcgaccgaaaggcacgcaaccctgcaaatgataagtccaaagaggctgcattcacagtctgtgttttcagttcacatttcagtactggtgtatttttcagaactagtccctccatctttgaatatatcaatatagattaaatatactataaatctgaatttatatttaatcgagattgatatattttaagactaacagaatataaccgaagcttcattcattcagagaaccacaactactcccgataggggtgaaaaccgggggggtggggggggggggtgaaaacggtaatggtaattcccggccaaccgacgtttgtttccggtaagggcgagccatatggaaacggaaatggttttgctgttataccgatcgtttctgtatttacgtattcttatggaaattaccgtttcttataatatggtaattaccgtatttctaaatatgatttatagggcatgtctctacttgacccataatttagagattgacggactctttaatcaaatccctaacttgagtgcatggttaaaatgaagttaatttataatttatatagtataagtttgaatttatttatacatataacatacttatgtaaagttaaatatatgttttcatagtttaatgtttccgtatttgttaccggtttacgatctgcaccgacatgtttccgtatgtattgtttcgtttctggttttccaataattccgatatagtttttgtttccgactttaccgtatttgattttgtttccaagaaaaataaggttatggaaatggttgaggctattttgcgatcgtttcagaccattttcctccctagctcccgagtgggtggttgcaatagccctatgtgagagcatttatgaacagtaataatatcttttcaaacttcgaataaaagtttgtccaacaccctaattaaaccgggcgcctaacccatgaacttgggtaaaattcaaaattattctagaaagatatcaatctaaaaacaaacaaattcaaaattattctataaggatatcaatctaaaaacaaacaaattcaaaattattcaagaaggatatcaatctagaaatattatattcaaattaatttcgcttaaaatttcatgttttttagctgggatggcataagaagagactatccaatggtattaagattacaagaaaatttttaattacaacaatagaagcctgtcgaggttgtccgtgcaccggagcgtacgcccagaaagcacgtgctaacctcacaaaacacaagcctgtaagacggggaacctagcaccaacctcaccgctgctatacgtggccaatcaccgccaatgccaacaccgcaccacaagacaaagtcttcaaaaacaatgtctccatggaggttatgaggccaaatataccgtcgctgctcatataggaacctagatatggttgcccatagagatttatgtcaagagaagcaggagggaggcacctcgacaacgtccgggggttatggtaacccataggcatcaccactatcggcccaatgattcgccagtctagacttacacggttacacctgaacccgatacgatccttatccaccatccaccatctcagttacctctatccaaaagtggtagcatgaggcctccaccacaccgaaccgacctcacttcgccagccgatcgaattcaatggggaaaacatataaaagaatcaggaccatctgtagtgcgtcgtccatttgagttaaccagcacgttctcttttagtagcgtgtctatttcgatagggtcatcatcatataagttgaacctttctctcaaaaaattcattgaatttttccgcaaaaatatatacactgaaattcatgggatatgaaacaaaacagagtgtggcgtaccactagtacagaaatcaattttgcaatcggacttttcgcatgagattgggtggcccgcatgcacctagatgtctgtgaacagtatttttttcatgtgggcagcgcaaccacatgcgaacatctcatcttcacatgcggtccaaactagccgaaaccctagcctgccaccacccaaaaaccctagccccaagctgatgtcgtcgttgccgccaccaccacctttgtcatgctcatcgtcgtccaccttgctgcctgccacacacgtgagagaggggaccgctagatccatgagggaggggggccatcgctgccggatccgcgtgggaggaaggctgccgccgtcgatgcgctgctcctccgctggtctcccactcgagcccgccgatggatctgcgtggggggaaggctgccaccgtcgatgcgccgctcctccgccagtctcccattcgagcccaccgcagaccactcgctccagctaccaccgcttcggccgccggagaagagaagggggggaagggagagggagtgggagaggagttatggcgtggagagaagagaaagaaaaaaaggtgtggtgcagagaaagaggagaaggagaaaaaatggtgcggaaaagtgtgtgggcccaagtgctctccatgtagcccgcatgtgaaaatctatttaagagacctgtatgtgaaaatggactcatttttgcatgcgggtatgttaagaggtccgcctgtgaaaattaatttttgtatacgaacgttttaagcaaccgtatgcaaaaatggaatttttttagaactaatattattttaatggaaaatcgcaaaagtagtggccaaccgggggaaatcgcgaatataggggcctgtcgaacgggtgtagttcgatagggcacatatcgaacggccggcgcgtgattgaaaaggcgatcaaacggctgcagttcaacagggcatgtcaaacagtggcatttcgacggggcctgtcgaacaggggcatttcgatagggtgggctgtcgaacaggggcagtgcgacaggcccctgtcgaataccaccagttcgacaggctaagctgtcgaacaacggttgttcgactggtccactcgcccatttttttttaataatatgttgtttgtttcattattgtaatattttatgtgtaaggaaggaaagattattttaatgtttcatgtatagggtttagggttttgataatgtatggtgggaaatattagtatttatttgtttatttaatatattttatgggaaattgtagtatttatttgttggttaaaatatttggattatttagtttcattatttgtatatatttttggtttcatggctttgtcgcaatttatttagtaaggacggataaagaataggaggggatcgaagagattgcagcggatgcacaaatgagcttaatagatgaaaaagagaatgaaacattagctaacacatagataaacataatccattcatgaggcatacaacaacattgtgaggacgtcccaaagcctaggtggtgcaacgctccaaggcatgtcagcgcgaaatatctagatggatggggtctcaaataaagcccaaataaatacggtaaccatccaacctcatcacagaccccgacatgtcttgaagagtgcactacataggctctaagccatcagatatgaaatagaagacacaaccattggaatagccacactagtcatctatgtcatacgcccgtcaaccactcaatggtggcgaccaaaagcgtaccccagagactcgatctcaacaaaggcatattccccggttatctcaaccatttcaaacccatcctcatgtgggactagttgcccaggaatgcaacatagtctcacataaatcatctcaagcatgatatccaaataataagtggttctaagcaataagcataaataatcttaataaggttctaagtagtacttggtgacaagccataaatattggttcatgcggtaagcgtgctacccaaaagcccataggcaaaccgactaggataaatccctagttagaaccatcctagaaatctgcaacatcacaagctgcatcaaactcctcatccaaacagtcattacctgcagcggggtccgagcataaacaagtaatagaaagcaagaaatcagtacattaatcaaattaatgtactggcaagtcggaaacaatcctagcatactacatgttggccatattcaaggataagctgtgtataggttaatttgcataaatgccaattttagttcacaacatgtttcgcaacggaattttataacaatagtatagagtaagtaaaacttgtaatgtgaatgaataaataatacacatctacccctcaaggtagatcatcaccactctccatcatctcatcaccattcaccgaactttacccaagttcacaaacaaaacattccaaccattttccaggttcacaagagtttatcaaaatcacaaattatactcatgacacttcaccatgccgctcatgaccgtgagcacggctaatcgattagttttagactctgcagagtttgtacaacttttaagcccacatgatatggatcgctctagtttttccgatacccgtcggtatcaccacactctacacattgagtgtgatctagaggtcataacggaaccgttacattgtttattgtctagccttgcaccagcacgatgtgtgttttacccacgctactagcaaggtagcgccactaggtagcgggcccacgctttaacctagcgccgtaaggaacccagcccggaatacctcacgaggcacgacaccgttgtattggatagactacccgctaaaatcatcacataccacatatcattaatcaatttcatcatatcacaaaccataggaagttccgataagtggcggtgtgtctcggtatgcccatgcatgtgtatgcagaggcttggttagtgcaaagggttagtgcatgtgctctcatatggtaccagggtgctcaccaagcagagaaacggaggcagcgaggtccagggagcggaggaggtggtggttgttggccaacggcggtaaaactccggcgtcggcgtcgccgggtcaactcaaggcgcgaactgcaacttcgagagtacgggggtgttagagatgagccacagagggtgcatgcacgaggaatccggcggaaactcaccggagcttggtgttgcttcggtggtgaggaacggcggccggagcggtgtcggcggttcgggtggccggcggcgaggacggtgacgcccaccacgtgctcgacagattggtcctagggcaaaaggggtacgggtgagctcagcgtgatgcgtaggtcacattccataggagggaagagagaggaactcaccagggatgcacggcgacaacggctaagtcgccggagccgggtaagacggccgagctctgggcattctgtgcgtggggtgtgttttcttggacttggaacgcgatgtggggagtgtgctgttgcttctggtgctttggcatgggatataaggaagagtggagtgggggagtgagagagagagaggtcgctggtgctttcattgtgttccttgggcatccattgggcatgggggacggtggatgctgtgaggggagagtgggaggctgtcatgtgggtcccagagggtgtggggcccactgtcagtgaaagaaattcgaaaatagccttggaggctgtcaaagagggttgcctgccaaggatctttggaggggattcaaggtggattttgtgcagcaagaaatctgggctagatatcctcttggtcaggggtgatgtggagagtaaatgtgctgaagtggattgggttagaagtctctggtttaggtttgatggagtgatgaacatgtattgacagtgttggttagcagcagttgacagtgcagttatgtcacgcccagaaattctcaaaccagaatttctaagctgaatgtgcattaaatccctgtccaggaccagccagggtacacaaacgacaattgttgacatacagatccacgtcttacaaaaatagaaaagattacaaatgcagcggaaaagaataaaagcgagctaaaccgggaagcttgacttcagcagcgggcggctccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttggaagcagtaaaacagctgtagtaattaatcaatattaaccaaacactgtccaacgctacaccacgttgcaacaggcccaaccaacctcttgaactacaccagttcattaagctaaactaggggtgagactaatcacggtgaatctggttgatcg

SEQ ID NO: 54559 - DNA, 1900 bp, Oryza sativa
acgcgggggagaggcggcgacgtgggagggggacgcgggagcggcgcggcgtgggcgcgggaagagcggaggaggcggcgacgtggcggattcggcggcggttgccgtcggaggcgggtggctggaggaaggggacgacctgacaggtgggccccacctgtcagcgtcccggagagaggaggaaggagaacgggccggcccacaaggggaggccgagcgcgggcgacgggtggagtggactgggccgacggcccaatagagaaaaaggaaggaaaaaaaaaggaaaaagaagaaaggatttttcctgggattaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaagggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaatccgatatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaactggcgttcccctgtctgatcccagaagagcggagtacgacacctccgtccatacagtgcttcaaacggtgccatctgcagactagcttggtaactgttgttgtacgagaactcagcatacggcaagcttttgtcccatgctccaccaaagtcaagcgcacatgctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacataattcttgccaggtagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgattcttcccacttccattctggaatctgaagtggctgtagcaaacctgctggcctttggtgttctgcctttactcgttgacagacgtcacagagtgctacgaactcagctatttcccttctcatgctgacccaccagaacttttctttgaggtcttggtacatcttagtactaccgggatgaatggaatattgagtttgatgagcctcggttagtatcaggtcttttaattccttgttttcgggtacac

SEQ ID NO: 54560 - DNA, 2934 bp, Oryza sativa
ctgctatttcaggatcacttgcttgagctatgcgaacctgctccaccagtgtgggctgtgcctctagggcagccacgaatccgtgctcaactataccaaggttcagatgttccaaatcgcgttgaacctcacaacatagttgctttacccatgcaacattgcagtagctcttcctgctcaaggcatccgcaaccacattagccttgccgggatgataatgtattcccatatcataatctttgatcagctccaaccatcttcgctgtctgagattcaaatcaggttgagtaaagatgtactttagacttttgtgatctgtatatacctcacaacggttactgatgagatagtgccgccaaatctttaaagcatgaacgactgcggccaattccaggtcgtgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccaagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccatgacaaacttgtctagaaattccataaacaccttgttcatcaaattcatgaagaaggcaggtgcgttagtgagtccgaaagacataactgtgcattcgaacaacccgtaccgagtgatgaatgctgtctttggaatatcctcttcgcggatcctcaactggtgatagcctgaccaaaggtctatcttagagaacacagtagctcctttcagctgatcgaacagatcatcaatccttggcaaagggtacttgttcttaatagtgacctcattgagtgcgcggtagtccacgcacatcctcttggttttgtctttcttttccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccatcgtgaaacgaggcttctgactcttcccctggggagtccggaactgagctgccttcctcttacggtttattttgttacagtgctcctcctgacggatagccttatccaccagcttctcaaagtcctcataatctctagagatcaactggttagtcaattcatcatcaagaccagacagaaacttctcctgcttctcggcatcggtacgcacgtcctcaggggcgtagcgcgcgaggaggttgaactcatgcaaatactctataactgttctggttccttgttgcagggaacggaactctctcttctttttgccacaattccgtcgggaacctgtgctttattgaaactatgacgaaactctgtccaagtaaactctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaggtgggcggcttgacacgaagaaattctagcagtttggactgaggaggtggagaaccaaactgcaggttctgctgctgcag

SEQ ID NO: 54561 - DNA, 2511 bp, Oryza sativa
tgaagaagaggcacgcaactcctaattgaggcagtcataccactgacacatgatatcgaccgccgactaacccacaagcaacaaacctaaacacgaaaactagcaagcaaacagactaagaaggcgataaagctaagggtggcgactctgaagcttggagcggcgcttgcgaacgagggataggactgacatctaaagtagacaagggataggaaccaatttatgctcaaatccaaattaaacaaagcaaaagaagactcaaataaataaccgagcaggatgatttttatgcatagaacatttttcatgaactcaaataaagacactaatgcaactaaacaataaattaatgcatagactagttgcatggaaaatgatgcgcataacattgcccccatcgaatatagacacgacctaatgcataaacccccaataaattcccgactgactgtcgaataaactccaactaaaatttttctaaagccctaggctgagctaattttttttttttttttaaaaaaaaaatccgacccgaaagaacgaccaagatttttcccgcaaaccaaagaggcaaaactccaaattttcccgaaacaattccaggtgcaaaaagggcatatgcagatgaaaaaggggttcagagggctcttagggtttccagttggcttgtcctacggtcaaggtcggctctgataccaacttgtcacgcccagaaattctcaaaccagaatttctaagctgaatgtgcattaaatccctgtccaggaccagccagggtacacaaacgacaattgttgacatacagatccacgtcttacaaaaatagaaaagattacaaatgcagcggaaaagaataaaagcgagctaaaccgggaagcttgacttcagcagcgggcggctccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttggaagcagtaaaacagctgtagtaattaatcaatattaaccaaacactgtccaacgctacaccacgttgcaacaggcccaaccaacctcctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaactggtccttaactgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaccaacatctagtcattttgatacccaggttatcaatggcataaggtaaacaataaatggctgagtattaggacccatcccacatgatattgtaaaagaatgcacatttaatagaaatgcgggatatttgtaaattgggtacaatatgatcaaacgtattgcatgacttgcctttctctcgcactgatgagatcacagcaacgtcttcgagaaaccgtggatcgacgaaacggccgaaacctacgcgacaaacaaagcacacaagcaaaacatgctataagactacagaaacaggaaacaaaaccatttttaatggattctttgcatttttcttgatttactgagacttgaatggacttaaacggagctcggatgatttacttatgatttttagaagataaactgtgtttttactaataaagaaaagtccttaattaattattgcgcaattattgccccagggctgacgtcagcgaggggagggggcggcgccgacatgcgggccccactggtcagcgacactaagagagggagagggggcggctggcaagcgggccccactggcagcggcacaaggggagagggaggggtggtccaccggctggtgggccccaccgggcagcggcacagggcgggagaggggcgtggct

SEQ ID NO: 54562 - DNA, 2612 bp, Oryza sativa
ggaagagacgagcggcgatgaccggcgacgcggaggcacggacgggcgccggcgacaccctaggggaagatgggaggcgttaggagaggagacgacgaccacggcggcttgaattgccggccggagatggaggggagggaaaaactcaccggctcgcgaggggagaggtgctccggtgggattccggcgacgcgaggcggcggccgggaaagctcttgcagcggcgaagctaacggcggcggcggtttggcgcggcggcgactctagcggcggcggctcgcggccgaaggcggcggccagcggcggagctcgggtgcgacggcgcgagggcggtagacggcacgggagagcgcggcgagtgcgaaaaaacgagagaggaagacgcggggaacgatttataggcggagggggaggcggtcgtggccgggaacccatcctattgcgccggcgacgtgggaaggtgggggagagagagaggggtgggattcaaattcgaatcccgcccatttgcgaggcgcgcgagggcgggagacgcgggggagaggcggcgacgtgggagggggacgcgggagcggcgcggcgtgggcgcgggaagagcggaggaggcggcgacgtggcggattcggcggcggttgccgtcagaggcgggtggctggaggaaggggacgacctgacaggtgggccccacctgtcagcgtcccggagagaggaggaaggagaacgggccggcccacaaggggaggccgagcgcgggcgacgggtggagtgggctgggccgacggcccaatagagaaaaaggaaggaaaaaaaaaaggaaaaagaagaaaggatttttcctgggattaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaagggggaaaacttcagggcgtgacaagttagcagctgattggatttttggagggagagaagaaagggttagagagtgatccagggtgtgccactcctcagggtgttagaagaaagttagtagaagactttggctgaaaccaaacttcaaaaagaggttttgaaataaattttacagagagagcaagtttgaatctactaagcagttcttttcaggattttggagagattaaaggagatcaacaagttagcaaaccttactgaaaaactctgaaaatttgtgggttgatttctgacatatcaaggtttttttttttagaatttttgtggaagttttggatgcatataattaccagattaattgtttttgtgactctaggcctatcaagatgcatatgatgagatgattaagatccaaatacaattataaccactccccaaccacatcatgcatttaaattaaatttagttctcaggtatacaggcttgggtatgttccaaacataacataacaaaaggccgaactagagcgattaggggttaagcttctctattgaccccttctacgtcgttgtgtgtgtaatgcaacttcgtgatccttcaatctcttatattatgtttgcgtttcagctttagttactcttccgccttcatacgtcgggctgaccatgtcgatccatgaagtaaaagcacacatccttggattcccctgaacaatcaatcaaattagataatgggaaataaatgttatgggaacgcgaagcaaaatgtaaattaataattaagcatgtgacatacaacgaagttgtcgtctatgttgggacagacgaagtaccgcctgccatatgtatcttgtgagaaggacgttgcaacctggcagcgatctctacaactgcatttgggatgatcagaccattcaggtatacctaatggatttgatctccagtgtaagctagcggactaaacctggcgctcgtactccatccacgcttgaatgaattgtgtggttgtcttaggttgagttatcgtcgtatcaatccactttacatagctacatttgcggtcttcttcctgtgtgcagaaattaatgaccgttggcatatgtaggtatatgacagaagtaatgagagtgagtgaaaaattagtggtacttacaacaaaatcatcgtcgacaatgttaggacacacgaagcatctctgtcctagagttcgttgtcgaacggaccttatcacctggcaacggtctccacacctacactctggacgctcccgtcaagtggggagtcccagtggatttacttgccattgtaaggatttggcagtttttcatcgttcgtactcatccttcctccttaggtagtccgataatggttcgctgcatggatatgggcgtgccctgtcacgttgtggattcatcgtatcaacccactcaacgaagtcgcataaactatggtaagtctgaaaattcgagatattgtagacatgtggttagcgatgtatgtattaaacatgtgcaaatgtagagataacaatggattgaacagtt

SEQ ID NO: 54563 - DNA, 1969 bp, Oryza sativa
ccccattaagtatgtggatgcatagagattcacatatacatacgtggtttgctagtttagtcttaattgtgaattagctgtgaagtactcttgtttatattaggatattaatagattactgggtgaccttagaaactgtttgatacttttgatcagtacaagaattatgtgcctccactctaatgatgataattactgataaaaatgtcaatttggtaaagttaataagttatattgacatagcctaatgacccctcctgaatatgcagacttagccacagaaatatattatgttctttcagcaggcagtcacacaaacatactgttaattcttcatggaggcataagccttgacaaaaaaagatgatgagattgaaatggcatgcacgcattttatctccatttcatattgcataacacataaaaaaaactggtagtaaatttccagaataagtgtcaaggcagtaagttgatacaagattaccttttctgggatctgcactaaagaccccatcaacatcagtccagatagtgacctgaccagccttaacaagtgaaccaattatggctgcagagaaatcacttccatctcttttcaaggttgtaggaatgttttcaggtgtactcgcaataaacccagtagcaattattgtctcagctggctgtcgagcgaaccatttctcaagtcgtttctcagattccaaatagtcaggatctacttggttggaacctgtaggatttacaactaaaacttctcgtgtgtccatccaactgcaaggggttccagactgcatagtgtaagatattttggtgtaagtccatgtttttaaaggtataagctaggtaatatttttatatgagcagtgccttctgaatatagtaggtgtatttccatagagattactctaaactaaatgcaaatgcacaaattggttttgttgataataacaacattaaagaaccaaatggtttggtacaagtgtaaaactacacccaaatatttaaaataagctcctatgcacttataaaatagaatatttatttctcatgaataataatgttcagaaaaggagatcgagcactgctagttctatctcaaaaaagaaaggtgcatatagactacattcagctgtggcttgaccggatttccacagaagaaaggatgatccaatgagcaattattactgaagctactgtagtgtaaggaggttctatgcatgaattctacagcgagagtaattgctttgtgccatagagatgttaatttcttttagtgtgttcattgttaccttctttatggcaaatgacaacaattgagctgaccatatctctccatgtccaacaacaaaatctgagaaagactccgtggcatgcccagctgcaaaaagggaaatgtatcataactcagctaagactatatatctgcaatcaaaccacaccattggtacataattgtaaatagtcagcagttagcacagaagtactaagggcccatgtaaatcctctccataagttggacaaaataaaggacaacctattttactgaaaaagaaaaacatatgacagaaagataagaaaaatagggtgtgattaacctatgcaaattgcacgaagcattgcttttaggttactgacatccgcgtgcaactgagataagaatcttgcaaggtcctctcctccaagcagatcctttgctgctgccatatgcttctcgaaaacttcatcaagtgcagtgatataagaatcatcccttgattgagccttatttacaaggttgtacatcatgtcagtgactttagacattgcagacacaactaccagtttcctctcagaagggtcgcgaaggattatgtcagccacattctgaatcctctgggaggttcccatgcaggtcccaccaaatttatgcacagaccacatgtcaccttttggaaagtgagcactagcttcagcttgctcaactgaaaca

SEQ ID NO: 54564 - DNA, 7451 bp, Oryza sativa
caaaatcaaaacctgagatgaataccaaaaatgagaataagtaccctgcaatagctttaatcaaagaacagttccaattgagtaatggaatctagcctatggaatttctccgtcaaaaaaggggtgaaaattataccacaatctagactagactaaaagtgaactgggagaaaggaacaaattcaacatagtgaaacaatggccatgaaagatgatagataatattaccagcagctggcttgagcatattcttcgaaacatccccataaagtcctcctggaaggtcgctggccctgaataaagcaaaagtagaaaaaaaaaagaggaaggattgattcattcactgaaatttcacattgcctgatggttaccaaagatgatatagaaataataattttattgaatgcagaactgatagagtagaaattgactagagaagaagaccgttaggttgctatattttgataagaagacagttatctgataagaatacgttaacattccgtaaggagtataactgctcaacagctttcgatagaacatacatgatgcaccaaatatgcatttccccaaattccctttagaaataatactgcaccacgctatcaatcacagctaagcgaaatgcacaacaacgaaaagaaaaaaaccctcatgtctgtgacccaacgccaactcacaacatgacaatttcagtcaagaagggattcaatccatgcacagaaaaccgttcacgatgaagaacaccaaccacagagagctccaaaacgaccatgcctgagtcttctcacatcgccaccgctgcggattcacacctctgcatatataaataatcaccagtcaggaaaccaacaaaccgcatcaccagaggggagaaaatcgacaaactggaaaaaaaaaccacggtcaaggaaatgaaatcgcgcatcctcgacacgaacaaatccacccaaaaaaaacaaataaaaaaactctggggattcgcccagggtaaaccaacgaggagaaaccgacgagacgtccgcaggggacgcgagaggcgcgcgagatgggaggagaggggacgacctgtgggagggggcggcggcggggcgagggccgcggcggggacgggccgcggcgaaggcggcggcggggtgcgggctcgcgacggcgaggctccacatggtggcagccagcgcagccgaaatgggtgggattagactgatgagcgtgacagcgagctccaaaaccctgctttaaccctatttgcattttttccgttttaccccctcctactttttgttttttaatatctgtgtttatttaaacgtaacaaacaaataactacttcatccgtttcacaatgtaagttattctaacatttctcacattcatattgatgttaataaatctagacatattgatgttaatgatgtctagattcattaacattaatataaatgtaggaaatgttagaataacttacattgtgaaacggagggagtatacaataatgagataatagtataaatttgtatgtctactctgaggggcgtagaaatcaaggatgaaaaatagaaagcgaagaaacagcctctagattaattcagaagttcaaattttgttgtgttcttccaatggaacactaagttgtgttattttttaaggcaatatagttatatagggttttttttctcaaatatcagcaacttgtactgtggtccattcaatgataccaatgggccatgggccgtggcaatggtctaatttacattttacttgatttttctctacagaaatctgattgatttctcggtcttcttttctttgcaacaactaaatttaaaagtgcgtgagctatacatatttaccttgtgtcgaaaatctgataaaattcctactgtcctagcaaaggcatgaatcatcttttcgattatattttcaaatatccgggcacgtttctgcgagtgctcatcttggtttcgaatgtagttcacgcgtacgtctacgtgcatgttgtcgaaccatttggctataggcggcagatggtttgtgacttctgtgactgcccctgaagacctgcaggacattttctgcggttggaattctgaaccatgtgctacagtgctttcagccaactagattaaccagagaaggcgaaagcaaaccatacttctccagcgtcatagtttgattcagaccagctacaagacaaattagttggtaatacaaaattttggcataaaaaactttcagccccagaataatatatatcaaggggctattcccgaccatgatatctgtatagtatagaaaacgttgatactaaggttgtatgagattgaggtaaagtaggtgggagaatggatttttatactggtttggacctcaggatagataataactctagttcactttatatatagctctaggttgtatcactttattataatagggaagcaaactagctaccaactactccctccatcccataatataaggtgtgcacgtatttcaagattcaacctttaaaacatttgaccaacacttagtataatatgaaatgaattttatttgttaaaaactatatcattagattgtgatttaaatttacttttatatggttataattttgttgataaaaattttatagtatataagaaattataaactaaatattagttttggagaccgtgctaactttgatcacactttatatatgggatagagggagtagtattcgccgtgaactaatccgactacttgaagtcgacggctagctattgtcttcctattggttgattttgcaatgtggcttgtggctatggcttttgatttttcgatgccctcccctcctagagaggcgttgtatttatataagtagacaacttcttatccaagtagaattcaaagagccctcgtaggatacgggcatataagactttgccttcctcatgttagaatccaatatcttctattcccgtggaaggagttcttgttcttatatacctttctgcataatgttaggtatgcaatacttttggtggtcacgaatctaagtataggaggtatatctaattcgtatcactggtagtagcccttgaaaacgaactcgagaaaacgagtaggtaaatagtccttgaacaagtcatctttcccagcactaggctagaaaattactgaattttgaatttggagtgaagtcagaacaccaccaccacagaaggacaaccactaaacttctgccaaatatttcttggcctttgttggaggataaactcctcgagcaggggatccctccttcttcagttcggccgggggcagtgaatgtagattgaggaactgggcgtattagaaagaaacaaggggggtcggggctgcgacctagcgggcgagacaggaaagattatacaggatcgggccgctaagaagcgtaataccctactcatgtgtatgatgatttttctgagctttgaaagtctctgaatctctggtgtacagactagagtcaagtgttcctattctcctctctcctccccctctcactggacgtccacatccttttatactccaaggggttgttacacgcatcggatgtgccatccagtaaaaagggcaaatattctctagattaaacgcgtgtcttgcactacagcttggaaatttcgatcatcggctgtcgagcgggccccatcaaatcatgccggctgacacaagccgatatggaggaggatccctgtcattcttcatttaatggttgtagacttgaggcttggatgtgtcgggaacgctgtcccgggcgctgtgtctctcgtcatcttgatgggacagggcgcacctaccgcactccgcatgacactagggcagaccacgcgtggcctgttgctgtctcgtccgttgtttcaaccggtcacgttcggtcaagattcggtcaggcgagcggcacgccacatttaatgtggcgaggaacgcccgctccgcccgcattaaatgtggttaggtgggcgcggagcggcgtccacgaatcatctttgcatggtggtcatgtggggaccaccccgaggggtcggggcagcctgacccctcgggttaggtacgggcggcttccacttgtccacgggcgcgaccccccggggtgagcgccacatggatgccaagggcggctcctgccttttaagttcggtactcccggtacccccaggcccatatcaccgacaacctttctcaaaatatgaatcatcacctgtggtttataaaactcgcttctgagattcatttgggttccatttgcaagtattgttgttcttcctcctttccgctcccaatccaccacaacgcacagaaaaaccctaaccaaaactttcccttccaccaccaagttcgccatcgatctcctacagtccaatgtcaacaaggcggccatggacaagctccagtgcgatggggcgcttccaaatgctcgggcgattgagcgcacaaaaggtggtaccgatccttatcctactattggaaaaatcataatcatttcttctttcgtcaaatgtggattctcttccttgattactgtgacctacacctccttcacttgaatccaaattcgatcgcctttcttaccatcatcacccacctatgtgaggtgtacctcggagcgcgaccctttctagatctatttagataattttacgaggttatattcatggagcaatcaaggatcacaggctgctatggtcttcgccttagagatgggatgcaggactgttaacaacggaattttgcatcatactcgaggcggatttggtgcagaatcgagttggattaagaatcgaactgtgcatcaactaggcattgcatcggctggaaacaaagttggagacagactaccgatatggcaagcaaccgatatggtttaacttgggcttgggttgggcctagattggaataaatgatattgccgtatagagattgagctcatttaaggcaattgtatctattaattaggatatttttgtcgatttaaattagagttatggtaagagttgcttgtattttatctttaggaaagtgtgagtcgtgtccgtaatggacaagttttgtactcgaggtataaatatgaaccccagggcattgtaataagggatcgaaatcaatcaatacaactttcggtgcagcgccaccctttttgttttacttttcgacaagttcttgcttcaagtcgaggcatcggctgcaatttctcgacaaaaggtaacttgtctcgatggcttgcgctatcggggctattatgtcgttttagatgtattagtccttttatcgtggttattgatatcatatatcttagttaatctagtcttagtatctcgatttagttctatcgactgacacttgttttagggtttatgctggtatcggctaaatcgtcttactagattagattaactaaggtatctaccatcctgaaaagtgtttaactccttgattgtttagactttatgcttctttgtatactttgtgatgcatcacccctagccgtatttagaattgtaaaaactaacctggagttatcataattaaggataatatcggggtttcaactgatcttacctaatatgcatgatagcatatgtttcatggtctatctacgtatatttgctacttatatgattagattgttctatatagacgcatcaagttagattgatattgcccaaacttcatatctggtgatcaattcctatttgatatgtttatatagattaatttactcacataagtttatattggagtattagccagtatattatctatctttgctctaaatattgatctatcagctatttccgtaatattgtcttaaaataattcataaaagctaaagaggcagtattacagccgatagggcatatttagggttttgctttcattgactatcataaagccacagccgattaggtttacccgtatttgctgggtcctgacgatatgtcgtcggctcgattggccaattggctatcgttcatctaattacgtttttctgttttctcttgttagttgtagatcaaactagctggcacgctcttagcattagaggcaagccttagacctacactggagtgaagcgaatctcccgagtcgtcgtgttttacgtcaacagggacaagtacatcccctttaattgccccacctctaggaaagaatggaggaatagatggttttatctccacacagtgactgcctccccttgcctttccctccctgacttcaaagcaatctaaaaaaagttctagatttcgagtcctccaatcaccgaatccttaggaccttttgtaacaaagatcaaatactttcaagatcgtggtctgatgggatacgagatcattgaggatttcgtgtgttgtccaattcaaccgctctatgctcgtgcttatcatgcgtataagtacacaggagatgaagacacgacgtggatatagccctgggttacattgtccaatgttatcagtaggatttatcataataaaaacttttgttgagcactaatgttgacaatattggtgtagatctctccgatgacacagtgaagactcgcatcagcaacgtttcatacggttgcagctatcccaatcaacctcatttatctattttgggccacaaattggttaatccatctaccgcatagatcatccatcccacttggtgatggtctgaaagcaaaattaaatctaatatcatatttttccattggacaagcatcgtaagtcaatccactaatcatgaataccacaaaaacatagatagttctgatcattttcatccccctatgagtcaaattatcttctttaaaatactactacttaacaccccctataagaaaacttttgtagcttgccaaaactgattgtttagcctttaaagccattaaaaaatattttacatagaactctagttttctatttaacaaccactgaagactcctcaaacaaaaccacacaaacatttatgctgaagttctagtcacatgttataattttgcacatagcagttttcttctaattcacatatttgaacaacttgggtgtactcggttcgaaatttatctttgtgtttcccaaatatagtttatacgcaaattagagttaaaggctacactcatagttgaacttatatgagctattgaacttacatttctttagctttgtgaaagctccctccaactagccaacaaacagaggaattccatcacctaaataacaaataaaatttagaacacatgtaacattacaacctggaaaagataggaatgaaaatataggttgttgcggtcttgttaatcttcttaggcacttaggagacgagaatctcgaatcatgttgcatgttgatggatactaacaaagcaacataaaagagggattgttctttaaatggaaaaaagatattaagttaaaatgtgatcacaacagaagtttttta

SEQ ID NO: 54565 - DNA, 21726 bp, Oryza sativa
  unsure (1)..(21726): unsure at all n locations
gtcgtgtcatccccaatataattgggagcacgtcttcatagttaagtccaaggaggtcgagcaggtacttaaccacatggaggtcatgagatgccacctccagccgccacagctcaagattgtgtagattattgccaatgagccagagctgcccgtcaatgtcagggaaggggtaagattgcacaaagaggataaagggctttcacctgcgcgagtagcaagaaggcaaggaagacgtcagtacatgccgtgggacgggcgcaactctagacgatggggtgggctggcgcatagacgggcaccaccggcagcgagaaatgtcgggctgcagcggctactcaatgttgggtcaaattctgttcagagttgacgataaagaagtaaaaaaatgatggtagtgctagaaattggaatggaggaagcttttagatgctattagagatttagagtaaaccggtaacttttggttctataaaacaaaaaacatgaattttcgatgctctagagccaattttgcctatttttttaaatggggaaagaaattaaaatgtgatcacaacacaagtttattagttaaagtattaatatctttaaggctttctcgtctgccgtgtcatcaccgatataaatcgggagcacgtcttcagagtggagtccaaggcggtcgagtaggtactcaaccgcatttccttgttccaggaattctttgaatgtatctcatgaaccttacaaaagtaaaagatagatgagtatacaagcaataaagtattttaagagttttttgtctcagaaaatattgttagtgtccttatactccctccatccacaaaagttacacctattacttttgtcaccaagaccaagaagaaattaatatttggatgttacaaaatcaaggagtaaaagcaaacatacaaccaatgagtatttagattactccttgggttctaatcaaacatttaatttatctcttcatttaagtcttgaatgcataaagactacaaataggaacaacttatttggaaaaactcaaatgtgaaatatgtctaacttttgtggatggagagagtatttgtgtactaaggatcggttggcccactatataccaaatcctatacataatcaagcctcatatggaaggtgttccacataaggaaagataagcaaagtcctacttgacaccacaaggtctactcggatcagatccatacttgctccctaattctattttgacaaatggtatgtgagagcgtaaatacaagacccctaggaggaaaggagacaagcctaaacaaggtatacttgcttcctaattctattttgacaaagggtatttgagagcgtaaatacaagacccccaggaggagaggagacaagcctaaacgaggtctgtacgatccaactagcaccacaaaagacagcaaagagggatctatagccacctccaatctcgtcgagtttttgttcgaagaagcttacaactgctaaccgtcgaccacatattcaagctttacgctgctagagagactagattaagttctcctcgcaattatacctgtgagagattgattatataatagcaacaccggcttgtccatctatttactacaatctcgtgcatactttagtaccaacaaatctcatactctacaaatacggttgtcgggtcccgtcgacacgtaccatttgtcccttactcattctgagattttcggaattttgcacgacttcatagatagtggtctgaacgaggtactagagcttggaacaatgaagagtgaaattgttataggaactacaatttcaattcctctaagattgaaaaaaaagaaataatgacactcgagctctaactcaccttcttgtcaatgtttctttagtggatagaaataatgacactcgagctctaactcaccctatatagctttagtggcctttaccagagacgtaaaagcctgtaatgcaaaaggtagattcgaaatttcatatataacggttagaataagtagcacaatttgcaatttgcaaaaataaaaaaaaacatgagttataactcattaatagaagggagagaggcactcgtaggctgcaatggagtatgttcttccgtcgataggagtcaacaatgtaacattaaggatctttgaaaaataatgtattaagaaattttagcacataatcaaggtacaggatgctagaactatgaaatatttctcaaatacttactatttcactactacttgcgggctgcgtagttgctactcttttcaattccttcaaaacaagagtagtgagcttggtgtagtttgtcctaaaaacaaaatgtaggagcaatagaataatttagaatatacaatagtgttagcagtttgtaacatctattaggcattttttttccaaatatatgaataatacatgatatttgtgcagttaataggaaatggcagtcaggccaactaataatgttaggggcaactggcaggtagatatagacggggggcattggcccctagtcagttctacaccaagcgggggcaaatgccccttatcaatttttattttcttattctacctaagtaataaactcttcgttccacccattttacttcttacatccacccatgacagctacaaatctacaatcatcaatgttaaactctactaatcagagctcatgaacttagaaattaagatcaaatactaatatctaaacccgaagtcttgtaggtatctactatgaatatatcttgtccagtaggaaatcttgcggacagatcttctgctttgcttccaccatagtgatgagtgaattaacagccttgttaaattctttttaccaaattttgatagaggaaatatcgctatgcatagaaatcaagtgtatcatgttagtcttatcaaactgaatcgtcacgctgggaatctaaaagttgctagttataatagatgatggcttgcattctagatgcacatactatctgcacatcccctagagcatggctgatgcatttcttgcatgtattatagtgtcactgcgacactacccaattgcatacatatgctcttctgtgagcttagcaaatagattagcaaaggaggataggagcggatggggactccgggcacccttctccttccccttccccggcccgaggccggagagctcgccccgcgccgtcggccgcccatcactgcgcctggctcagcagtgcctcctccgttctccctccctgctctctctctctctctctctctctctctctctcgtgcccttagcttttgagctagcacccgtagcactaccgaacgcgcgtgtacgctgccccgagcccctccgccgcccggcatggcctcgccgccattgccgtccgctcccggaggccgctgctcgtcgccggccctccttggtactccttcgtcccatccggcgccggaaacggattccttgaaccccggagatgctcccacccctttgaatcgaacccccgttgctccggtgaagtttcccccttttctcgccgctggcgtgcgccgccgcgatccgtcgtcgctgcctccctccagcgaatccgatccggtggctcactccctctcatccgtcccatcgttctggtgtactccctctctctcgaatcgtcgcgacgagctccggtgaactcggccgccgtctgccgtccatctcggcctccccttcttcctcctcccaccgacccacgtggctgccacgtaggcgccacgtcggcgccacctcggctttgaccgggccaagccggtcagccaccccctccctccgtcttccttcccatgtgcacggtccacggagagcctaacggctgcgcgtgggcctgccacccttcggtccacccggtgcaccagaccgtgcgccactcctacccgaaccctagcgcgcgccgcatgcaccgctcccacggtgagccgcgccactgacaagcgggccctactcgggaccctgcaaggtggactcggcccaccggccctccatcttcctcactctccccgtgccccttgggccgcctcttcgggccggccggcccattagttcgaccgagctgcgcctctcctctcgggccgcgcccaagccgcccgaggaagtctaaatcacatccctccttcaatttctttccaaaaagggtttaataaactattaaatcctttttcctttgattagaaaatcaatatctctctatccgtaactccgattgactccgttcaacttccagcaattccgtaaaattgagatctatctaatggcactattaattagtctaaataggatcttttgggtcttgtgtaggtttttaattgtttgcgtatagttgcggttaccggattttcgtcgatcgtggatttctcgaagattcgtgaagctcagtgaagaccttgagcaaggcaagtcaccctttgatcaattgctcctataattggaaaatcattattactttgtttgcaacttgcattattagaatcacacacttaatttgcttggcctcggtttgcgtgccaaaccgacggacctacccagtagtcgcactaactcctgtaggttgtactaccctgattccttgttgctccacccttgtggtacatcagtatccgtgctctctgagcgcgcataccaaatatcccacatacaccgttgattgtcgaaaacttgggaaatgggtttgtgaagccttgaaaacccgacatgtgatgtcggtgtgtttgaaaaataaaatgaattgtgaaaactcacgatgcgggagctgtggctacgtggcgctgtcccgtattcgcatataaggaccgattcctgtgggaaactcatcgagcataatcaaagtgcaaccacaaggtggaatgggacaccctggctaagttaactagtcggttcagggaaacctcacatgccaatagttgggaacgccggggcggggtcggttggagccaaaccgggttcctggtaaggcaagaatgagaagcttgctaacttaccgatcgagatggttggagtttgatttgtgaaaactaaaatggcctaaatttatgtgaggatttgatccttctatgtggcatgaggtatccctgggtcggtttgggaaaggctttgtcgcgaacctctgacaccggccagtgtctggagtaagttcgtgtattgtgggtaaagtgtacccctctgcagaggttaactaactgttcgaacagccgttcccacggtcatgggcggatgtgaggtggttcccgttgcgtagatttgattgcctgtgctttgcgaaaagttgttgtggaatgggaatcgtaaccagaatcagcctatgtggcagatggatgacctgagtggtcagaaacgaatctgtgtgattcgggatgtcagcgggcatcatagactaggcttcccaagtggaagcggattgctttgctgctgggcagctggactctgggagtccgcaaaaatgaaaaagactctgggaaccgcctaatcaagtgaaatagctctgggagccgataagtaatgatctgacccaggaggtcggtacattaccatttgagttgttgaaaagcatctcttaagtcgaatcaagacgcaagtcttcttttgacccaaacttaaaaagaaataaatcgcttagtgatttcaaaatgatttcaaataaaggatttgcaaaacaaccttgcctctcttccaagcttgcattaaacacctaaattcccgtgacttgctgagtacgaaagtactcgcccttgctctatataaatatatatagttcctccgccttgaagagaagatgaagcgaagtgaagattagggtttcgtcctggttcccagccatcgcctgtggtgttgggtgttagttcgttggttccgctgctgctgctgttggtgtttcctcgtccgtgtcgtcggttgcattctcgggctgttctgagctgcaacctaagttaaggtaaataagtcctctattttaaggattgcaatgattcatatttgtcaccgtgcgtaccagcgctaagtcctaggactggtactgagatcgtggtttcgtaggaagcggttcgcgccgttttcctacgacacgctcctgtcaggtgccgttgtacggtagtaccggattggggtgtgacaagaaatttccacaataacctaaaaaggtaaaatgaccatctaattattctgggtatgtagtctaaacaagtactgttatattatttagggtcttattgctacgagttctaataaagctaaaggtagcccaatgcatggacataaggactcggacatgaacttgaggtgggaaaaattaggaagtattttcttttgtgaatattcaaaaggcttgcatgtacacatgtcaaaatgtgtttgggacctggaattcgataggtggggtcgtggcctcatggggagctgtgttagtgattcagtgtaagattgcaaatagatgcggaggaatgtgcaagacaacagagttcacaaattatagcaccgataaaattttgagaatcggagatggctggagttgataaacaactcggcaaaatgatcaatacacataggtctatttaatctcctcaataatttgcatttgtcttaaaaaattaaaaactggtggatccacctacatatttgagagtcccgactccttttttttgcccttccctctttatctcaaaatttcgtcccccaagccggtgccaagtggcatccattactaactgtcttaccaacccttatagtcaaccgcctctctagctcctctgccttcttctctgaccgtcttgtgctagatatagatggccctcctcctgtggtaaggatgaaggcaaatagaaagcatgcgaatgttgatcttgcaagcggcacaattaggcaacagcggaaggacgtagccctaagcacaaccaatcaacattgatgccccttaagtgctttggtcaaaaaacaaatgaaaggagagatcaggaaaccgttatatcgatgtggccaccgtcctgaaacatccagatctctccctctcccccaagctccccccatctctctctccatatcaaggcggtgatgggccttgggaggagcccatcaacagcatccctttgtgagaagccattgaaatggcttctggaccgcaacaatgaatccttctctacctctccatatctccatcttaagactgtagtgggcctcggggaggagtttgccagctgtgcccctagggacaacgtcgtccctcgaatgctttggtacaaagtgaagagcagagatgaggagaggagaagaaaggaagggatagataggtgtaggaagatggtcataggcaagtaggcctaccattctttattattatttttgctgatctaacggccacttcatcatataaacaaaaatcacctcaatttgtgcaaggggtgaactaaatggttttgatagttgaagagggttcaatacccagttttaaagagtacgggtattatttgatgaaaacaaaataacgaaacacgaataacaggaaacccaatattttattagtcatagatgagtgtttacaaatagacggggttcccataggagtctgcattttgatttcgcgaggatagtttatatacatctgtatgacgtgcaatctgctgattcctggcacctagcaacgaggcgatcaattaattacatttgtaggaaaaagcctatcgaacaccttcgattaaactgtgctcatggtcatcgccttcaaaattaattgctcgtcgaaggttgaggttagtgtagatttaatggtgaatatagtgaatgtggaacgggtggttcgccaaaatctgaaaatagtacactatcatcacgctgatgtgtagaggaaattttgtgaagggagtgacttttgcctcgtcaatgccttgtcacgtactccagccttcatcaaatatggtctttgtggttgcttttgcctagttgtgccttgcaatggtgtatccatttcccatccattttggacgtgttaatagtatagtgacctagcctcgtcggtactcggccatggtttcatatagcatcgttagtgatcaacacaaggtacattttggtggttgcagttttgtcagctattagctgagatatcgtcatgtctcgtcagcctcgcacatagtgtagatgatgattgacgccatacaatgtcatctacactcgaccatgatgacgatgtgtgtggtgaatatgaacgccttacccttgtggctagcgctgctttttaaagaaacaatcttgttattttcaaggaagaattgctcccgtgtgtgaacatgaggcaaatatcacagtatagcttaatagacatgatcaatctaacaatagtgatcgactttgttttagtcgtcaaaagatcaaatagtacatctgcagtctgattgataggttcagacatgcttagtacctttgatcaagcaacttgctcaataacaccaaccaccggcactggaaacggatctcgtcgaaaccatcgccatcggtgtggatggttgtatttcaggatggtacacctcccgtgtgtgacacagactggtcatatttgtaatccttctaaagtcgaagggaatgcacctatgtataaattatggttggtccattgccaatgatacttaaactccacccaagtttatacaagtgattactcaaaacccgcaagatagattatacgatttaatgccaatgaggccagatgagccttgtatttgcccacacgtacacaccgttgatggtaattagctcaacgatgaacaatgatcatcttcttagtgaagactacttgatgagggtttcatcgtcgagattctattcctcaatctcttggtgaagatcagtagatgagaatttcattgccgggatcttgttccttgatcacttgttcttagggtgtgttcgctacggccagctcccaacgtgcacacagtacgtgcggaaaacggagcggtctattagcacgtgattaattaaatatttgctaatttttttaaaaaatggatcaatataatttttttaagcaactttcgtatataaacattttataaaaaacgcaccgtttagcagtttgaaaagcatgcgcgtgaaatacgagggagaggtgttgggaacaccagcatcaaacacagcctagtgaagtccggctgatgagaatttcatctcctgaatattgtttcttgatctctactatggccgtgtttagttcctctaaattctcaacttttcatccatcgtatcacatcgaaaactttcctacacacataaactaccaactttttctccaaactaccaactttctctcaacttcctaacttttccactatctaaatacagcctattaagaccggctgatcagaattttatcgccagaatcttattcctcaatatcactcttggtgaagactagccgataagaatttcatcatcggtttcctttatctctaagtgaagagttgccaatgagaatttcatcaccagatcttgttcctggatctattaatgaagacctaccgatgagaatttcatcgtcgggatcttgttcccacagcttgacttttctgttagccgggctgcacgcttgctcaacgctatggcatgtgtgttggctccctctacgtgccgatgcccggttacacaaatatatacgtgcaacactatggcgttgcttgtgctatcaatgatgaacagttgatgaagatgggctgtgtatatctattatggatgtagaggccagattttaatctattttcaaagaaaaaaaaagttgatgaaggccggtgaagatatcgttgctgccagtgacctaaaggatttggttttcatttaggctttgggttgagatacgctccggtgctctctacttgaagtattctactacaagtagaattaatctcaaccgttaattttataggataaattagtaatcttctaatatagtttaggggtaattttggcatgggatgttttcttcggttgttcgcatcaggtccgacgcatcgcatctcgccccgacgcaagcaccgcatctctccccgatgcaggttttcgctactcctcccggcaggcagcggcacgacgccgctgccagcggcttggtgtggcgaaatcctcaggtggccactcctcccactcctcacccgtgtatccgttccccttcctctcctctattccatgccggcatcccggttcgccgtcgtggccttccgtggaggagcacgccctcaccggcgccccctctgtcctctgtgagtggccgatgctagtctgcctatttgctcgctgtctcagtggtgaacatgtcttaaatttgcctgtataaatgcatatactagcttgtaaatggctgtgtataggaaaaagtacgaattacccccctccgaatcacaaaaccagatattcttcacccccaactatgcataccggacgaattacctcactcgacccaatccgcggtggttttggtctacgtggcgtacacgtgatagtccagtcaacattctatttataaaaaaattgtgagacccacctgtcatacactactctatcttctctctcactctctctctctctcttcctctctctctctcaccgtcccacgggtcagcggcggcggcggcgcgtgacgcggaggcagcggcggcgggggatgaggagctcggcgcggcttcccccctccctctcggtggcgtgcgcgcggggacgagcacccaacgaggcaaacatccattcctagatccactcgcccacgaccaccactcccccgtctcgctctcgctgttgccgtgctgagctctgaggtgagctgcttggtgggtggaggggtgggtttggtttggttggtcgctggttggcttggctgcgtaggtgcgcaatgcagtgagggaggtgggtaagggggggagggagagatcaggtcaagcgggattatagggtgcgcacagtcgcggatcgagaacgaggaggcggtggcgaaatgcaaggagcggaggcagtgatgaagtccgtcgtgcaggcacggaacgcgttcgcggcggtgcactcggcgtacgccatgtcgctgcgggacacgggcgccgcgctcttcgagttcgcgcatggggagggcgtgctgccgccgcccccgcccccaccgacgacgacggggccacgggggaggaggcgcgccccgtgggatcatactagtactgcagaaatctctaggcaatcaaccattcactctgtttttatttctggagttactatcaatctaaccatgttttcagatgttaacacaacgttattgttcagcaaatactcctcttcaccgagctggagctgtagacaggatctgaaatcttctgaattttatttagatattgaaatcttctgaatatttgtccctgtcatgtacagcacgagaagttgcagcaatggaggagacctcatcaggggcagcagatcgctctctgtatcagaaggcagcagcgatggttgcctcctacacggagacgtaccgcagcaagcccttgtccttctggctgctgctcgtcctcagcgcgtgagcatcccggcgtcgagcctcctgtcgcggctgtactacaacaacggcgggcagagcaagtggatcctgtcgtggtccgccgtcgccggctagccgctgaccgccactactggaaaactgatctttgctcggtcgcccaaagccacaatagtcccggttacaaaaaaacccggtttaaaaccccgcagcattatacgatctatagtcccggttcatccctgtcagtcccttgtcaaatgggcaaaccggaactaaagatcaccattttagtccgctgaagacctcttagatctttactcccaactaaaatcacgcatagtatataatctctattctctatcctctcccccacaccggcctcaatctcctcaacaaccggcctctcctctcctcagatccatctccctctcctcctccccctcctcctcccatgcccagcaagggccgcctcctccccctcctcccttcccgcacgccccttcctcctcccatgcccagcgagggccgcctcctccccctactcccttcccgcacgcgtcaggcggctggtggggccgcacgcagcaggcggccgtgcacgggccgagtagcgagcggcagcaggcggtgctaccggcatccattcttttttctttttttttttacaatttgtgattcactgagatgtataattttatgatttgttgtatggatctgagatgtataatatgtgatgtatttggtttgtgtgtaattttttaaagatttgtgatgtatttgatttgtgtgtacaagtaacttaagatttgtgatgtgaatgttttggatgttagtttgatttggggagaagtagagagagaagagagagtagtgtatgacaggtgggtcccacaacttttttttataaatagaatgctgactgaactgccacgtgtacgccccgtagaccaaaatcatcaaggattgggtcgaaggggtaattcgtccggtatgcatggttgggagtaaagaatatccggtttatggttcggaggggtaattcggacgaccgtgatagttcggggatactagctcgtacctatattagagaatctatatttgcggatgttaaattgaactggagatctatcttaaaactgtttttttaggctgactgattgcggtggacgagagtcaatggctcgtttaggataatgataaattacgataatacccctacgcgaattattatctctggaacaagtatatccctctacgtttctactatcactaactcaggcggtaatagaactagatcttaaccatacgattaaatacgttaatggctcggattactttctatcacaaatagaaagcaccggagtagggctcgttttattaatatctgtagaatagaatatgtatgggtgtgtcataggtttaacaccgcacagggcgcttcatgcgtagcgcctggcggcggcatcgcgcatgtgcctcagtgcttctacgcgcatgtctcagcccctcgcgagcaggggtcctttgtataggcagagaatatggcaaaagtgtgtgttaatcctctattacattcaggtagtcacacgttataattcctttggataaagagaaaatctattatatacgtctgaaatatagctaacctcttatatacctttgaattttgcttccttcattacatacccacaaaatttgattttgattccttctatattccttccgttagttgatcattaattgaccatcccattgctataaaatgactattttaccctttggatgaacataaaaatttatgaattacattattgaaaatgcaatactttgtcgcatgaaactattatagttatgagtttgctatgtgatgacaaaatttagttttagataatgaaataaaaaaaatatgtttttattttattttttaaaaaatcataaaaatgaggagcattcatacaaagatagaactaccaatgctcataatattttttttatgaatgctttgaaaaaaatccattgtcctattataatttcaaataaaatttttaatttattttattttttattttcaaaatttatgtcaaaattttctatactagttatttagtctcattagtttcataaaatacacatactgtgtatttaaataaaattttcaatcgtttttcaagcttatattcaaacgtaaatcatcgagagcataaaaaacatttcaaccaaacataacagaaatgaaggaaaatgtaacggcaaaagtatagaagggatgaaatttctgagatatagaagggatcagctaaatttttcgatcgtcacctccaactttcgtccatcatccgcatcagacctttcgtcctacagcgcgtgcatcaaccatcgctagcgagtccgtgtcgatttggtccgtcgtcctgcctcatccgtttcggcgccatcctattttttttttttttgcctaaccatcatccgcgagacatgacagattagaatctgtgcgtgacatgaccaatcggacgtgatcggtcggacgtggccatgcggcgttaggctacccctttgaagttggaccccatggacgtctgtctgtcggaggatgctacgcgtcggacgttcgatattttgtaaatatcggacgcccgaccctacactgtcgtgcgcatacatatgcatatatacatgtgttctattatttctactctagttgattagctcgtgtaaaaagtctatatgcttgtgcatgcatgactgttgtttatactctagttgattagcacgtgtaagaagcctatatgcttgtgcatgcatgactgcatagttactatgcagtacttgtctcaacctactttttattttttttaaattaaatttccttttaaattaattatccgatttatgattcgatttcaccattaaactccttgcaattaaatctttacaacaagatctcagatggttatattttgatgagaaaaaaataaacattgtttcaccacttgtaaaaaaatgtttcaccacttggtcaaatgttccaactcagtctataaaatatttcagacaaatacaacattcaagaaatactaaatgcaacaccgataatgaatgtatgaaacattgagtccccatgagtgagacataaaaatcttggtcaaatgttccaatttagtctataaaaatgtttctgagaaatacaacatttagaaaatactaactgcaacaccaataatcactgtatgataaattatgataaattgagtctcaatgagttagacaaaaaaaaacttggtaaaatgttctaactcagtctataaagtgtttcagagaaatgcaacatttaagaaatactaattgtaacaccaataatcacggtatgaaacattgagtctcaatgagtgagacataaaaataaaaaaacaaatgacataaaaacccatatgaaagatataatatatttgcaaatatgaaatattattaaaatattttcatgtaattataaaacattaagttattacatctgaaacattataaaatacaaattggaacattgaaaaaacaatatgtgcaacatttacatatgtattagcgaaacagtactagttgacacatttaaaagaataaaaaatattttttcatcggaatatagccatgtgtgatcttgttgtaaagatttaattgcaacaagtttaatagtgtaatcggattgtaaattggagaagtaatttaagaaaaagattatttaaatataaaaatgtatacgtgcatcggtgcatgatttggtaaagtgctctacatagagcaagggagtagtaaagtgctttgcatggagacaaggcagcggatagaagcatgcatgtgatgagataatgttacgtccgatatttcattggagcgtcggacggccgatgcgaagcattttcactgtctgttcgatgtttcgtcatcgtaggccgtgtttagtttcttccatattctcaactttccatcacatcatatcacatcaaaaacttttctacacacgtaaacttttaacttttttttttcaaactctcaactttttttaaactttcaactttttttaggaattaaacacaccctaaggcttgtttagttggggaaaatttttgggttgagttgtcacattggatatgtggacacatatttgaagtattaaacggagtctaataacaaaacaaattacatattccgccaggaaacaacgagatgaatttattaagcataattaatccgttattagcaaatttttactgtagcataacattgtcaaatcatggcgcaattaagcttaaaaaattcgtctcgcaatttacacataatctgtgtaattagtttttttctatatttaatactctatgcatgtgtccaaacatttgatatgagagcgtaaaaatttttgttttgagaagtaaacagagccttagggcttatttggcacagctccagctccagctccagctccacccctcctggagttagagcttagccaaacagcttcagctccacccaaactgggagtggagttgggtggagctctctcacaaaatgtactagagttgtagagctgggttttggcagctccacaactccacttcagactcaactcctaaagttatatttaggagttggagctctaccaaacagtcctagtcctagtatcgaccgatcgccgccacagccccaccacctgccggctgccacggtcgtcccggcggctcccccgccgtcctacctcgctaactcgatctgtgcgctagctctgtacgtctctacctcccaacagtggttccttcggatcctcctagctagctggccagtccgggcgctctccccctcgatgatgccttcctgcagtctgccatgccctagcctctgcctcaccgcaagttctggcttgccgccgacgccgacgcagacgcagacgcagccaactgtgtgtggttgcgaattgcgatccgtcatcatcgtcttgactctagcacctgccggttggggcggggtaactcgatcggttccctcattccctgatctggtgtacggcatctcgattgtccttgtggccttaacacagtattaattctgtttataatgttatactgttagtattaatcttttctttacctattataatattataagaattataaagatgattttgtactcacccctcccttcatctgtcatctaacaatccatgcgggagtcctgatctgctcacgatttttttttttgcgtgcataatctgttttggatcaggctgtccatttccttgcttttcgtccatcgcgtgcaagagatcgtgccctgtgcgcatcagtcacccgttctagtgtgcgccggatcgtgctcgtgtgtctccttctcccgctctcgcgccagtcatcagcttgcatatagagtttggccaacctcgataatatctggcgcttgttcacataccaagatcttgtagccggcgcacggtgatcggacagaagcgtcaagcaacacgacgcggatgtggcatgtggccgtcgactggccgttgcgtaggctgtcaagaattttctgtgcaactccaacgaactcctcccggattcgggattcgttgtcttggccgctatttgcatcaccagcatctcgtagccaaaggtcttgatccctgttgttgacttcgcttgcatcacctaggtcactgccattgctcagtctcgatccatcttttctgtagcctgtagcaaaatatcgatctgatctgttgaggatgtgagtttgaagagataggtgcagcacattctgatgattccccccatatcaatattcttgttccaatttgtcttttcgatctaaagtctcaaatatagtgtttatctcaattttgatgaagtctgggcaaatattgttctcggtgtgtctgaattttgatgtaaaattatctgattttggtccagttattgacaaatgttgttcagttacgtttagctaaatttttagatcaatctagctgtacaatttcaaattatgttcatatttaagcctcgagagataatgcaatgttcatggctacatctaatcggagttagacctgttgatgttcgtcattcatatctaaaatatgtgaaaattcaagttgggaaaaattcgtgtcaacgcacttttgtcaaaacactaccaaaaccataagttcttcatcagacaaatagggctaaatttacaaagccttgcatgtctttttaccactaagtcatcttaagaaaatgggagtaaacctgagcattagttcaaaaaccaagataaaatcataactgaacataaaaacagagttaaaaacagagttaagaacataattgcctattgtctttttaaccaagagtaaaaactaatgatgctacgttctgcattatgatatggtcaaccaaaatagccatctcccattgcaacgcacgtgcatatttacatattaagatatcaaaatttatgataattttatcatctctaagaagatatcggaatatatcatgttttctagtataatatttagtatctttagatactaggtatattaagatatcaaaatttctagtgtagaatcttgatacctccaagaatctactctgtactcttacaaaatactatagtggtggactggtggtgtactcgtgttgagtctgccctcgtaaccaccaactaacatgtaagcctgtgagattggtggatctcacataagcaatttaattgccagaaaatcgccttttcacataaatagaggcaaaatactttttttcttactaaataaataattgcaacgcactgatattttgctagttttcaaaggatcgtaaaatttttccacaaaattaagtttagagacagcttgttcgctacactattttttttttttggagatagttaccttgccctctagccactggcacttgtttgatggatgactagcaaatttcaaagtcgtgatctatagccgtcctctttccgtatgaatttggaaatgaagttacctcgcgatttcttgaaatatggaggtgacattgaagagaaaattcgataggttgatatttatatgtgctccgttcatgagggggcagttgccgcgagagagatggcggcagcggtgctgaacgccctcgcgccggcggccaccgtcgcgcagctcgccggcgcggacgcggcggggctggtgtcggcgatcctgcaggcggtgcgggcggcccggcggaaccggagggagtgccgcctcctggcgcggcgcgcgatgatggtgggcgacctgctgcggctgctgccgccggagtcggagacgatgcggcggccggaggtgaggcgggcgctggacgggctgggcggcgcgctccggcaggcgctggagctcgtggaatcgtgccaggagagcggcgccgtgcgcggcttgatgacggcggggaggcaggcggagcagttcagggaggtgcagggcgagatcaacgactacatgctactcttccccgtcgtcagccacatcgacatcacccgccgccntgacctgatttacggcctgctgcttcctgcagactctcaaccccaccaggtgaggtgattgctcttcctaaatgacatttatcgaaaaaccggggttaaatttttagatatcgttgattcaattccacccctgattcctctatgatgtaaaattgttaatccctaggagttactgtaccattttacaatccttggtaatttctgaaatagaggaatgttagttgtgatgaaggaatcgtaggctcctagctttgccagcacaaccgtttgggggaattgactgacagagaaatgccaggggccttccgattaactccacaaggtggtggggcagtgggttaaatgtcctgggttcaaagcctcaccccttctaattatttgatattaggtcattccctattatttgcgtcttttttttttttggaattgactgaaaaggcatcagcgtgggatctgacagaaaagttcatatctagtggcttgcgaaatcctataggaggaagaggaggctactaagtcgagggccatcacaaagaagaccacattttggaggaggttaaccaaagagattgcctgtttgtctccaccacactgggagttcgccaaaattaagaaaacaattttgatgtccatggcatattagccaagcaacaatggcagcagtggtaccaaaaaaatatatttaagtgaactagtggcatgaaacagaatggcaaaattgcgttggcaaataaggaaaccacaaaccagttaatattcagaaccaaatcatgatttttttttctaaaattgtgcatgataaactattgtcctctgcttgattttcagtgattaacatcgtattgaactgtattccagatgccagaggatgcgccaggttcacctggcgaccattttgaagctgatgttaggttggtcagatgttaccaatgtattttgtaaatatgtgacacacgacagtgttcagatgcacatttgtgatatttttaaccatgcattgttgttcgaattgtattaatcatgcattatgtacagtacaatccattagaatcatgcttttccaaagtccacacagtaaaacaaacacattctcttgaactccaggataaacatcgttcatgtatttagctctgctagactacgaagtaacattcctttcttactctgattaagggtaaagagtttttttttctttctaaaatagtgaaaaggttttttcatactcatgtggccaaaaaaggaactctatcttttcatgtgtgtaactttcaggaatgtggagatcactgcagctgaggtaattccgtttgaaagcaatcaaactataacagagccttttgagttcggtgaancaccatgtagcaggtgtgtgctgacttctagtgcacatatttatttatttattttatttagatacatgaagtaatccaaacattaaacagtgtaaagtaaaaaaaattctaccagcagacttggtaggaattatgttggctaaaaaatgaagttctacaaaaaaaattctatacatgaagtaatgcaaaaaaaaaaaaaaatggcaactgaattctgggggtccaaaaggagatttagtgtaggttttgacaatgtatcgaaccttttgttctgtttccattaatggaaattgggggatgccctcttgatccgtaaaggaaagtaatgcaaaaatttgtatgttcttataaataatgttttgggacattgtatctaggtcatcaggaaggtttggaagagctgctgtccaaagtgcagaggttgaaatggctttgctggtggtctcagcatgattctctaggttggtcacaaaatcatctcagcatccaccatgatgcgcatccttgtgttgagtaccacatccgacatttaaaaaggattcaattattataactttatcctgttaaacataaataaactgttaaattctgctaaaagaaatttaatgcatgaattaaccgaactccattccttttgacagagcgtccatcaacttatgacttattaaaggctgctacaaataatttctcatctaaaagtaaaattgcaagtgggggttgggctactgtttacaaggtagttcacaattttccatgcccttattatatgtgttatcgtataagcattttaggatgaagctgaaagcaatagtcatattttttctgattgtttaaaatatcttatcaatcatcagaacatttttttataataatcagaatatgaatattctttattgtgttatatagttcttgtgtttattagtaaatgataatgagataaggaattgagtttatgctaaattatgactctttttaccttagtgccagatcatcgattgaatgactcgaacaaagccaatttgttggcatgcttatgtatataaagcactgcgatatattcaactagatgaaaccccgcgcgttggtgcgggagtttagtatgataatagtagaaataacgtgtaacatagctagacgttttaagcttatagaatttgtattttttatcgatcattggaaaaaggctataaaccattaagttgatgtggtttatgataatttaaatggtatatagattgataatccaaaaaaaagtaaggtggtgtgacttcatgaaagaagaaaatgggggaaatgatttacacaatagattaatcatttaaagg

SEQ ID NO: 54566 - DNA, 1418 bp, Oryza sativa
aggtgattttggtatagctaaaactataagcccggcacggcagcaagacacatatgtatcaggcacattgtgagaaattatgaaacgcgtggatgattagattttataattttacatccattaaattcttctgactggtaatgtgtactgattctatctcttgaattgcagtgggtatattgctcctgaatatcttcgtggaggtattttatcaacaaaggttgatgtatatgcctatggtgtcattcttctagagattattactggcaggaggtcctgtattccctgtctaaaagatgatgagtatgtgcatttaactgagtatgtaagtaaattataatctaaacgctattcaatctctaaattttgggccaacatccaaacaaattaaagaaaactgcataatattttgtacaccctccatttcaaattacttcttgttgtagatttgtccaagtcaaacattttaatttttaaccctgaagtacctccacgtagaacgacaactaattagaacggagggagtacatatttataggacattttctgaaagacgattcttttcgcaggcctgggatctatggagaaccggaagatcagctgagcttctagatgcagcattgcgcaatgaggctcgaattgctgagataacaagctgcattcagatagcgttgttgtgtgttcagaaggatccggctgaccggccttccatgttggatgtgcttgcgatgctaagagatgagaagattgtagctgcccctaagaaaccaggtgatcttctccttggagacgaaacgagcgtagagtcaggtgatcttctccttggagaggaaacgagtggagagactgcacattggttcgcaagcagcggcgctacttgcagttctactgagttcacggtgccccggtgagaagagattttgtcatatttgaagctggtggctacttaaggtgcaagtacgttatgtataaagctattacctttgattattcacagcgttgcaagcaaaataagcatggtgaatgtgtatttcagattctgagtaattatggatttaccatatgtgatggaaataaattaaacatacagaaggtggaatgtatagtatatcataaatattttagacaaaattggctacaagcaatataattctgtggcatttgcttatgggcgaaagtaaaaaaccaaacatttactgaaacactagcaattttgttgcattttgctatagaacactgacagttaaaatagtagccctgtacgtggaagataggcagagacggaagaatcagatgatagagtttgtgtcgaatacgtgtatatggtaggttatagtttaggacttggagttgtattagatatagaaatatagtaagagtcagattctattctagaattgatcttgggctgcaggaat

SEQ ID NO: 54567 - DNA, 7239 bp, Oryza sativa
aatgaggagagggagaatagtgtgtgtgtgtgtgtgtcatgatatacccttatactatgtattatctatatgatcaaatcattaattacacgaatctcctatagacaactaatttaattaggcgcatgcagctgcagtttctgtgtttttcttagtgtagagggctaacatttggcaaggggaaatgatgtactaatttttgttatacttttacatagtttcagtacttatttggcaaggtggcaatatcaaacttttaactcactactacacaaaaaaatgttgttatagttaatacacgaaaaataataaaatattaatatttgatacattgacaaactaaaggattatctttttttgagaaaaagatgttttttagaaaaatatatatacttttacatatcattagtaatgtcataactagaaaaactaattatcaaccatatgtgttaagctttcctaaggaaaaccatagatatgccctaaataaaaggaaaacaatagggttcccatataactaaggctgcatcctggagagaagtattctccccgcatacgaaaaatgaaacgcctcatttgtgcataattgattaagtattagctaaaataaacttaaaaatgtttattataatatatttttttcaacaacttgcccatattttttaaagaagctgtttaacgcttcgtaaaacgtgcacgtaagaaaatggaagggtgaaaattgggaagacggagcactgaaatttatagctacacaagttttccgttccgcatatattatacagatgtatgatgtaaaaataattatattctccattcatatcaaaataaattaatctaggattgggtggaaggtcattcaacgaatctacacaagtcatgggctttgtttggaaagagctcaagatattctaagaagcagctgggtggtagctaacttctgataatctggaaaatttaggtttcttagcttttggcttctagttcttttctggattttataattatagcttattagaatctaaatgaaaagctgaactgtttaggggagaaactgtaactgtcagaagtttcccaacaaaccctaattggtttatttcggaacagaaggagttgatagcaactgtttgaaccttttatgcccttaaatgccccctaagggatctgtgaacccctacactttttagagattaggctcatatgtagtttggttcatattcaggtttggatagaatatgattatccatatttgcaagtatatggtgatcctgttttttagttggttgaatatgaccatcattatttttttttgttagatggatgagaatggatagaataaaaacaataacatattaattaataataaaatatgttaattaacaataatataactataatatatactaattaacaatgaaatagactaagaggaaaagagaaaattgagaagatatgcaaaacgaggtgagctattagcacttgattaattgagtataaactattttaaatttcaaaaatagattaatatggtttttaaagcaactttcctatagattttctttttgcaaaaaacatactctctctgaaacgtttcaggttataagacgtcttgacttcggtcaaagtcaaactatttcaagtttgaccaagtttatagacaaaaatagtaatattcataatactaaattaattttatcaaatcaatagttgaatatattttcataataaattttttttggttgaaaatgttactactttttttctacaaacttgatcaaacttaaagcagtttgactttgaccaaagtaaaaacatcttataacatgaaatggagggagtaccgagggagtaccgtttagtagttcgagaaacgtgcgcatggagataagacaaatctcctctcaatgtcctgctgccaaaacgcaggttctaatcaacactaattttacaagtcaactactaaatagcaacaaaatacattttgctaattaattgctaactatcaagattaataaaggttgatatcctcatccagtcaatttgactagatatactcatccagtttctttgtgaaatattttctttccgtttaatcccatcatttccctatttcccaccatgtaaggccgtgtttagcttgtgtaccaaaattttttttaagtatacggacacacatttgaagtattaaatgtagattaataacaaaataaattacagattccacctgtaaactatgagatgaatttattaagcctaattaatctatctttagcaaatatttactgtagcatcacattgtcaaatcatggcgtaattaggctcaaaagattcgtctcgcaatttacatataaactgtgtaattgatttttttttcgttcatatttaatgctccatgtgtcaaaatatttaatgtgatggaatttttgaatgtttgaagtaactaaacactgcctactaaacacactgaaaacctggatcaccatctttcatccaaccaaaaacaccctatagcagcggtcggggcagggcgaaaaggtggtcgcgttcgtcggccaaaagccaaagtttgaccgcacaaaacagcgagtctacaagcagaagaaagaatcatcgttgctagctacctgtacccctttaaatttgccccagcaatttcagctcaattttggatggatgcgcccaacttacttcgcgtctacttcaattcgcaccgccattcttcctctcagcatagctaaagctagctcagcatcgtcatgctccaaatttagtccaagatgaagtctttccaaaatccatttgttttgtccaaagaaatctttgccaaaatttttctactagtataatactatctcctgcttcggttgctcttgctcgcttagttaaataatactaaggacagtattctacttggccgccttcttcttcctcttcgcctctacctgctgcatgccgctttaccccttctcgatgcggggttggattccgacgagatacttgagccgacgagaggtaatctgcttctctcgccttctctctccgctgtaatatgttctttgtcctcgatgtgtttccgattttgcttttcgcggcaaaagactttcggtgttgctttttgcgagggtttgtgttagtgttcttgatgggaagattgccgggttttttttttttttgctgtttgcttagcactttttttttatgatttcttggacaattttggagccatttcgtttagtttgagttctttcggtgtttttgacgcctgtgaggtttcttttattctctaaaattttcgccgagtttggcgttctctcccaattgtttcttcgatattttcttgaagaattgaactgggtaatttcattaagattgaattcggtgcgaagtttatgtcaggttgttgcacacgaatgatttttttttaaattttttttgcagtttgattcgaatcgaagctcctagtcttctttaccatgtgaagaaatcaactggttcagcatcaagaagcagccatggccgccgttcgcgtggtggcgccggcgccttcggtgctgctgcttgtggcggcggcggtggtgctgcttcacctggctcgcgccattgccggcgcggcggacgaggccgcggcgctgctcgcgttcaaggacgcgtccgtggccgccgacccgggcggcgcgctcgcgggctgggccaactccaccacccccggctcgccgtgcgcgtgggccggcgtctcgtgcgccgccggccgcgtccgggcgctcgacctcagcggcatgtcgctctccggccgcctccgcctcgacgccctcctcgcgctctcggcgctccggcgcctcgacctccgcggcaacgccttccacggcgacctctcgcgccacggctcgccgcggcgggcggcgccgtgcgcgctcgtggaggtggacatttcgtcgaacaccttcaatgggacgcttccccgggcgttcttggcgtcctgcggcggcctccagaccctcaacctgtccaggaactccctcaccggtggcggctacccgttcccaccgtccctgcgcaggctcgacatgtcgcggaaccagttgtcggatgccggcttgctgaactactccctgaccggctgccatggcattcagtacctcaacctctcggccaaccagttcaccggaagcctcccggggcttgcaccttgcactgaagtttctgttcttgatttgtcatggaacctcatgtccggtgtactacctccaaggtttgtggccatggctccagccaatttgacatacttgagcattgccggtaacaacttctccatggacatctcagactatgaatttggtgggtgtgcaaatctcacattgcttgattggtcatacaacagactacgtagcacagggttgccgcggagtcttgtcgattgccgtcgattggaggcacttgacatgtctgggaacaagcttctgtctggtccaataccgacgttcttggttgaattgcaagcactgaggcgactctcactagcgggcaaccgattcactggagaaatatcggataagctgagcatcttgtgcaaaacgctggttgagctagacttgtcaagcaaccagctgattggcagcttgcctgcaagttttggacaatgtaggtttcttcaggtgcttgatcttggcaacaaccagctctctggggacttcgtcgaaactgtcatcaccaacatttcttctcttcgtgtgttgcggctgccgttcaacaatattacaggggcaaatccactgcctgcacttgcttccaggtgccctctgcttgaagtcattgatcttggatccaatgagtttgatggcgaaatcatgccggatctgtgctcatcattgccgtcacttcggaaacttctcctgccaaacaattacattaatggaacagtgccatcatcactgagcaattgtgtcaaccttgagtctattgaccttagcttcaacctgctggttggtcagattccaccagaaatattgtttcttctgaagcttgttgatttggtcttatgggcaaacaatctctccggtgagataccagacaagttctgcttcaatagcacggcattggagacattggtgataagctacaacagcttcactggaaacatccctgagtccattaccaggtgtgtgaatctcatttggttatcacttgccggcaacaacctgactgggagtattccctcaggattcggcaacctccagaatcttgccattttgcagcttaacaagaattcactctctggcaaggttccagcagagcttggcagctgcagcaacctcatctggcttgacctcaacagcaatgagttaaccggcacaataccgccacagctagcagcacaggcggggctcatcaccggagcaattgtctctggcaagcagtttgctttcctccgtaatgaggctggcaacatctgccctggtgctggtgttctgtttgaattcctagacattcggccagaccgccttgccaatttcccggctgtgcacttgtgctcctccacaaggatatacactggcacaactgtatacactttcagaaacaatgggagcatgatcttccttgatctttcatataacagcttgaccggtacaattccagcgagcttcgggaacatgacatatcttgaggtccttaacttgggtcacaatgaacttaccggtgcaattccagatgcattcactgggctcaaggggattggtgcacttgatctctcacacaaccacctcaccggtgtcatccctccggggtttgggtgtctgcatttccttgcagattttgatgtctccaacaacaacctcactggtgaaatcccaacatcagggcagctcatcacatttccagcatcccggtatgagaacaactctggactctgtggtattcccttgaatccttgtgtgcataattcaggcgcaggtggtctgccccaaacttcttatgggcataggaattttgctcgacaaagcgtgttccttgcagtgacactctcagtgctcatactgttctccttgctgattattcattacaagctatggaagttccacaaaaacaaaacaaaagagatacaagctggttgctctgagagcctcccaggatccagcaaatcaagctggaagctttcaggtatcggtgagccattgagcatcaatatggccatatttgagaatccattgaggaagctcaccttctctgacctacatcaggccaccaatggcttttgtgcggagacactcattgggtcaggagggtttggtgaggtttacaaggccaaactcaaggatggtaacattgtggctgtcaagaagctgatgcatttcacaggccagggtgaccgggagttcaccgcagagatggagaccattggcaagatcaagcatcgcaaccttgttccattgctaggttactgcaagattggtgatgagcggctccttgtttacgagtatatgaagaatggcagcttagatttcgtcctacatgacaagggtgaggctaatatggatctcaattgggcaacaaggaaaaagatcgcaataggctcggccagggggctagcattcctccaccacagctgtgttccacatatcatacaccgggacatgaagtccagcaatgtgttgcttgatggaaactttgatgcctatgtgtcagactttgggatggcgagactcatgaatgcgctcgattcacatctcactgtgagcatgctttcaggaacacctggatatgtgccacctgagtactgccaggatttccggtgcacaaccaagggcgatgtgtacagctatggagttgtgctcttggagctcctcacagggaagaaaccgattgacccaactgaatttggtgacagtaatcttgttggctgggtgaagcagatggtggaggacagatgcagtgaaatatatgatcctacattgatggccacgacatctagtgaattggagctctatcagtatctgaagattgcttgccgctgcttggatgaccagcctaaccgcaggcctaccatgatccaggtcatgacaatgttcaaagaatttcaggttgactcgggcagcaatttcctcgatgacttctcactcaattcaacaaacatggaggaatcatctgaaaaatcagtgtaaatgcttctggttcttgcacatttcgattgttaatggaatgtaagtaaactagtttaatcatttaacttacaggaaagaaaag

SEQ ID NO: 54568 - DNA, 9354 bp, Oryza sativa
  unsure (1)..(9354): unsure at all n locations
nnnnnnnnnnnnnnnnnnnnnnnnnnnnnnnnnngtgagtgagaagcttggaaaaaccaaccatgcactttggaaggtgcaggtctatgctgcaattcacggcgcgcgtctacaggggaacctgactggcgcaggaagaagctagacgccgagatcgccgtcacagttgatggcaagacggagaagaaggcgaatccggcatttgaagattgggaagccgtggatcaacaagtcctaggcttcctcctcacatctctttcaagagatgtgctcatgcaagtcgcaaggtgcacaacggcggctgaagcatggacaacaattgattagatgtactccacccacaccagagcgcgagcgatcaacacgtactatgcgctcaccaacaccaagaagggaaatatgatggcgcttggtgacgagatggcggcaagcaccgggcgacctgttgaagaagaagagatgatcatgcacatcattgccggccttggcgagggctacagcgaggtcatctcagcaatgagtgcgcgccccgaaccaatgaccatgggagaattatactctcagattgttaacttcgagggtcgcatggcactctaccgaggaacccaggagaacgtcgtcaactttgcaagccgtggaggtggcggcaatggaggaggttgcggtggcggcaacttcagccgcggcagcagcggaggtgctcccctaggcggttgcgggcgcggcaacaatgccggaggtcgcgggcgtggacgagcaccaggagctgcagatcgccgaccaacatgccaagtctgcttcaagcgaggccacactgccacagattgctggtataggtatgatgaagactatgttcctgataacaaacatgttgcagcagctgcggcggcgagctcctcccatggcatcgacaccaactggtacatcgacaccggcgctacagatcacatcaccggtgagttggaaaaactcacggtgaaagacaagtacaatgggaatgagcagattcacaccgccagcggagcaggtatggatataagccatgttggcaatactgttgttcatacccctaatagtcacaacattcatcttaaaaatgtgctatatgttcctcaagctcagaaaaatcttatatctattcatcgtctagttgaggataactctgcatttcttgaactacatcgtgattattttttgtcttaaggatctagccaccaagaaaacgctccttaaaggaagatcacattgcaggctctatccccttcccaagccatccttgaagtatgcttgcaatgccaccaagatctccttccatcgatggcacagtcgtctaggtcatccctcctcgtcagtggttagacaggtggtcaataaaaataatctcccatgtttagatgtgtcaaatgagtcagtttgtaatgcttgtcagcaagcaaagagtcatcagttaccatttcctgtttcatctagtgtctcccaacaccccctagagcttgtcttctctaatgtatggggtcctgctccagagtctctagggagaaagaagtactatgttagtttcattgatgattttagtaaatttacttggatctatatgctacagcataagtctcaagtctttgaaaagtttcaggagtttcaggttatggtagaacggctgtttgacaagaaaattctagccatgcaaactgactggggacgggagtaccaaaccctaaattctttttttttcgaaaattggcatagttcatcatgtgtcatgtcctcacacacaccaacaaaatgggtctgctgaaagaaaacatagacacatagttgaggtaggtctctccttactatctcatgcctctatgccattgaaattttgggatgaagcctttcaggcagccacctatctaattaatcgagtccctagcagagttaatactacccccttggaaaaattatttcatcaaaaaccagattattcggccctacggatttttggttgtgcatgttggcaaaaccttcgtccctataataaacacaagttgcaattccgctctactagatgcgcctttctcggttttagcaacatgcacaaaggtttcaagtgtcttgatatatcctcaggccgtgtatatatttcccgtgacgttgtctttgacgaaacggtgtttcccttctccgaactcgatgctaatgcaggagctcgttttcagtctgaattatctctcttggcacctaatattattagtggggatgaacaggaattccattcatgggctaatccacttgctaatctgcctaatatgtctcacaatttgcctcaagatgctgcaacagatcaaacggccacagaagatccaactggcgctgactcccatgatgatccctgcgcccgccctgacagatctgtgcatcgctcccctgcgcgcacgcctgacgcgtctcctgtccgccagtccagtactgccatgtcgccacaccagcattcgcctgctgctgatcgcattgttttgcaggggtcaccgtcgcatcgggagacaagggggcagcagtcaggcacagcgacgggtgatgggacgtcgggcagtcctgcaacagatattgaaacacctgacaccaatgacattgatactgacgatcttgatgtcacaggtattaatcccgatgccgacactatactgcctcattttcaacagttggagattcaggaaccacaacaggtccatcccagaacaaggctacaaagcggcatttgcaaggaaaaggtatataccgatggcacaattaaatattcctgctttactagttcaggtgaacctagtgatcatctagaggctctaaaggataaaaactggagattagccatggatgcagaatatgaagcattagttaagaataacacttggcacctagttccacctcagagaggaacaatgtcatcggggtgcaaatgggtgtataaaattaaaagaaaggctgacggttcactagatagatacaaagctcgtctagtagctaagggattcaaacaaaggtatggtatacattatgaggatacctttagtccggtagtaaaatgtaacgccccgattttcgttcgggattaaaaatcattaaataatgcattttctagaaattaaataaaagttaaatcaatttaatcaagtgaaataatgggagaattaaaattttcccttaaaaatcattggccgggaatattttgcaatattctttgtgccctaatgtactctccggaattttccgtgaattttcggagctcgagaaatagttttaatagcacaaagatcattgcatcaattaaaataaaaagaaaacaaataaaattttcccctctttgtcttgggccgctttcggcccaagatcttctccctctccatcctctcgggcccagccgccctccttttcccctcctcccttctctttgggccgtcggcccggcttgccccctcctcgcgcaagtccgcttcgcctccctcatcctcctcctcttcccgagccgccgacaggtgggccccacctgtcggggtcacccccaacctccagctcgggccagcaaccgccatggccgcccgagccgtccaacgtcgccgccgtttccgcccacctcctccaccccccgcgcgcgcgcttgtccgtgggacctcgccgcccacgtccgcgccgtttccccccactctccccgcaaaatccggccacgtcgccgcctcccgcgtctctctctcccccacgacgccggcccacttcccctcgaaatccgccgctccccggccctctcctcgcccccttgagctataaaatcaatccccgtggactcctcttcctttttccccgttttcccgagtaccccacgccctctaccgagctctccacgccgatccccttcgccgccgctcgccggcgatctccagccgcccgccaccgccgctcccgtcgctgccgcgctgcgccgccgccacctatagcatcacagtgcctcgccgcaccccggcatccactccatctccctcctccaccgccggaaccaccttcccatcgcgaggccgagccactaccgccacacaccgccttcagccggccgctgccgccgcgttagccgtcgccgcacctcgccgcttgcaccaccggcttcgccggccttgccgcacctcggcccccgctccgttttcccatttcatcgccggaaccacctccccaccgcgctccctctctccaccactcaccgacgagctccagccgccgccaagccgcgccctgccaccgtcggcttcgctgcatcgcgtggtacccccgccgctcttccaccttcgttggagaccgccgaatcaccgccgtcgtcttcgccccgtgggatgctgccgcctccctctgctcgagccccatcagccgcctccttcgccgccatgcccctcggtgagctccgccgcctccctcttcgcctcctccgctcgttttcgccgctccccggtcgccccctcgctcgtcgggccgacgccgccatcaccattgtcgtcgtcgtccttcccgcgtcggtgagcatctccctcctcctcccctccctttctttttctctctttgcccgccggccgccgcatgcgtgtcgccgtcgcgccgcgccgcgtcgccgcctgtgtcgccgccggtggtcatccggccgcgcgccgccgtctggtcgggttggtcggcgagccaaccctcccctccgccttgcacctctaccgtggactcggtccacggtgggctagatccttttgcccgctgacgcgtggggcccgctcttttggtggacccggtccaagcccgcacctccttgacccgctgacgtgttgggcccgcctgtcggcgccggcgccccttgctgacgtcagcgaataacatttcctttgagaaaatatttaataattgcgcaataaatcgagtttaattatagaaatccatttaaatggctcaaaacttctaaaattcatatctaattcattcgaactccgaattgagccattcaaattgcaaaattcatctaaaattaagctctacatgtttgtttactttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattctccttgagcatgttgatcccaatttataaatgttttaccgtttacaaataaatatgcatgttttgctaattacatgggatcagggttttcctatctgctcgcttgtgccatgtttacttgatatctatcctttgtcaaacttgggtgataaattgactagctcgtgttacttatgtgacctagctagaactatatgcttagccatgcttaattaccactagctcagtcgatgggataattgcagtattagacattctagtatcttgttgagccgcgtgctcgagacatctggccatgttacatggtcataattatccaactaaaatgcgactgaatggtgggctgtgggtgcatggttttgtgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgtttgctaaataaaatgttttacaaccgcctttatgcaaatagccacaaacccctccttgtatccccttgcacgtccgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttatgctttatttacgtttggagctgtttattacttgtcgttttgtgtaccctggctggtcctggacagggatttaatacacaaaatagtctggaaatttgggctaaatttctgggcgtgacataaaagcagccacaattaggataatatgccgtgtctagaggatggagtcttagacaactggatgttcagaatgcgtttcttcatgggtatttagaagaggaggtgtatatgcaacaacctccagggtttgaggatgtcaccaaaccacactatatatgcaaacttgataaatctttgtatggactaaaacaagccccaagagcctggtttgctagactgagtcagaaattgattgaacttgggttcagtgaaccaaaggcagacacttccttgttcttcctgaataaatgggagttcactatctttgttcttgtttatattgatgatataattgtagccagttcatcagagagggcaactgcagctttacttcaggatctaaagacatattttgccttgaaagatcctggagaactacactacttttcttggtattgaggtaagcaagatacataatggtattattttgacacaagataagtatgctactgatttactaaagaaagtaggcatgataaattgcaaaccagcagctactcctttgtcagtaagtgaaaaaatgtctgttcatgaagggtctcctttgggtccaaataatgctacacaatatagaagtatagttggtgctttgcaatatttaactcactagacctgatatagccttctctgttaacaaaacctgtcagttccttcatacccccacaacagtacattgggcagctgttaaaagaatcctgagatatataaaacaatgtactaagatgggcttgaatatacataagtcagggtctacattggtcagtggattttctgatgcagattgggctggcagtatagatgacagaaggtcaacaggtgggtttgctatatttattggctcaaatctagctagtgtcatggaatgctaggaaacaaaccacagtgtcaaggtctagtactgagtctgagtataaggcgatagctaatgcaatagcagaaattatgtgggtgcagactgcttgctgagttagggattaaaagtccccgtgcaggtaaaatttggtgtgacaatcttggtgcaaaatatttatctgttaatccagtgtttcatgcaagaacaaagcacatagaggttgactatcactttgtcagagaaagggtaagtcagaaattgttggaaattgattttgtttcttccggtgatcaagttgctaatggatttactaaaccattgtcaactaatcttctggagaagtttaaagccaatcttaacctaaccgagaagtttaaagccaatcttaacctagcaaggttatgattgagagagggtgttagttgagtctatttctatctccatgcatgcgataatgatcggtttagttgtaataagatatgattagattttatctcttcctttacatttgttatcgcatactggtttctctcccgagttggcgcggttgttgccgatctcgtggacttctgtaatcgccacagtgagggctattctcaccatatattagcgcgtaagcaacgcactgaaacgtacgattgtttcctgccaaaatcctcacaccgccatccgaggacgcggcggtggcttaatttcgtcggcggcggcacccacgtccggcgctgactacgtggcccgagcagtttcacgctatgtttactattctcattagtgaagcagtgagccggcgcctgccacacttagaagttagaacaccatccaactcaaataagctcgtcgcatgcatgctgctgcatgcatctctgggaaacagatcgaaagacacaagtcatggcagagctgtattaagttactgaaccagtgaagaaattttggactgcatcactgcatttgttcaataggaaattaaagcacattgttgggtcaggatagtaatcactgcagaaacttgactacttcaatttcccttgagaagaatatcagacttgacataatgatgcaatgatgcaagactcgtgggatttgagtcgagacgtgacagtcgaccatcggccaggcagtcatgtgctcgagtggcaggatgctgatgggtggcggggcaggaggtcgagttgaagtagtacgaggtgctattggtccactcgacgttgtagacctggttgccgatcgacttgccggaggcgactgacaaggttgaggttgcagccatgggccatgctggcatatcaagagcaccttgtgaaactgctcgggattcggcgtcagcgtcatataggagagccaccgctgcggccctcgaccggccggtgaaactgctgcggaaaaaagtacaccgaaggtccccgaacttgtcatcgagttaaaaaacatcctcaaatcgtaaaaccagatatccgacatccctcaactaattaaaatcggtcacaataggtccttttgtggttttgattatggttttatccgacgtggcggctgagtcaacgtgggccccacatgtcaggatgccacgtcatctctcccccctcttctctcccctcccctctctctctctctgacttttcccggctcgccgtcgctgggatctagctcctcccctcgcggcggacgcggacgtggactttcctggctcgccgtcgcttggatcccctccccccgcggctgacgcggacgcggacttccctggctcgccgtcgccgggatcccctcccctcgcggtggacgcggacgcggacttccccagatcgccgttgccgggatcccctcccctcgcggcggacgcggacgcggacacggactctggcacggtcgcaatctgctcacgcgtggccc

SEQ ID NO: 54569 - DNA, 9099 bp, Oryza sativa
cctgcagcccgtctgccgtgacttccgcgccgccgccgactccgacgccgtcaggtcccgcttccttccccgcgacctcccgtgcctcgccgacggtgagctctccctgccgctgtccatgaaggagctcttcctccgcctcttcgctgcgccccttctcctcccacacgaactcacggtgagatcccttgcagtggcggcgccgtcgccgcttcctcctcctcgccgctgggctactagccccggccgcggcagcgtcgggccgcccgccatgactgaggagagaagtgagagagaggaggaagagaggggtgatgatgtggcatctgacatgtggggcccacactgattcaatcgtcacggtggataaaaccggattcaaaaccaccgagagacttaaaagtaaatggttttgtaagttaagggatgtcatatatctgtttttgcggtcgagggacgattttgtaacttgataacaagttgatggatcttgggtgtactttttccaactgctgctgcagcgttctcagctatttctcgcttacctgttagtggaccgattctattacagtggaccgaaagcgaggctaggttctctccgctctctcggcaccattcgatagaaaatgaacggcgcgcgcgcgttggacgtccctttgacgtagatcgatctggttccgttcccaacccctccaaaagatacttattactcctctggtttgagaatacaagacgttttaacttttatcaaagttaaactgttttaagtttaactaagtttatagataaatatagtaatatttataatactaaattagtttcatcaaatcaataattgaatacattttcataataaatttattttgggttgaaaaagttactattttttttacaaacttggtcaaacttaaagcagtttaactttgaccaaagtcaaaatgtcttgtaacctgaaacggatggaattgatgattagacctaaattattctctgtcgttatgtgcttgataagaaacttggatccatatcaattctagcgaatataatgctgctattgtttctgttgcactggcaactggcaagaatgatcaattttgtgctgaaatgcgcttggtttgtcacgattttgttgccctcattttgatcttggacattgcttttcatgtttgcggttggaataggaatttgtacaaattcataaatgtgtgcttatgcacaattttggttctaaaacaaagatgaagaatatctggaggtgctctttttctcctgaacataaagataaaaatgaagattaagtgtttgacgcaaaacgaggtggtattaacgtatgattaattcagttttaatcattacaaacttaaaaaatagattaatctgatatttcagagcaacatttatatagaaagttttcgtacaaaacgcaccgtttagcaatttaaaaagcgtgccacaaatatccaaaattttattaacctttttagtggaaacgaacggattaatgctagtgaacatgagcacgtcccttgcacttctctaaaggaaagacctatggtgaaaaaaaaaactgaaggcgcacacggaagcttaattagaaattttgtgatgtctagaaatttatccctcgcctcagcagaattgtagcaaacctatttttggtgattctgaaaagacattcatactagactatgtaacacaaatttttatggttcagtatcaaccaatcattaaaaagaaggaattaaacttttcaaaccaaatcttgaatcttcattctaagggcctctttagatcccctagcaaaagttttcaacctgccacatcgaatgtttggacacatgcatggagtattaaatataaacgaaaaaataactaattacacagattgcgtgtaaattgcgagatgaatcttttaagcctaattgctccatgatttgacaatgtggtgctacagtaaacatttgctaatgacagattaattaggcttaataaattcgtctcgcggtttacaggcgtaatctataatttgttttgttattagtctacgtttaatacttcaaatgtgtccgtatatccgatgtgacacgccaaaacttttcattcacccctatatctatacacagcctaagcttctactccctccatccaaaaaaaagacaaaccctagtttccgtgccaaacgtttgactgtccgtcttatttgaaaaaattataaaaaaaattaaaaagacaagtcacgcataaaatattaatcatgttttatcatctaacagcaatgaaaatacgaattataaaaaaaatcatataagacggacagtcaaagttggacacagaaacccatggtttgccttttttttggaacagagggagtagtcctctattcaaatataagcaataaaaaaatcaggccttaaaatccaattgcaacgtcagatcaatcgtttctcgaatgaaaatcgtgttcccaaattcacactccaaatttgccattcaaatccctccacctctacaaaaatttctactgttcattcgaaaacacaaacaattgtttattggatcatcccaactccatacatatatactatatgatgcccgcggatcatatatcctaactccatacatatatactagatgatcctcgtgcttttctgcgggatatatgttagatattggagaaatgatgaaatgatttagtttgaaatattatgaaaatgatttgtcaataatgaattagcatgtgtatgtttagttttataataaaatagattgtagatataattactatatgcttgcatattgagttttgtgtgcttaatgggttaatgtagcatgcttgcatgtaggttttaggagtacgaataaatacaatgcttgcatgttatgttttaggtgcttaattagtagcttaataaaaagaagggatatgaaaaatcgacaatctttccttcattttattggtctgaatggcccaaaattaagtgcagccaaagcaatcccagcgaacacggccacaccaagggaccccaagatcatctccatggagctcaccgtggacacctcctccctcttgacatgcgccgacgcggcggccatcaccttcctcaccatctcctctgcggtcgccgcgtcggccgccgcgagccgccggaacccctcgctgttcttgacggcctcgatgccgcgcgcgccggtggcggcgacgtcccggacgacggccgccttgagcagccggaggccgagcctgtcggccagcgcgtacgtgtcggccgccgtggccggcgtgacgcaccgggccagcctgtcctggcacgcctggctcagcgcgtccatcctgtacaggtccgccgcggcgagcaggtgctgcgccatgtgcacgccggtggcgtccctctcgctgttcccgggcagctccggcagggtatcgtcgtaggcgaagcgcagcatggcggcgaacgcgtcgggctccatgtcatcgatggtgatggtggtggtggcatcgtcggtgtcctgtgtctcccccatggcgcgcgccgccggcccgtgagctccgccagcaacacgggcgaacgcgcggcgagcacgcagcggtgcgcgcggaaccgctccccgcggacgacgaacgtgacgtcggcgcccgtgccgtcctccagcatgcggcggaggccgcgccgcagctcgtcgtcgagcggccgcgggccccgccgcagcacctcgtcggcgtcggcggcgaggagcacggcgcactcgaccacgaggcggtcgccgcggagcaacacccccgacgcggcgaggtcgtgctgcaggatgaactccgggaagccgaagcagccgcggcctacggtggctggacccgggccgaacacatggtacccgcagcgcgtgtacgagccgtcgtcctcgccgccgccggtcatcccgccgcggcggtagacgagggtgaagtcgacgagcacgcggacctgctccctgtggtcgctggagacgaggcggaggaagacggcggcgtaggggctgccactgtagtagccgccggggaagaagaggatgtcccagaggtggccgccgaggctgaagagaccggagatgacgggcttgccggagctgaggccggagaaggaggagtacggcgtgatggtgaggcgctgcgtcgacgccgtctcccgggtgggcgcccgatcgccggacgacggcgaaggtgcggccatgtcgagttagattggaattcgattttgcttaggtttgtcgtaataattagtaggaaaattttttgaagaggaagccgtgcttcattgatctttttgatcatggcgaattattacagtgtcctctagatatactccaagattatatcaggaaacataatatcactgtattttttttcattactactccaaattatacccgtacgttgcaacgggtaaactaaaatacccgtgcgttacaacgggtaaactaaaattataccaaatataaaaatattagatgattgagtcccactccggtgctttctactcggagtagaaagtaatttgggccattggtcgtatttaattgtagggctgagatctagttctactcccaccagtattagtattagtggaagtagaaatatggaagggtgttttcgtcaagggaaaaaaatcgcgtaggggtattatcgtatttttcagtctcttacccaccctatccctatccgattcctctcgcatcgtcgccatttcaccacttcccgtcgccattcccccccatccccgcttccgccgccgtccatctccctcgccgcctccgtcgcctgtcctggcgtctcctccccctccagcgccgtcgccttctctgctccctcgccgcactcgcccttcctcgccgccttctccaccgccagcgcccctctgtcgacgtccgcctcccccgatattggcggcttccctccgtcgaagcccttccttgtcgccctcgccgccttcgcctccgcccgcgtctccgcgccggcttgtgagcccccaccgtcgctgtcctcctcccccgccctcttgtctagcgagtcgcgtgacgtagccgcccctccacccgcctccgccggcgcgcgatgagtcctcttcgccgcgtcgcctccccgcgccaccaccgccacgttctcctccccatggaccgacgcacccttctccactccacctctgtcgccatcgacctagccgcccccttctctgaagtgtgaacatgcccttggcaaccgatttaacccagtgtaagcgatactctattagttaataggagtactactaactgtgtcatattaatcacaattcaccaattctattgtcttgaattgcagttttttttggttaatttacaattttccatctttagtgttcagatactatgcgaggaatcgagaggagacagccgagcttcaggtacattctgaatcctccaatcttaccatacttttcttaccaatattcagttatacggtatcagaaagacaacgaagagaagttggtaaagagtatcatcttctaatgcgagattactcatttactctgttgcttcagccttcattatagtgctcacctaagcagcatcttaatataccaaccactactgttatgattttgcagataaaggttgtttgttcttgaatccattgtattgtatattgattatttgattgaatggttgggagcagggtcagtttgcaagacggtggcatgcgcgaaggggatccgtatgccggcgaaggggttatcggtgttcaggtgcgacattgtagcatacgcacgtcggtgacgtcgatagctgactgcgctgagtcatcccgaagcgtaaggtttcatataccgctccttctcaaatggattgaaatatgaattatgaatattatctcaaaaaggcatcaatgtttgggatccatcaaatacccaagtagtatctaaattatttaataagggtaagagagcatagtaaggtaattgtggtaaatgtttgacagataatccatttatgtcgtggttggtagcagtggacgatctttaatgttgttcagttcggagttgatcaaaattccggctaagtcctgtcgaaatgttttcacttccttctgcataatgcaaagggagtgcattttaaatggttttttgtattgggaagcactggtgcaaaatatgaatagaggttgttgtagttgcctgtagttgaatttctgggagataagatccgctccaatgctccatgaacttaagggtgtacaggccacacgagaagctacaagaatttagtcgttaggctaacatgtttgcgtaattgaataatgtgaatatcatgtggaagagtttgagtcacccacccgtctccttgctttggcaagttttggactttgttgtactcccattcggtaatattgaaatcaggccaatcgtgttttaactgtgggtgctgattctctgtcccgtgtaatcccctctcaatagctagcagctggaaagttttgtgcaacgttggtacggttaaaacatagcaaaaccaatttgaattatacaagtggaagtgtattgcttaccacacgccttagatcaggtcgatctttactgattggctttgcgagcgaatctagtatttgcacctcacatcgcttggcgttaagaacggctaggtaccagtgtgtatctttaatattaattgggaggaaaatctgcatatgttcattgttcaacactaagatagagtcataaattgaattagccattacatagatagagtcataaattgaattagccattacatagatagcttgaataagtattaccatgtcaaatgctagatagtcgcgtgccatatctctaatccatcgtttatctcgaggtttgcttgcttcgacatgcgctccctctacattagtagacctgttttcatggccatctctaggaaggccttgccatctcccctgattcctttctctttatagcggaggcataggatgtatgcatccatgacctgaatttgaggttagttcagttatataacaaatatagttataaaagaatagtaggcttgttaaataggcgaacttacatcatcattcaagaattctggttgtgttagtactttcattcttatccgtttaacctccacttcttcaatatgcaccatcactttgttatcctccgtgttattaatgtaggtaatgaacgggtcttcttttttagtcaactctacgaaggttggacaaattagtaatagatctatagaaatgttaaatggttagtcattaccttctgaattttttaacattgtttggccattcgtttttttttcttcttttgacctcgtaaggcgttctttggtggtccgttgtctatgtttttttgcgtaagatattccttctctatgtacactaagaaaagggtaagtcaaatcagtaacacacaaacatagaatataagtaaaaaattatggatgatgtagagagttcatacattcggatatttcattcagtgtttggttgtcttgtttcctcttcttttcaccccgtaattcgctgtgtctggcatgtaagcttctttattcgtttgcgcttgaaaaggagtaaagttagtaccattgacatgagcatatgcaactatgaaatagcatagtacctattgttttctttgtctgtgcttgggttttgattatgtccttctttttacctcttgtttcgtagatgaagtcagtccgattagttggtttgtatgttcttcctgtaggacctgtaagcatcttcctgctttgattgctctagttactattgtcctgttaggtaataaagtgcacgttagtattatgataagttgtagtaacgttagtgagagaaataaaattcagtttaccttcgtttcacaagtcatgtttacattttgatttatataggactcttcgttatgatttgatacatgctccctgggatcaatttgttcttgttcaacatcctgcaatagcgtcaaccttttttttagcggtgttacgtaagtaataatgattaacagtctagcatatgatctttacctcaaacacatgcgtactatcttttcgctctgggcattttgaatcattttccatgcaatctagtatcaatgatcgcatacgtggccaaaaatcctttgtgaaatcgttgaaattatcttgtaaagtttggatgctttcttgtaacctttcttgtaaagtgatgtcggctgattgttcagtggatgttatagagtgtacctgaatagcacaagtgagaaaaggatgtcaaacatattttgttaaatagagttcgtattaaaaccccataatatatacctcttcagaagtgccttgaaaatcttcattgctacgtgtttctgagtcattgtcctgcgctttttcatcggggatttcattgcaatgtatagttcccgtaatgtcgtcgacaacctatttttagtgaaaaaggtgtattagagattttacagacagttgatatagttagtacatagtattaaaaatgagatagttaccttcccttgtccaaaaaggtaagaaattcttttttttttttgtcccagtactgaattagtggcctttgacgaccagaatgatatattgtcgcagccaatttatctattcgcactttttcccaataccaaatctgcaaagcatttgtacataagataattagtattgctatgaaaatatgttcatgacaattttgtaaagaaactcaattttgaaacgaacctgtaagaggcatacgttcccctcaatgtttgttgtcttctctctaaattttaatatgcctttcagtaactgatttagtgttagactagaccagtttagttccctcatgttgtcaacgtcgtcgacgagattgagatattctgagcgcacatatctttgagttgtaggacatatgaaggatccaattgagaaaagaataaatctttgaatgaagtggtcatcgtagctcaaggagttgattattgcttcccgtaatgcttgtaaagtaattgttgtttggccttccttttttacaggttgaacaattctggtttattgatttttggtggctcaaatatgtcatctctttttgatggcagtccaagc

SEQ ID NO: 54570 - DNA, 2618 bp, Oryza sativa
caattagaaatcaaaggaaataattaatcctgctctggcatgttactcgtctgacatgttgaagtgatgtcctccatcactgttctggcagtctatatggccctctctataatttgttcaatgttcattcttatgtgcaggattcagtgaggttgaggagtttgaggggagcaacatgagtgaggtcttcgagggcaacatagtactgtcaggtttgtgccaccttcacccatgaccacatccctcactttggtttgaaagtttgaaagtgtgaaattctgaacatatagtggctaatatagatcggtcgtcgaggcgtggtaattatattgaaatttccaatcaattctaacatatattcagtataattcataagatctcaattgggttgaagattcaacaaatataattaagattgtctggatggaatatcatgcatgattgtgtttctaaggtagatggtcacagtgtgtctgtgtgtggcgtagccctgctattttacttctttaatcatgaggccaacatttccggattcaacataaatatgcactgcatgtttcctatttcattgctcatgaggccagcaccatatttcagacagtaaaaaagataggctcagaaagcagtataaccgtttctaagatttgaattgttgtagtattaacaaaattaacaaacagtaggtgctaatgaagtgctgtagtgccattgagtttacatcatctccgcacattgttggctgaaatttaaacttgtaatcttggaagaacaggcatgcaacccattataaccagtatctgaaagttggtttcttatattacagagtaaatcattttctttgttgtaggagattacatatcatggaacctgtgctttcagacatctgtgtataccctgacagtgaccaggattagatcttcatttttagacagtctaaaactaaactaggtcaccaacggaaacacatatgaaaacattgagcctctctgaatatgctacatctaagttttacctctttagatttgtggagaacaccatgagtttggataaaaatataagaaatcctgatttccttaattggttgtagataaattattttatacttaagtcagcgatgacccctatttgttaatgccagatcttcgacacgaatcttacactttgtttttgttatgcaatctatataaattctcatcataatatggctatgataattacttgtatgataattgcttcgttatgattctcagaaatcctaactaattctcactaatcaataatatatatcccaatacatcagcacacatgaatctttgctactgcagggcgtcgccagtgccattgtcagcttcccgccacaaacgctctggatctcaaatccaccacgtcgaagcaggggttggtcaggccggcagaccatctacggctgcgcctaacactccccgcaggtacattgcttcatcccattgctcccataggcttttagttttttttttttttggcaaaaagtcgagacaaaaagttatatgccctaatggcatgtggatgtcatgtaattactaaatttttagcatgctgaatatataacatggatatgttgctttggattaatatcactgtcttctcaaaaattaggtgccattctgttcgttttttgtatggagtatgacaagtatataaaatagttgtatggagtaggacaggtatataaattaggtgccattctctttttttttatggagttgtacaagtatattttttgggatatctgccgtgctgtgtactctgtgtggctgctacatcctctatacaattgctccagagactagccagagcttaaaagaggcacacagtaaaatcaggggagagactatattcgttaataatctaatcatatgtgctgtaattatcgttgcgctttagacctattgcaactttggcttgaggagtctaagatttcgacaactgatgtatacaagagctgaaagtgaatgttgtatgtaaaaagacgtacccgttttttcttatgttggcttgtgcccgtcgtcgctgcatgaaattgttttcgtttgctctccgtcggcggctcgtaagtgggcctcatcttgttatctatttagtaatttttgtccagaacatgtgagccacccgacatctgtctcctatatatatatatatatatatatatatatatatatatatatatatatatatatatatatatatatatatatatatatatatgtatgtatgtatatatgtatgtatgtatatgttacatgtggattaagctcggtatgtaataataggagatcaattaggtctaaaaaataacatataattcggcaggaataaataacagataattcgaaacaaatcaattcggttagagaacggaaattatgttagacttctgctacctacatcgctagtatttgtttaaaaaacctcgtgtatttaaaacgcaggaagttcgataagttccgacaagattttatttgtccaaaacaatcggatccgatatattccatgcgatctggatggtcggcgatatgattttttattcgtccaaaataatccgtttcgctataatatacgagcgatcgaccgaaaattta

SEQ ID NO: 54571 - DNA, 2162 bp, Oryza sativa
ccaaaataatccgttcccctgtaatatacgagcgatcgactggaaatttatgattttcaaaaaccggcccggtgggcaacatgatcgaccggaaattgttttcttacaaatcgactcggcccggaccaactcgagtacgtacgtgaaaaccatgttttcggatatcggtactgttagttttaaaaacctcgtgtgttaaaaacggaataataggagagcgttaatataacgcacgaagttcgataatttccgacaagattgtaatcccgttgttgtaggaattcatatttatttgttttctaaaaaatcgaccggaataattgttttataaaaaatcgaccgtcccggacgtaataattattttgttcgaaataatccgttccgctgtattctatcgcacgcccaaccgaaaataattgttttctaaaagatctaccatccattggactagcctgtaacctagtaacttaacttgttgtcatcagaagttcagaatattagaaaggattaaactaatccaaaagcatgcacaggggaaacacttaatatgcacatcttgagaaaagattaaactaatccaaaacaaaaacaatgccaataatacaaaagatacaaagtttgtgagccacaattacctaattggttatttgtgtgcaatgtctcacggaatggccttcgtctcttagatggagctcattttgccctaatctcttcaggatcaagtactctcttctctaatggctggttactagatgaaaagtgagttggcataggaccaaaatctccagccacgatgttctcatcggatgacgatcctttatccaaaatcccctttaagaaatccatcgccttttctgtctgctagagttcctagcggcctcgaagaaagcatcactacccagatttcggaggctacggtaacgaaccatgtgttcagaccacacattaggatcggcattcctgtctgacctaaatgtcgcctttgctcccattgtccacctatccacgacacaacaacgagagatggtgtcaaaaccaaggaacttgagtacaacaaaaatatgtgagcaagggatgtcttcgcactccatcttccgacaatgacattccacaccttccaaagcctggcctttaaaagtaaccctcacttcatcccacacctcattatcgtccttcaaaccaacagcatacaatgacgaaccatcttgattagtcccactgatgacttcaagtcctgcaattagccgtatctgtgcacggattgtcttgaacacgactgcagtgtatatacgggcaacgtctttctccaatgggtcggcgtctattctacaaaaagggaccgaattggtagacttagcgtccaactgagcctccttcttatgcaggcgttgtatgcacaacttaacatgtttgactaagcacattagtgacatgtttctctttagaagggtgtgaagctttgagttcagtgactcactacattggttgctgtgcatacccaacaagtatttccaatatgtataggcagctgcccacttctcccttagtcggtacatcagagcgatccattgtccatttcccgtgcctccattctccttaaaatcagcccaacgtctctcgaacttgtcctcatccatattctcataaattaattttcttagctcgtcgagttttggcttacgaaggtgacgactcatattctcctctatatgccaagtacacaatctatggtaagcacccggcattaccttactgatagccttcgccattgctaggtcgccatcggtaatcaatgattttggatgcacttgacgcattgcctccaaaaaagtctcaaggagccaacagtaagagttgacatactcatttgatagaattccgcacccaaaaattgttgtacttatgtggtagttaactcctatgaaaggaatgaaaggaagattgtacttgttcacatggtaagtgctatcgaaaataacaacaccaccaaaagcagcatagtctaaacgtgattcagaatctgcccaaaacacattcctaagacgcccgatatttcaacacatcttcagcatcatgacccttgatattcttcatctcgtaccgtgtaaagaaattataaaggtccttcatcacaaaaccaacctcatctaactcatcatggt

SEQ ID NO: 54572 - DNA, 10605 bp, Oryza sativa
cgacgcgggcggaggagacagacggcgattgaggaggcggagaaggcggcgacggcgagcgatacggacagcaacggaggcgggcaaggcggcgaggccgggggaggaatggcgcgacggaatccacacctgcgatgcgaaccgatgcgaacagaagaaaacatcccataccaaatttacccctaaaggatattagaagattacttacctaccctttaaaataaagggtccagattaattctactcggagtagaatacttcaagtatattgtaccggagcattcccctagatgattagggtttagttttacatgatatgagcattttaagaaaatctattactaatgaaataaaaaaagaaaatccattactaatgaaataaaaaaagttcaacttaagagacctcaagtgaacttatttcgtgtggagcgtacacgcggcccatgaggcggcctatagtgtgggcggcctgaaaacatattcggggataactttagggacaaaaagtgaacttattctatgaggagattacaagcagcccaatagtgtgggcggcctgggaacggcacccggcccgacgcaggagaagctggagtcgtgcgatctgatggacggtcctaattcattgcgacctatatataagttcaaaaggtccaaaccctaaccctaaatcatttccccttcctctctctctcagtggtgccgcctctcctcctccagcgctcctcctcgccctccccggcggcgccgctctctctctacctcccccaccggcggcgccgctctatctctccctcttcttcctgaccgtccttccccccttctcttgcctccctcgcgcgacggattcggcaacggcggtgtcggcggcgaccgtgggtggatctggccgcggtggtggcggccaaggatgggtccggcggcggaggctccctccgacccctctcgcctccctcccatagcagatttaacagcggtggtggcctcggcggctaccgcatgtgcatctggcggtggttcggcacggcggcggacccagcggctgctgctcctcctctcaggtgtggcgacgtggccgggagtggtgatgggctcaggagcggcggcgggctcgggagccagtcacggcggaagacgactacggcgacgacggcggtgaccacaaggaaggcggctgcgggaggcggctaggcttagggtttggattttacttttgaattggacatgactacgacgagacggtagctggattgtcgtaaccagcttacctcactcgttgctattagtacacctaatagtgcctttctttatttcttcttatagaattttcttttgatttactcattcgaattacgatctgattgcaccgctgtgttcataacaattaaatctttaaaacaagatctcacataattatattttaataaaaaatgataaattaattttataatatatctaaattacttttagatttcaataaattacttcttagacatataaagtaaattcaataaatcataaaaataatttaagaataacttaaaagaaaaagaaagtaacttatcacaacaataagagtaaatctattgtggggtaaagaaatatatcaatctagaaattatatttaataaacatattgtagaactaaccaataaagtaaagtgttcattgaatgtctaaaaagtaatttaatcaaatatagaagtaattattgcatataataaaagcaatttacatatataataaaagtaatttacaacataaatattttttccatcataatataatcatgtaagatcttgttataaagatttaattgcaacaaacaccatggtgtaatcggattataaatcaaataaatagtttaagagaaaattctataagaagaaaaaaagatatatactattgggtgtactattagcaacctagagtactcttatgtatgggtgtctctcgttaaggctaaaccggagtgttctcggtttagattttaccttttgaattgggagttgattttgtggggattcttgattttgatttgggattgcaattgagtgattttgtgattcatgtattttgggaattggtggcaaaggggtggggagcaatcagctgatctactcagggtttttttttaaaataaaagacggactcggactcaaacgacgactacggacaaaacgggtgatcgaaagccctacgtattttttaagtaggtatatagatatggaagaaccaccaacacatactacattcataccgttgacacctgcgttcgttccctggagttgggaacgttcatctcaagcacgaaaatcagagcagttcattaacatgtgattaattaatactaattaattaagtattagtaaaataaacttgaaaatggatcaatataattttttaaagcaactttcctatagaaattttatgcaaaaaaacatagtttgaaaagcgcgcgcgcagaaaacgagggaggagagttgtaactctcaccgccgaactctctaacatatgctgagatgaaagctaacggcaatttcttgatctaactttaaaaaattccttatgtgtcccttaaaactcatctaatccctttcatatctttcatatttgcttggtccttttgtaccactgaatttttactttgatcactaatatgcctcagctgttacggccctcccatcgcctcccggccccatactcccgtcgtcgccatcgatccctcactctcatcgcccccacgagcagtgatgtcaatttcggttccctatcggcaagcaaatatgttagccgaattttccagggctttttttttttccaaattttacgaatttggtgaaggtttattaaaatttccgtgcaaaacgaaattgacaacctaaatacttgatacctagtatcaggtctggtatctaaggatatcagaccgatctagataccaagtacctgatacctaggtatccgatacccaataccaagtatcaagtatcaaggtaccatgtaatcgatacctgaggtatcaggtatcaggcctagtacatatggaactaaactgaatactttggcttactacttgatacctagtatcagggacttgatacccaggcatcaagtaccatatgggtgacatgtatgatttgtgggtatcatgtcttctacacatctgttcaagctattaactctatatactagaagagtgtcagagcaggtctctagtgtgatctttggctgcataaaaatgtttaccaaagaaaagctagtagtactttagtacataagtctagtatatagtagtactattagtacaacagcatacatacagaaatccggaggcaactctagcctctgaccaacttagcaatgctaaggccccctttgattcaaaagaaattcataggaattttagaggatttcattcctatatgaatttttcccacaaagctctttgaatcaaaggaatgaatcctatggaatcctataaaattcctatggaatgcctcttaccatacaagttttgaaggaattttaacaagaggtagaacctcatggaagaaatcctttgagtctttatctcttctcaaattcctgtgtttttcctgtagtccaatcaaacggtcatttctatgtttttcctgtgttttgcaatcctctgttttacacttacattcctgtcagaattctatgtttttcctattcctccatttttcattcctgtgattcaaaggggccctaagtttttctcacgtcacgcctggcccgccttcgcatgctctcagaacatatctaaacatgaaaaagaacggttcactcataacttatcccattgtttagacagtatcccgtttcctagtttttctcctttagcgtttccttcgataaccgggggatgctttacatccgatattacggttgagggccccttttattcaaaggaaattcataggaattttagaggatttcattcctataagattttttcctatatagccctttgaatcaaaggaatggatcctatagaatcctatgaaattcctatggattgtcttttcccatgcaagttttggaggaaatttaacatgaggtagaatctcatggaaagaatcctttgagtctttatctctcctcaaattcctgtgtttttcttgcggcccaatcaaatagtcattcctatgtttttcctgtgttttgcaatcctctgttttacacttgcattcctgtcagaatcctatgtttttcctattcctccattttttcatttctgtgattcaacggggccctgaaagatgtgaatcgatatcgggctagagtcgagggtgacgaaacacacttgttccgctccacttcaccaaacaacccaaaatgcaggcataaggaaaaagtacatcagaggtccctcattttgtcaccgaattacaaaatcgtccctgaaccacaaaaccggatacaacgcatcccccaactcacaaaaccagtgcaaactaggtccctcggcggtattgtctccggttttggctgacgtggcgcctacgttgctcctttcactaggtcttagttccatgtggcaatgacgtggcgcttatgtggcaatctgatccaaaaataaattaaaaaaactggggcccacatgtcagttgcatgcggcgtccaggagggagcgcgggacttgcggaacggctggcgggggcagtggggcacccgctcacgccgccggtcttcacgccgctcctcctctggctcctaggcagaggggcgctttttcttctcgcgcggcttgggagttgggggttagtggacgaggccggcgagtcggggaagctgtccatgtccatgaggcggagagggagcagccgtcgacacaacaacgagggtggggagcggcgcagcgaagcgggacgcgaggcgagagagatggtggtggagcagccgatgattccaagagaaacgccgttgcaggagccgttgatctttgccgctgccgtcgacccctgcggcggcgacggcggcacggtggaccacctcttcctgcatgtgctcagcggtgatgtcccacgagagcgcatccctctccatcccgctaggccgtcacgctctctgccctctcccgccacttccgcgtcctctcgtgacccgtcccagttcggccgcattgactctggcgaccttccccgacctgctcccgtcgctcccggcgaggccgtccttcatccgccgcctcgccttcgcattccagcaccgcgggtgtcctcctccgccttctcccgactcctcgacgccaccgccgaccgcggcctttccgagcttgccgtctgcctgcaccgcaacgggttccttcccaagaacctcctctccatccgctccctcaccgtggtctcactcaactcatgcgggttgcctcgccggttatggaggaacggcaggtgggccactcaagctgtgcgggctgccagtggcaacccttcaaatcactcaaactcacacttgatcggaggtggaagatgatgaacagtgaaaacaccagctgtttgatgcaggaatttttggtgccgcgtagaacgttgcagcgtttttttggggtttacttcacttctataaagcaaattacatgcaaactaaaatcaactgaaaaactgggagtgccatagtggcctccgtcatgtgtgccaatactccatgagacgtgctcctggccaaaacacacgacgctcacgctgcaacatgcaaacgcgctcatgcaacatgcaaaaacgaaaatataatcttcggctgcacatgattaaagaacgctaacacgggcaatgccggagcagacgctggagatggacatcggcgaggaggccgcgccgattgacaacgaggaggctacgctgcaacatcactggggcggtggtgcttggtgagtaccttcggcggcggcggccacgggcgccgaatggatcacaccgccatgtcgctggattgggtaagaaaagaagaagaccgagagattggggaggagacgtgggtcccggccgtgctgctcggccacgtgcgactgtcgagggcggcggggaggccggcggcgagagacggagagggaggaggcggggctgacgagggggacgggcaggccgaggagctggcctgctccgcccaacgccgtgtagcaggagagagaagaaatgtgaagagaggaagggggagaagagggagaagaaaacgagtatgacatgtgggccccactgtttttaatttattttttaatcggactgccacgtaagccccacgtcattgccacatgtaacaaaaacacctagtcaaagaagccacatagacgccacgtcagccaaaactaggaacaatactgctgagggacctaatttgcactgtttttataagttaggggatgcgttgtatccggttttgcagttcaaggatgattttgtaactcggtgacaagatgagggacctctggtgtactttttcccaggcataaatgttctgcattcgcgtttgtgggccgaataagtggaaacagtagtacgtgggttaattttgggtcgaacttcaacgctttgcgggctgaacgcacatgggctcgatcgtcctttctggcccagttggggagtgcgacccacctttccctggcctcctcgcctcgccacttcgcccgccgcctgcgcctgcgccgccggcgacctccatcccgtccccgcgcgagcagggtccccggcgacctgctgcttcctccgccggtgagctccggtacctaggcacacaatcctctccagtgtaacaggagatggtggagcatgccactcttgaatcctctaagccgcgcgccttccacccacatccgcagcttagctcgtgtcctactctcatgcctccccaccggcggcgaccgcctccggcgtttgaacccggccatccatgcccgtgccaccgtcgcaggaagactcgacgacctcttcctcaccaacctgctcctgcgtggctactccaatcttggccgcctccgtgacgcccgccacctgttcgatcgaatgccccaccggaaccttgtctcctggggctcggtcatctccatgtacacacagcacggccgcgacgattgtgcaatttccctcttcgtggccttccagaaggcctcttgtgaggtgcccaatgagttcttgcttgccagtgtcctacgtgcgtgtacacaatctaaggctgtttcgcttggcgagcaagtgcatgggattgccgtcaagttggacctggatgctaatgtttatgttgggactgcgcttatcaacttatatgcaaagcttggctgcatggatgaggcaatgttggtgtttcatgcactccctgtaagaaccccagttacttggaacacagttatcacaggatacgctcagattgggtgtgggggagtagccctagagttgtttgacaggatggggattgagggtgtccgtcctgataggtttgtactagcaagtgctgtcagtgcttgctctgcacttggctttctagagggtggtaggcaaatacatggttacgcgtatcgtagtgccacagagacagatacatcagtgatcaatgtgttgattgatctatattgcaagtgctccagactgtcagcagctcggaaactgtttgattgcatggagtaccgtaatcttgtgtcttggacaaccatgatttctggttatatgcagaactcattcaatgctgaagcgataaccatgttctggaatatgactcaggctggctggcagccagatggttttgcttgtacaagtatcttgaactcatgtggctctttggcagcaatatggcaaggaaggcagatacatgcgcatgtcataaaggctgatctggaggctgatgagtatgtcaagaatgctctcatcgacatgtatgctaaatgtgagcatctaactgaagcaagagcagtatttgatgccttggctgaagatgatgcaatttcatacaatgctatgattgaaggatactcaaaaaatcgtgatcttgcagaagcagtgaacatattccaaagaatgagatttttctcactaagaccaagtctattgacctttgtttcactccttggggtgtcatcatctcagttagccattgaattgagcaagcagattcatggccttattataaaatcaggaacttcattggacctttatgctgcgagtgctctaattgatgtgtactcaaagtgttcccttgtgaatgatgccaagactgtattcaatatgttgcactacaaggacatggtcatctggaattcaatgatttttggccatgcacagaatgagcaaggggaagaggccataaaactcttcaaccagcttcttttatcgggtatggcacctaatgagttcacgtttgtcgcactagtaactgtggcaagtacactagcaagcatgttccacggccagcagtttcatgctggatcatcaaagcaggtgttgacaatgatccgcatgtttcaaatgctcttattgacatgtatgctaagtgtggcttcattaaggaagggaggatgctgtttgaatcaacatgtggggaggatgtcatttgttggaactcaatgattacgacttatgcacagcacggtcatgctgaagaagctcttcaggttttccggctgatgggagaagctgaggtagaacctaactatgtgacctttgtcggtgtgttatcagcatgtgcgcatgcaggttttgtgggtgaaggattaaaccattttaactctatgaaatcaaattatgatattgaaccaggcattgagcattacgcttctgtagtcaatcttttggtcgttctgggaaactgcatgctgccaaggagtttattgaaaggatgccaatcaaaccagctgcagctgtttggagaagtttgctgagcgcttgccatctttttggcaacgctgaaattgggaggtatgccgctgaaatggcactcttggcagatccaacagacagtggcccttatgttttactgtcaaatatttatgcctctaaaggactctgggctgatgtgcacaacttaagacagcagatggatagttctggcacagtgaaggaaacaggatgtagctggattgaagtgacaaaggaagttcacacgttcattgtgagagggagagaacacccagaggcagaactgatatattcagtactggatgagctgacgagtctaattaaaaatttgggttatgttcctgatacttctgaccatactctgttgtgtgagactggttaatctagtaatctacttgttaaggcttctacacagatttcatttgccagagtgtcttttactgactgcaactttgagtgagaacctaaatggcaaatatttttagaccgatctaagactaacagcttaagtgctgtttatgccttttgaccagtggttttgcacataatatcacgcttgctacagacttgttctttgagaatgtttgacagactaactggcagataaccattaaacctgaagaggtttccagtggtggggatagcacggaccaaaaattagaaggatctgcaaggtgtggtatgcctgtaattgttttgctgtaacgccatttcatttattagtagagttcttgcaacgacatctttatcagtttatcttcattctgttatcagtccatttctttttagttaaaattttctcacataattatcatttatacctgaagttttcaacttgtgtcctgacaatgagatacacctgttgggtgcccaacggatatcaacgatggttcttcaggtccactttcatcattgtctgccctttaacttgtctgtgctccacaggatatgacatccagcagaactttaccctggcattgttttattttgtgtgaccactgcccatgggcctaaatgtatttctattcaagggaaaccagttgagaggaatgtttgaatatacctgatgttttgtaaatttccacttatatccactcatcacttcacttttgttcatcagtaagagaacaagaatatgggcatcttttcaacaggtacatgtagaataatttggtggatgctgattcttttatcggtgatttgcggaaaaagtcttattaatcgtagttacatatggtttatcttaggttatagccaacgcactaacaatttaagtcttaactgctttgagctctatctccaaggaatcaatatattgatatgtcaatagtggcatgttgaattgcagctactaagatggaatgccagattgccagaacatatgtttaactggagtacacggtgtaaggtcatatttctcacacctgcgtttcatttgattctaacaaggaagactgatttaactgtcctgaattttagctttctgaacttatcatcaatagtagtgtaatacttagttgagaaagtttgttccaataagatagtaacagtattctgaatttaaataaccatgcttaggctgtgttcattcctcctggttgggaacgctcccctctggcacggaaaatggagcagtccattagtgcgtgattaattaagtattactccctccatcctaaaatataaggctcaaccattcataacacaaagaccaagaaaagttttaatcatcttcttg

SEQ ID NO: 54573 - DNA, 1214 bp, Oryza sativa
cggagagaagcagctatgccgcattagctcttcgctggtttcagaaactcaacttgttccaggtatagttccaggtgctccgtgctcgtcaggactgaaagagattatagatcttatttggtgattcgcaggtatgataggctttctcccacttttgttttcctgtcatgacatagaattagtgaagagaaaaataatgcatggcggataaatgattgcaacttgcaaggcagcatgctgaacatgcacagctcagctctctcttgcctaggaaattcttggactaggagatgtgtttacggtgcagttggcacatgcgttcagttgtcaacgcacctaaactcttcacctttcgtctggatcaaatgaaggattgaaaatatgtgactcttcctatcttaattccatcggttggctagctccttctagccaacatatttttaaaaaaaaaaaattcttggactggcgttcccagccttgagtacactgaatcgcatagaaagtactcatctcatattttcatgtcatgtagcatcaaatcctctctatgactttatggatctacggtttttgtttaggtttcctgttggtacttaattagagttgtttcttgcatattttacttcagattcagtcaagattcgaagagatcttatgtgataattaacaggtctgatgaccttgctcccagttttgtttttgtgtaatccgtttactgaaaagtaatgcatggtggatgaattgttgcaagaaagcatgctaaatacgcactgtactgtgcagaagttctgcagtgcaggacattcctgccgctagtcgtgccttggacagccagagctctcgaattctcagccttaagtacattggatcacatacaaggtactcacctcatgccatgtatcatcaatcctctttatggacctggagttaggtgcaccttatcagcttaagctctcaaggttggcctgctcctcatcactttctatcttctatatatgctgtgcatgttaatttcgatggtttgtctcgtgcaggtctggcttcttggagtccatatgggcctcgtgccattctctctttgcactgaggtctgctgagcgcctggatgcttatagcatactctctctctctctctctacttgtcaacactgaaatatgttttctcgggacctgacgagccccaagactatgatcttacgaattccaatgaattt

SEQ ID NO: 54574 - DNA, 1953 bp, Oryza sativa
ataatagccccgatagcacaagccatcgagacgggttacctcttgtcgagataactcactgaaaagaacaaaaagggtggtgatgcgccgaagttgtattggattgtctcccgtattaaagtggtatggggttcatatttataccccgaggacaaaattgggtccattatggacacgacttaaactttcccaaagataaaataaaacaagaccatacggcggtctattaccaatctctatcaaacctactcaaatatcctaattaatcgatacaattgtcataatcgagctctatctctaattggcgatgacagttattccaacccaggctcatgccaagcccaactcatagcatatcggcacaatcagccacttgcgttatcggcttgaccaaactcaactttgtttctagccgatatgatacccagccgatacgctacccgacttcaaaaccgactcgatcttgctccttcttctccgagtctgatgcaaaattccgttgttaacactagcattgaaaatggatatccaatgtgcgtataaaaccatccctaagcttctgattatcctcctcctacatgggtgtatgagtggcaagagccccagtggtatcctcaattgtacggtcagtggcaatcaacagcatcatggacaggtcaaagttagtagaaatacaacgtgaggttgctacactcacacagctcatgtccacatagaagtacatcatggtatacaatcggtggaacacctagctatgtactatgtcagtatgtcatatccttcgtttcgaactagaacttctatatttgtgtttcttgtcgtaatgaactaccgtatctatagccatggacattatattgtgaactctattgtttgagctacatgtggacatcattatgctttgaaatgtgtgattgttgaattgttatgctatgaattgttgaattgctttgaagttcaaaatatagaaaatatcatgccgaatttttgtattttacatccaaaaggtaggtttgaaaatatcatatatatttttctaattatctctaatttctatacacatttaagtgtttttcaattttttgtagcattgttctgttctgctacacaaatcacggctaccatgcaaatatcgtggttacagcgccaaaccatgcggtaaccgtgaccaaaccgcgaaatcaccgaatttttgaattcaaatgtttgacgatgaatttcacagggttttcagtaaccgccttactgcggggttatggtagcccccatccaaacggtaaggaaaacactgctggtagcaggtgttcagttctgttaatggatgaatcaggaaagatgtgccacgtatactgagtttgactcgttcaattatgtgctagtcatgctactagttagctgcaccaaacagaagtgttcttattgagatatgtatgatacatggaaaaccctgtcataggctgaccattctggggataccattacttgttcgcactacaaaacactcatgtgctgtgcagtctgaatgcactggctgcctggcactagtagctctggaaagcttcagtttggcttctttgatatcttgtttgcatctcccgtgtactgtacatgtaaatatgagtgcgcactgatcattgtatacaaatcattttttaggatgtattatgctctacagactactggagtacaatatatcagcttcgcttaagctatctctaaaggtttgttaagacttaagagtcgccacgggatttgtatcattgtatggaagaaggcgcatggtaccgaggatgagaacgggggaacatcatgcggaaaactggtgtggaaggggcgcgtttgtgttgtttggtatgcgatggacaaggctgagctgcatcaccatcaaggcatcaagacctgcatttgttttctttgttgtcatcatccttgctggactcgtccttatttgtt

SEQ ID NO: 54575 - DNA, 7519 bp, Oryza sativa
acgggcctcctcaacgccacggccaggtacgcgcgcgggcaacaccaacgcgtcgtccaggctgttcgcgacgggggtgatggtcgggttcgacgcccagttccccaagatctacgccatggcgcagtgctcgccggacctgtcgccggcgcagtgcgggctgtgcctcggcgccatggtggcgcggtggtggcagacgttcgagcccaacacgcagggcgccaggagcgtcggcgcgcgctgcaacatgcgggtcgagctgtactcgttgacaacgtcccttccatgctgcagctgcaagccgaggccgtcgcgccgtcgccatcgccggcgccggcgccggcagggaagccacctgctgtgccgggcactacaggaggtgagcttagctgactttactactatgcatattaattaggagtactctgcttccatcttttgttccctgaaaattattgtacctagtgtgatgctggacgtatgatagcttaactaatgccattataattttgcaaagtttgagatataccatcggtatctcaatgacatgtaggatccacatgagtcaatgacatgtgggtcaggacggcatggttttaattttgcaaaattataatggcatggtttcaattttcccttttaggttaagtacagttcagaattttcatcacgccaactaatccatagtttaagcaagaaacgtccgaatttctcttggtattaactagatgaatgcctagattttccatgattcgatccagacctgttgctgtcatgctagttagcgtatagttcactactattccgtactagtgtatactagtactcctatcatacagttgactaagtctactttttccaccgactaatttcttagagacatttttatttagggaatataatatcgaaatcaacctaatccacaagacaaaattgtgcaatatgatactagtaatacgtgtggtttctctgtatgtgattcaattatctgtcagtcgcctaactttcagttgtttgatcagctagtagttaagtgaatgcacggaaaaaaaaaggcactctcttcttactctgaaaatttacaccatcttttctgagaagaatcttgtgtcatgtatttttctgtttgtttgggaacagttgtctatcttttcgtcttctgcttactgttctagattcagtaactgcaggcagcaccacatgtgcaatggcaatctagaagctatgacttgtagtcatgtttatatatggggatataaacacaggcatacagctgttaccaactttagattgtcaaattggtagtttgtagtttcgactagatattgttattaacattagttagtttatgcatttcactcaagcaatgggagttagagtggagcactagtcaagaaaagctaacagtgagtgttatgaccataatgcataacattgataggccataatgcataacattgataggccagtgccaaactgccaatgtgatatcatgattcattacctatctggaatgccattttagacccaaaataaaaataggcgtgcaataatgatcttgcagaatgctgggttagcttatctgaaaggctatccttgctagttgcttactgttcaacaccaaatggcagtttttacacaaaatttgagttttcggaggcaaatatttcacacaatctctatcacatggaaaatttcaaagaatctgcaatcgctatcttacttttcaagtgtgaactcatcatcagttcctcctggtttgctttctgctaaccgtgtcttgagaatctttcaccacaaccatactacttttttcccatgtgtaatacggagtataatctacagggaaaaggagaaacggagcaggtaaagttcttgcaattgtaatgcctatagttgctgccatactggcagtcactgtaattggcttttgtttctggaggaggagaagaccagaaaaaacacctccaccaggaccgctccgatgtgagtcccctgaagtctgagcacttaaaatcatgtggtaacaaattaaatgattcatttgttctgtgttcactttataattgatctatgccagccgcatctcgttcggaggactttgagagtattgagtcactttttcttgatctatcaacactccgaatcgcaacagataacttctccgaaaataacaaacttggtgaaggaggatttggtgttgtttataaggtattgataggcttctagcatctttatcgcaacaaaagtaagtagaacctgcgccagataacaggtatatatattcatttgtgcagggatccctaccacatggtgaagagatagcagtaaagaggctctcacaaagctctgtgcaaggaatgggggagctgaaaaatgagctggttttggttgccaagctccagcacaagaatcttgtccgtttggtcggtgtttgtctagaagagcatgagaggatgcttgtctatgaatacatgcccaatagaagcttggataccattctttttggtgcatttcccctccgtgcattctaaaaatttgtcaacattaatttgcacaagtaattcatgtcccctgatgcttctcattttcatgagacagatgctgagaaaagcagtctgctagactggggaagaaggctgaaaataataaacggagtcgctcgaggaatgcagtatctccatgaagattcccagctgaagatcgttcatcgggaccttaaggcaagcaatgttcttctagactctgattacaaccccaagatttcagacttcggcttggcaaggctcttcggaggcgaccaaacacaggacgtcacaaatcgcgttgtcgggacatagtaagcacatccagtcatccatcaacacccatgacagacagatcaaagattgtgcatcagatatcgtcaaagttaaccatgttcttaatttatctgcagtggatacatggcgccagagtacgcgatgcgtgggcactactccgttaagtcagacgtgttcagcttcggcgtcctggtcctggagatcgtcacggggaggaggaacagcggctcctactacagcgagcaatccggcgatctcctaagcattgtgagcaccaccaacttcttagctcaattgagcaaaaccaacattacatttctcgcagtgacaattcagttaaaaaaatggtgatctctgacgacgatgcagatatgggagcactggaccatgggaaccatcatggagatggtggaccggtccatgggcgagcgcgcggcgggcggcgagatcgcgaggtgcatccacgtcgggctgctctgcgtgcaggagaacccggcgagcaggccggccatgtcggcggtgaacgtgatgctgagcagcggcacggtgtcgctcaaggcaccgtccaggccggcgttctacatccggaagggcggcggcgacgacggcggcggcacggggtcgtactcggggtcgttcgtcggcaccttgccgtcgtccggcaggtcggcgcccatgtcgcccaacgaggtgtccatcactgagctcgagccgagataaggaagaaaaatgtagcagagccatgtcatgtcacaggagtgaagggctccggggatgcctaatttgtgattttgtgtgctgtgatggtgtcctcaagatgctacaatgtatagaaacaggcagtaatcgttggcaagaacaaaatgccagcaaaacagtatagcactttagtgttgtcttttaactcttatggcgaattatgctgagataattgcatgatttgcaggtgttcattacaaatatattaccctcgtttcatattataagtagtcttgacatttttcttactttaactttttcaaatttaactaagtttataaaacaaaattaacatctacaacaacaaatcagttttattaacatgtaatatatttttgtagtatgtttgttttatgttgaaaatattgttatatttttctataaatttaatcaaactaaaaaatgttgattagttaaaaaggtcaacttatataatattgaaatgaatagagtagtgtactcactggtacatgatttatgtggttgaacatattcgagcccacatgtctacgtatgccaaatgctcaactcaacaggtaaatcaagatacataggaggaggtaaataaatcatagtgcactggaggaggatctaccttgcaggacattgccagatattcctagggggaatgggaataggtgttatgtggatgctgcttgggtgaatggtttagcacaatatttttccacatgccaaactctcataatgcgctctttataaaagctagtactatcttgatagctcaatcttctttgtaggcagaattactggctctgatggcaatggagatcgcaaaatttcttgactttgcaggtaccatctttaacaataagaaacttcgatgctgaaccatgacattggagtctcagacggtcagaccctgaaagtttgatgcaagtcaaatggattatcaacagacaacagggtagccgacaagatagccaaggatggtagacatgaacaatcttctgatacggttcatattttgtcaaaatatgttgcatatttaaagtttttttttttttaaaaaaagaggccacatgtctacagtgaacagtgcgtcagactggcagtgcagatagcaattacctttctttaatcctcctgttaatcacagattctatagttttaatccatcgcccatttgacatcagatcatccctgtgctgtgtgctcgatccagatctcccgccggtagccaccgcgcgtggtcgccgcggcggcatcggcatggcgtccgagctgcgcgccctcgccgcggtctcggccgccgcggccgcggccatggcgtacgcgcgcttcgccaccgcgcgcctggccccgggcgtcccgcgcctcgccgcgctcctcccggtgctcgccctcctcccgttcctccccttcgccttcgcctccatccacctccgcaccatctccgccttctccctcgtctggctctgcgccttcaagctcctcctcctcgccgcgggacgcgggccgctccacccgtcgctcccgctcgtccgcttcgccgcctgcgccgcgctgcccatcaaggtcgtggacgacgagaagcggaaacccaccacctccacctcctcctcctcccggcgtctcgctccggcgttcgtgctgtcctacgcggccaaggcggccgtcttcgcggcgctcgtctcggccaggtgctaccgggaggggatgccggcgtacgcggtggtggcgttcgacggcgcgcacgtctacctgatgctggagctcttcctggcgtccgccgcggcgaccgcgcgcgtggtgctcggcgcggagctggagccgcagttcgaccggccctacctcgccacgtcgctcgccgacttctgggggcggaggtggaacctcatggtccccgccgtgctccgcccgagcgtgtacctccccgtgcgcgcccgccacggcgccgcggcgggcgtggccgcggcgttcctcgtgtcggggctcatgcacgaggtgctgttctactacatcaccctcgacccgggctgcaccacgggcgaggtgaccgcgttcttcgcgctccacggcgcgtgcgtggtggcggagcggtggtggctggaagaagctcgtcgtcgcgcgtggaggtggagggcgccgcggcgggcggtggcgacggcgatgacgctggcgttcgtgacggggacggggtcgtggctgttcttcgcgccggtgacgcggagcgggctggacaaggccatcgtggcggagtgcgaggggttcatggccttcttggaagaggccgggtggaaggcggccgccgcggcccgtttgcttccgtcgtgaaggcccatgttgtaaccgagcagctgttcgtgggctgttcagctgattcatgttgtaacggcccatgtcaagtctttccctttgtattgtggcccgcggcctaactcgattcacggccaatccaaaacaggttaagaagcagtccaactcgcaatgagagaagtgacgagatggatcaaacagttgcggaataagtgcacttaccatccctcatctttacgtagagtttgtttgatatcccttaactctaataccaaaaatcttcacccctaaactatacaaaaccgtgtaatttggtcccatagcagtatgaatgtttagtttcacagacgtgacatcctagtcagcaaaaataaaaaaaaaatgtggggcttgcttgtcaggtcccttttgttccttctcttttattcccaagagagggaggcgaccgacgagagagtgggggagaggctggcgagcctaggagggaggggggagacggccgactcacccttccgagctcgccgacctccttgcaagggaggtagaggcgagagagggaggggaggcggctgacgaaaacggctgggctcctgccatcccgcgtcgcttgcagatgcctcatgctgctctgtcctcgtcgattgaatctgttgctgcagattcatgttgctggccggagtgtggagtcaacgcaacgcgacggctccagtctcatgggtgcggcattggctagagaggggaagggcggagcctggtatcaccgagctcgagcggtagcctcgactcctctctcctgagtagcacgggtggcgggagagacgacgatagcggcggtcggcagtgtggacttgccatcatccacctcgaccttgtggtggcgccatcctcaccctcagtttccccacacccgcacgttccaacgacccctttccttgccctcatctttgatgctgctggccgccgtcctcatcgtccgcctccccgcacctcgccttgacctcgttggtcacaccttccttggcgtccacctccccgtgcgccgccttgacctcgccagccgcgccgtcctcggcgtctgcctcccgccttgatctcgccggtcgcgcctttgtcggccttcacctccttgtggtagaatggctgcgggtggaatggctggtagagttggtcggatgatgtggaggggcgggggcaaaggggagcttgtcaggtgcgggaagcgataacggcagcagtggtgcagggcgaaggggatgttctggcggtggtggtgcaaggccgcagtggtggaggcgatgcggggctgggatgaggggcaccatgcctgacaagtaggcccggagatctgttatgccagcaaaaacaaggtaaagtaggatttatattgctatgggacctaagttgcatggttttgaatacttaagcggtcaatatttccggtattgagaattagggatttcaaacaaactcgacgtaaagttgagggatggcaagtagacttattccaacagttgcatgttggtgcccatttgccaaattccagccgaatggctttcctaaaaaaaaaaggttcgcagtgtgttaggaacaaaaacgaatttcaaatcttctttttcacatcgccactgttgtgtcactcaagtagacaaggatattgagaa

SEQ ID NO: 54576 - DNA, 2705 bp, Oryza sativa
atctcaaggactaaactgggcccgaagtaaaaactctagggaccatattagctattcaccaaaaacaaaatcgaaactactttaatatgaaacgtataaaactgagtgagtaccagttacaaacaaatctgtgtttcccctttcgggttttatgattttatcaccgcggccacatgttgtggtctcgttcgtagtatatgccgattttggaggtggacacgcgagtcacccatgtcgaattgtcgatcggttgggcttccacgatgtggcggcttttatgcgtgtggcgcggtaccagacgcgcgtgcgcatatggcaacgcaaatattgctgttctttcgaggaataacaatatgcaagttgttgttctggtccatggattttcatcgtgctagctagttaatgcgtgcgatcgaattattgttatcgtctgaaaatgcgctccccaagatgaggcatggccatgagatctgccactattaaaacctcccaatattgatcagtagctccaagctagggccatgttgatcgagcagtaatgaaaacacattgatttgatagaaatgcatgctcacaacaatggattgaaaatagacaatattacaacatttatcatttaaatgctctggaaaattttcatgttaattggacaaataacaaacaaatctattcatctatctgtgtgagatcaaattgtaacaacttagattagaagaagaaattaacatcattactgtaggaaaagttctagttaataagaaaaatagtgattaaatctggtcatccatctaaaccgaattacagtaacaaataagattagaacaggactaatttctaattattaattttaattttcaaattcaataaatataagatgcaagatggagaatacaagatgatcgagtacagcatcatatttatcaattcttgatggatttattaatgaaggcaaaagaataaaataaaattgagactcatattgaatacaacttgtgttaacttcaaaattactttatcaagaaaataaattgaaacggaccatctacaacttaaaaaaagttcatgttggtcactacctactaataaatgctattttgaatttcaagaattatggaaataatataatacttcctccatctcagtttaatcatcacctaaacaaatagcgtagggaccaaggataacaaaatcttcattattctaaaattaattctcatcagttaaggtgctacgtcgtttcgtatcccgtggattacataaagttttaaatattatatgtagttgcactaacataaattaattttggttggttactctgtgcacaaataaatgaagatgtgcttgttagatgatgattattttagaaagaactctgaaaccttagatgacgatcaaactggcatagagtgaatatatactaaattggggcttcaaggcaagtacaactaagtgtttattaatttcgaaattttaaattagtaaaccataaaagcagaaagtaaaataaaataaagaatatagcccagatgcctgtttggaaatactattttaaaatttgaatgattaataaaatcatttttaaggtatagagcagtgtataatgcaaataatttgcacggacgcacctctgggtttcaacataggaggctgttgatttacgtttgactattcgtttattaaaaaattatacgatcaacatttattttgtagtaagtataatttatcattaaaggttttttaacaagatgtatatttttaagaaaattaaataaataaaatagtcagtaagggtggcatatattataagctagcttacaagctaaaaactctaaatctaaacaaacaggttgattcttcatttagttttcttaaagccaaaagccattttatactggtaagcccaggttggagaatttttttttatgtgaagcggggaatgacttcaccaattaaacctaatgctttaaacccataggcttataaaatttttaagcttaaaattagcaaagtataagctaataaacctaataataaaaggccctaagaaccagtggtagtatatttttagaaaagtccctttgggtctcaccgtgctggctgatgatgatcagaccgaagatgttcggtttcctaacaccatgcaggcatgcaccaaaagaaacggaaggaaatggtttaatatatcgttaggcagtgctagcttgactaaccattttccacacacataaaccaactgcagaaaaacagcagcaagtggggtcatcagtagtttctccatcctgctgtcgttgtcccaacgaggggctagctgcatcatccaaaaacgaaaaagaagaggataagaaaaccaagctgcattcgccaagaaggtaacagtgtaacactactaccctcaacgagcgttaatgtgattcgtttgagatgactcacttttaataggtaaaaaaaatatatcccatttaaaataccctagtgatatttaaaatattcttagtatggaataccgtttgtgatgtatgactatggttaatataccctagtgatattaaaaatacattttagtgtttttagtgtatttaaaattcaaaactcgtaaattctcatcggtgaaggttcttaattaattataaccagtcacgaataagtcatcggtgaatggtgttcacctgatatagataagatttttttcatcggtaaccactaat

SEQ ID NO: 54577 - DNA, 12625 bp, Oryza sativa
gatcaccccccatctccccctgacacgctcctctcccccttcctcctctccttcttttcctactacaccataaatttttaaaaaataaaaaaacaaagttaaaaaaatttatgtatagaaatactatatataaaaaatatttgaattcaaatttaaatttgaatcgggtatataaacttttgacttataaactttggttctataaacttgagatgtataaactttagatgtatagaaaatactatatataaaaaatatttgaattcaaattcaattttgaatcggatatataaatttgaattaggtatataaacttttgacttataaactttgggtctataaacttgaggtgtataaactttagatgtatagaaaatactatatataaaaaatatttgaattcaaattcaaatttgaatcggatatataaacttttgagttataaactttagatctctaaactttagatgtgtaaacttgagatgtacaaactttagatgtataaatttactaaaataggaaaataaagtaatacggtgccaaagaaaaaaaccacgtggaggagaggtgagcgatcacccattaggaatctcgaatgtctacagtctacgtacgctgcattcatccatgatccatccggagaggaaaatgacaaatcaacagtcatgctaggagtgctgtggttatctcaccacatcttttggttgctactccacttgctataatcgtgccatgccaaaaaaaataaaataaaatccttggtcgacctagcccggcccagttgcaaattaacctgtatctctagttctctacacagactacacaaggccactaggtcgcaggcacgggacgggacgcatgcacatccagaaacgaaatcacgagtccatgtctccatgagccttgttgctcgctataaattcccatcgcgctcgcgtcttccagtatagtcgtcgtcatattttaccctgctttcctctgccactcgatcgccacggctcgcaggacaagaggccatatggcgctcgctctcgctcacctcatccttgccgccgcattgccgctgctcttcctctcacgtgcaggtaaacggtgtagttgcagctctgtatcaacggcagtgtggtgcgttgtttttttttgtttttctttgcttataatatatcgacgtgtaattcttttgcgtgttcgcgaaaaatgtttttcttgcactgcagatgggggcgaggtgggcgtgtgctacgggagggatgggaataatctgatagatccaccgtccgtggttagccttctcaaggcaaagggtatcaccatggtgaggatctacgacgccgacccgaccgtgctaaacgcgctggccaaccaaaacatcaaggtgatggtggcgatgtccaatagagatctagtagctggctccgccaaggatttcaatagtgcgctcagttgggtgaaaaactacgtgttgccgtactaccgttcctcacaaattaacggcgtggccgtggggaacgaggtgtttcagcaagcacctgacctgacctcacagctggtatcggccatgaggaatgtgcaggcggcgctggcgaggctgggcctcgccgacgcaataaaggtatcaacacccattagttttgattcagtcaaggtgtcattcccgccatccgcaggtgtgttccaagataacatcgcccagtcggtgatgagtcccatgatcgacttcttgcaacaaaccaactcctatctcatggttaatttctacccatatattgcctgggctaattctaatggccaaatctctcgtgattatgctgtatttggccccaacgcctctcctgtggtcgatcaagcaagtggcatcacataccatagcctctttgatgctcagctagatgctgtttacttcgctatagaccatgtttcaggtggtagtgtgagagtctcaatggcccaagcaagacgggggcgcccgtctccaaggatacccgtgaaatgttcagaatgtgggcatccctctggtggtcggctccctcagttgtccacactagatgatgttcaagtagacgtggctacaaaagccaacgcccaagcttttaacaatggtcttatcagtcgtgcactattcggagccaccggtatgcctgatgtctccgtatacatctttgctcttttcaacgagaatttgaagggcggagcatctgtagaacaaaactttggcttattctacccagacgggacggaggtttaccaagttgactttcacaatggtggtggtggtaatgtttgccctacaaaagcaagttggtgtgtggcaaattcagcagttgggagcacccggctgcaagcagcgttggattgggcttgcagtaatggtgcagattgtggtgctatccaaccaggcaagacatgctttgcaccaaacaccttggtcgcacacgcatcttacgcgtttaatgactactaccaacgtaagagccaagctagcggtacatgtgacttctctggtgctgcttttattgtctacaagccttcaccaagttagtttcctctccatccttattaagttttcaggatactgtttctacatctatgcatccatttcttattcgctatttgttaaccaaaatgtataaaggtatctgcgacccgaacccaagctggtgcattgcgaaaccggaggttggggacacacgtttgcagaatgcgctagactatgcatgcggtagctgcgcagattgcagcgctatccagcgtggtgcgcaatgctttgaccctgacaccaaggtagcgcatgcaacctatgcattcaacgactattatcagactaccggtcgtgccagtgggtcatgtgattttaacggcgctgctaccattgtcacacaacaaccaagtgagttcacgttcattttagaatgcgttcaattaatatatctcataccacttaaatcacatccttgcctgaacaataattgaacgctttcatttcatgagcagtaaatggttttcaccggtgctcatttaatcatattttgcagagattggaaactgcgtactctcaccaaacaactcttgaatgtacagaagactcggcagtaagaggatgggattgaagaataagtccatattctctaagaaaggaataagtccatattatggtcaaataaaaataaggacgacattgtatgtattccggtttggaattttaagtaagtaataaatgtatcgttcactcgtgttgaaatgaataagaaacttaattactctatgaaattcccagttaaacattaattccagagagatacatgtacatgaaactcctacgtggcttgttcgcttaatccgagagagagagagtgagggggattggagggaattaagagggaataatcccacaccataatagttatggaataaatcccctcgatccctttgtgggaggggttaatcaaacaaggtctcaacattaacagcaagtatgcaatgcaaatgcactgacgacattgttcaaggcgtttcctcatcaaagttttagaaaagatttaatggccctcgaaaggtgcggtactacaaatgtaaatttggtactatagtatctctcagttccaagaggataccctcctgctacagtcttaaggcccctttagaatttctcaagttgtattatcccactgggccatacatttgacagcatattacatcatgtaaaaaagaattaacagtatatcaagatctcgggatcaaaaaccttgatctcccttttctataatgaaagaaaatatttaaatgttgatgagttggtgctgaggtactatatataattatttttgcgtggatagacacctatgtgcatttgtatgatatcacataaaaggacatgttcggctgcgaaacatacatacggtgcggcaatcacaaagacagcagctgtagagctggcctgccaaacaggcccaaaatttgatgatcagaaaatattaagtctccccttttgacttgagaaaatgatggcatttggcttgtatagctaggcatggcagcgccaatgactctagtggactgaacgatagatatttatgtgaacgaaattaaagctaggagtatgaaaataaacaggcactagcgcatacgggtcaggcatatatatgcactataaaagagaagaaaacggtacagtggaatggagatattgttagttgttacttgaccttgtatctgcgccttttccacacgagtagacaaaatgtggaaaatagcatttgaccccgaggaagacctgcatatatatgccgaatgcattgcagcaacgtgaggatccacacaacatacaagttgggcagcaataaaccagagaaggtatagaaaaaacagcttataaaaatgattatattctaagacggagggagtacttcagaacaattcaaatgaaaactttatcaactacaaaggtttatatctcagagttctacaagttttatattggaaatatctccctccaaggtcggatgaatttttcaaagtttcgtttttaaaaaatagatcacaccttataatgtatattcagacatgtaaacaatctctcataaagatattatcaatattaacgttgtagatctggttgagctccacaactttgatatacggcatatctccatccatggtcattagaaaattttgaatttttgttttcttttaaaatatttcctcattccaaaaagaattcaatcctagtgatgaatctgaacatatatatagtgtaggttcagatttatttttagggttgggtattttatgggattgaggaagtcgatctcatcacctatatcatattagggtatgtataaacaatctcaaatgacaattattatcagttataaagttgtagatatcattgaggtactaagatcaatatgtaacggttgttgcactagtgccaggggcggagctagagtcatcagggggttcccaagaatccggtgaaaaaaaattgtaactaaaccttacctattatgatcatgtgtgcgctcctctcaatataaatttaggaacccgtatcaacttaaacttgatataaagtagagtaaattaaacaaatgacactcctccattttattctagctccacccagtgcagaggtactaggattattaatcatggacagacacctgcgtgcgccttgtataatagtattgcacaaattttggtattgataatagcaaaatataagtctccccgttgactcgagaaaatgtcggccgtttggcttgtatagctaagcatggcaacctactctagtggactaccgaacaaaatatttatgtgaacgaaattatagcgcatacggcatacgaaccatatgcactataaaagagaggaaaacagtacagtggaatggagatattgttactagttgtcacttggcctatactacaccttttccacgtacgcgagtagacgaatttgtggaaaatagcaaatacgactacgagtaagtttcttcttccaagtcgcggcctttgacccgagaaagacctgcatatgtatacatgatgcatgcatattgcagcaacgtgtggaacgatacaacctacaagttgtgcagtgtgagccagagaaggtacagaaaaacagctgccctcttgggttacataattcttgaaaaacatctactaacgttttgtacaatcacagagtcttccaaaatatatctttagctatattcttctatcataatatatataataaatatatttttttacttttgttataatacttggtaagacacatctatatatgttattccagtgtctttaaactaaatatttttaaagttattgattgtcaaaattacaaaaataatgatctcaatcttgtttaaaacataaagaattatgggaccgaagggagagtataccgacaactcaaacgtgcatttaggttcgatgattgaataatttttaccattcaacatttggtatcttgagatactttttattataaaatttgatatttttagtgtaaaatttgacacctcaagatacctacctaatacatcgagggatcaaatttttgcatgcaaaatgtggtaataggattaaattggttggtttgcgttgtggcttatccaaaccaaatcccgcggctctctctccagtgtgtcgatctgcctcgtggaatacgacgctacaccaagtgggcacatatttacgcagacatgcatgtatcataggttctatttgagaaattttgctgagattcagataagttgaatgtcagttgtggtacaatattaactggatgatatctgccgtgcttcaaccgcactattttttcataaatctttttatcggtatagtttaaaaaagtttccaagctatttgtcagcattattttctccggtcctgtaattcttaacgttttggacaacgttgagatcaaacttataactttgactatcaataattttaaaaatatttagtttaaaaacagtaaaagaacacgtatagatttatatatacttcctccgtttcatattataagactttataattgcccatattcatatagatgttaatgaatctagacattacgaatgtagacaatgctagaaagtattataatatgaaacggaggaagtattacaaaatacaataataaagtaaaaaagtatttatttattgcatactcccttcgtcccaaaatataagcatttttagttatgaatctggacaactgtatatccagattcataactaaaaattattatattttgggagagaggtaatatattataataaaaaaatatagtcaaagatatattttgaagaccgtgtcaatgcccaaaatatcaagaattatggaattggggggagtaaactatataatatttaattcatctttgtagataattttctatataatttttatcattatttagaaaggagatagacttaatttgtttaaaaaatatgtctaacatattaagtgtaacttaaaagtaaagtgtttttaatgaaatgtttagatgctctctttttaacatatcatgaaaaactattattgctaatacatatattttgtcagtatatcaaggtagctctccttctaattgattcacgttaatacagttcgttacatacttacatatgaattaataaagacaacgaagatatatgatcccttctatatgcgttatctatagttcttttttttaaaaaaaaaactagtcaacatgggttctaaaatttaatttaagagtaataaatataacttttaaaccaattatgtaatgctacgttagtgtggcttatatatgcaataatatatagagaaactaaaaaataccacggtatgaatagatgaaaggccattaatatctaatcacttaaaaatggttatgacaatggaaaacataatgatcttttgaaaagtaagaaccaattctttttaacgaatttattagattttctccgtatagctcaacttagtctccgttgacatgttctattttatacaagtcttattttaagtttaaaaatatatgtattatggatgttgaactattggtttaatatattataaatagagcaacatgtagattataaatcagatgtgtagtttacaaattacagtcgttttaatattattaatggtttcgcttttagtttgcggaaagagtgaaggttcaatagaaacaggcagagggaggtgtggagagcggagaacccgaaccaaaagaagaggggggcgcgtgtaatgttgtgcattggggcattgggaagattggagagggggaagtgaaggggacctttatttttctgatttttcagaacgatttaggtgaaaagcgataatcagatgtgtccatgtttatattggtaatattaattaaaatatgggctaattgtcgttattctacagcacgtaattggcggtcatgttctgttctgatatttacatggaatataagtcttccctaaaccggagaaaatgatggtcgttggcattatgtacatatagacggcggttgcgcctcctccaccggactggatatttctgtgaatgagacgcatgcatatggaaaaacaatggatcaatccatgcaccaccagtaagagatggaaatattagaatggcagtcctactgttaggcgctttaagttgacttgtcttagggcaagtacaaaaggtagagaccgatatagtctctatgttaattagaggctatcacgttacaatagttaagagaatacggtctctaaccattaatgtaccaaaatattttcttactagtcgtctttcctttattagactcaaaaatgcaacaaaaaaaattcctaataaatgctaagagtcgactctatgctgttgtcatgcatagcaaccatctttctttttcttttttcctccctcttccacgtcatcagatatacttacatgacaataaaaagagaccgctaataaagaccattgtacatgcccttatgccttttttccacacgagtagacgaactgtggaaaatatcactgctcgttaggcctctcaatagtcaatgcatatttatacggattttccaagtccgctggctttttcttgagcaatattgcacgcaacaaaagctagcaattaaactgatgctagggttgctagcttgcagttgcatgtcacgatcgaggaattggaaaatcgatggactgatggagtccactaaccaggagatcaggatgggtagacaaagcataggcgaaccgtggatgacgggggtcaccaccagccgctcagggccgagccctttggcgaatggcgccgtagtgcgcgtgcgggagctaatgcctctcggacacatatgtgccgacatcgacgacttgcccgcccgtacaagtcatgcacggacatgcacgccaccggccgaaattgtcaatttggcaacgccctgatgaaaggatatgcagcggcgtccgaagacatcgccattgctggtctatagaaattaacctaggctaggctttcacctgtttcctctctactactactctatcatcgcagtgatatttcccacaacccgtgacctgtgcaaacatgagtaccttgccgcaccagcactcctccagcggccatcccctgcccgccttcaaaacagaatactggggccttccactccacaaccgccaccgtgttgacatgtaacgtcccgtctcccccaggccgggcccacttacatctgatagttttcataggtcatagactgcccgcttaaccctggagttctttggagattggcttccgaaaaagaagttgcaacttgttcatatgagtattctattaatcctattaagccctaggccgggatgttacaccctcacccccttaagagagatcgacgccccctcgatcaaccctaagccaggaacgtcctctcttggccacgtccatgtgtccagtgccagcgcatgtgccatgctgtgtaaccactcccggtctacaccagccatgcgcaccatgcctgcgcaactgcgacacacgcgcccatgaaaccgcgagagtcagctctgataccatctcttgtcacgccccgaactagtaccgaccggaactagcccgtgacgctcccaattaacctgttaatcgataccagtcccaggaaacagtgctggtatcacaggaagacagattatcacagcaacagaggtctctttattatagatagagatacagtcatgttgggctgcggacagaccccgagctcacaactgcattacaaaaggaaagcagaagccaggactaggaccaaacatcacaggcgcgacttgggaactaggccgaaaccctaaaactcatcgtagccggcttgctcctggaagaactcctcatcagcaggatccgcttcatcttcttcagcaactggggggggattatttatatagagcaagggtgagtacgggagtactcagcaagccatgggaaataggtgtttattgcagactttcaaggaaaggctgttgttttagcaattgattttatttgaacccttttctgaaaacaactaagtgagtgcttctcaaacgacacggatgagacagtgcgtctcgtccggtcggagtatgtgcaatgtatcagtctttagaattgaaacaaggttggcacccggccaacagcttttcaaacggccacccgggccaacaactttcaaacggccacccgggcctagccgattccatcagttacagatttttcaaacatcgaacccctttccacaacagcaatttcacaagcagtagtccaacaaaactacgctaggaatcacctcacatccgcccatgaccgtgggcacggctgttcgaatagtttgttaacctctgcagagggggtacactttacccacacgacattactaacccggatcacccagcccatggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaccgtacacccggtacgttccctggtccgcggttttggaaattcatttagttcgcaagcaccgacccaggtgtcgggttttccaagtcttttgtaaaactccagttttacccaagttgttactcaaaattttaagtttgaaggcgtccgtcgatactcgcgcagggtgcacgaatatcgagacgcaactagatggttacaaggggacatggtatcacaattaacaaaggaaggatcaaatgcaacaaattaggtaggtccgccaatctgccttgcagacgggacaagcagattaagtgcagtcctatcaatgcataatatttttcaagcaacataattaaattcaaatataggctcaagacgttcgaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctggagatttgaggaattttggaagttgaacggagtcaaacggatttacggttgggaagatattgaatttctaagattattggatttttggtctaaaggaaaaggatttaattaaatcctttttaaaaagaaaagaaaagaaaaggaaagagggagggaaaatagacttcccttgggcggctagggcgcggcccgagagaaagggcggctcggccgagcttaatgggccggccggcccaagaaggcggcccagagcggcccaaggttcgcgcgcgcgggagggaagaagagagagagccagtggaccgggctcaccacgcgtggtcccgggtgggacccgcttggcagcggctcggctcaccgtgtggagggagcacgcggcgcggcgctagggtgggggagggacgcggtgcacgcgcgcggttcgcggtggacgcggatgcggcgggcccacgcgcagcctcacggctcacggtggaacgcgcgcacggggagggactgaccggggtcggctcgacccggtcttggctgagctggcgccgacgtggcgcctacgtggctgccacgcgggccggcgggaggtagacgacgacgccggccggaatggacggcggacgacagcggcgagcggcggagcgaaccacggcgatacaggcgaaagcgagcacaccgggtagttgcacgagacgaggggagacgagccaacggctcggattcgccggagggagtccgtcggcggcggattgcggcggccgcaaccggcggagagaaaaggggaaaacggcgacgaggtcacgaggggccgattcccggcggagagagcatctacgcggctacgggaatccgttgctagcgtcggattgggcggagctacgccgagcgaggccggcgacgagcgggtgctacggagctcgggcggcgacggcggcgagcacacggcgagcgacggcaacggtcggggcggcgccggctagctacggggaggctactcgtgctaccaccgaaaactaaggggggggagatggagcgaggaggaagaacggagggaggcactaccgtgcgggcggggcgcagtgacgagaggccgacggcgcgggagtaatctctccggcctcgggccaaggaagaggaagaagagggcgcgcccggagtccccttccgcgtccttgctcgtgccggctccgccgacacgcgcaacgacgaacggcgatggcgaacagagcacgagaggcggcggcaatggcgtggaggcgatgggacaacgagggagaagagagggagggcgcctgggctttaaagggcggcaatgtcggtttggaaaccaactttaggcggtctaggcgcgagctggcgctccggctagcggccaaaacagcgacaggaggt

SEQ ID NO: 54578 - DNA, 8794 bp, Oryza sativa
ccccggggtagatgggccgagagagatttcggcccatcgaccctgggggaggcaaaatagacttttgcggagggatttgatttggaaagatttggattcgggattgaactcgacgatagatcggggatttgagatcttgagatggcacggacactagacaacaagcaaagaaacaaatttcgcaattagggtttttaagagataatttttcccgctaggcgccacgacggaacgggcgctacacgacacccctccaccggtggttcccctcagcacgctaacacctcacagcccataatagctccaccaatgcgctagccacgagggctagattgccctcttaaccacctccctcatcatggagaaccccgtgactggacctagaagcaaactgtccctagaaggagaggagctcctcagagaagtggggactgtctaaagaggagctgatcgtcgctaccattcaagtaatccaagatctgcaatcgtcgctagaatcccactggtcatcaccactaccaccgtcaaggcacttcggtatcgtcgagcttagctatttccatcaccgcccactagtctcccactgagtagatctagatggaatcgggctcagcaactatggattcagtgcctgcaaatcggttgcggcctccaccgcagtctacagccctggccgttgtctccaccactacctggtatccaaccacaacatacaccaccgcctgttacctcaccaccacactccgccagtagtgcggtgtccgtgggcgtcgtctctccagatcaagccacggcgacctatagatttgggcaatgcagtgctacctctacctaaagacgtcgtggtgctcccaaccactctagcaccaccaggggagaaggagccctaccaccgctgtcttagccggtatggggctacccttgtcgccctaaggctagagcgacgcaaggtttcatgaagctaagagagctacgagattaattgcatcattgcatggacatggtaaggttccatgatttattacccattaaaaatgtgccctagtatgacatactagtcatctaggatatggctcagtgagtgtaacaccgtttacagaaatgttatcaaaaccacatcggtcatacacatagctgcgttgcccaaatgaaggagaagaggaagctgatcctcccccaaagaagaatgcaggttgtgctggtggctgaagctccatgttttctcgggtcaacatgaaaatgacagatgatatctgaggtctatcgttagggtctgactggacgcacaacagcgcaatgtggatgcatcgcagtgcttggctttgagaatatccgtgaagcgattggtcaatcatttgggaaaccgtcccttttgtccagcaattccagacctgttagacggattgacatgagtttgttaatcggaaacttgtttgagagtactttcagatttgaaatcatgactagtttcagtatgcaaatgcaataaaaatggaagcatatatactggagtaaggtatgtcagcattactcagcacttacatcactaaggagattcacaagatcatgatcatcagaattgcagttccttctcctcgttactatttcgaggaccaacacaccaaagctaaaaatatcgatcttggttgacacatttccatctattgcatactcgggtgccatataaccgctgcagaagttatcagcattaggcttggaaacatacattgatcaatatatgtgtgattagtcgtgagtgaaggttttattatgcagatgaacttacaatgttccaacaactctagtcgtcctagtatgagtatggccttctcctagcagccttgccaatccaaaatctgcaattttcggttccatatcctcaccaagtaaaatgttgttcgattttaggtcccggtgaatgatcctcaagctcgagtcctcgtgtagatacaatattcccttggcaattccaagaatgatgttgtattgttgctcccagtttaatgcatttcccctattgatatctaatgtgacgaaatgttcaacttaatcaaaatcactcacctataatacaattcagaaagtgcaaattctgttcttaagcatgtaacttgtttgccatatttgctacagtacttaatgctttttcttaatattgttccacatactttgtctgaagtaaaatatttctaatcgcagtgttatagatttagatactccactctaaagaaatgtgtgattaaatggtccatgaggaggtacagttgtcagttgataccataatttttaatatttaattattggtaggggcaccaaaatctacactgaaagatattataccttttggtatctcctcaagaagtgtaaaaaaataagatatgtttgaatgggaagtaaaattaccgaataggaagttgtccaggctcccgttcttgatgtattcataaaccagtaatgtctccccctgatgcaagcaaaatccatgtagccgaacaaggttcttatgctgaagctctgccaataacagaacctcattgtgtagctgatctaatccatgcccacttgttcctaaaagtttcttgactgctacttcttgtccatctgagagtactccctgaacagattattattcagagaatgaacaatatatagtcctctaccgaatgatcaatggcatctgaagctatttttcatgcatataacttaccttgtatactgaaccaaaaccaccttctcccagtttattgttctccgagaagttctcagttgcctcttgcagcgtaggcagatcaaaaatcatgcattgtgctcttgttatcttcttcaatgctgttgccatttgacaagaaaaattacgtcagggaacagcaaattccagaaactgagcagagactgtatgctactcacggtggtcagcctcgacagccttggtcctcctcttgaaccgaacgaatgcaaaaactgcaaggatcaacagtaccaaaactgaacaagccaggcctgcagcgactcctgctgcactctttttcttccctgctcaaacaaaacatgaactctttatattcgcacaaccttgatcgagtcatatttatttgttggaacataactaaattgcacgctcctgttcatcatactagggtttgaaattacggttcgaaatttcggtaattttgcccccccagcaagctcacatctcacccaaaattttcggttttttgcaattttttgtgaatttggtcaaattttattcaaattcattaaaaaacagtcaaaatttcaactaatttcggccaaaaaatttcggtccccccagcaaaaaaaaccaatttcgaaattgaaaaccctgggtcatacctgctccagcctcaaccggagtctcgacgaccggtggtggcggcggcgagagctgcagcgtcgcccggcctccgtagaacggccgcacgctatacatcagcctgcaccacaccgaatagataccaacccaccggaggctgttgcccatgtacaccgttttcgcattatcgtggaggctcctaaggcattccttgcactgctccggcgtcaggaccggcacgcactgcgcgaacccgtagatcttggggttgaagctctcctcacccgtggcgaaatacttgatggtggtggtcgagttgttgcccgtcgtcgtcgtcgtcgtcgtggcccaggcgtgctcgaccagggcggcgaggatctttgccacggcggcgttgaaccagccgacctccggcaccttgacgttccccgaggcttggccgggaatccaactgtttaggacgaggagcaaatcagtttctctgattccaccatggatatggttaggaagaaatggtcggatttatatatagaatagttcagtacgtcatctgggagacctgccacttgtccggcctgaggaaatccatgaagctctggccggtgaagcggatcaagcaggcgtcctcgtacagggagatgccgccggggcagacgcccttcgcgtcgacgaacgccgccgcgacgcacgcgcggcaagccgaggcgttcacgtcgccgcggcagagcgccagcgcgtagacctggtcgggcgccgcgccggcggtgcggacggcgaagcccggggcgccggcggcagaggcgttggcggcgagcgccgcggcgaggaggcccaggttcctgtcgaaagcgctgttgccggtcacgttcgtgttggcgacaccggggtcgcattcagcgaccggagccgccgtggccggcagcggcagcgtgacgacgacgacggcgagaacgacggcgaggatgccaccaccgtagacatagccggcgagcatcggcgcagcagatggggagagagaggtttctacccttaacgaacggcgccatggtttgcactaaagatggcctagctagctagcgccgctgtgccgatagctacgtatgccggattgagtgcgcaagtgtggagtcaaacatgaccggctcgcccgggaatgtttgcaaattcgcccacttgaagttgcattcaaccatttgccgctatatgatttagcctgccgcactacgtggggaaaagggatgtggatttccacgaggggatatccctcgttgattgcatgtcatctaaataattatcaaaaaattttaaagaaatgacaacatatatagattaatatgaaatatatcactccacaaacatataataccaaattcaacttttacatgttgcaacaaaaagaacaaattgaactaaaaatagttattgtacattcgcagctatatttgttatttttgttacaacttgtagaagttgaatttaaacttgcatgtttgtagagtgatatatttcatattaaactatgttaaaaattttttaaaaaatttttagtgactatttaggtggtatgtacgaaacgaggggatatctattgatgaaatataatcactttcccggggaaaagcaacaacttgcatcgctttgttacactagggaaagatagaggatgtgcttgcctttcctgcttgggcggccgtgtggcagcaaagcatgcatggccttggaaaatcatgtgccaatttttctgtacttagttatcacgagtcattgactcagatgtcattgtcgcggtatttttagcttttccggagtatattggtacacgaatactcgaggatatgacagcataatatggtttcaatgaaaaaggcaatgtgatcgattgatgattttgtagtcgccgcctttcagactttagaccccgcgcgtgcgtactttccagccacaacatctgattatcagagcctaactcaatggttttaatttccacgagttttccggccgatggtgacaagagcaaaggcataggtgatgttgctcagggattcgggtcagctgcagtcactactgtgactgcaacttaagcagcagtagtgcatgtcattggatgcaaattggatggtccagattgcatgctgtaccgcgcatagtactatagaaaaaaatactgtagctccgatctgaaccgttgatcctaaaaatagattgccaaaattgtgtgcagttttatcttgcagttacaagtgtaacccgatctcaatccgttgctcaggaaccttgatccggtatggaatctggaaagccatgcgcatgcagatcgctcgctggaaaaaggaagcatcgatttttttttgagggaaaaaaaaagggagcatcgattgatttgattagcatgaagcttggacacacggtcagaggagcgcgcggcatttgacgtgtctattggaaaggaatgaatgtgggaggaagcgtcactaccacattaacgattttcgcataggggcccctctctagcttaccggtctgctactcggctatgacatcatccgtctgtgataatattatcggcccgtatgttcaaaaaaaatattatcggcccgggaggaagacaacacactcgtatgtaaaaatcaatttttgcatgtcagtctcaccaagccagctgccccgttccctacttccctcttcatctctttttctctctaatcttttttaaaaaaatctcctcactccacactcgtgtgtccatccattctcctctcctcacccgctcctctagcacccgtcccccttcccccaccgcctatccatgggagcgatgacaacggtcgtgacgacagcggcgacgggaatggccctgtgatggtcagatctgacgccagtagacagggcgacaacgacgacgacagtggtgggtagggaaatgatgacaatggcatatcgcgactcgcgcgagggtggtaaagtggctaatctaccatcccctgtcccgggaggggcgcatccaccgtcgtcggcctcgggagcgacgacgactactgcggtgactgcgtgcctcagctcttcctcctccactatcgcgagcgcctcaattcctccacggtcggaagctttgcaacagccggatctaacggtggcggctagatctagcaatagtggcctcgtgacaattggatccagctgtggcggcgctgcgatggttggatctagttgaggcgccccctcgacgggtgggagctgccagcagcgattggcccggtgacagatgggcacctgggcttctccactgcagcgcacctcggcacctccgccaccggtggcctcagcttctcgacccttgacggtaagattttacagatttttgggattatttatttgtttttgccaaaattctagtgcaggcggatgacataacatgtccacttgcgaaaaatagtgtttgcgtacggttgtagtgttgatgtgcgaaaatcttcatttttataggcacctggctctaggcaggtggagcaccgtttgtgaaaactgaaaatgcctgcttgcgaaaagcaattatgtagcagtgcgtcatctacatcgtgaatgcgttgatcgtacccgtctgaggatcctctgagtggtttctcgaaagaagctcaaagaagatatgggatgttcactactctcatagttgccggttcaattcgtcagcaccgatgcctaactgcataggtgccagttttaaaattggcacttatagagattataggtgtcggttctatcagtataaccggcacctataatcttcaaaataataaaacatatgggctaggagaggtgttgctaccgttgggtggagctccggcaggaagacaccgtcgcgggagagcgacgagcgggatgacgacgccgactcgttgttgtccctccaggcgtgctcgacaatggcaccctatcaccgtcgacagcgccaccggccgccaccactgcctccatctccatattgtgctcccccttgcctctggccttatctccttgtgcgtggggaggggaagtggcctgaagtggcgggggtggatgggcgcagacaccaagctctaagaccttgtcatcagccagccagggtagactaacgcaggaggggaaggggaaggggagggagaggaggtagaccgcaggtgggagagggagtgttgacccccgattttggaaatcggaaatcttctgtgtttatccgtaccaatccctggatcagtagttggtacacacatacatagttggatcacaacatatcacgaatgaatttaggctaaaaagaattaaatacttacattagggccaggtaggccaacaactatcagagaacaacagcggaagacaaaataatataagggcccggttaacatgccacaggcagtcgactggggaacgagacctagaacaagaccgcactccgatcatcttgtgggatacgcaagcgtaccgacaagggcttctcttcaacactcccctaaaagatatataaatagcaagggtgagtaccaaccgtactcagcaagccaccacaacaacaatgcatatgatagagggtatttcaaggaatggcttcaggttcttttgcataaagctaattttacaattcttttcacaagcctaaaacctagcatagactgatcaaattttagtaccagtgttcactttaaacaacgacggttcggtccaccatccattgtcatcccaaggatagcttcccgccattgaatcatcatggttttctgaggatgtccaccttccctcctctcgggatgtggctccatcagcataaaattcatcatgcaatatcccatcccccacaagttaagaatttagagtctagccaagtgtaatacatgtcccggtgctcaataaccgcgagtacggctattcaaatagatttagtttactcacactgcagtggatgtacactttacctgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcacgcctctcggccctacctcaacggctgtcccattgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggatggtactagccttttccagataccacccaaatcctccgtccgccccagtcga

SEQ ID NO: 54579 - DNA, 2082 bp, Oryza sativa
attgatataatcttgatcaaccttcacctcctggaagttgcagacgttgcctcacgactaaccgatacaaaaggtctataatacgcgagaaaaaccaatattcaaacaacaatcaaatatgcgcaacaaaatgtactattcgtgtttgctaatggatcccaatcatgctaggggctaaggtttcttaatctttctattgtcaacgtggcctatttaggagttaaccaacatagcatttatgggatacatatatatttggctaatcggtggtttagtctatcaaatggcttatggaaggattatggctaagcatgcatctatctaaataggacggtcatatactagaggttctgttgttagatggatttaggatcaatcaaataattacagtgaatcatttgtattatttattttattgatggaagctttactttaattatgaacatattttacttgtcacaataaattataaaaggttaataattatccatgctctatatgttaaattcgggaagtttataatattatagttacagattatctcttaatgaacaatccggagttacaattgaactatgaacatatgaggtcaagatttataattagtacttatctactattcatgtttgttatatactccccagtttaatatataaaaaagataaattaattgtgtaactataatgggatgtacaatatatgtgtgcaacagcatataaggtttggtcgcctactgtacatgagcttatttagaaagtgtactacccaatgctctaagtgattcctgaatatattgtagtttaattatatattagctagtttctatgagtgatattgtatatgtgatgcgacaagtttaagcactggttctattgggttactaataagtggtaatcaatttaggcatatataagctattctatatggtattgcatcgattaatttacttagtgattcctccacatctagctctgttattattttcctaaacaggttaaagattcatctatgtgtgtttatattttagttacataatcataaggctatacttgatttaaataacctataagccatggccatcgaatattaaataagtactagtattttcctgtacatccattcatttgagacatcacataaaattagtttgtgtggttgttacagtggcaagacatgttagagacaaatattattacatccactctactgtacaatactaattttatttattagcatatttttaagttgactattatgcatcatcttgatattaattatttaatatttataaatatattttatcaattagtgaattatatatcattggaaagcttatgaatttagatgaatttaggttcaagtttcactcaaattggagctaaatatcgaacgaaatcctagaaatattatatgatttaatttagtctatgactaaatgattaaatataatacacggctaaaatccctagtaattaaatccgaatttctaccgtgaatcgattacttatagggattacccaaaaataatctataataatctataagaattcatctatttgtctagttattaattacatctaaattactaccgcgaattgatttctcatagaaattaccaagaataatccataatttatattaaattttgcaattctacgactataattaatctataattaaattctaattattttaaattttctaaacttccccaaactccctctaatttcctatttatttccttttcctttttctccctttcctttttcttttcttttctcttttcccttttctttttctctttttctctcttttccttttcttttctttctcttttcccttttctttttctctttttctctcttttccttttcttttctttctctcctctctttctttttccctttcttctctccctcccggctcctttctctcttactcggcttctccctccctcggtatcttttcttcttcctctctttctctcggctctctgtctctcggctctccctcctacccgagcggtggcggcggtggacgcgagggggaaggagggcggctcaccgacggcagcagcggcga

SEQ ID NO: 54580 - DNA, 2747 bp, Oryza sativa
attcctgcagccctcttatatatatttttctattgtattatttaaatgaggtctaattctaaaattagcctagataattttggaggctttgagggttctaaaatatcctagtgtggccctttttattacaatagcacattgaacgaacttatagcaatatattttacacggataggttgaatctatttattctataaatagtatattaagactcggtacaacattaatctaattttaaacactcacatattcttgtttatatataaggactaatttatttatatgaccattattttatatgagtgattttcatgtcatgagtaactcggcgacatgttgcaagtatcaatctatatattccggtgaattacttatttataaacatgatcactatagttgtgatcatcatttcatgtgttcttatatttcatgtgagattcgattcaaatgaattagatttaatcttactatttctttagctaattgtgacatcaagctatcaatcatggttcgaatatttaatacatgatttgtaatttgtaatagaaattaatatttgacttaactatcttgtgcataattatttgtaggattaacaatattatattctcgtaaatttatctattacttaaattttagatccttactttactttctttgtgatcacttacggtttggcaagcaatagcaatcataacaaccagcataatgcaaaagttttaaaaagttcaaaattttagtgatttttattgtcttgaattttcaggatgttacagggaggcgagaagcctttgggtggaagtggataaggatgaatgggtgtcagttcggctctgttcgattttgtacgggtacccattttttcaaaaccggcaactataatatatgtgtcgatttttttaataaccatcacctattgccaactataagtgtcgttttttaaatagtcccacattggttgtggaagggtaaaaaacctaatatataaatgggggagcccctcacctcattggctagcttttggggtgggaaagaccatttacgattctacaattggtatcagagcctaactagtttaacatctcttgcccaagggacagagaaattttaggagttgagggagctacttttgaagagaagtacctagaagacttcctaccccagagggtaaaatgaagagtgaacccttccaacctgtcaaggaaagatttgcaaaaaggctatgtgattatagatggccatttggcccgcccggcctaggcacggctcaagaagaatcgggccggcatggcatagtcgacactttgttttatcggccttttgcaggaggtgcgttttgctcatattggaagagggtgtaatcaggggcgaacgtaaaacaaaagtgacgatatgaatcagcagctgctgcagctagcgccaccgaacaggccctaaatatataccaaagggtaaaaaaaactcttatctgcacttgatcctaagctctatctaattaattaaggtatagcatgcagcctacaaccttatgcaaggtttaaaagaaaacgagtgtagcaagtagcagtatatttaaggagtgtttagatctatgggtataaagtagttttgacgtgtcacatcggaacacatttaaagtattaaacatagactaataacaaaacaaattacagatttcgcctgtaaattgcgagacgaaattatgaagtctaattaatccatcattagcaaatatttattgtagcaccacattgtcaaatcatgacacaaataggcttaaaatattcgtctcgcaatttacccgtaatctgtgtaattaattattttttttgtttatatttaatacttcatatatgtttccaaacattcgatgtgacgaggtgaaaaattttactaagagatctaaacacaccctaaattacatacggttccaagcaaggaaggaatttatgaaccgtggaatataattctactaaccatcattgagataaagaagcatctgtaatctttgagactatgaaaagcaaaaaagaaaaaaagaagaaaagaaaagagaaggaggcacacgggcacacggcacagcattccaggccactgtgccccactctactagttaggcactgctggtttgaagcttcgctaccgttgctgcctcagaaacttcagactttcagagcatcgccctttgtgggcttgtggcagcgccactagggattaaaatggcttagaaacaaacagaaactacctgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacatactcggcggattcaaatccccaaacaggagtagggtattacctctcattgagagggcctgaacctgtctaaatcatttgtctccgcatccatccacttttaggtctcgtgcgctacccccttttattattgccgaattcatgtttcgacactaccctaaccatattttttttcaaattagaatagtaaacgataatttcagataaaattaag

SEQ ID NO: 54581 - DNA, 5803 bp, Oryza sativa
actggtgcctccgcctacacggctggcctattatgccgccgctgttgggcgtatacgacctcaccgccggcctgcctccgtcgccgccgactggtgtcctcgcctatacggctggttggtcataccaccgttcatgggcgtccacgtcttcgccgaccggctggccttcgccgccgccgactggtgtttctgcctacacggctagcctattatgccgccactgttgggcgtctacgacttcaccgccggcctgccttcgtcgccgccgactggtgtcctcgcctatacggttgattggtcacaccaccgttcatgggcgtccacgtcttcaccgaccggcttgtcttcgccgccgccgattggtatctccgcctacagggctggcctattatgccgccattagtgggcatcttcgctttcaccgtcgacagccttcgtcgccgccgactggtgtcttcattattattaatggacgactttgttcccacattggccacctctgccatcaccgaggggaatattacaaagctaagtcatcatttattttattctttatatgatatttttgtcttttccttcgcctcactacatcaactggttcgccgttgactagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggactgagtaacgcaaggttctaagtattattcagaataaatcaaaagcatagagataagataaatttattttctgctctttacaatctgagtacaaaagtacctatcgagttatggagttctatcttcctatgctttccgtttggtttgccaatggatggttgcctttgggccgattcctagcacccgggggctcgttggatggactgagtaacgcaaggttctaagtattattcagaataaatcaaaagcatagagataagataaatttattttctgctctttacaattgcaaaagtacccgagtagtaaattctgattcgtgaaactttattccattaatgacaaactcatgtcactcatatgtatgtttgggaagtgcctaggccgactcccgatgcttgggggctatgactagtcggacagagtgtttaaacgtacggagtcatctgcttagggaaatcaaaattgacaagaggagaaatacatatttataaatattttaaaatacttgattttttctcgagtattatatttatatcagatactactcatcctatatgtttgttctgcaggatccagatccagatatgcacaaaagggatacatggctttaagcttatctcttacgctccaggaatggatcagtcagaacatcaccaccggcttgccgtcatcgccgccgactggtgtcttcgcctatacggttgtttggtcacaccaccgttgttgggcgtctacgacttcaccgaccggccgcctcgtccgccgccgactggtgtttccgcctgcacggctggtctattatgccgccgttgttgggtgtctacgtcttcaccgaccggccgcctcgcccgccgccaactggtgtttccgcctgcacggctggcctattatgccgccgttgttgggcgtctacgtcttcaccgaccggccgcctcgcccgccgccgactggtgtttccgcctgcacggctggcctattatgccgccgttgttgggcgtctacgtcttcaccgaccggccgcctcgcccgccgccgactggtgtttccgcctgcacggctggcctattatgccgccgttgttgggcgtctacgtcttcaccgaccggccgcctcgtccgccaccgactagtgtcaccgcctgcacggctggcctgttatgacgccaactgatgctatcttcttcacggctggctacatcgccgtcaccgctaataggcatcatcatcttcgacgcaagctgtctacgtctactgctgactagtgccctcacctctacgtctggtttagacagctaccactactgatgaacatcatcgtcttccgtcgccgactggttatgctgtcgccgactggtgcttttatcttcacaactgcgcgtcttcaccaccggtttgcttctgttaccgccgacttgtgttcacttcattacagcaatacaactttgtcatcatggtggagcgacttcatctttattatcttcggcaccggcaaactctattggtgctacttcgcaagttttgctacttcaccaaccacgacgtctttgtgaacctcgacatctcggcatgcgatgccgtgttattttactacaacaagtggctcttcaatattcaggatttctacttggacatcttcaacacatatcttcaatcaagcaatgactattcgacgacaagaagctacagtctcgactctatgttcagttgtttcccaactaatcaaagagtcgggggctacacaaatacaaggctcaaaatttgacaaattttatgtcaagctaaagaaatcaattcatcaacccacgagtcaaatccaggagtcattatcttcatctttgcttcagaacagacattctacttcaacaacatcaaatattttgatttagacgagttggacaacagcatcaactctcctccaagtgaagcatctacaacagctataacattaatttgatggattattgtcactgacatcatcaccagcacctttgcttcatcggccctgacatctccgctgttgctaatggatgattatgtcttcaccgacttattatttcaccttcacggttgacctactatgcaaatgttgatgagcgtctttgtcattatcattggttgctacactgctattgactggatcaccgacatcgttatcttcatcatgtcggttgcgtttgtcgtcgtcaactattttcttcatcttcatgattgatggatttcgtcatcgcctttgatcttcattgttagttgatctgtctgtcgctgactggtttcttcgcctccatggttatgcaacttcattacctttgattggtgtcactgtttttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactagggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaatgtgctgtttgggtttttaagcaattgattggatacaatatcattgcttttcgccacgtaagtgtgcatttttattgaccaatattatggcttaggctgattatatattgtggtcattttctaggcggttggtaaaacctttatgagtttatttactcggattttacaccacatatgccatatatttccgggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacatactcggcggattcaaatccccaaacaggagtagggtattacctctcattgagagggcctgaacctgtctaaatcatttgtctccgcatccatccacttttaggtttcgtgcgctacccccttttattattgccgaattcatgtttcgacagttggcgcgccaggtaggggttgcgtcgagtttcctatcaacgagcgcgatggaattaacttcatgagtcgccgacttcgttttcgcttcgggagttttcacttcctttccgtcgaccacttcttcaagctcctcttctctgacttgatccaaatcagtcagggggaaactcaatcgagggattacaacaatctaccgcggcaagtttcagattcaatctcctatggctgccgtcagcaccgccttcatcttcggaccggttcttttcttctggagttcggcttgcatcgccgccgccggaaattccgacgggacgtcagtcgtcaacttgatcgtttgacatgccgagtccatcatctgatgatgtcaaatctcctggcgatattcaattactaatctaaattggagtcgacgtggaatctgagccaatcaataggagcaattttcacgcagggaagtgcagcactcatgcatgtattgcatgtctgtcacaagctgccgatatgatctcctgtccacccattaacacatatatacggaggacactgagaaaaaagctaagtgcttttatttttcctctttatgtgatattttccattgagcaattttttttatatatctactcatgctaactactcgtccagcgccggacgcctagttttatcattatttatcatattgatttttaatctcagattaatctcttgttattttttgttgttgttcgcatataattacgcggcactattgaggcgattaatgctggtcatggagtcgaggcgtctcagctttccggtcgatcggccgcgagtccactttgccggcttgtcttcgccaccgccattg

SEQ ID NO: 54582 - DNA, 9754 bp, Oryza sativa
tggattcacccatgagataacgtggttgttccatcaaggatgagaacgtggcatcctattaatttcgtgcgatggctggcaataggatgccatgtcctcatcctaagtgaaacagtcacgttatctcgcgggtgaatccattcattgacagtgtggttttgtgaaactacactaccaaaatatatgtacttaagtgccaagtgtcaaagtgtgtgtggttttctgcaacttggactacaaaacgtgcagttttatgaaatttactcttataattatgaagttgtatccatattagaatctcaatttcaagtgttatgtgttttactctaaaattaataattaataaatgtaattgatatggaccatttttacaagaataagctattaaattaataaagaatcaatctatttaatacactattaaatatttagtatcaataatattaatatagtctatggtttggaacaagaaaaatgcttgtccggtggtatttcgtagaacaactaatgtttttagaaacacagtacaaacatagatgtttataacacacgcacactcaccccggtaaacaaacatcctgcctctatgagcatctccgaaagatttatctatcatatattgaaattgacgaaatcaccacgggtgtctcgttgtcgatgtgaagtacatcacctaatactaaagaataatttaccgtaaatgtgagcacccgtgtcaaatctacgacttgaacccaggtaagcaggttccaccacaaggaagctaatcagttcagttacgttcactttgacattaaaggtaggttgtagaactgataatctgtcaatggtgaaatatagattcttccaaaaaaatgatctatgctaaatggatggatttatttgaggcaaatgatttgttgctggcctcggtttcttcgagcatgtgttagtgacacactcccgcacggacgtgcttatgatgcgttatgcctgtatatgtggctttcacctaatgatgataaacaagcgcaatgataagctgaagcagtacataattatgccccctaccccgctaatggcatatatgtgctttccttcataactcagttaggtatcaagttcttcattctctactctgtcgtgccatgacttttgttgctttaatttctagcttgctataaattcctgcacctcagtcctgtcccaaccatcaaattcgtcttgatcaaactatcagagcacatatggcactcactcacctcctctgctccctcctccttgccaccgcattgctgctgctctccatctcccgtacaggtaaccatggcaaacgtagaaacgctttcgattattttggactagtagtattatttagatatgcttaagtatgtgcagctttgtaccaacagaaccggtgtttcttagctttccactgcactgtcagtggcagagcgaccgctcggctagcccgggcagtccggctcgccggcgaaaactccattaaattttaatattgatggataaatcaatgagaaaataacaaatactagttaggccctctttaattgaaagaaaattcataggaattttagaggattttattcttataggaatttttcctacaaagccttttgaatcaaagaaatgaaccctatgaaatcctatgaaattcctattaaatacctcttcccatacaagttttggaggaattttaataagagatagaacctcatggaagaaatcctttgagtctttatctctccttaaattcctgtgtttttcctgtggtccaatcaaacagtcattccgtttttcctgtgttttgcaatcctctgttttacactttcattcctgtcagaatcctatgtttttcttattcctccgttttttcatttctgtgattcaaaggggcacttatattgaagtttgcctgggctcaaaaatctatctttctgactccaccactgactgcagaggctggcgaggtgggcgtgtgctacgggagggacgcggacgatttgatggatccaccggccgtggtgaatcttctgaaggagaacggcatcacgaaggtgaggatctacgacgccgacccgacggtgctgagatcgctgtccaacacaggcatcaaggtgatggtggcactacccaacaaggaccttgcttctgcaggccacgatcagggaagtgcgctagactgggtgaaaacaaacattgttccgtactataaccagggcacacaaatcaatggtgtggctgtggggaatgaggtgttcaggcaagcacccaacttgacccctcagctgttaccggcgatgaagaatgtgcagacggcgctagcgagactgggccttgccgacatcataaaggtatcaacacccattaattttgatgcggtcaatgtgtcatggccatcatccaagggtgtgtttcaagacagcatcgcccagtcggtaatgagtcccatgatcgatttcttgcaacagaccaactcatatctcatggtcaatttctacccatatattgcctgggctaactctaaaggccagatctcccgcgattacgctacatttggccccaacgccggtgtagtcgatccgtggagccacatcacatactatagtctctttgatgcccagctcgatgctgtttactacgctataaatcaggtttctggtgatagtgtgagggcctcaatggcccaaacaagatgggggcacccgacaccaagggtgcccgtcaaatgttcggaatgtgggcatccctccggtggtcagttccgcaagttgaccacacaagctgatgccgaagtggatgtggctacaaaagctaacgcccaagcattcaacaatggtattatcagacgcgctctgtttggagcctctggtatgcctgatgtctctgtgtacatcttcgctcttttcaacgagaacaagaaggctggagcatctgtagaacgcaacttcggcctgttctaccctaacggtacaaaggtttacgaggttgattttcatggtggtggtatttgtcccaccaaggcgagctggtgcgtggcaaatttagctgtggggaattcccggctgcaggcggcgttggattgggcttgtagtaacggcgcagactgcagcgctatccaacagggcaaaccttgcttcgagccaaacacaatggttgcgcatgcgtctttcgcattcaatgactactaccagcggatgggccaagccaatgggacatgcgactttgctggcgctgcttatattgtcttccaaccatcagaaagttagttcctacgaccacatatttcttaaaatgcaattttgtttagttctcacaaccatttgataaatctgcctcactgtttatctactaaattgcaggcatttgcgacccaaatccaagttggtgtatcgcgaaccctgcagttggggacatgcggctacaggcagccctagattatgcatgcggcagctgtgcagactgcagcgccatccagcccggtgcacggtgtttcgagcctaacactaaggtggcgcacgcatcctacgcattcaacgactattaccagcgtgttggccgagtcagtggctcgtgtgacttcggtggtgctggttccattacctaccaggcaccaggtgagttcaagctcaacagatattctcatcttgtttgtttcagatattgctttcaaaaattattgcccatgcatttcttctcccatatataatttttcgaagcaaacatagctaattaattgatccatcttctttcgtggcttacaaccacgtgccattttaatctccattgtatgttttgttttgaaactaaatgccattaacaatgcgttcgaaaccttcaagtgctaataatgtacattttgcgtaaaaaaaatacacacttgtttttgtacactacgtgatgattcaactagttaaatggtgatcttaggtgtttgttgaattattttcagagattggaaactgcgtccttccgccaatgcttgaactggacaaagcgtactgaagaccgagggctaagctagctaccatcagttcgcgatagtggggatggatatcgaagaacaagtccacatcgtttggcaaaaataaaatgatatgtttgtagcagtttttccagtcgggtctattgaaataagtaaatataccgttcattcctgttggatgaaattcctcagttacataccctgagcaatttatcatgtatgtgcatatgatcagactcctaagcagaactgaaaacatgaagaagtatttatttatttatttttagagaggatcaatgcactctaccatttccataaccgctgcaaaggtttgaatttttttttaaaaaaggaaaactgcacgagattgtgtttttcattaaatatagaagtacaaaattacaaccccaaggaataaaggaaaatagaaagcactctatacacaatacatggttgggtacgtaagagctcgcgtaagcactttgcacctgccagcgcccacgtcctcgcttcctctttaatttaaaataaaagcatcgccaactgaaacatacccaattcttttcggcatcatatataggtgccatcctattccaccttctaaggcaattcgagcactagaggagaaaggaactagacatcacaactcctgaacatctggaacagtttaagaactcctgaaacacaaaacgaccaacttattattacagaaggttcaacaggcataagtgcaaagcctgaaccagctccaaatcaaaacaacaaaacagttaacagagaaaagtccccccaagacaatattgtggagaattatgggtaccacatactcacatggctaggctatccgactggttatagggaatagatcatgtatatagaatatatataaagactaggactcgggtataacatttacttgtctatcaaggaacggtttgtagtcctggtttgttaagtttgtagattaggtataggagatctaaactataagggatatggtctctatcttataagactactccttcgcctatataaggagggcatgacgcctctttgggggcagattcataaccagatcgttagatctatattacacctggtggattcaaatccctaaaccggagtagggtataacctctcatcgagagggcctgaacctgtctaaattcttgtctctgtatccatcaacttttagatcccgtgcgctaccctgtttatattactgaattctagtttcgacgagtattaaacttgctcaaacgataagttgtttggctctcccctgctaggcttgatgtagatagctactctctctatcatataaaaaaacctaagggattgttcagattgttatcatttcaaaggcataccattttttagagttgtcaaatatttgcatccatttagttttattttaccaaactctaataactacatataaatgctgtcaaaacttggcaatattgttaaattgttgaaattttgatattgtcaaaatttggtaagatttattttagctataatctgaacatgccttaagattggatggaacatatttaatgtgctaggatatagcacatccaattctagattggttttttttatgggacggaggcaggcgccttaggccatgcaatatatgatgcatgatgcaagtagaaaaaaaaatgttgaaagatgggacgaaccaactaattaattatagataagaatgctggatgtgaggagccttacacgccaccatcgaaagctccccatggttgaccacttgacctactaataaacttcgttctaattgcaggtgttggcgtgttgctgattgaacgagaggaaggcatcaatagcgtgggggtggtggagtcctctacatagtacctaaactctagcgaaagataatctactgtaagaattactgacaaaaagctgagtctggtaaagatagaattgctgatatatactccctccgtcccaaaatataagggattttgagttttgattgtaacgtttgaccactcgtcttattcaatttttttttgcaagtataaaaaacgaaaagttatgcttaaaatactgtagataataaagtaagtcacaaataaaataaataataatttcaaaaaaaattgaataagacgagtggtcaaacgctgcaaagaaaaacgcaaaatcccttatattatgggacgaagggagtagatgttttaacgtctatacctacacattatggccttgtttaattcccaaaaattttttttacctaaaaacatcacatcaaatctttgaacacatacataaagcattaaatatagataaataaaaagactaattgcatagtttgtatggaaatcgcgagacaaatcttttgagcctaattagttcatgattagccataagtgctatagtaacctatatgtgctaatgacggattaattaggcttaataaattgatatctcacggtttccacgcgagttatgaaattagttttttcattcgtatccgaaaacccctaccgacatccgatcaaacgtccaatgtgacacctacaaattttcttttcgcgaactaaacagtcctatatattaagagtgtaagatggacctttcccagctgatgtatatgttggtaaaaatagtccaacatatagttccacccactttttttttcaaattattgtgcataagtattacgcaaatatgggtatgattccaacaatattttaatgaggtccaagatttatcaccagtctttgtccgttttggcgtctgttaatgtacgtgggtgtgggattgtgtgtatgcatcttgtgtgtaaagaaaaaaattgagggcaaaagcaagtaatatgtggggttaagaaacaccaaaacaacttccaggctgttttatcaatagttgagataagagagtgatttatttactaggaccgttgaaattcgaacttgccaaaactttaaattttggtttagtctttttttttctaaaaatttatgttgagatgtatattagcacaaacccattataattttcttttgtttcgggtagcggcaggagggatatgctgcagaaggataaatataacatatacagagaccatgtttgtttcttttttttttcagaagttgccaaggtcatttcgaaaaaaaaaaggataaatccgccgaagcgatattgtgataggtggaaaggctgaaagctatgttgccgtcccctaatctgttgagagatgccaattagtctacgttgatcaccaatagtataagtggtcagtagattatactctctccatattttaatgtatgacgctgttgactttgtaaccaatatttgaccattcgtcttattcaaattttttatgcaaatacaaaaatacttatgtcatgcttaaagcacatttgatgataaatcaagtcacaataaaataaatgataattacataaattttttgaataagacgaaatgtcgaacgtttgttaaaaagtcaacgggggagtattagttgccatgtgttgggaaagcgatcaagaggaaataattcaaatggctgcccggttgagactcgacgaagtaggggaaggattttaggtgcataaatgtgagattgtgactctgaagacaccttagcatatcaacatctccactccatcactcttgaaaaagaaaaatgacaaataaatcaattaatcatgttgtgtttatccaccattgtcgactggaagtggttcctctgatgtaaagtcaaagggacatatatcactaacatatagtgcccatcctatcctagagtccatccttatgggcatatatatcaagagacataggttactctattgtaccgataaatatgtttgttaaccgttccaccaaagagtatccaatgcaataggagtagttgagatgctattgctgaagtatttatgctgcaacttagcttctgttttgtcggcacattagctgggtgttagtcaaagatgtagggtatatctcgaattaatacttttttagtcacgtttagtaccgaacgccatgaatcttttaagacttagccaattcgtcttccatctcctcagctttccaagttcttcgctttcctttgcaccattccgtattcaaagatccactgccctttctctttaactgacgggaagacacaaggaagccatcttgacagctctaagatcggacctgctggctgctgctgtgatttttgggtgagagcttgttgattcaaattggaattgttatgattcgagtaggaagttcatggttctaatacaaattttagatactcgagttccaagttagaggcttttgcatagaaacgtttggatattttagttcaaagttatgatttttgtgtgataagtttggggactcgaactgaaagttcaagacaacgagtagaaatattcgaggattttgagtcaaagtttcgatgtccagcttgaaaagtgtgtttttcttttctttcttgctccagatggaccagatgtagggatctccaaagaagcaatcagccctcttgatttacgctgcctcttgccacggtgtgcactgtgcagttgcagagtagagcatggcattcagtcacctcctccacgccctcctcgtggccgcggcgttgccgctgctccttctcccccgtgctgcaggtaacgtgcttctggctttcctgccaatgcagctgatcggcaacgccaaacgatggagtaattccttgctcgtcaatgcagatgctggcgagatcggggtgtgctacgggagggacgcgaacaacctgatcgacccaccggcggcggtgagccttctgaaggcgaacggcatctccgcggtgaggatcttcgacgcggaccagacggtgctggacgcgatggcgaacaccggcatcaaggtgatggtggcgatacccaacgccgatctggccgccgccggccaggatctgcgcagcgcgaccgactgggtgacgaacaacgtggtgccgtatcgcagccggggcacgctgatcaacggcgtcgccgtcgggaacgaggtgttcaggcagagacccgaactgaccgggatgctcgtctcggccatgcgaaacttgcacaaggcgctggagaacctgaacctggcgaacgacgtaaaggtgtccacgccgatcgccttcgatgcgctcaagcagtcgtcccctccatctgcgggggagtttaaagatgagatcgcgcaatcggtgatgaagcccatgattgacttcttgaaacagaccggctcgtacttcatggtcaatctctacccgtacttcgcatacgtggctcagcctgacaaaatctctctggagttcgcgacgttccgccctaacgctggtgtgcttgatggcaataccggcatcaggtacttcagcctctttgatgctcagctcgacgctgtttatgctgcgataaacagggtttctggtggtagcttaacggtctcaatggctcgacgagatggaatccttagtgtgcaagcttcagaatcagggcacccctctggaggtacatttcccctattttccatgctagctgcagccgatacggactcgatagccacgatagccgatgcccaagcgtacaacaatgggcttatcagacgtgtagtatccggagcctccggtatgcgtgacgtctccgcctacatcttctctcttttcaatgaaaacgagaagcctgggccagccatagagagaaactttggcttgttctacccaaatggcagaaggtgtatgaggttgactttagggccggtggcggtggc

SEQ ID NO: 54583 - DNA, 894 bp, Oryza sativa
gatgttgggagtgcagcattgcagtcagcattggactttgcgtgcggtaacggcgcggactgcagcgctatccggcaggcagtgtgtgtttcgaaccaaacaccttggttgcacacgcgtcgtacgcattcaacgactactaccaacgcaagggccaggccagcggcacttgcaacttctctggcgccgcttccatcgtattcaagccatcgccaagtaatgttttgctctcaatctttaagatcaatgaggctttcgcaaatgtgcattcatatcttgattccatctcattgtttatttgtcctgtgaattgtttcccgagatataggcatatgtgatccgaacccaagttggtgcgttgcgaaatcggaggtcggggacgcacaactacaaaatgcactagactatgcatgtggtagctgcgcggactgcagcgccattcaaccaggtgcacggtgctttgatcctgacactaaggtagcacacgcgacctatgcattcaacgatttttaccagaccaccggccgggctagtggatcgtgtgactttgccggtgctgcttctattgtcaaccagcaaccaagtgagttttctctcattttactgtgcatgatatatatgccctactgctactaatgtacatattccctaagaaaaattgcacacttctgtttcaagtagtaagtggttatcttattagtgcttgttcaataatttacagaaataggaaactgcgtgctcccaccaaacaatgctgggacagaacaaactgcaattgaagatcaatcgactgcaaacttaccagcaacagcttggcagtgaggatggattaaagaatcacttcatatttttctgcagagaaaaaaataatggtaccattaataattagttggg

SEQ ID NO: 54584 - DNA, 1291 bp, Oryza sativa
atcacgtataatgttggtttattttgggacggagagagtacagggaacacatagcaacaaggtttcagagttttttgtggagcaaaacaccgattgagatcctatgctcaaagtcaaatcactttgagtcactgaacatgtcagtgactctaaaaacacattacttaagttagaggataattcgtgaaacacgtactatcgtaataatttgatctgagccttgatcatgactcggacgattacgacataatgtgtcctaatgcaccttattggtatcctcctctacagtacagtttatacgcttagggcatgtataaaggtagagcttagaatggtctctttgttaatacatatcacttagagactattctcctacaatagttaagataacaaaaactcttaaccattaatgcaccaaaatattttttttagtaccattctttccttttctccacctccatgcaacaaaatttcctttaataaacgttaagagtcgactctgacccgttgtcatgcgtagcaaccatgtttccctttactccactctctctcttccacgtcatcaattttacttacatggaaacgaagagagaccgttattacacaccgttgtacatgcacttagggtgagtttgaggaaaaggtgattgaggagattgggaagtttatgcacttagggtgagtttgaggagaaggtgatcgaggagattgggaagatacgcaaaacgaggtgagccattagctcatgattaattgagtattaattattttaaattttaaaaatagattaatatgattttttaaagcaaattttctataggaaatttttgtaaaaaacacaccgtttagtagtttggaaagcgtgcgcgcggaaaatgagttgttatctccctcaatgttacccgaacgaacgtagccttagggtgtgtttgaggagaaggggattggggagattgggaagatacgtaaaacgagatgagtcattagcatatgattaattgagtattaactattttaaacttcaaaaatggattaatatgattttttaaagcaacttttttatagaaatttttttttgtaaaaaacacaccgtttattagtttgagaagcgtgcgtgcagaaaacgagatgcttttctccctcaatcccccagatcgcccaggaacgaacgaagccttagagtcgctgacatatatgctcatgagtttcccatgagaaagtggatcctacatgttaggcgtgatagtatgtcactgcgaaggatctcgtttcaacaaaattgagtttcgct

SEQ ID NO: 54585 - DNA, 2812 bp, Oryza sativa
aactctatggtgtttccattctgaaacatgatcataataatcacctgtctctaggtcatgtgcattgtgaaatggaacacctggagtctgtatccgaatctgactgtgtgtgcttctgaattttcatcacagaggcttctggccaactgctgctgtttacctgcaaaagagccccaccttcggttggatattccaccaccctcttgtgacttcggtacggctataagtcaccaccggatgtgcttaaactccctgcttgtcgtcgtagattcatagtctctgttcttatggttgttcctgtttacaaatttgcagctgatcactaggttcaggggaagacgagtcccggtgtgatcgtcgctttgctgctggagctggatcactccaagggatgccgggtcacctccaaagaaacttgagcgatacatgcggttttttctggttagcttgtgattcgttggtgctgctggtatgtgaatcttgtgtctctgctaccagtaccctgcctcaaagacctcgttactacgctcgccagttgcccagttgttcgtagaaactagaaagactttcttgcttgttaatgggtagagagggtagtcatcgtacatatggctatgctcattgcacgattggttgattgctagtaattgatttgtaggtcatcctacgggaatattactgagtagcaaaagctttcagttccggtgctacgtatgacgttcatgtttttaccttatgacgttcatatttttactgttcatgtttttaccaaatgacttttagtagaatcatatttttaccatatgactttcagtagaatcaatctgacttaccgttcatttttttactgtatgacgttctagaatccttcgagtttctatttttctacgcaaataattcgatcttttctgcatgaatcttttgtcgcacagaacaactataatagtataattgagaaacaatagagtgaaatatcacaaaatgaacaaggtaaactaagaaatcaaaaatcaactaatccatcagcaccacaacgtatataggataataggatactgacatcagtggaaagcagaatgtatcagtttcagaaagacctgagttcctacgtgttcaggcttctgaatgctaaaccaatcttcctcgaccagttccttggccataccgtgctaaaaaatgattcccttggccataccaatttgctccttattacaccaatatcaactatagttggtaaagaagagtaaaatgccacaaaatgaacaaggtaaactacgaaaccaaagtcagctaaaccatcagcgtcgctggggaatttgaatgacgcatacagaattgaggaaaaaaaatattaaaatatacctttctcctatgattttataggaatatacttatttttgaaggtgattattttgcatcctaatagtaatatatagagaaaaacgtgcattgcacgtatatgtactagtatactcatgattttacagcctgacttgaaaaccgtgccatgaaccaaaaataactagcaaacaacagtgcaacacatgttgacacgagatagattatcactttcaaccacatatgactcgttcttccagcacacgtcgcgcctatggcttctcctgcaaacataaaaggaacatagacgagtaggaaataccaccactcctacaaacagacaaaaaaaaataatgtcatgaagtttggccacgcataaattagataacctttgtgtatttgtaatttgtaaattaaagattcggaaaatttattttatttattttgtaaaggatgtgcagtaatggcgtttattagctgtaaaggttcataaatttcatttatttatcgtatattttgtataacaagaccacaaatcgaagtgattaacttttccatattattagttagcagaagtgctaaacaaagattaattagtgattaatctttcattaattactatctcaacaacaatttaaaggacgtaccttgggcttataaaaggactttttaacgcaagcaatcctcgccaccttgaattgctgctcatcggcgaagtaggccgccgtgtcgacgttgaaccagaagttgtccactctaccctgtctagttatcatggacggtgatgatggcagctcagcgaggatatcggcgccgttgatgcagtgccccttgatgacgacgacgagaggacagggggctctgcacacgtgacagcgcctgtcctcgctgacgaagcggacctggacaatgcatctcgcgcaaacacagcggtggccgcatggcccgatcgccacccactctaatggctccacacacaccgcgcagcagttggtagtagtagcagcagtgccgccgcgggctacgtcttggagctcgatgtcgacgacgacatggcacactgccttggtgctcatagtattgggtggttgtttcacgtggtatatgttggatcgaacacaagtaaccaagtctatgagagagatgttgaatggtagattacatcagcggaagtcaaataattgaatcttaatagatcaaaacacaccccaaccttaaaaccaatggaacacacgtaatccagtctatctgtggagattatgggtaccccatacccacacggcatggttatccgactagttataggggataacttatatatatgaaatatgtaacagatcatgacttgggtattacgtttccttgtatattacggaacggcctaaagtcctggtttgataagattgtaaagtagagttaggaaaccgataccgtattggataaggtttctatcttgtaatcctgccccccattc

SEQ ID NO: 54586 - DNA, 2669 bp, Oryza sativa
tgattacaaccctaagatttctgattttggcttggcgaagatatttgatggggatcaatcaaaagatatcactcatcgaattgccggaacatagtaagtagtaagtatgatatgttaggtttgaattttaacatgatcatggccaacatttatcaaatatggtataccaaatataataggttacaatgtaatgtttttttacagtggatacatggcgcctgaatacgccatgcatggtcattattcagtcaagttggacgtatttagtttcggcgttttggtactagagatcgtcactggaagaagaaatagtggctcatatgatagcgggcaagatcttgatctcttaaaccatgtgagtactttaagtctgttcatgaataattaatcaaacttctcaacatactacttgaataaatgaaccaatttggtgcaggtgtgggggcactggaccaggggaaatgttgtagagttgattgatccatccttgggcaaccatcctccgatcgagcagatgttgaagtgcatccacatcgggctgttgtgtgttcagaaaagacctgcaagcaggccgacgatttcgtcagtaaacatcatgcttagcagcaacactgttcgtctcccttctctatccaggccggctttctgcatccaggatgttagtgccagtgacagctctaatccgcattcaacagcggtgtcttcgaatgatatgtcaatcacagatcttgtgccgagatgaatcctgaattcttagttcagtcgccaaaccagttaagtgtacagtgcttctagatattggattgatgcatggggaggccctgacccctgaatcctgcattatggctgtaagcctgtaaatagaattgttaaaacggtaggaactatctatatattagtcggtagatttttttttctagaaaatcactcggattttataagcaacaggttggaaacgtattgctcagatcaaattaagcatgtcataggctgtcaaacactaaaaacaacataatgctaagaaaatgtcaaatctctagcaacatgccagcaccggagaaaacatcatacctaaattatttaacgtcaattataacaaaattacactgaaaaagaaaaaaaatacattctactacaactagtaatatgcccgtgctaatgcaactgtacatttttcataattaatgtaaatcaaaccatcaatacatgattatatattttgacaatataaatataaaatatttcaaaaaccgaatatccaaacaaagatatacctgtatttgtgcgcacaataaaggatttgtgtatatttggtttaataataattttatatactcataaacttattgaattgtatagacttttggattcaatcaccccatagacattattcgtaattcattcaacttaatttttaatttgtataaacttttagagtcaatcaccataactcattcaacttaattcaggcatagatttgtcaggagtatttatatatttggcattacacccaatgtattgaccttcatcgcaaaaactccagttcttcacttagagtatattcaattacaactttaaaacaacaacattgtggcagatatttttcagaatctaatgttgtgaacatttagtgtattatgtaaagggaatagtataaagggaagactttaatataattgagagctgtcaccacctctacacccacctcaaaccaattatgggatacgaagcaatcgctgaaaattaattatgtagacaacgcgtctacgtaattaacaactactctaatgccggccaaacactaaagcaatcactatattttactgaactatagtgaaaaatgatcccgcacgctaattagaaactaatcaagagttaattctcaacgagcaaatcttaagagtaaattacactagcggtccttaaacttgcatgtaacgaggtttcacttaagttcacgaacttgcaaaacgcatatcgagatccctaaacttggtttaatgtatcatcctggtccaaagcatcgtttgaccgtggtgttgcctacgtggcatgctacgtgaacgatgacatggaatttttttattttttctcccttcttctccctttttttctccactttgcctccttcctctcccttctgccccggcaaggctggcgagggggcgcggaggccgacggtggcagcgacgtcatcgataggaaggagaatgaggagaggaaggggaagggccccgctccggccgggcgcaggcgcgtgcggcaaacggctgcggcagctgctcaagttcgacgagctcgcctcctcttttgcggagctcattgtcgggccttgccgcccgattgttgccatcaagctcgctgccgccaatgagctcgcactctccccgctcgcgttgagctcaccgacgcctccccctacacgcgcggcggcggtcagcgacccctcccctaggcgcggccggcgatatctccccccgcgcgtgcctcggccgcttccgcatgaatgacacgccgccgcccaacgaagtgcgctgcccccctcttcgccccctccggtgccggttgcaaggccgcgccacccgctcctcaccatcgtcgtcatcttgggcggcagagggagaggaagtagagggagaagttgcatgtcgccgcagcaggaggagagg

SEQ ID NO: 54587 - DNA, 12652 bp, Oryza sativa
tactctctccctacttctagtatacaataaagtacaatagaacctcttataattcagctcatactttggtgtgtgtgagaatgagggaggagaagtgtatgtatatggtggaagtgccttgggaggatagagtttcttccaagcatccaatgagtatcttcatcctcctagtgccaagtttcccttctactgatggttagagtgacggaaacagtcacaaccgtcattgagagatcattatctgccgaactgaacttgggcctaggccaatggcctctgtcagggttcggccgagccctagccagcttcattggccccggttttcggcctagacattcattttaggaccctcaatccatattgccatggtagatgggaccatttgaaggtgtttaattggttttttgggtgcaagactccataagtttggatatgagtttgattctcctccttcttcacgtatattttctctcaactttggtagtttgtcacctatgtccaaatatacatcaacactcgtggaaattgttagaaatataccctatcactatgttggatgttttatgctttccattttatacatatattgacggcgtgaatttggtacttaacagccgtcgacagtgtggagggggagggatggatgggcggttgtgagacgcactaaacaacggtctatagtagttctcactaataaaatcgtttatacaccattaagtctactagtgtaaatggatatgatatatgagatgagataatacaaaatgtctacccttgagatcagctattgactcgttacgtggtgacttatgagcctggtctccattgttcttcgtaggtggcgtaccgtatggaaaatgctttggagagaaaaatcgggccctctcttcttactgtcacatatatacagataagtgctaagatagtttcccttctttcttttcctcactttaaatgtttttttcttctgaactatttatttgatttcaattcgatcacaggtaccgttatttttgttataattcaatttttacgacaagatatctcatgattatattcaataaaagaaaaaatatatatatttcaaaccattaaaacttaatgtttcatacgtgataacgacatgtttcatcatctgttttcactgtgtttcacaaaatttatttaactacttacacatactctttctccactccttgcatgcatgcatgcatatatgtatttagtgagctccaaaatgattttttccctaaactacttatccgatctacgatccaatcacaccattatatttgttgtaattaaatttttaaaataagatatcacatgattatgttttaatgaaagaaaaatatatgtttcaatctactaacacatgatgtttcatacacgacaacgatatgtttcaacgtgtgttttcaatctgtttcacacactttttaaatgtttcgatgatttattttgtttgttttaccatgtataacttaatgtttcaccggtggttaactgaaacatttgactgtctaattttttgagataagatcgggcgtccgattggaagtttataattagaagaaaaaattgtttgaagaaggaaactatggatcggtcatccgattcctaaaaaaatggggcagtcaaatgttgcagttgaccaacaagtaaaacattaatttatatggtgaaataaaaaaaatcaacaactgaaacatttaaaaattttgtaaaacatggtaaagatacacgttgaatcatatcagtactatgtatgaaacaacaagtgttaacagattgaaacatatatttttctttcgccaaaatatagtcatgcgatttcatgctttaaagatttaattacaacgaatacaatgaatacaatggtatgattggattgtagattgaataaataatttaggagaaataggtatttaaagagagaaaaaggaggaaaaaaaactaacttgtgatatacttgcatgcatgcagaaccggacacgtccgatttttattcatccaatcgggcccctatcctgagcattacgggcagctgactacgtcaaccctgctgaaaatatgaactgaccgacgacctatgggaggagaaaaactggtccatagcgaagaaccaatggttaatattgattgaaattaatccacgcactggatttttagatactcgaaggcaaaagaacacggaaagagatctaaacactcaagctaagctatataggctctggccgtgtttagttcccctcaaaattttttttatgtatatggacgcacatttaaagtattaaacatagaataataacaaaataaattacgtatttcacctgtaaactgcgagatgaatttattaagtctaattaatccatcattagcaaatatttactgtagcaccacattgttaaattggcgtaattaggctcaaaagtttcgtctcgcaatttatatacaaactgtgcatttggtttttttcgttcacatttaatgcttcatatatgtgtctaaatatttgatgtgacagaattttttgaagttcgaaggtaactaaatacggcctctgttcggaagctagatactgcggctcaacagtgtttctattgttgattcagttattacgatgtagtgctgccgaacacagccactccctctgccgtgaatataagggattttcaccattaaatttatcctaaaatataaaggagtttcacgatctaagacagtactatggacctgtttagagaagtttaagattctgagaagcagctggttggtagccaacttctgagaatctgcaaaagctgggtttctcagcttctggcttctagttccttctaatttattttatgtattctacaactacagcttctcagaatctggactaaaagctggactgtttgagggagcttcttattctgggagaagctgcggcacttgaaactccccaaacatggcctgtattccccatctggcatctaccaacttttatactagtttatttctctaccatctacttttatactaatttattctcccacctacacttttataatactgtattctttcacacatcaccttttatctcatcacatgtctttgtactatttccttattaattcttaaaagaaaaggtataatctcttgtagtcatggatggagattatggtcgtgtctagttcctcctccaaaatttttttaacgtatacggatgcacatttgaagtattaaacatagactaataacaaaacaaattacatattttgtctgtaaattgcgagatgaatttattaagcctaattaatctgtcattagcaaatgtttactgtagcaccacattatcaaatcatggcgtaattagcctcaaaagattcgtctcgtaatttacatacaaactgtacaattgattttttttcatctacatttaatgcttcatacaacacagcctatgtcacagtcttgagccaacctaaaattctagccagtcaactccttagcccgctgcactcttttagactaggagtagtatgagtattgtgcgtccatatccgctccgttttcgtcctataccatccggtcggcgagcgcaacctctcacctctgctcgaggctcggggagtaccaccatggccggtcatcgactacatcttactttttggtacaacctcgccgcagttgccctgctcctcgcgctcctccacgggccgctcgcggaagcgcagccgctgccgtggcagctgtgcaacgccaccgccggcaactacacggaggggagcgcctaccaggcgaacgtgcgtgcgctcgccagcgccctccccgcgaacgcgtcgtcttcccgggccctcttcgccgagggcgcaccggcacggcgccggacaaggtgtacgccatcgcgctctgccgcggcgacaccaacgcctcctcctgcgccgcctgcctcgccgccgccttcgacaccgcgcagcagctctgcgcgttcaacaggcgcgccaccctgttcaacgacccctgcatcctccgatactccgaccaggacatcctcgccaacgtcaccgataaccggggcatgttcgtcgcctggaactacaacaacgtcagcacggggaggatggcagtgttcgacgccacctccggtcagctcgtcaacacctccggcgactatgcgtcggccgtgtacgacgccttttccggcatgctcgtcaacgccaccgccgactatgcggcgaagactcagtaaggcggttcggcacgggggagatggggttcaacgtcttcgactcgccttaccacaatattttctcgctggctcagtgcacgccggacatgtcggaggccgactgccggagctgcctcggggacataatcaggaggatgatgcccaagtacttcgtcgggaagcccggcggcagggtcttcggcgttcggtgcaacttccggtttgaggcgtacgagttcttctcgcggccggccgctgttgcagttgtcggggctgccgccctcaccaccaccaccagggctgtccgcaccatcggggctgccgccctcaccgccggggctgcggccggcagcatcaggtaatattaataatagagaaggtgagttgctgctcgatcgctgtgtcttactgtggcttgcactcaccatcaaacgaacgtcaaaaatcgcacctccactccttgttcttcgcccggcgagccccggaaactacagggacgctaggtttgatgttggcctgtggggcagccattagagccgtgtgatcgcgaattgagaaaattatttgcgtggacctaaccaacctccatccccaagtggccttaattcgttctgtacacacattttttgtgctttgcttaatccccgtacacacctgaattttggttttgactagaaaatgtgctgtgcgtgcacaagttggcacgtctgtcatttagcccgcacaacatcgaagattaacaatatacagtttcaggttgtgtttggatacaaagactaaattgtactccacactaattagaagtattaaacgaagactaatcataaagacaattgcataaatgatagctattttgcaagacaaattttttaagcttaattaatccataattagtacatgtttactatagtactccctctatctacttttgatagtcatatttcatcttggcatacagatcaacgataagtaattctacttatcacccatttaaacatgctactagttattcctcgtaaacaagcgatacattaatatttacatttctcgatgcccatgtagccaatcttgtgtggaagaatggagagtcctgcattaaatccgagaaagttattaagaggataggttgttggattgaaatatgcctatcaaaaataaattttttatatttagaaatatgcctatcaaaaatagatggagggagtatcacataggctaatcatggattaattatgcttaataaatttgtctcgcaaactagtctagaattatggaatggattttgtcattagtaaaagtttaatacttctaattagcgtcaaacatcagatgtgacaggaactaaaatttagtccttgatccaatgagggcctcaattagatgaaagtttagaaaaaaaaatctaataaaactaaaatctagcaaatatctaaaacataatccatgtatgctaaaaataattcatgagaattgggttcccttttcccattgatcctctcttgcatgagcgtggtcgtttgaaaacacatgtttctttatagggttaattcgatctatgccattgcaaatatggctattaaaaaaatgctattacaattcgtctattcgtgagtgtgtcattcaaattttacgaaattaaaatcatgccatcaccgtcacatttttcatcttcctccccatctacacgtggggcccatccgtcagattcatcttcttcctccatccgcccctcttcttgtttttcctttttttttcttacctttgtccttccttattcggaactccttttatatacgagatatgattccgtataagacttggtatatgatgggacctaccgagtttagtcaactactattagctatgtggtatccatatccatgatagcttttaagaaaaatcgtctagtgtcgaaatttttaaaatatattaaatttattcttataattaagtagataatccgcaacaataatctaatccaaattaaataggacctaagatgttttatttggagggtaagtttaccctattcatacatagaaaaatagttttttaagggtcatatatagaaatattgtgtgagtttataatactataaattgtaataaaattcacaatattaaatttaagggatttgctaaattcaatcagctagatcgggaaaaaaacatcatgtaaaaaagtctaacacagtacgataaggtaactctccaagttaatatggacacattttttttaagctgtagattaggactgcattaattttcagaaaaaaaaaatctctgtttcataatgtaaggctttgtgtctaaatttattaacatcatctatatgaatgtggagcaatgctagaaagttttacattatcaaaccaaagtagaaacacgccaagcaaaacagaaacttggttacttcacccgcttaatggggagaaaaagaaaagaaaagaaaaaaaaaaggaaacggcctcaaggcctctcgtctccgtcgttagacagaggatgccgctctgcacttcttctcttcgttctccgccgttcgtcgacctccccggagttcatgaccgtcagatccggtgaccacaagttaaaaaggttgtaagatatggccccttggaactgaagaaatttacatatctttcacccataaaaactggcttcgctagaatgccaatgtcaaaatgtgattcaatcaaacgccactctcaatccgcgggcatttgctgcaatgccattttcgtggtttttttatttcgaaattaatttgcctcaattataatttttgtcggacgtttatgcccctgggtcaactggttaaatcggacctggtttcttctcgatctctctcgtctaatcgagcaggcaagcgtgagtgcaagaggagaagaggcggcgacaccggcgtggcccaccaccactattccaccacgccgcctctccccattcccccaccgtgcctcctctcccaccaactgtgccgcctctccccgccgagatctcctccccgccaaacgtgccgcctaccccggccaaaccctagctgtcaagccaagcaagaggagagaaagacgaagggaggggagaccacacctgcaccgctgccttcccccaacctcaggtgcacttgtgccgcctcccccgccatccgtgcgaccgccttccccaatcgcgctggtgcaacccacctcgttctctgccgccttccctgaccgtgccggctctaccaccacgagctcgatgacacgtgccttgatggcgccctcggagaaatcccaaagtggcgcaccctcctggcccgctgacgtgttcatctcccggtggccgggggcgaggacgacgtacactgccggcctcgcgatggcagcgctagggaagagaaaggcgggtagcacagccggcagcaagaggcaatgtggcacagccagaagaggcggttcggcggtgcggcctagttggggaaggcagcagcgcccggaatagtcacccctcctgctctgctggcgaggtcacgcgtcaccacctgagctctctcctctctggttcaacctattgagccaggggcataaacttttgagaaaaaaaaattgaggaaaaacaatttggaaatatcacaaatatttggaccgaaggggttagcaaatattatattgcatttggcggtattttcttttcccatcttaatatttttaattagcagacgaataagcactccctttaatttgtttactgctccccgaaaagaaaggtactcccttttgttcactgagaaatagctagcactgcaatcatgcatgaactcatacaggtcacccatgatattatcactttttttttccagtaaaattgcaggtagaaataagccagggacccaaattctggtaattattttgccactagtggccatttcctccgttgccgcaatttccatctgtatgtggaatatacgtaagaaacgaagatggcgaagagcagagaatttatccgcacgtatgtcatccgaacaatttggcataaactcttaacaaattccaattagaattcttcatcatcaatatttataacacattaacatttctatgcaaaattgccagctgatacggctgaggacttcgaaagtatcaagtcaaccttgctgtctctgtcatcactacaagtggcaacggataactttgacgaaaacaaaaaacttggtgaggggggatttggtgcagtttataaggtattgtagtctttaatgtctacataagagctacttatattagaaacttttttgaatggttgatactttattttgagaaataataagttcatgattttatggtgtgatgagtaagccttaggcttagaaatacgagtgacatgcatattagtgcgaaattgctaatttacaatatagtatcttaggctttaagaaattcagctaattactcggcaacccatgcattagcgattttagatgcatcttttacttttcgtcactaatatttttgtaaaattttattgaacaatacatgttaataaatataaacttatatttatgtacatactcatacaaaaataaactttctattatgtaattattggctctattttttgtcttaaacaactattaacttattgacttattaaaggactagaaaaagaagcctccacgttcgctctcatgttataaaattaatcggaaaaaaataaataaatagtccatatagaattataatttaaaaatatctaaaattcgaaattaaaaataaggaatataggaagagaagactatagtgcataccggtatacaatagaactaatgaaaattcagaattaaaaaataaaaaaattaaaagtagaggttagagtcgatatagaaatataatttagaaataatgaaaattagaaattaaaaaataaggaatattagaagaagaatatagagtccatatagaaatacaatttaaaaataactgaaattcaggattttttttaaaaaagaaatattgaaagataagtctagagtgcatatagaaatataatttataaataatataaattaggagttaaaatatgaaatattataagaagagtacagagtacatgtaggaatttataattaattatagtatagaaatatgagtttagagtcctaaataatacaattagaaataatgaaaattcaaaattggaaaaaaaggaatatttaaaaaagagcctagagtctatatataaataatttacaaataatggaaattcggaattaaaaataaaaaatattggaagaggagtctagagtacatataggagtataatttagaaataaatgaaattttgaatttaaaaataagaaatataatagaaatttagaattagaaaataaagaatattggaaggtgagtatagagtcaatataggaataccatttagaaataactaatgttcgatattaaaaataattaataactatcacgtatatacaatataatatgaatattacacattagatattttttaaaaagtaaatcatttcaattttttattagttacaaaaatagtaattaaaaagataaattaatcattttccacatagttgaagtatttcctctattttcccacaaagttgagtggcttttgctaaaatgccacatggctcaaaaacgtttagcatagactatcaactttgaggcaaaagagaggaggcactttaactatgtggcagatatgcaattttcccattaaaactaaatatgtgcctgaattctatatcttgatttccacattatatacgaacctttttttttgttgattcaacacaattcaagatttccttgttatattaagtatgagccctaatgttacttttttatgaataaatgaatttgaattcaaaattaatgaatacatagttgtccttgagttggagtcttttttatatattgtttgttgttgacttagatcccattcatttagaagtttcccgaaatcggtaagaggttcttctctccatcgggcaacaggtgttcaatagatcaaaaatcataaatgtgccactaatgattacaatgacctgagcagtaccccaaggtcctaagttcaaatcttcataagagcgaatttcagattgggttgtttgcggagctaagttccctatttcaatggccgtatatattcgattggatgtagaggcaggtaaaaaaaatacccttctctaaaataaataaatgtaccactaataattaacacgttgtgccacatatggattattcttttaatctaaaccaacatgagttgttcccactaattggatggctagatctttttttttcattattgagttgtacgaatttggaaagttcccactaattgtacgaatttaatttttagttgtaccatgtcacgcccagaaattcccgaatagaattccaagcagaatgtgcattaaaatccccgtccaggaccagccggggtacacaaacgacaatgttgacattcagatccacgtcttacaaacatcataaaagtcttacataaatgcagcggaagaaaaaaaaagacaacaagagctaagccttgactaaactgcagcaggaacaccactccacaggcatcctcgacggcacggacaaagcctactcctcggagaaaccttcatctgacccgaactcgaactctgggggttgggaaaagtagagcaagactgagtactacccactgtactcagcaagtcataccggaataggggtatgatgcacggaaaatatcaaagaagagctaaagtggttcatttgcataaagcgagcatttataaacagaaattgaaagatttaaacagttgtaattattaattaaacatccactgtccaacgctaacccacgttgcgacaggcccaaccatccacctaaattatccaaattcaaaaggttacactaaggtgagactaatcacggtgaatctggttgaccgcccgtaaccgcgggcacggctattcgaatagttttgctctgatcagaggtgtacaattgtacccacaagacacagccccacgacacgttttcgtgcgccgacatgccaccacgacatatcggaaagaggccgtgacaggacccttcgcataacccctctctagccaagcacaccacacctcaggtttcacccccgtccccagcgggccacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtagtttattttaattaacccacgccaaagcggtggcactaatccaacagaaccattggaaccaacagtctaaacattattatgcttttccccattgtgaactagttgaactaagcatgtctaagcaattcctagtccaaactctaatcatgttataccccaagctaacaagggagcatggtattcaaaaaaaaaaaacatggccgtaacgataggtaaccatcccatatttaatattataaaacaatgcaatatttgaaagaaaacaatagaacatttgcaatataggatcaacatgttcaagtgacaagcatgacttgccttgctctgctgctggaggaacctcggcgactatctcgaagtacaccggagcgtcggaggaattggaatctagcgacatacaaagtaaacattgcaaacaagctataagactactgaaacagggaacaaaaccaattttaatggattctacacatttttcttgatttactgagacttgaatgggcttaaacggagctcggatgaattagttatgaattttagaagattcactgtgtttattactatacaagaaaaaccttaaatcaattattgcgcaatatattccagggctgacgtcagcacaggggaagcggcgccgacatgcggggcccaccggtcagcggctcgggagagggaggaagggcgccggcacgcgggcccactggtcagcggctcgggagagggggggaaaggcgccggcacgcgggcccaccggtcagcggctcgagaggaaaggggcggcggcacccggctcggcttggctcaaggccggccgaccggccgcggcgacggcgacggcgcgcgcgcgaacgcgttgccggcgacggcaaccggcggcgaaggcgacggcgcaaacggcgacgcgaaggcggctgcgctaagcggcggctaggaaggggagggaacgggcgacgataaaggcggccgccggctcggctcggcatcaaagccgacctgccggccaggcctagcggcgacggcacgcggccgacga

SEQ ID NO: 54588 - DNA, 13292 bp, Oryza sativa
cgtgggggagagggggaggagagagaggcgggattcgaaaatcgaatcccggccatctcgggcgcgggcgcgagcgggagagagaggggagtgggcgcgggaaacgcggcgcacgcgcgggcgtggtcgacgtggcccgaaggaggcggagacgtgggcgcggcggcggttgcgggcgcggcggcgcgagcgagagcggcgggaggtgggggaaggacccgacaggtgggccccacctgtcggcgacctcggagaggagggcggcgggacggcctggctgggcctcggcctgcggccggcccagcaaggaggagggggaaggaaaggagagaatgggccgacggcccattcgaaaaaaggaggaaaaagagaggaaaaagaaaaagaaaaaggaaaaaggattttccctggaattaaaatattgcttgctcaattttaattggttaaaattatttctagagctctgaaaattccactaaaaatcatgttaatgaatttcgacacgtagaactcaagaaaaattccacatgtcaaatccgattattatttgcattatttccttagggtttactcctgatttgcaccggtattttcttagggtcatttataaaaattacaattttggcttgggaggaaaacttcggggtgtgacataccacttatgtttttctctctgtaggagcaatagggttattatgctggttactaaacttgttaaggagatggagtaagtcatcatgagttattaacaagttttacttcatatgaattacgctttcattcttggattgatccgtttactatttctgcgattaacgtggaaattttgagtgccaaaatagggtataggacttatacatttatgggctcaagaaaaaagatagtatctttgtgttcttactatcatgcaaaaagtaagatattaattaattactaaatcaatgcatttagggacttctttctggacaagaagtagccgtgaagaggttggcgaagggttcaagccaggggctagaagagctaaaaaacgagctagttctagtggccaaacttcatcacagaaaccttgttcgccttgtggggttttgcctggaagagggagagaggatgcttgtttatgaatacatgcccaataaaagcctcgacttctttctttttggtaccattaacaacctaactctgaatctagatatacacccttctcatgtgcatcggtatgacattataacaatgagtttttcatctggtgtcaattaattagatccagagaaaaggagagggctagactgggtgacacgattcaaaatcatagaaggcgtagctcgcggactacagtatcttcaccaggactcccgaaagaaaattgtccaccgtgacatgaaggcaagcaacatcttgctagacacagacatgaaccctaagatcggtgattttggcctcgctaggctctttggacaggatcagactcgagatgtcaccaaccgtatcgtcgggacattgtaattaagtccaatactttacatatttgttcttatatgtagctaacaaactaatcatgtgattctatttgttgttgcaagcagtggctacatgtctcccgaatacgtcatgcgtggacaatactcgacaaaatctgatgtgttcagctttggtgttctcatcatagagattgtgacaggccagaggaacaacagaccctatttgtttgaacaaaacgaagatataataagcacagtgagtatccctgctagctcatacagcactatgtggtactatttgcgtttgcaggtagccacaaatacatgttggtgccgctgaaaactgaagagatatgcctgtaaccaatggtaggtgtggaggcgctggtcagatggaacagttgcaaagatgatcgaccattcgttgggaaaaaattaccctgaagccgaggtgctgaaatgcatcaatatcggcctcctgtgcctccaggagaaccccgtaaatcgacctacaatggcggacatcatggttttgcttaacagcaatgctagcagctctataccggctcctgcagctaggccaacattttccttcgatgggagctctcgctactctcaaaccatcacacaattatctgccaggtagtaggggctaaagaagagcagcaacaacagttattgcctgttttattttgtattggaatcgtacacattatcaatatgtaatctaaacagcaaattcagttataaatagggtaacaaaagggaaaaaatagtcatcctagacattccagtgaaattcatgggtcaaaaccgcccattcaaaagccagcctatcatgcattgtacagctgttgccggatagtcaacagtacacgcatggattactcctatgagacctggtctaatgggtctatccccacattcatgagacctgatcgcataagattgttctcccttgtaatgcgctaccagttagggctattcaaaaaagctcgaggctcgcaatctgctcaagctcggatcgagctccaaacgagccgagcccgagcttctcccaaagctcgcgagcttcttcgagccgagctcgagctttcaacgagtctagtaatatatgatttttgttgttatttaataaattaagatatcaaatatattatttgtatgtcttgtattggtcttgtatatttatttattcttttttcttcttctattaatatgatgaactagaaattaattatttttaaaaggttatccttgaaatataccttgttctacttaaaaatcaagcttagtagtcgagatcgagctagatcgcactcgaactgagcttgtttgaaagctcgaacattttataggctcggctcgagcttgtatcgagctcgagcctaggcaggcgagttcacttgagctcggctcgttgacaaccctactaccagtggagctattcacaccaacaacatatcgatagtatcgactcacttggaattgcagcacacagaacttcactgaaagtagtgaacttggaggaggatttgttgttgtttactagtacaaggtaaaccccaattgaggtgtcaaaaacgttcctacaaagctatgttaactcgcttgaacaagtgaagaataatccccaagcagatttggttacagggaagcaggctctgtatcatgaggagcgaaagatccaaaaacccaagcaaaaccctttgaataataattgtcgatgggtgaagctaaaacagggctggatgaaactgaatgtagatggttctattgatataaattctgaaaaatggggcatcggtgtcgttctaaggaacagtatggggatggtaattttctctgcttgtggttttgttaatcagtgtagcagcccgttggaagcagagcttcttgcctgcagggaaggtattagcttggctcttcagtggactctccttccattcatagtggagacagactgcttggtggtgaagaacctcatagagtcagctgtgcaagggcgctctgagcttacattcatcgtcaggggcattggtgaattgttatcaggaaacagggaagtgatcatcgtgaagattcagcggaatcagaataatgttagccatactctagctaatagagcccggtgtgaatctctgactgagttctgcccggatgataaatgtaatttcatcgcacattttgtttgtgaggactctttagctgagtaatataatccccatttcccccgcaaaaaaaactgatatacaatctttttaggagtgtataattctatcatgtaaggatccccctgcctgatggtcaatatacagtagtaaagaggcctctcactgagttcaggaacaagggagactgaaaaatgagctggttctggtggccaagcttcagcacaagaaccttgttcggcttgtcgatgtttgcctcgaggagcatgataagatggtcatctatgaatacatgcccaacagaagcctagataccattctctttggttcattttccattgcaaaaatttcagcagtacaactgtacaagtgtacaacacaagttccacatgcaagtcatgcctctcatagatgtttcacaacttgaatgacagatcatgccagtagtttgctagactggggaagaaggctgaagatcatacacgggatcgctcggcatttgcagtatctccatgaagaatcacggctgaagatcatttaccgggacctcaagacaagcaagtgaagcaacgctatgctagactccaatttaaccccaatatttcggacttcggttggcgaggctctttggacgcgaccagtcggaacatagtaagaacattcagtagtatatcatatgggagatggatttcatctcattttcttgcatatcacctaaaaaataaaaaaaaattgataatatagatttacatgaaatatattgttccaaaaatatgcaaaggccaaatttgacttctataggttgcaaaaaaaataaattaaattaaaaatagttaatgtatattcgtagttatatttgttattttcgttacaacttgtagaggtttgatttgaatttttcatgtttaagaagtgatatatttcgtattaatctgccttctcttttttttttcaatttttaaattttttataactatttgggcctatttgttttgaagaaattctaacccataggaataagaaaagtggagggacagtaatgcatgcatacttcaatccataggaattttcaaaaaggtttgagtggatgaaaagtttcctaggttttctctctacaacttataggaaaggaaaatttcctttggttttcctatatctacattcatataaaccaaatgaaactcataggaattaatcctcggttatctaaatctttcggttttcctccaaaacgaatggacccttaggtggcatgcaaggaataagggaatatcttttcaagggatgaaaacaatttccccatcatatgccctatatgtcggagtggattttagaagatatggtaccagtgtctatattttcacagtaagatacatggcactagagaacactgtacgcagaatcggtaggcaacagtagcacaccgcccacgtgcggcgcgagtgcgggtctactcaccactcccaagtcccatctgtagaatcatatgatggtttaattgtggtgatgaacaattgtcaaaggcaagtgtttataaaaataggtgatatgttttcggatggtaaacggtgcggtggttggcactgggttgccggtctaaccaggcgggtgccgccggtcaaaccggaggtgtccggggctctgggcagtctgaccgggttgcctgacggtcagaccggcagactccagtagggagtcgatttcgggttgtttttttggaatttctagattgattcatggatatgatttctagatgatttttattcgtatgtgatgctattgtgtgctgatgtgagtcaagttggtgtgaacttgtatatggaatttatttgttgttcatgtgtaggtgttgcttgaggtcatgggagtatagccggtgatggatcgggactaggcttaggggaagttgaggtctagacagttaaggatattacacaggatgctcaggttagaaaacaatgcacatggaggtgaaggtttccatatggcatacacatagtgttgtgtgcgtatggaaagaggagtcaaatttggattggattctaagtttgagaagattggagtttgtaaagtttgtttttttgtacgggaaggtttcctaggggattaggacttcttgtatgagttggatttgtggctagggaccgccacgttatgggtataaatagatgaggggttgaggctagaagtagattgcctatatcgactttttgaaagaaaaaagttagggtttactttgaggtttcaatcctagttcatgagttgagagattgggcgtggctaatgggcaggtggtcgtccacagcgatcacaccccatccccaatacgcttctctcccctttcctcctcttcttctcttcctactacaccataaatttaaaaaaaataaaaaaaacaaagttggaaaatttatgtatagaaatactatatataaaaaatatttgaattcaaattcaaatttgaaacggatatgtaaacttttgacttataaattttagatctataaactaatatttgaattcacattcaaatttgaaacgggtatataaacttttgacttataaactttgggtccatagactttaagtgtataaactttatatgtatagaaatattatataaaaaaatatttgaattcaaattcaaatttgaatcggatatataaacttttgacttataaactttggatctctaaactttagatatgtaaacttgaggtatacaaactttaggtgtataaatttactaaaatagaaaagtaatgcggtgtcaaaaaaggaaaccacgtggaggaggggaggtgatcgctaggggcgattgactcccgttagccttgtcgtgagagatgagtgctttagatgcactttataaacatatattgatgcaaagttgatctactttcaagagtttcatcaatgcgtgtttttggggatctcggcagtttgaccggaggcaaatcgatggtctaaccagcgggcggtcaaccagttgctggaaggcggtccaaccagcgacaaggcgtcggtcagaccggcggtgtgcaggcggtcagaccagcaacaacactgcagtcagaccggagttgatctgacggttagaccgactacgtcgagatctccattgatatgagggtaacttttatttccgttaaaaatttttgggtttttggttttccctagcattcactctctctagtaggtttgtttgatattgttcgatactacaccgtcgatggcgctgattgcctacttgctccattgttgcagccccgccgtcatcagtcatggatctggatcagctgcagtcaacttaaagcaatagcagtgcacactatctattaacttattaaaggaatagaaaaaggagcctctatgttcgctctcatagcctagaaattctcatattaatcggagaaaaggaaaaatagagtccatatagaaatacaatttagaaatagttgaaattcggaatttaaaaaaacaaggaatattggaagaggagactagagtccatatagaaatacaattaagaaataataaaaattcggaattaaaaataaggtatattagaagtagagtatagagtccatataaaaatacaattaagaaataatagaaatacggaattaaaaaataagaaatattagaagtagagtatagagtccgtataggaatttaaaactaactaaaattcggaataaacataataaaattaaaaaatatagtttagagttcttataaaaatataatttacaaataactaaaattcaaaattttataaaaaacatgggaagaagagtctaaaattaatataggaatacaatttagaagtagctgaaattcgattaaaaattaaagaatactgaaagatgagtttagagtccacgtagaaatataattagaaataataaaaattcagaattaaaaataagtaatattggaagaagagcctagagcctatatagaaatacaatttatagataatgaaaattcagaattaaaaattttaaaaatatattgaaagcgagtctagagttcatataggaatataatttacaaataactaaaatttgatattaaaaataattaataactaacacgtatataaaatataatataaatattacacattagtagtttcgtaaagttagtacaaaatttaaaattatgttgtcattttaacatatttgaataatacattgagaaaacatatatgttattatatgagagagaatataatgatgctagccgtataatctgcataggtcaccatactagttggatgtaagttggaaggtttataccgcacattgtaatgttcataacaccgtagcaaaattactgtagcacagagtacagttgcgtcattactgtagcctcgaatctggcccgttgatcggaaaaacgaacggccaaaattatatgcagtcgttaactttaccgttcaaactataactggacctgatctgaattcgtcggtcatcgcgcgccagcgccaccttccctgtcagccgtctatcgacgtccctccgccacctcggccgaccacgagagtcgaggaattgagatcacctgcagttgctatagcccctgcaacttaaacagtcacataggcaccgttggattggaaagtagcggtcaagatttccctaggcactatttgttaaacactgtagctagatatctcctgtcgcaaacattgtagcatctactgtttagagccgatgtgtcacagattttatccgttgatcgtttcaatccaacggtgaaaaataatttcaactgcttaagttgcagtctctagtatagttgcactggatccttattcagagtcgagcgcttcctcccctggatattcccccacctctttgcccggtgaacatgcttatggatcgccagctacagatcttggtgtgtttttattgcatcttgcatcttggatgatttgggagaggaagctaaagagagtttctagcatgtaattgctccgacctaaaatataacaatttttaaccctcaagatttgtctcaaaatataataatttatccaccaacattctcttctcaaccaatcacaattcttcaccattcacttttcccacatatcttcactactcaaccaatcacaaccatccaccatttacttttacctatttttttaataactatggccaactataaaaatgcatatattctacggagggagtacgttcttgcattgagagctctgattctgtttgctgctcactgccttcttgtttgagcaattttggtatacttctatgttttttatttaaaaaccggtgcagaatatgccaatttcattggatataggaagagtaaaagttacatgtacagaaaataaataactgtaaaaagagagaaatgcctaaggaattaaaagcgctagctgttttgctctcgctaagacctaagcattagcttcctccttgatctgtgcttccagagatgtgacggataacctacgttaccccgatacgccgatacggatatggatacgcgatacgatgatactgagatacaccgtctttctaaaaacgtagatacggggatacacttatatatttatatatataattaaaaaacatagaaaaaaattgagtgtggaatatggacggaaaaaatagggaacacagcagcatcaaaccacaaatgcaccaatcatctatgtatggtatatatctcagtacgatagattcacagcatctcaccatgcaaaaccacacagtagatgatggcaaacatcttctctgcaatatattatttctccgcatcaaaaccagtattaccactagattgctagcactaccactagcattcaagctttcacttctaaaatccattgaatctaccaaagataacagcaatactaataaaaagtgaactggaacactatgcacggtgcagatcaaacttgaagggattttcttttacctctagtcctcaacatcgggatcgaaggaagacaacagtgctggggccggtcggagcgagcggcgtaggactggttcagaggcggcggcgcgtcgcctcatggaggagtcgcggaggagagtacagaggaggggggccgtcgacgcggtgccagccgtaggcggcagcatggcgtcggccggcggcggcggcgaggcagcgcatgcagcgatggcatatgcggcggcgccacgatggggattagggaagcgaagagagagggacagcgtgagttgcgagagcgaggggcggcgtgggggagggggagagatatgcggttatgttcctgcttgatttagggctccaccgtatcgggtctgtatcccgccgtatcagaagagtatcggtatttattttaattatctgaaaaagagaaaaatgagggatacgtacgggatagtatccggccgtatcccgcacgtatccgtatccagaggcgtatcggatactgatacaagggttagcaaccgtatcggggtaacgttgcggataactccttatgttggaagacttttttgtttatttccttccagacatccaatattgtgataagtccttcggtggttgccagttctgtccaccagtcatggattgtcgtggttgcactccactctatcggtttgagctgcttgtaggttgtccagtttgtttaagttttccaaattttctttgtgaatctgcagtttgctacgatatttctagcgtgtggtggcaaagcaggcaataggtatatacttatatatgactatgggtgtgttcgtctgcaagggctgcagcctatacaaacagtgaagcaagaaaaaaaaaaaaagcagcggccggctgcagcagctactgcacctgcctgccgaacaggccctatgttgattagtctcagcgcacaggccctatgttgattagtctcagcttctttggtgtatatttctttattttgttgaattgctgtaatacttggctgtaacctttcgaacaaaaaccgggattttattcccttattaaaaaaaaggaaaaagtattaattaccctcttaaactattgcaccagtacgaattgcccccccccccccccccccggaaccacagaaccagacacattaaacctcaaactattgaaaccggacgaattaccccttaagtcaatacgaagcggttttagtcctacgtggtatacacgtggcgctgacgtggaaatccaatcagcaaaaaataaaagaaaataacatatggcccacatgtcatattaaccccttctctgtccttctctgtgatgctggcgttgggcgtggccgcgtggctgggcgagcgccggcggcgagcggttcgacccgcggctgcagcgcgtgccgctgcggcacggcgtgttcgcggtggtggaggcgaagctcggggaccccggcttcggggacggctgcgccgcagcggtgctcgtgctggtccgcttcaacaaggacgtgttcgtcgggccggtgctgatggggcgcgccgtcggcgcgctggtcgggtccgcgtccgcgtccgcctcagcctcgccggcgctgctgcgccgctgaacgggctttggccgccatccgcagcccgctcgtggacgagctccacgcgcgcggcgagctcccccggctcgtctccctgctctgctccgccgacccccgcatccgcacgctcgcgctggagttcgccctccgcgtcggctactacggccgcaaggagatcgttgacgcgctcctcgccgagggcctcgtcaagcgcctcctcgccctggagggcgtggtcgccgccgtcgctaccgcagctcctcccgtattattttccagaggaagattagttggtgtttgctgtttccatttgattgattggcttgcattgttccaagtggttcgattcctgcacctgcctggtccattcctgccagtcttaattgcatttaaataaatcggggatcattgttggtctgtctgaactgttcgttcatttcacgttgcgggctagctaagagcaagttcaatagtatagcccactattaactccaatttatctataactgatctaatagccaattaataaaatagttgcttactatactattaacatatggtcccacctgtcatacgcatattgcgtcttggagtccgtgctgcagctggctacagatctgtagcccgctgcttttctctcttattttttatctcattaaaatatatttatagctgactattatatctgctctaagactaacccgcgacacccgttgacagaaaattcccgcagttcagtgcgggactggttgcccgttggcccgcgtgggacttctgcagtcgatgcgatgcggggcgccacaacccgtcccactttcaccccagcgtcctgatcctgtagatcgtaacgacgaagaagagaaacagcggctcctacaacttggagcaatgcaatccgccgatctgctaagcatcgtgagcgccccagcgatccactcgcctcaatatagattaacacatgccactttatctgtgaccactcaagaagctacgaacacttgacgcagatttgggagcactgaaccttgtgggacatcgccgcggtggtggaccggccgatgagcgagcaagcgtaggcggggtggcagatcgatcgcgcggtgcgtccatgtcgggctgccctacgtacaggagaacccggagcagaggccggccgtgaacgtgatgctcaccagtggcacggtgtcgctgcaggcaaattttttattattttaactttaaaaagttataaatataaatccaaccaaaacttcatatgaaccttttggccatgtcagctctctcgtggcaaaacaatactcatgcaccacatacaacagctatgatagttttatcctaccacgtcacttagataaaactgccacgccaactagaccagtgtgactaaataacgatgtcacgttagctagaataatgtgatagtgttgttttgccacgctagttcagctagtatggctaaaaggttcagatgttgaaaataaaaataaattttaaaagatttctttaaaattaaagataaaatagaaaggttcgggaaaataaaaaaaaatcgctgcaggcccctctaggccggtgttcttctaaaagagcggtgacagcagtgcggcggcaggcgactgtatcgtctaacgaagtgtccattagagtaggtacaataataaactacaagtcgactacaaacttatgtggagaagataagagatgagagagagaagagaagcatgttagagcaagtttaatagtatagccaacaactggctccaaatcacctgcagacaattcatataatagtaacatataaatgtatactacactattaatatatggtctcacctgtcatatatacatttcgtcttgaagctcgtgctatagttggttacaaatctgtagtccgctgctcatctctgtcttctttcatctcctcgatatgtgtttatagttgacatatagcctgctattgtacctgctcttataaatttgtagccagctgcaacacgaactccatacattatgtgtgtatgatatgcgggaccaattattaatgatgtagtatatatttgtagttaactattgtattttttaagtatgaattagctattagattggggctgcaggaat

SEQ ID NO: 54589 - DNA, 7440 bp, Oryza sativa
atcgttagattcgtctcgcaaaatagcctagaggttatggaatgagttttgtcagtaatctacgtttaatactcctaaatagcaagatttcggagagatatttaatagcccgaaggatccaaacaaaccctataaatgatttgaaattaggagttagctattctattaaacttgctcttacagagcctgaatggagatgggaaagaaacggtcaaaccaagaaatcggtagacatttttctttttacaagacactttggtacaattacacatataaaaagagccactgcattaagccatgtcattgtcattttatcatccattggatttcattttaacgttttagcagtttatttcagaattcagattcagttacttatttacttcctatctacacgtacttagcacgtttgttgagaaataagcacaacatttagcgtgttctcatattccaacagaaatactattctatttgttatatttctgaaaaacaactttataacatgttttatgctaacaaacttaaccctgagaaaagcccgacagaaagttttactttagagtattacctagaaattccatagtaacgtacagaaaatcacctagtatatataaagtggagaaacaaaatcattttttaatcaaattcatgaccaatactatatctagttttttttagaggaagtactatcttgttaatatggctgcacgcattaaaaaaaaaactctaagacatactttgagatctttgccacggtggtttgcagtattaaaggaagcattggttgccgtctcggtagaaaagtggtacgtacgtacatgcagcaacatatcataggtgtttggtgatgctttgatggaaagcagtcaaagcacttagaggttgacgtcaccttctttttctacagagtttccaagccaaatatttttctaaaaaaatttattgcagcaaatataccgatgccattttcgtataatcaatctgctcgtttttctgtatgctattggatggatcatagcattccaatccaatgctaggatctaatccaaatggaggcatgaacagctatgctaatgagcagctaaattacaagataagcaacagggaatgttctaaaaaaaacagaaggaaaactgaatcggtggacacagaactggtccatggatgcaatgcaatagcagctaaaaaggagactttggatgctggcttggcttatctcctctctctctctctctctctattcccaccatgcctggaatggaaactgcgtcgtgtctgcgcttctgtttgggtggggccccactttccaacgctttgcttgctttccatagtgttaacattaactaggatcctgacacttgcatctttctccgagcttttgatgcccaatcttttttttttttgctgtcaacatgatcatctctttactgtgcaatttgatttcgcgaacagtttctgcgtgtgtgttgctgaacatgtggtacttgtcccagttaatcagtacggctcaacttgattttggtgtgactacaggattgttgattttggttaattactagtcgagatggtaaaaggatgcaggatctccgcccggccaacgcacatgcgtagttgcttgcacgaatcatttttgcgtcatattgaaaaggcaatgtcaaaaatggtcctgtctgttttttttttgagctactgaaaaacttccaaatttttagcattggttcttgattggtactagaagatatcatatgcatgcatgtgttcagtccaatgatgctaatagccgtgttcggaagaaattttttggcagcggcagcagcagtttaaaacggctataagctgcagtgattttcaaccgctgtagtcacagcggctgcaacaaaactggctgccgaccaaggccaatactcccaaaagtccaaaccaaagagtaccaagctagaaatcgacatctcattttgaattttagaaattttggttctaaggtcaattttaggggaggtttccttctactccatccgtccaaaaaaaaaaagacaaaccctggtttccgtgtccaatgtttgactatccgtcttatatgaatttttttataattagtattttcattattgttagatgataaaatatgattaatactttatgcgtgacttatctttttattttttttataattttttcaaataagacggatggtcaaacttcgacatggaaacccatgatttacttttttttttttggacggagggagtacaccgtttctattgcaatgttttcatcttcatgattgataccatgatgagtaaaaagaaatctatctaaaattgcatttaaatttatgttccaaaaaatttgggtctttttagactggtccatggaccccatacgggagtagagagggttacccattctccctcttttgggggcggaaaccgtgacgtgtctgtctcactgcacggtgggccccacctttcccctcctgggttcgcttgctgtagttaccatccatcctgacacgcaggcacagtagtacagtacagtaaaaaaaaatatggcaccacctttttacacccaccacctcccctctcaattcactcctcgtctcctcctcctcctccttcacatcgaagcatattctcgtgaagccctcgaggaggaacaagaacaaccaagaaacactcctccttctcctcctcatcctagttcagtgcagcgcgatcgtctcctcctcttcttcttcttctccatggaacagtagcggtggtggccgggtgggttttgtttttgtttttgttttgttttttggcagccgcgccgatcgaatcttcctcccaaggtacgtggccgtaccactgttcccaaaccgcattgttctttcatttctttctccccctctttcttttgtttctttgtgtgcgcgtgtgtatgtttgtttttttgaggcttgattatgtgctttaatctaagcaagaaaaggaactggatggtaatgagctagtgcttcttgtggattttgggtgaacgcgtatttgattggttcatccgttcatgtttgggtgaacgcgtatgtgtgtaagcagggcaacgattcgtgaacagattaggtttttttttcttttttgtgatttggtgatgttttttttttcctctcaagcaaactgtggtccgttcttgaatcgacttcaagttggtcccgtcgctgcttcattaatcttgcatgtgtagtggtctttgccctgtcactagattgatgtactttgtttgattccatcattgattttgccctgtagccccacaagaagtgtgggctttgtacggattccatttactgagacattgatcgaactggagttcatgttgatactccttttgagttcactaactcgtgattcatttcttgtttttttctttgttctgcatatgagtcgtcaaggaatagggctcagttgcttttgttctacattgcgcttcagtaatgtgatttgattgcgcgagttctgaaaaaatcatgatttattccattaacacccaaaagaactcatctcttgaaaataatgttggtgattcctaaagagttttacttcttgttgctttccgtaaaacaagaatcaacgatacagttcagtctatttatgtgtattttcttttggttctccatcttctagagtcaaaatgatggtgaagaaaaaaacctcttggagccagattgtgaaaaatggcaggccagcaaacacgtctgttaccacaagaaacctccgaccacaagatcttggggctgtgatatttggctgcacaaacaataccatcgcagagtgtcactcacggcaacttttcggtacgttcttgtctttcttaattcaaactctttgcataagatatctatttgcaaaacttagccatataaaattgacacattcatttcttcctgtgagtaagataaatatctccacctttcaaaggattgcaacttgctaggtaatccaccaacttagtagctatatttgtgccatgtttcaggcttgccaagaacacatctctcctatgtacaaaatatcaaggaaggcctacctctgttcctgttcaattacgatgaccgcaaactatatggtatttatgaagctgcgagcaatggcaagttctgtcctgaatcaaatgcatggttacaagatggcaagggaaagaccagctatcctgctcaggtacaatccctgatctttgtatctttggaagctgccttcttgctaaatctcaatgaaacgactccaacatgaatgtccttttttgccggtttaggttgccatgcggatcaaagtgtggtgtgttccactagcagaaagtcagtttagaggtgctattctagccaactactaccagaggatgcctggcgctcctggccagaagcttcattttttccagtttgaattggatcatgcacaaacacgtgctttgatggatatgtttaccccttcaccttctaccaacaatggctggtcgcctcctgttgcacaacctgctgatgagcatgtgagatcgtcatgggcaccagtgtatgcggggaataatggtctcaaatctgagaagattgtaaagtcatatgcggatgtggtaaacaataacaaatttgagcaagttagaacaggagatgtggtccatgtggatgcagagcatgctagctcaggtaatgaacatgtcaatggttttgatgatctggattgtggagacacaaccccagagagtgaggagtatgcactatcgggtaaggaggttgaagtgcaacaacaacagcagcagcagcaacaagaacagtctggtcagcaggataagcttagctttaaaggggtactagaaaagctcaagatgttgtctgtccagcagaggaagtctactttttatgccaatgctactgaaactgaaagtattgatgcgtatagctgtaaggatgtacaagatgatttgccagaaaacttagattctgaagtagatcagttctcctgggggcattctaagttgctgatgcactcattggactcagagtcctgtacagaagtcaaggttataactttgcacatagtggcatctctcattatcatccttgtttttttgtgtgtattcattcaatcttgttaacatgttcagcttttgcctatctattccaaatttctcacattagttttgtttgtgcagttggtagatatagtcaaagagttatatgagcggatagcgatcatggagaagaagcaggtctcttttgaaatgccattaacccatcatactaagattgcaatcttaaagttatgaattgtgtaccatatgcataaaataagtgagaagtctaaggaaattgtagagttgtgttaatataatatacctttagcacaaaaaagggaaaaaaaggtaggaatgaatagaataaaacatgaactgtcaagttgagtaaatcattgtatattactttacatatgctaaacttggttgcatgtgtttaagatttgctttcatcgacaatagctaatttttgcagcctagaatgactaaatttgttatgtgtactaaaagggaaaatctaaaatatgtttgcagtgctttttacctaccagcttgctagaaatcaaagtagtctatgattttgctattatgcttataaaatcggtctcacatctagttaatttatacctaataattatattttaaattaactttgctgtagtcagttgatgaatataatatattctcaactaaaacttggaagtcctagagaattaatcttccttggtggttgaatttatgttatgttaaaaatgcaggcttggtccaataaagaactcaaatacttacaaggtgtgaacgagaggttactaaaaagagttgtggagctcaagggcacggtgaagacattgaattcaaagatagatcctttaacccttgatgattcccttagccagtttgttgaacaatgtttgggttcagaagatgtcatttatctagttggtggttttgatggcttctcacatttgccatcactagactctttttccccttcattggacgtactaacacctctcaaatcaatggctgttggaaagtcatatgcctcaactgttgcattagatggcaagatatttgttcttggtggtggtgatggagtctgctggtttgatacaggttacttactgaattctttgttctgtttcctcacaagctctccgatttatgttctttcctaatcctgcatttgactttttcatgaagtcgactgttatgaccgaagacgtgatgattggaccacatgcccatcatttactcatgataaagggagccttgctgcagttagcttcaatggaaaaatctatgcatatggtggtggagatggaaatgagtgtttctctgacgttgaagtatttgatcctgcttatggaaagtggattaaaaatcagtctatgctggataaggtattagtcactctctactccactcattttgtttaaacctaaaagatttgtgctcatggagtagtgaagctcttaatagaattaatggaaatttatttaggaaacaaaaaattataggaaaaaatcaatcatttacttcaggaaaagtcatacttgtgtaatgagacaacaatttctccatgaaaattcgtacttctgtaatgaggcaacaagttattcatttttgtgtactaattaagaattgtacttcagttttctataatattgtcttcggaaaatatttgcttctgagccttaaatctccatactgtgtgatgaattcttttgtttgattgacatctcctgcttggtttatcagcgctttgctctagcaggcgtggaacttaacggtgcaatttatgcagttggaggcttcaacggtgttcaatatcttaggtgatgtccttttgtgcttgtacttagtacttgatttgttccgttttgaattggtgcagatacaataaacgaacgagtagtacttgttttctaaaagacacttacaaatgtcttagagctgatgcagtggcctatggcttagtgtaaaactgtaaatgtggactatcattagcctattcttatgcaagggaaattattgtttcattaaaatgagaagcatctcagaatttctttttatgctaacaaatgctgtgttaccagctctgctgagagacttgatcctcgggagcctagctggaaaagactcccaaagttgagtacaggaaaaggttgtcatacactggcagtgcttgatgacaagatgtaagtttttagttctttctttatacttcaaaataaccaactaaaggttgcagaatgttctcttaaaaaaggttgtcttttctttttaagataatggaaccatttataaaactcctgacctctacaacaaaagattgtagaatgtgtaccttgaagattgaatccctctggtgtatattaccttctgttcttttga

SEQ ID NO: 54590 - DNA, 4723 bp, Oryza sativa
aattcctgcagcccaaaaaaaaaaatcaaatgtcaaatcttgtacttagttgccagttcttttattttgaggcacaactgtattggcacctgtctctactgcatatatcatttgttaccatgccactcttgctattatctgctgcatttcagatgatcatcaatttttttacggtcattaagcaccagcttttcctgtacaactctcatgtattgtgactgataattaagccttggtgttggccgatttgtcaggtggaacgctacaaggaagggtgtggttgggtgactaccgagtcgaggtcaattggcaggaggtgctactgctcggccattgttctctgactctcaatatcgacgctgtgaatttagttagctttctgacaagggaacaacaaacagatagttaaagaacttagaaggctcttcttttggctgaatttagagctgtagacatacataagctcttaccctaatcttttgcatgaactagaaaaccgttcaatgttgagctattttgttgatactgcaaaaatctgatgcaaaaatcagtttggtactaaacaagatgagaattccatgaatgaatatttgatagaactgtgattattaactgacatcgttgagcttcagttcagttttttcctacctgtttgaggattttactgaagcagatgtgggtctggctgggttcaccattccagcaatcacaaaccacatttaagaacctagtttactctttgctgtttcttacagagacctcaaagttgtgatgacttttgggggtgttaggcctgtttgttattattcctatgttgatctcaaatgttttgattttgattttaatcaaatgataattgcaagtattcagaaatgcatttgaagcgatacagtcaatggaaaaaaaattctgtcttcagtaaaacacaagggatgggagacgtgcgttccttgttgctgctgctgattctcgaagtcaccggcgatggccgccggcgacgaagacgctgctccggcgctgtcacgctgtgagatggtcaccggcggcgactgcgacggcctctcttcggccgctccctccgaccacgacggcaattcctcccatcaatcgccgatcccccctccgccgccgccgttcccgcactcatcggtttctctttcacctcatgacaccgcccaccccgcgcgctgctcatcgaattgacgcggagatatggggccgaactgacccgaatttatgtgcatcctttacaggccgatgaacgcacacttttagcccaactgacgtgcatggttgggctgaaatgctatttgggacaaatttgttcacacgtttgggccctactcacagaaaatttgggcttacattactagcgcagtagcgctgctctggtgaatggagaaggtccacttgactcactcctataggtcggatctgattcatatttctcgaccgcaaaacaggtataatgatttcctcgaggctccaactgttaaaacaggtacaaaataactcctaaaacagcattaggttttcactaatgtggcacgttgagctagttcaacttgctgagtcaacatgggtccacgtattagtgtagtgaccgatgatagccagtggtggctcctttctctcccctctcttcctcctattgtcctatgggcatggtggctggtgagtggcggcttctcgctttgcattttctactgcaacgagcatgtccggtcctagaactctactaggccatcggcgaacttctcgctaatcctgcaacaccacactgaccccccctccttctgcctcaccatcacgccccgatcaaccaaatcttagtaagatttaatgattgcttccgtggtcctgccagtagccatctccttcttggctagctagtttcatggttgggaagatgcatgctgaggctgagcttgagctccatcgagggagcaagaaagaaaagatcaaagctttcatcgattagtggctggtgctactcctatgtcattgccctcctcgtcggcaccacccttctgatgctctcccactgccttatgcctcgatctggttagccaacgtctctactatctgttgccctgatctacagaaccgacgggatcaagaaaccaactgccctgatccgatctgccatgtgccgccgagatcgagatcattagtgattgagcttggttggaatgatggctaggttgaccgtacggtggttggtgaggatgccacgtcctattcacctctggtgcgggtatcaccagcgtgtcatcgcggtgtgggacagagcgcgaggggaaatgcaaaggaagaagaggagagtggcatggatggacggtgagctagagctcgacggggttcactcgccattgtcgcttccattgggagctcaagctcccttgccactactagagggggaagagcgaggagagggagatatgggggagagaggaaggagagagaagtgaggtagagtgagatgacatgtgggctccacaaaatatttctaatttaatgtgccatgtcggccagcaccacctctcaatattgtcttaggaattatttctctggttttaacaatttgagggatacagataagcgatatgaatatgatccgacctatattttgaaggagttagagtggacccttttgcctagtttattgacgtgcaaatttgggccaaatttatgatcacctttaggcttaacctacgcccactttttggatgaactcgtacccacgtttaggctgaattaacttaaaactagaaaatcagcgcgtctattggcgcgcttgctagttagcccataaatgtgtgtaaaaattgaacttcagtaaagtgtcaaaaatatatttttgtcgttgatttttgctgcatttgcaatagatatattatcattctaaaacttttttaacagagtagaaccgtatttatatgactcaataatacataataaaacagacattgatttttttttagtattgctatttttgtggctcttgattttatacataaattttatattaaaacagtttatgtattgcataatgcactctcagtaactacgaacttaatattacgtgaaaataatacaaatttaatgataccacatacgtaacactattttttataaaaaaaatattagtcagatttttaaatattgaagtttttaaaccgaatcctatattatctttttagtacccagggttaccacgctgtttgaaagtgattgttggccacattatcacccgatccaatctttcacattatccctatcatctagttttgtatgattattgtttttataatatagaaatatttttatccaaatattttacaaaaatatatgtatttttttctagtactatttatttcctcctatttctattttctacctgctcatgcatgagctgcaaagtagcccagggaggaggaggcgatgttcaacgtgcaaactctaattatcaggggaacacataattgggtcgatccagtgcatacgctcgtaatggctttgttagttttctaaaaaaaaagttaaataaatatatagcatccatctatttaatgggctctattggagaccatttggcccagcataaaatggcggacggacaccgttaagcgtatgtacgtgacaattctagaagagattagattggttgaggaacctgcgacttctccgttagctgtcggaatttatctgcaagatgaggaaggacacgtggtccaatcagctggctgggtctccagccagctttagaagtatctagaaatatagattatatatggaccgaattatgcttgattttgggctgaatacttgctcactgatgggtgatgggtcgaattaatgtgcagctatgggctgaatcctatcttactaagttatcccccactaacttcttaaacttaacatgcaaagatgccacatcatcatccactaacaagatgccacatcatcattcactaattaataatatgccatatcatcatccactaacaatcatcacatttaaacatcatgcaaacatgctatatttttatagtttttataatttaagagattttcaaatacaaacatgttaaattatcatccaacataattcacataatgtttcaatgtatatcctatataagtatatggttcatactcatttagttagtgcttaaacgattaatttatggtacaaattatttttctcccttttccctctaattaagtcatatcacatcaattgtttttaggccctctttgtttagacttataagccaaacttataagccgaaaagtccaagcctaaacaaataagcggcttttttgtttggcttttctgaagccataagacattctgacactattaagccaaaagctaggttagagaagcttttttggcttatatgaggtagatgcatgactccaccattaaatttaagacattaaatccatcggcttataaatcatataagccaataagctaacttaaaagtctaagccaataagtctaagcctaaacaaagagggccttagcctttagatgattaatctacggttcaaactattttcctacttttcttcttctataaagtcatactaccttactttttacgtttgaatcactattctacatactatttaaatttaaattatcacaaaccatattaatttacttaatctgatattatctagctatcttacacgttattatttttgttgt

SEQ ID NO: 54591 - DNA, 5457 bp, Oryza sativa
aagatggttgattcggtttgattgtgactatatagtatagttgcctaaactggcaggtaacattggaatgttgccattcaaacaataactggtgctgggttcttagaattcatggtagatagcttggatccttatattagtattggcaattggctgatgggtattatctattagattactcttgaaatcatttggccattttggtgaggcacatattcttaaaatcattattatatactaagtcttagggggctgtaaatattatattatggattgtattttgatgcatatagattgtgttttagattcacatgtgagggaagaaaatatcatctgctggaacaaaatgttctttcagcatgctaattaaagttgaagcactgtgcttttattttacgtgcgtcactgcttatcacctaacaatggcaacaaaaacagcaatagtaacaagaagatgacgaaagagacatgagaatctcatctgaacacaattttcccacaatgcagttgcgtgctgcagtttggcttgagtcttgaggtcaacagatagggaaatatcaacttagggagctgccaatgttggtgccaggggaaatgttacatgcagggtatcaccataaacgcattatgcatctttgaggtggcgatgattaagttatggcaaactaactcctgctaggtttcaaacccctctagcttttcttcttcatggaaaacaatggttccctgcaaaagaaagagagaatgggaaatttggtggtatgcctgatatatgtttgtctatttgactggtttgctacattaattctgtgtacatttggcgcactgtgaaaattaccccataagggagacatgccacgttcaaccccatggaggatataaccctgcaaaggaaaaacaaagaatccctagccacatttaagaagtaatattagccacatgtacaattaaattcagaaacttccttaacaatgaccaaattgatgagaaaaccaaccacaacattgaaaaaaaccaacaaatgccagagataattcactataacaaccccccaatactaggcaagcaagaatgagaagctatgctcatctgaatcatcatccacacctacctaatctgcccatgggaaaaggtggatcctgcgctgtttgggcaaacaagcctaagctggccagctgtgtttttagggtccataagttgggatttatgataatctatttggtaggtttcagtacctaaactaccacaaagcatttagtgttattggaatgattttcttagatgatttatcctctgttgcataaagaagtttaagccttttccttctggttagaaattattttttcttctaccacttctctcaactagtgagtcaatgtggcccatctgttcagtaattatccatgcctgttcttttgctccattcttgaatttttttctgaagttgactcggttgtctgctgaccatgttattttataggaaaatcggaacctgctgttgaggttcagatatgcagggttggaatagcgccaatgttttatcggtcttagcaaggtatatatatatatcctgaaattgggattctgttaaacttctttcagtatctgatgcacacctgtgattgctatgaatgttagttaggttattcccaatttaggttctagttcattatctttgagtttttcactgagacacttatttgtgactggctacttttgttacagtaactgaaccatgcttacgatatctatattttacgttgactaatttctggtatgtactgcactgactatctactttttcatagttcagtgggttttgcaaagtttgtccatctagggttgtaacttctatatttgttactggtagccagggtttcccttaccgcctttaaccgcgcggttaccatggtaaccggtcttaccacgggtgtacagtaatggttaccggcggtagggtttggggaattttgaccaaattcaaaatttccaacaaaactgaaaaaaatccaaaagaatcatggatgtagttcttgctttttagtggcggatggtgaagaattttttttgaaaaagagtaagataacacatttgagggcaaaaccgaaagtagtttagaaaatgggaaaaaaagaaataaagtaatgggcctgaagttgcaatgtttatcggacccattaaggcccaatagtggagaacatatctcccgtgtggctagggctctcctctcgttctctctgtcggcatgaggtgagggggcagagtttcccttaccttttggagaggggttatcgcatccccgtggtaaggcagttacagcggtaaccgccaaaaaccatgtgaaatacgtcgtaaaacatttgaattcaaaaattcggcggtttcacggtttggtcacggtttggcgcggtaaccgcaatatttgcgtgataaccgtgatttgtatagtagaacataataatgctaaaaaaattgaaaaaacactaagatgtgtagaaattagagataattataagattatatatgatactttaaaacctaacttttcgatgaaaaatgcaaaaaatcggcctgaccttttctatattatggactttgaagcaattcaacgattcatagcatgataattaaacaacaacaattcaacaaccatttcaaagcataatgatgtccacatgtagctcaaacaatagagttcacaatataatgtccatgactacatatatgatagttcattatgacaagcaacacgaatataaaaatagtttgaaacgaaggatataaataaggacatactaacatagtgcatagctaggtgttccactgattgtatgccatgttgtacttctctgtggacatgagcaacaagttgtgtgagtgtagcaacctcgccttgtattcctactaactttgacctgtccatgatgctgttgattgccactgaccgtacaattgagcataccacttgggctcttgccactcatacacccatgtaggaggataatcagaagcttgaggacggttgtacacgtacattggatatcaacatttcaatgctaaaggcactgaatgagctatagctatgctatggtgtgtcaagctgctgttgttgttggcctctcagagtaacggtagttcattgagagcttggagcaccatgatcttggtcccgagcatcgtgagtgaagtcagtctcacttgcaaatcaaatagtaggaagaagattaatcggtcgtgaattgcaaggtgaaggttgaaataataagtaaagaattgaattaggttgtggtcatctaacactgttgtgtgacccctagaagtcacattagtggcaccttggccttcttgaccatcgtcgtctccgttatctgtatcagttcttgagctactttcatcggactcttgatagtctgggctcccttgagtctcttcatcgctatcaacactccttgaccgtgtagctaatctgattgttagtgtcgtagaatgataggtccgctggcctttgaaggggatcgtcatcgtccttcctaacttgggtatttgtttgctgaatttgaaggcgaaggttgtagttgacatagacaagtttgttgagcttgttgtgtgtaagtttgttacggatcattgtatgtatggatgcaagtgtgctccaattccattcacatccacttgaagagcaacactgatcaatcaaacgcaacacaagtttcttcaaattcggcatgcccgatgtaaacatagaccgccattgtgctgcaaatgccgagtaacatgtcattttaattttgaatacgtcgaaagcattcggacttttgatagttgcattatctgaaacataccaagccaacttttcccatccatcaccatctttcttgcaagcggcctcccaaattcgctactcttacatcgatacatctcaacctccagcaaagtggcagcaaccatttcaatgttcgtcatccgctcgaaggcctgacggaggtcttggaagacggtcgcacttgcaatgtacgcgtagtgcatccgagggtttagtgctgcagctacaaaacatggcacaagttaggtaaagggttatttactatgaatacaagattatgttaagaacataagtgctagctacttgctaacattgatgagtgtatcattggtcaggtcgtgcaaacttctgtcaacaatatccatgtaagctgcgtactagtccctttcactcgcgaatagactgacatactccattttaatcaattgatatctcagaagaacctcactcaaattggggttcttgtcctcgtcagcaaagcggagggagtacattgcttgggtcgttattgcctctatgttttcccaccaccccttgctagataggtaggtgtgtgcatatctaccttccgctgtgccactgaattcgctttgcatgaagctagaggaagccatgcacttcatgaactgatctcgcttcctaaggaaactctgaaggaacatgtagtttgtgccgaaccgtgtagcattccacttaaccaattcaccacctatagttgttgtcaccatagcatgaagcttcgaatgattgtataaccatctgcaaattttcctagcactctgaatcaccatgtcatgatctggcatttttccaacctccttaagaatcaagttaattgtgtgagctacacaaggttgccacacaatagttgggtactcttgccgcagtagcctgcaaacctttttatagtttgacctattgtcagtgataatttgcacgacatgttgagggcctacttcacgtaccaccttccttatctcttgcattagaaaattacaaaataaacataagtccattaccctaaacttgataacatatggggtaaatttactgcatcaatgtcgtcaccttctatatgaagttagcattctggctttggcccgttgcatcaatggacttgtgaaaaaacattattccattgcaatatatcaaaaagttgatgacaaccatacccgttggtcgagttgaggaatcacacattagagtaacaccatactcagcaaaatcacgcttaaacctcttgaattgcttctttacgtaccttctctgtagcatcaaggtacttgccatctatctccctaccagttggagaagttatgttttcacttttcacctataattaacataccaaataattagtctctaatctgttagaaaaatgtaaatccatattaaatgcatatgtaccccacttctgtgtctctcatacggtgctgacgaagtttggattatcggcatttcttgcaaggataccggagataaaaaaagaaacttatcttggactcaccaatcacctccctaccttggtttccctctttgtgaagaatcctatgtcaatgcatagtagggatgtgtgggagcatggggagaacataccaccatgctttcgttgtaagtattggggctgcaggaat

SEQ ID NO: 54592 - DNA, 1162 bp, Oryza sativa
tatgtcctaaccaattttattctaggttattatatatggggacgaaaagagtacttagtacttcacgtggatggagaatagtgcgtttggatgttgcaacctgtttattcctagtattgggtgttcgtgttgtagacgcttggcgtgactgtttatttcccgagttattatattgtattttttctgctttatccataaaatacgaatatatagctctatttttttagggagtattttgggggagggagtatctcccggtgaccgtgaagaaaaccaaattggtcgactcttctgtcgctgttactaatcattagaggtgacagttcaggtgttactttagatttcagcggagccaccgtttcgcttattttagcgaaacgacatatttataaacggaaagtaatttgtaaataaaacttttatatatgtgttctcagcgatctaaaaataaagactgaaaaataaacttcgatgaaaaaaaccttaaaatcagctttaaatttaaagttaaaaattcaaattttgaatgataagcataagcataaacgaagatagtccatcacccagattccattgccggagctaagcacacgtgggaaaaggcgtcgtcctccaaacaagcaaaaaaaaaagaaagtggtccacgtggactgaagccattggccaggtgccctcatcgatcaatcgcaaaatgcctcaggcctaagaaatctctaatcctggtcctaaacttcacgagcaagtcactcggcatcccggaagattccagtaggcgcggacacaccaacgcaaccgtcgccaacgccgccgcctccgcccggctcgggtcggaaactcggaacccggcgcgtccgatcgaagcttccgacctcctcgcccgcgccgacccggccacgtcaccaccacccggtgcaataagaccctggtcggcgagcgagttcgaggcaaacggcgcccccattcgaaaatcaaaatctcttcctcgcctctctctctgctctctgctctcctcgccttcctctctcgccagttgctccgcgtcctcgctcgagtgcgcggcgatccatccgggagggagaggtgcgtgcgctctgatcgctcgggaaaccgtcgtcctgctcgatcgcgctggttgatcgcgattcgccgcagcggcattccg

SEQ ID NO: 54593 - DNA, 16599 bp, Oryza sativa
  unsure (1)..(16599): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgagaacacccttaaagactatcgaggagtcatcccttctaaatacggtcacatcaacatcggtaaaaagacaattgtagcccatggaacacaattgagaaacggacaagagattatagtttagagattttaccaagaggacgttagaaatggaaaggtcattgtagattgcaatcttacccaatcccattacttttccctttccatcgtccccgaagactatgttctcttgcaaagagccattaggatcaagggagcaaaacattgattcttctccggtcatgtgatttgtgcatccactatcgatcacccaacttcttccaccggagagatattcctacaagagatcaatttctagttttaggtacccacacttgcttgggtcctctcatgttagtgacaagtgccttaggcacccaaagaactctcttgatggaaacatttttgccccttgggcctacatacttagcaacaacacgaccactagcattcttcctaagaacataagatgcatcaaaagaacaatgtgaagcataatcattaggaaggatacttttggccttaacaaaattgctaagaccttggggcctcttgatcgtcatactcttgtccacctttccttttggtggaggaacataccaaagaccctcatggttgaagttgtccctttgatagcctaggtactcctttagggccttactacccatatggcacttaagtaggccattgtgaaggagtcccataagcttctcattttgcttttgcaaagcactcaaagaaatagagttagtagcacaagcttcaatatcaatatctttgcatctcacacatgattcattgcttgggagaattttggaacaagacggctcgctagggagagagacactattctttaaggtttcgaacttctcttcaagagagatgtatgctttgtccaagccatccactctctcttgaaattgagcgttcgccaccccaagattagcatgagactctttggtttgcttgtaaagccgtgccaaagcctcatttttctctctctccttagcaagctcactcttgagttcatgagatcgctctttctcacgaatgagcaaagcctcttgcctctcaagagttgcatattggtcctcaattctcccaagcaactcactcaagtgtggtagagattccttagttatggacttgaacaattcgtcatccataacctcatcctcaacctcatcctcctcatcactaacaagatcatcattaaatgatttgagaggagaaggtaccttaggctcctttgccatgaggcaaatgggagcatcctcatcacttgagtagtcgaagagtctcggcggtgatggaggcttgacagcgaacgtggcaactccttcttcatcacttgagcttgacttggaatcagagccgaaaatcatcccaaggtgagcttggccataatgttcccgcttgctatgcttatacttctccttcttctcatccttcttcttatcttccttgatgtgggaaccatccttgaggtgagggcaatccgcaatgaagtgcccgggctcttttcacacgtagcacactcttgcggaatgtcttccacttgacttgttggagtgatgcttggaagaatttcccttgaagaagccgcttcgcctcataaacttgccgaacttcttgacgaagagagccatttcttcatcatcgatctcctccttgctcttgctcttgtggttctcttcttcttcttcctttgccttcaatgccaagtcttccttcttgatgcttgtcgttgagctttggttgatgtattggatgacctccttggactcttgcacaagcatgtcatgggcaagaatgcgtccgagcaaatcatgaggtgtgagagtcttgtagtccggacgctcatgaatgatggtaaccaaggtagagttccttggagtgattgctcgaaccatcttcttgaccacaacctcatcggtcatgtccttggaaccaagtcccttgatctcattgataatcttgctcaaccggtcatacatgtcacttgggctctcaccatccagcatcacaaatctctcaaattgccccttgaggatctccaccttggactcacgaacactatccatgccttcatgcaagttccgaagcgtgtcccaaatcactttggcactctcaatgccatccacacggttgaactcacttccactcaaggcactaagtattgcattggcggcttgagcgttcttgtgctcattctcgtcgtcctccttggtgggatcttcgggattctgcaaaacatagcccttttcgactattctccaaatagatgggttaatagacttcaaatgcatcttcatcttatgcttccaagcggcatagtccataccattgaagtacggagctttgccgctataggtactcacataagatgtggatgtagttggatagtcataaggaaacgtagctcccttatcaccatctttgccttcccccgtttggcccgacatgatctctccaagcggttaagcctaattaggagattaggctctgataccaattgaaagggtcaattaggcctagagggggggcgaataggctaatttaaaactttatgcggaagctaaaactgagttagggtcggaaagtctgatccacagtcagactatccgaaaatatcagatagtctgatattggatcagactgtctgatccactaaaagaacactacaagtagatctagtgcacaaacaagagtatggcgcaaacagcgactagatctatagcggcacaaaaaacaaatctaaataatgggagaagagatatcaccaacaatgaagctcacctagttgttcctagagttcaaatccttgaggggattctattctccgttgaggagctcactaagagccgggtctttgctaaccctttcctcaagaggttgcactaagcacttctacttccactaaggggtatctctttccttgtggaggcgagatccggtcttcacaaacttctcccgaccaaccacacgtagatcggtggctcgggagtgacacctagccgtctaggagtcctcaacctccaagagtaacaaactccacacaactcttggtcaaccctagtgctcaagatcgagtgaaacacacactaggccctcaaaccccaaatccacaaccaccaagatccaccacacaaagaacaagaggggatttgagagagggagagagagctcaaagatccaaaccaccttagcagcaagctcaacccaaagtgaatatgaatgaatgagttgggtaaccctagaaaagggttaggtggggggtatttatagaagcccccaaaatgtggccgttgggagagaatcttttcatcccacctcggaaagtccgaggtgacatcggatagtccgatgtttttgaccaccaaccaggccagagacagagaacgaaattctggaaaatttcggacaatccgatcgatcggatagtccgatgtcatatcggatattccgttatttttgaaccaagaatttcatcctctcacagagactcaagttccattgaatttcggagtctctggatcatcggatactccgatcacatcggatagtctgatttaaaactcactcaaaaggaataaaaagcaattcaaaacagagagtgaagttctgagaaatttcagatagtccgacgtatcggatagtccgaccttatatcggatagtccgatattttttagccaacactcagacccaagacagtgagcaaagttctgtgaaatttcggatagtctgagcatcggatagtctgatcaacatcggatagtccgacagacataaaacaggaacacttcaaataaatgattttgagcactagtgttctaccaattatatgcatgtggcatccctcttaatagtacggcatcctaatactcaagaacacaagatatacatggattagaagacaattaccacaaaagatgccgcaatacttattgtgttgacatccactcctttttcatccttgcatatatctcaacaaaaagcattagttaccctctaactgtgttgtcattaacaccaaaataaatgaggggtcctagatgcactttcactcttctctttcttctcttctctcctcctcatattcctctctctctcaaactccccactcccgggagagaacattcttctctctctctctggggcacgcggcggcagaggccggtcggcacgcggcagcgagcgccccacgcgtcaaaggcgacgagggcaacgccggctctcccctacccagatccgtgcgaatccaacagcggtggcggggggagcacaggggctgcggcgggtgcatggcgggcggacaatccgcgcccagatcctgcggtggcggcagcggctgccgtccctcacccaaatctgatggtggtggccgtcccccgcccagatccagcggtggctggccagcaggcgttttgctatttttatttttgtgtgtggacgacataaacatccgcacacggaaatccgattttcgcatgtgggtgcgccaccctcatagaaaaatagagattttcatagacatttctgggcaaacggcccggaggtccgcaagcaaaaatcacttttggcctgtttgaaaaaaattatattttactagtcccggcattcgtcagccaatccgtcagcagttgcaccaacaaaattaacgaatctgaaaattacaattttaccactccacgctcatatttctatgactatcgtaccttcctacgtttctactttcattaattagagtggtagtacaattaaatcttacccattggaaaaataataattgacggtttagattaatttctaccagtagatatatagcatcggacagggactcgtgactgttgtcttgaagtatcccagcagaaatcaattgttcttctattggtgttcatttttttctgaatgactgcttttctagtactaaatattggtgatgaaacaatgtataacattgggtgtttctgttataataatctcaccacactggtgatgttaatgtatatattgtctgacataagctgtaaatctgagatctttgctgatgaaattgtttggttttgcaggtttggctgccactggttgctaagagctacaactgcttccaatatatatttaccgtggcctatgactctggttcatgtggatcaaagttagattctaaggagtagacttgtaagtgtgaaatcatcgtcatgattaatatttgtgatgaacaattggctttacaaatgatttaatcaaagaattggtttgaatagatgtgtggatgttggtgtgagtgcgtgtgactaatgtgggtcaggttgtgatatctgcgcccagaaacggttattttgtctaattatgtgcaggtgacttgaggtcagccttggacaatggtgaggaccgggactatgctcaggaagaagcagaggtctagtgcggtcgggataccatgtgaaaaggtgactagagtcagaattcttggaggtcaacttcggtcaatggtgaggatcgggactaaacttagggaggagttgaggtccagacggtcaaggataccgggtgacaaaattggatacgagatggcatacggtggatggacatcgtgtgggagagatcttcacaacgggcttcacgaggtgtgtgtgcaagcgtcggtgttcgcgaaggagattggagtgacaaattgagttagagtatatgatgctacagtacacgtggtactgtagcatgcatatatgtgtgcctactgtggattgcagtagcgtggtgatgcatgttgtgctatgcatgtgtgtatgcgtactgtgcagcatgcagcggctcggcttggtgatgcaagcagggcgtcggtctggcctgggcatgcggcaaggcaagccgagtctgactcggtgaattttatgtggccggctgtggctgcaggtttcggagagtttgtgagaattacaatttggtaaattgtaatttgatttggtgattaaggatagagtcatagtatgactaggagttatattcctactttgagtaggaggattttcatgtataaatagagagggagcatgaggctttccgggatcggttttaggaagccgagtttgagagattagatagggtttcgagagaaacttataagggtgctttggctgcaccttgtgaacaatacttgagcaataaagaccatattcaatcatcaacgcatcgacgatctatatatattccggttttataagttttacatttatgtttggttttggcattaacatgtgattgttcgttttgctgcgattttgttcaagttaatccattcaaaacctttctagtacttcatagatcagatctggaaagtttcgttgattggttcttgttagatttgaatttgcttaaattttaggttttgttcggatttgctgaaattctgatacagctgactttcgagggtgttttctcttaaaccgtttattagtttgcaaatcccttctgtggagttcttccttagtttgtctagtttattctatcaagtttgtaactcgatccaatggttgtttaagagaaatcgtgtttttgccgaagcgctgtcgtgctgttttcaggctgacggtcagaccgcgagaggacctgcgttctgaccggttagagttcggtcagaccgatcctagtaggtcagatagaccaccaaacgtgtgttccattggcttttgagattggggtgtgttttgatcgattaagattcgattatttgacttcgctgacgtaatctaccattcaccctttctggtaggcttggctactcgtgttcgatcctacggtaggactcaagtatctgttttggctgttttcctaataattaattcctagttgagagtcagtgattcatgtagacattagccaatagggattgctagagagtggctgattccattaatacaatagcatatgcctttttaattacggctggttagtatggttaatttttgctttgcttgtctagctagcttcggagcacatttgattacttgaggcaagctcatctatcattgaacgatttggtgttccatcttctcagtactcaataccggtgacggcacactgtttctttagcccttttactcgtactttgatgatgactgggttctttaagatggagcaacataaattttatatattttgtttgaaaataagtcgagttgaccttctgttcatcacagtaagcgccgttccataagcttggtcgtatgctatatggaagtggtggccagatcatacatataacatggcatctcgctaaactatttttcaagacaaagctagctaggctgatcatattaaatctatactttctataaagttaaaattaaaatggactaagtctaaagctcaacatacaaccatgccgcatcgtcagccactagcaataattacatatttaatctcatgcaagtatacaacatgatctacaatttatttaattctgcaaatcaaaatgcaagcatatccaatcatcaccactcatgtcatttgcacaatattttaacaaatctatctatcacttctacaatatttaacatatacttatcaataagttttacactaaagcacatgtatcatttgactgataaaccctgttgtttcattattttttttctttttactgctagcttgattgtaaaagaaatatatattgagaattacttagtaattcccacagcaaagcgcggggaatcacctagtataaaaacgaataaaaccttacacgaaaaagagattaaacatgccaacacataacaacgatgattcacattctataatgctacaagggatgctagcagaccagcgcaaccacaacgctgactaaattctatattcatgtaacgggacaaagtctttaaaatggcatattgcttgattatagaaaaatgatactgggtaagcttccaatgcttggatcctcacatgcagacctcggagaagttcatgttataacctcggataacttccattacacaaaaattgctaaactcattgcaaaagagagcactgagaggttgacaccgacggctaccctgtcttaggctcttagcctgctccgctaccgatagatccggtgcgccgccgtctctccttccgcgccaccgcacgctgccgcggcttaggccttgtttagatgggactaaaacttttaagtccctatcacatcggatgtttgaatattaattataaatattaaacgtagactattaataaaacccatccataatcttggactaattcgcgagacgaatctattgagcctaactaatccatgattagcctatgtgatgctacagtaaacattctctaattatggattaattaggcttaaaaaatttgtcttgtgaattagctttcatttatgtaattagttttgtaagtagtctatatttaatactctaaattagtgtataaagacagggactaaagttaagtctctggatccaaacaccaccttaccaccggtgagcgtatctgaattctattgataaaggaagactagtttgtatgtctgtgttcttatcttcttattgacatgtcatatattgtttttgttatacatatataggttacagcatgtgtatatcaaagttaggcattccaacgagtagtattgtaggactcaagtatgtgttttggctgttttgctaataattcatacctgtcgagagtcagtgcctcagtggttcatgtagatattagccaatagggatagctacagagtggctgattccattaatacaatagcaatctgctttttttaattacggctggttagtacgttaattttttgcgcttagcttgtctagctttcgagcacaattggttaactcatctgtcactgaacgacttggtgttccatcttgtcagtactcaataccggtgacggcacactgtttcttagcccttttactcgtactttgatgatgtctgggttctttaagatggagcaacataaatttctcatatattttgtttgaaaataaatcgagttgaccttctgttcatcacagtaagcgccgttccttaagcttggtcgtatgctatatggaagtggccagccagatcatgcatataacatgacatcgcgttaacttctttttcaaaacaaaggctgataatattaaatagaagaaacaattataaccttacatgcaaacaagacattaagcatgtcaacacacaacaaaggcgattcacattctataatgctacaagagattcgagcaaacgagcgcaactacaacgctgactaaattatatatacatctaacgggagaaaggctttaaaattgaatattgaatgattatagaaaattgatttatactgggtaagcatccaatgcttggatcctcacatgcagacctcggagaagttcatgctataattaccttggacaacttccaatacacaaagtgaaaattgctaaactccttgcaaaagagagcactgagaggttgacaccaccggcaaccctgtcttagcttgctccgccgccgacaggtccggtgcgccgccttctctccttccgcgccaccgcacgccgccgcggcttaccaccggtatgtctgtgttcttatcttcttattgacatgtcatatattgtttttgttatacatatataggttacagcatgtgtatatcatacatacctcatcttagagttccttgacttcagagttaattaaaaagcgatattgttcttgtgctgaaaagtttcaagttgaaagcaaaagcatattggatgcaataaactcaggtttacaccaaatgttaccctttttattttgtcacgtgtaactgtgtaagcaacgacacgaagtttcatgagattgttggtaaattaagttgcaatctgttgcaactctgcttttagtggacgattacttttggaatagaaatattgttgatgctatgcacctgcgggcaggggccaacacatgatttttacaatgagggtaggaagtttattaagaaaccaatgctatataatactagagtactgaagatttatgtagaaaagcttaaacaaaaatagttgtctcatatgctttaagtaggctaataattagtgttttggttgaaaaggcaattttttgtaccctactatagtataaatacctaattggcatactatctaatgaatattttaccaaaacatatataaaaaagagtgtgcatctgtacacctcttgtcccatactagctctgcctctgcccgagggattaaaatctacaattcatttagatggatctttaacatacagttttcatatgaccaggcgatcatcaatttatttggagcaaggacaatcatattgtctaatggatcttcaaaaaaacaagcataatgaattcatcgaaaagccaaaatggatagaggacaacatttctaatataaaggcattcacgaaagaagatataaaaggaattaccagtaactacagcaaaaggcttggaaatggtaaactcggaaaagtttacaagggtattcttgatgataaccatgctgttgtggtgaagaagtatattcatatggattctgaagaagagtttgctaaagaagtaattgtccatagtcaaatcaaccataagaatatagtcaggcttatcggctattgtactgagaaaaataatctaatgatggtcatggagtatatgtctaatggagaccttgattaccatcttcatgtcaagaatagcctcgattcattggacataagattgaacattgctatagattgtgcagatgctctagggtatatgcattccatgtgcagccctgttttacatggtgatgtcaagccctccaacattcttctagatgacagttttaatgcaaaaatatcagattttggaatatctaggcttctctcaacagacaaaactcatactgaaaatatgattacatgttatatggaccctctgtattaccaggaggggcgtctcacctcaaaaagtgatgtttatagttttggaattgttctaatggaactaatcaccaagaaaagggctacatgtctcactcaagctcttgctgaaggacaagagatgacagaattgcttgatcctatgattgctaatgagagcaacatgaaggttctactggagattgaaaaactagtgcaggaatgcctagcagaggatattgatagacgccctgatatatgtgatgtggctgcataccttcggatgcttaggaagatgagtcaacaagcaccacaagaaaattttggttggcacttgtttgcagaaacacaaaatgattttaaaaagcaaagccatcaaggtacaaacattatcagctctatcaagatggtgttccctaggatgatgggcattctcaacgtgaacatggccaaatctgaaaacaaaggaactccgctctatgttagtggcaaaagaatattcacagcattggaaataaagaaaataacaggaaactattcaagaattatcggtaaagatatgtttactgtggtctactctggaattcttgaggataacacacaggtggcagtgaagacacacaacatgtttgaacgtgggaagtggagatgtgccaatgaactgaatagcctttctgaacttatccataagaacattatcaatctgttgggtttctgctatgagatggacgctgtaatattggtttatgaattgatcgagcgagggcacctctgcaacattctccacggcaatgatactaaaagattccctctcccactagatttacgtctagacattgctattgggttggcagaaggattgtcatatatgcatagtagatcaaaacccatactacatggaaacataagaacagtcactgtacttctcgacgacaaatttgtcccaaagatatcgggttttgggtcatcaaagattggtgaagatggtaaatgcaggattgtggggagcgagatgggctacatggatgaaacattcgttaataccagagttctcacacggaagagcgatgtctatagttttggagttgttctcttggaactgattaccaggaaacgaatttattataatggtaaggacaataatactgccatcaattttgccaaagtttatgagaaagagggcagtgggagggctatgtttgacaatgagatcagtgctgacaaaaatatccctaccctcgaagacattggcattctagcaatgaagtgcttcaatccggacatagataagcgccctgaaatgaaagaagtatgcgaacaactgttgatgcttaaaaggtctagtaagaagggcaaaggaaaaatataagttctcacattgaagatagttaagagaaataaactaaaacttgatgcaggagatttgtgaggatgaggaatatgaagtacattacattagctcacaagatcatttcagcatttgtttgatcagtcaattgctttttctcgttgtttggtgttatggtttatcattatatatctgaacttctttttagtatttggaacactaatgttccaactctgtattttctgtagggtgtgattatagtgccaataattttttattccttttttatctgtggttaacaaatactattatcgtacataagaaaataatacaataacaagcaaaatgacacactaacatcaaccaatgttcttaaaaaaaacatcatagtccaccacattatgcattccatataattttgtagataaaattgcaaaaccatgtagattcagcctgttcttctgtcaaatatgccattttttcacacaatttattcaccaacagtacatctggttgttcaaaagtattttaagatcagggtaggaagttaaaactagcattacagtaccagataattattatgctggagagtggaactataatagcggcaggtggagctaggaattttattaagcctgggcaagtctaactaagatggtaaaaccgctaccgactgatgtgatgcttatatgctaattttactatcaaattgaacatggaacaattttctaatagaagcatagttcaacatgtatgtaaatttttacttgttgaaaaacaagccgactgatgattcgttaggctgctaattgagtggatcacatcagccatggtgaagtgggcaagtcggcaacaggtagccacggtctaattgcatgcaacagtgctgcaaagctagctggttctaattaaaattctagcctgctactaattttgtccaagatgtcagcaaatctatggaattcaacacagagaaatcattagacctcaatggatcgcacaggcaaagcccgggcatgcaactgcccgtggtgcccaggcggtgaatccaccactgaatagcgggtatccgagtatggactccgactcaccacgcgaattaaactgtcgacctttctcgtggcatgtttggagatgcttcattcattaactagatggaatcccacgcgttgctgtgggacactatgtgaataaattatgtacgattaaaggaaaggtttaaaaatgaagccaatcaataaaaggatatctacagtttggttggaatatgatatgtatgacatataagtgatctaacaaggtcatccataagttcaatgaagttatgttgttcacttcatactacacgcacgaaggaaataaaaaggtaaattgtacggttggttttaattagagaatgaataaaattgcttcttgctaatctggtaggaagtgcataggtgaaacatgagaaatcatgtcatgatttaatcatggtaataaataattgtcaaaggtaagtgtttgtgataaacaaaatatgtatccgttcgtggtcatttgaaaaactataaaaaaaaaattaatattgaccccacaaacaatcttaaattaaaaaaatcaactacaaagttgtatatcccgtcaagagatacaattttttatataaaatttgtcatcatccaactttatatgatgggcattgtttccatattagtgatgctcacaatattttactaacgcggaacatactgaggtgaacaatcatttttataaagagagcctcaagaaaattactgaaagacgattttgttccaaccggagatcaaattgcagacggcattttttttatttttacaaaagcattttcagtttgacggtttaaatattttaagtataagtagaaaagttgtgattgaaggaggctgttagataaaatgtaatatttcatgtgtatgttatcttgattcagaatgtaaatgcaatcctagagctagttggcaataccaatccagctgctcacgcggcaccattcttgtaaaaccacggcgatgcatgattgatatcgcccctatattaacacaggtgcggcccaagagagattaattcaacgcttccacagctcatccgatcgagttctttctttacacccgcccaagctcaaaggaattgtctcctatcaatgtatctgagagcatgcaagttggtgcttaaatggcagtggaatcaactcatcgttacatttagatatcaatcttatgttactgtcccctagtcattggtacatgcactgtagtgtagtgtcaataatctggatgctttggtaagtatgtacaactgtttaacaatgctgtcgttattttttaaggagaaaagtccacggggccgcaatcaagttaattaagcaagattaatcaaacgcatgcatgcacacatagacatataagtaaacaaataatccctctattaatatattggatgaagaattgaacaagtccacaagagctagcgcagtcaagtgcgattatattagcccagtccattggaactgagcaattaatatattacaacttgagtatcaatatgaccatatgcatggcttagtcgtgcgcttatatattggattagccagggggttcaaaatgaatccaactctgatctctcacttcaactctatgtgtaataggtagagatagatcgagcgcaatagatacacagatagctcattggctgtgtatacccactttgggtgtaacagactgggttttcatccattttcttaagaaaagatagatagatagatatagcataggtgagatatacggagagacagggagaacataatgggtctctctagtgctattgaatggtgggaggagtggcagctgcgcatcctcgccctcagtagtatgggcattcaagtgttccttttcttctctgctatgatgcgtaagcgtgctattccttcctggttcagatccatagtatggcttgcttaccttggcagcgatgctacggtaatatatgccatggcctctctcttcaaccgccacaagaaccaagattacactaatagcttcaaagtacagggcagctacagcctggaagtgttctgggctcccatcctcctaatccaccttggtgggcaagatgttataactgcgtacaacatcgaagacaatgagctttggaggaggcaggtcctcaccactgtgtcacaaataaccgtgtctgtctatgtgtaggtcctcaccactgtgtcacaaataaccgtgtctgtctatgtgttctacaagtcatggtggctggacattattcacagtgacttgaggatgatgcaggcagctatgcagatgtttgtctttggagttctcaaatgcatagagaagccgtgggctctcaggagcgctagcattaacatgcttgttagctctaatagcctcattacaaagatagaaaagagcaatgaagaaggggatagaattgatatttctcttgagtcctatgtggaagaagcgaggaaatttgtcttgaatccttctgatgttgacggtaatagatgccactttaagccctatatgctatttgttgatctttcattgccatattctcttcggcttagtatcctcaaaaccttgtggatacgtgatgatgtgcatttattgttgcaagaagaactcgcgcacacttttcaccgactctacactaaattgagaacgttagtaccagatcatcatgtcgtgtggagtacggattggaaaaatattccaaaaagtccaagatcgatccgatcggttctcgagagtattcaaggattttacggatattgggtttgttcttcctgtttgaagcctccggaatcttcctcctaagtcataaagaagtttataagagcaatgatatcaaggttacatatgtactcctgtgttgcacaacaatgatt

SEQ ID NO: 54594 - DNA, 6227 bp, Oryza sativa
cgaagatgtgggaggtgatcgagggcgtgtgggtagagatgctatgcttctctgcatctagatgcagagggtacctacatgcgaagagtctgggtaatggcggagagttgctcacctttgtatggctcctgttgttacaaatggggatggagcccctagcagagaagctgcagagggcagagattccaaaaagaggaggaaacggagccgctagtgctgcttcattgtcttctgataagagcttggcactacagcgaaagaagactgaggttccaagtggagatgaaggaaatattgccgatgtgccatcgacttccaatgacagtatagtcattgatattggagacaatgcttcttgacacccatatttttaatatcttgttttgtatatttccttttttatgctgcatattgtttagtaattttgtttcatgtgttgttgctaacaaataaatctatgtaatgtcgtgtgatttttgttataattctaccattgcaacaatttaatcttgtgagtgcaatttttacatttgattgattatccttttgtgtcattgcccaaaagattacaactccactggtattttatataataataccaagcccgtttttcgaatgtgctcatatgaatagtgtatgtgcgtacttacagtgatgagtgtgcacacgttatgagcgcatacgtttgtagtattgatttatgtgaaccgtggatcttttgtacggactcgcgtgtcccctacagaagaaaactactactcccactaggagataattacttgataagaagcgcgcctcgtgccgtgagtggcgtagcgcatcgcacgggccatctgtcttgggggcacgcagcgtgaaggcgtggaggcgtgtggggtgggtggtggcggtcgacatggcgagggcacgcgtgtgtagcatattttagctgtgcgccattgtgccatatcccgtatgtgcgttaggcatgcgagagcgaggtttggcatcatgcgagccttgggcctggcaccatgacagaggtggattgcttgctaggccttgcctctatcggctgggctggccttggttgagggctagggggtagttagcgggatggcattgtttggttggggaataagttcattttaggtctctttatttgtctccgaattcgaaatttatatctagaccgtaaaaccggatacaacacatcccctaagttacaaaaccgtgcaaaagagatccctcagcagtattgtcccctactttgactgacgtggcgtctacgtggctcttttgactagtcttcgtcctacatggcattgacgtgacgcttacgtgacaattcgatccggaaaaataatagaacttgtggggtgcaatatcagtttcacacaaaaaataataaaaaatggtgaggtccatgtgagcccacatatcatcctcacaactccttatctctcgacgagaaggtttttccccaaatcggttcaccgtagttcgccattgatgccgccaatgggtctcgtaatagcggaaggtaatggccctatttctcctctcctctcttcctttcatcatgccgctcccaatcactaccaagccgaaccccctccgccgtgccgtgcacctgactcgattccaggacggaggctacgccatcgcagcgaggtgctcgccgacccgctgtctctcgtagactggaatcgcacgcacgcatgcggaatttaattatcagtttttgtgaaacaacatcactctctttttgtctcttctacaagcaatcccgaacaggtggagtgattcgttcagaaaacactcacccgtagatcgaagaacagccacgcaccgtgtaaatgacgtggatctggccactggtcaatcaacagcagcagctgtgatcgtgctccaccctgtcaaaacgagccactaaccatcccaatccagagagccggagagcagacgcgctgcagcaaccggcggcgattcggggagtaagggtcggggatcggggaaaactcgggtggtggtacggtgctggtgagcatgacacatgggcccatggtttttattattttacaaatcaaattactacgtaagcgtcacatcaataccacttgagacgaagtcctaatcaaaattcaaaagagctgcataggtaccacgtcaaccaacactagggataatactgccgtgaaatgagaattgagaggagaggaagtgagaagataaggatgacttgaaattgttttgaagatgatgagagggaaagagaagggcagtcagacttgtaggcaacctttaagaggcaagtttgcgaaaatcaattttctcatgcggtcgcttaagaggctagctgcaaaaatcaacttattttcacatgagggcctgttagtaggcctgcttgcgaaaatatattttttttacacaggtcttctaaggagccgtatgaaaaaatgtaggccgatttttgcatacggctcaaatcgatttttataaaccctaaccctaaaccctaaacccatacggatagacggtcttgcactcaaaagtttgtaaaaatggggatttttgcgtgtggccaatgcaaccgcatgcgaggatccaatttttacatgcgggcgcttaagctgaccgcatacaaaataaaaaaaatcgcaaaaataaaaaattccaagaatcgtaaaatacaccgccgccaccgtcctcgtcctctagtcgctgccggtgtccacgttgtcctccatcgcaagtgtaggcgcaggcggcgacagtggcaactcctgtgctggcgacgcccgacctatcggcggcggcggcggcggtgatgatgccgccgcaatcgccgcctccgaaccccgaggaggagacgctcctggcggattactaccggctcgcgacggtctagctacctgtcgtcagcgggggcggccgggttaatcgtgccggtggtggtgcagcccggctaagggtccgccgcgaagaagtggcggccacggtcgtcggagctggtgcgggtgtcctcgctgagcgtgcaggaccagatctacttccgcaacctggtgcgccaggcgcgcatcacgttcgagttactccgcgggatcctgctgcgggacgacgagcgcgcggaggtgctcggcctcacgggcgtcgccgggttcggcgccgccgcgtccgcgccgacctgcgtgccgcggtactgatgggggaccgagacctgtggctcaaccgcgactgccgaatcgtggggccgttcccgaggatctcggttggggacgccttcttcttccgcatggagctttgcgtgctatagggctacacggccaggtgcaggcttggattgactttgtcaaggctaggcagtcttcctcaggggaacccatagccacatctatcatcgtgtccggtggttatgaagatgatgacgatcgcggcgatgtacttgtatacactggacatggtggccgtggccccaacctccacaagcattgcgttgatcagaagtttgagggtggcaaccttgccctcgagcgtatagcatggcccctatggtattgagattcgcgtgatctgtgctgtcggcaaggtatacttctatgatggcctctataaggttgtttttggccttctttcccgatgcttcttcctttttaagaagaagtaaaattaacgcggtgcaccctgataacatctttgcatgctagtggctgttttgttttagtaaaataaaatgcttgtttttttaaataaaatcggtacatgttcatgtaccatcctaaccaaacacttaaattagcaagattagcctcgtttattcttttggccttggctcgcacgcacgcaggcacgaacattttgtgaatggttccgcacaggctattcctttgcatttaaacaaaagtaaaggattttgatatcatttatatgatgtcatttaaacaaaaataaattgtgcttatgcgcttcgcaaagcttcatgacatggaaaccatcagtttcatgcaatttggcacatgtgcgtgcactggtggagaaaagatttttactcccggttgggaaccttctatagtcccggttttccaaccgggagtaacaatccgggactaaagacgctatctttagtctcggttcaaatacctgggactaaagatcgatttttagtctcggttgatgttacaacctgggactaaagatgtggtcccggttgaaggtttttttttcttttttttcttttctctcttcctttttcactgttcttttcctattttcccaaatcatctcagatcaaacattcacagcacacaacaatatagttcatccaaatcattcacagcaatagttcatcccaaatcattcacataatagttcatccccaaatcattcacaacaacaacacaaatcaaatcacacattcaacacagatcgtatcaatcaacacacagattgaatctcacattaagaaaaaaaggaaaaaaaatccacggcagcgccggcctccaccgcctgccgccgcactggacgccgccgggcgcctcccccttcagatccggcagtggccggccgcctcccctctggatccgccgccgctcggctgccgcggcgcgagggccccgccgccgcctggctggccgccgcggcgcgaggctgcctccgcctccgcccggccgccgccgccgcttggccgctgacggaaaagaggggaggaatagaacagggagaggaggaggaggaagagataaagaatataatttattaactcctcgatctcgcgcacgcctcgtcctctccgccacgcatgccgatattttgttccggtttaggctaccaaccgggactaaaaataatagagatattttttctcggttgtcgttaccaaccggaactaaaaatagatctttagtcccggtaaaaccgggactattgtggattttgactgaccgatcaaagatggtttctccaccagtggtggatgtagcaaaaactgatggtttacatgacaaataaagatgtattatggtaaacctttttgtgaagtttgttttcctctatttgaataaatatgaattgtttctaagattgatgaattttttaaaaaattaactcagaaatgtaattcaagtttgattccctttgtactaagaacttagccatcttatcttttacctcctgaattattggatgtaattatttttctaatacatattataaataatgtgcattgcagttatatggttactgtaattttttttattgtttatttcattctattctgagcaaaacatgtattccgtagcgtttagaacgggcggattacttgtataacccaaggcagaaaagccaaatttgagtcatctgcgtcgacggagatgactcaatgccaggttcgttcttgggcccgtcccctacttcacatcgatgcatgcatcatctctgtttcacactggaccttgacatattggtcttgctagctgctgcctctgatatgatcgacctcttatgccatttccaacccgatgaccagaatggtgtccatagtattaaataagctgccacctaagatgaaaaaaatgatatggtaaagtgaataaatgaggaaagagaaggaaaccatattttgcatgagacatggtttctacacaatatccaagacatgatgtgagataagtagcattaaatttaagtatgaaatagtggtatttgcattggaagagtagtgtctagtactagtttcttgatgatgtggagtctatgaaaaggaaaaagtacgaattacccccccccgaactatcacagtcatccgaattaccaccctaaaccacaaaaccggacatttttcacccccaactatgcaaaccggacgaattacccccctcgacccaatccgcggtggttttggtctacgtggcgtacgcgtggcagcccagtcagcattttatttttttaaaaaatgtgggacccacctgtcatagactcatagtctctcatctctctctcctctcactctctgtctctctcactcatcctctctcgcgcgcacaggacaagcggcagcggcggcgcacacggcgggcagcggcgcgggtcaagcggcagcagcggtgcacacggctggcggcggcgcgggacgagcggtcggcaggggcgcgcgggtcaaacgggagcggcggcgcgcacggcggggggcggcgtgggacggccggtgggcaggggtgggcaggcgtgcggtcggcgcatacggcggcgct

SEQ ID NO: 54595 - DNA, 2723 bp, Oryza sativa
gtcaccgcccatccttgagccgccatgagcgccgccatccgcaccgttcgcgtcgaccgccctcctgcctgtccctgcataccgcccgtctcgtgccaccgcgcgccgtgcgcgcacccctgcccaccgcccatcccgcgccgtcccgcgccgccgctgccgcttgtcctgcgcgcgagagagaggatgagtgagagagacagagtgagagatgagagactatgacaggtgggtcccacatttttaaaaaaaataaaatgctgattgggctgccacgcgtacgccacatagaccaaaaccaccgcggattgggtcgagcggggtaattcgtccggtttgcataatggagggtgaagaatatccggttttgtggtttaggggggtaattcggacgaccgcaatagttcgggggggtaattcgtactttttcctttatgaaaactatgtctagtgtattgggttaggaatgaccttagacgcttcaacgtattcctccaacagccacgctgacctccacgtcgatcggctgtttgcattaattgcagcagcacgtggttccgattctcctctacgaggcggccggtggcagcttacggtgagcggaggcggtcgcagtccattgcccattggtgatgcacgggcgcgcgtcaattcgcgttatggacaggggcggataaaaaaataatagtggggctaaacaaactaggagagccttcagctcccatatcttttggatctataaaaataatttatttttaatgggggcttaaggggagtctctgtggtcccagtaacagtagtgggtctcaagaccactccgttcccacgttaaatctgccacggattatggataccttgtgcggttttctacaatttactttaaactattttctcctaactagtaatcgactcatgtgtattgatctcatgttctcatctcggtgcgtgtgtatatatacaactcttttttggtaagtgtaacatcctgaaaattcaagacaataaaaaaaatcactaaaatttcaaactttttaaaaacttttgcatcatgctggttgttatgattcctattgcttgccaaaccgtaaatgatcaccaagaaggtaaagaaaagaactacatttaagcaatagatatgatttatgagaatatatttaatcctacgaataattatgtgcaagatattaaaatcaaataaaataaaagttattattaacctattttatcaaatattaaaatatttgaataatataggtgggtgccataatacaagtacacatgaaatgatgatcattcaaatgaactgagctctctgtatatataatagaattacggaagtatttaattcgatatgtagatcgattttgcaccaagttcctaattgcatttagggattgaaatttgatatattaaacccctccatataaaataaactaacatatagataaattgagctaatgtgctattatgttaataacggtctcattagaaaaaattatagaatctttaataaaccttaaaaacaaattggtaaaataaatataaattaaaaataaaagattaggtacggatagtaataaataaaatattatcgcgaccatatttggatcaattaaatttaattgcgatagaataagaatttaccctaattaaaactcaaataaattatataaacaaaatatgagtgatatcaaattaaggagaattttagttaggataacacaaatatgggataaacttcatttatacaagatttagaaattatgaaattaaatttatatgggaaataaactaaaatcgggttaattagaaaacggcactattcattgccccctaggtgttcgatcgcgttccctagccctagcccctcctctgccgcgtgcccccgcgccccgcgcgccgcgcgccgctctgcctctcctctgtcgtcgccatcaccgcgcgtgccgccgccgcctgccgccgcgccgacgtcgccgagccaccccgagcccgcgccgacatcaccacccctaggccgcgcgtgctgccgagccgtcgccgtcatcgcctcgcgccccgtgccgcgccgctcccccgagccccgtgccgccgctgctaccgcgccgcgccgcccgttccatcgcctcgccgcctgtcgccatcgccatctcatcgccgctgccgcgccgtcaccatcgcatccctcctcgtgccgcgcgccaccgctgccgccccgtcaccacccgtcccgtcgccgcgcgcgtcccctcgtcgctccgagccgcgcgccgccgctgccaagccgtccccatcgccatcccgctgccgcaccgctcgcccgtcgcgtcgccgtcgtcgccacaccgagccccgtgccgagccgcgccgagccccgcgccgcgccgcccgctcgtcgccatcaccggccgccgcgcgcccgtcccgttgccacgccatccgacgcatagccgtcaccgcgcatcgccgtcccgcgtcgcgtcgcccgcccattccatcgccgcgcgactgtcccgtcgccacgccgcgcgcctatcgtatcgccgctgtcgccccgtcccgtcgccttgcgccccgcgcgccgtctcgcgccccgctcgccatcgcgtcgccgcctcgcgccccgcgccgctgccgcatcgcgtcatcatcgcgtcgccatcgccgtcacaccgagccgcgcgccgccccaagccccgccgcttctcccctctctacaaata

SEQ ID NO: 54596 - DNA, 5402 bp, Oryza sativa
ccccccctctctgtccattctcccccaccccatatcacctttcctcccctctcccctttccattgagccgccgcctccacgtcgccgcgccgccaccttcgaagccgccgcgccgtcgccccggagccgccgcgccgtgcgtcgccgccttgcgccgccgtcgccatcgtcaccaccaccgccgccgccggtgagccgtcttccccccccccccttcacctcgcggccaacgccgtcaccgcccggggaggcaaagagccgagagagaaagagagaaaccgagggagggaaaggagaggaagggagaaagaagccgggagggaggagagaaagaaaagaaaagggaaaggggagaaaagaaagaaaagaaaagaaaagaaagaaaagaaaagaaaagaggaaaagaaaagagaggagaggaaaaaggaaagaaaagaaaagagaagaaaagaaaagagagagagagagggaaaagaaaagggaaaaatttagggggaaatttaaaatatttgcaaatattagaaattaattataggattaatgaaaatataattagatgaaatcttactaattaaatacctagaatactagcatttaattataggatcaattatttaagaactaaacaattagatgaattcttatagactattatagattattttgggtaatctctataagtaattgagtcacgatggaaattcggatttaatttctaggaatcttagccgtgtattatatttaatcgtttagtcatagactaaattaaattgtataatatttctaggatttcgtccaatatttagctcataatagaaatttctaacctattatatacaatgctcggggagagtaaattattgacaacgaaataattatacccgcaaaatagtataaatcgaaattgggtttgccgtagttcgcagatagtaaagttaataaaaaggaatcgactttcgcattcgacttattagttatttaaatagagttagccttataattattaggtaagtagaatatagatacacatagatcggtcctaagctttttatggcaaataataacagagctagtgtgattaaatcatctatatgaaattaatcaacgacatatcccatataatagcatatggtaggagaggtgagcaacccttagttaaccaagcagtaaatagaaactattcaaataaatgattcaatatattaagatattgtgcacacatatattgtacatcccattatagatatatggtatcgtattaatttgcttgttgcatatattaatttagagggagtatatgacaaacatgaatattagataaatactagttatacatcttgtcctcgtataattacagatcaactgtaaatttggattattcattgtaaaattatgtgatgggataatccgtaaccataatatgattgacctaaacgattctaacatacaaagcatgggtaattgctaaccttttataatttattttgacaagtgaaatatgtacataattaaaataaagcctccatcaataaaataaataatacaaatgattcactgtaattgtttgattgatcctaaatccatctagcaacagaacctctagtatataaccgttctatttagatagatacatacatagccaaaatccttccatagccatttgatagactaaaccactgattagccaaatatatacgtatcccataaatgctatgttggttaactcctaaataggccacgatgacaatagaaagattaggaaactttagccttagcatgattgggatccattagcaaacacgaatagtgcattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaaggcaagtcatcactattctttgaacatgttgatcctaattgcgaaattgttttgtttacaaataaaattgcatgcaatgatgaacgtcctacttgtgattatgccatgccttgattattgtttacccttaaaatccttgtacccatgattacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaacggttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgagacatgtgcgctacgatgggacagccgttgaggtagggccaagaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgatggagccacttcccgagaggagggaaggtggacatcctcagaaaaccatgacgaatcaatggcgggaagctatccttgggatcacaatggatggtggacagaaccgtcgttgtttaaagtgaacactggtactaaaatttgatcagtctatgctaggttttaggcttgtgaaaagaattgtaaaattagctttatgcaaaagaacctgaagccattccttgaaataccctctatcatatgcattgttattgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcttgtggcatgttaaccgggcccttatattattttgtcttccgctgttgttctctgatagttgttggcctacctggccctaatgtaagtatttaactcttttagcctaaattcattcgtgatatgttgtgatccaactatgtatgtgtgtaccaactactgatccagggattggtacggataaacacagaagatttccgatttccaaaatcgggggtctacagtaagagttgacacaaatttgtaagagactgttttaacaatgaccttgttatttctaacacaaagtcggcgtgggggcagtttgtcaagtcaagaaaaaaaaatatatcatggaccccatgctggcgtatccaccctagctggcttacacacatgtataaacaaattgtccattaactagtgttagatgaacatgacatatatgtatgttaagacttgaacaagtccacaagagcacagtcaaggaaaatatatgattacaagttaatttcctgtatgataaaatgttgccgctgttaccggtcgcacttaattagttatatactactacgtatgtgcttatatatattggatacgcgggggagtttcaaatcactcaaatccacctctgatctctcgcttggtccgcatttgtgtgtaagtgagtagatagagagagagagagaatgggtgtctcaggtgttcttgaatggtggcaggagtggcagctgcgcaccctggtccttagcagcacagccattcaactgctccattacctctttgctaacaggcgtaagcatgccacttcttcccagttcagaaccataatatggctttcttaccttggcagtgacgctatagctatatatgctctcgctaccctattcaaccgtcacaagaaccaagattccacatctagctccaccgcacaaggcagtagaatcctcgaggtggtatgggctcccatcctcctaatccaccttggtgggcaggattctataaccgcatacaacatcgaagacaacgaactctggaagaggaatgtcgtcaccatggtgtcccaggtaaccgtgtctatctatgtcttttgtaagtcatggccaggcggcgacaagagattgttgcaggcagctattctcctgtttgttcccggagtcctgaaatgcattgagaagccttgggctctcaggagtgctagcattaacagcctagttagctccgatgaccttgttccaaggacaggaaagggcaatgaacaagggggtagtatttctcttgagtcctacgtggaagaagtaaggaaatttgtcataggaaacgtgatccttttgaagttaatgttaatgcaagcgactgttggagacaaccatgagccctataagctattcgtagatctctcacttccatactctatacggcttcttgacctgaaatcatggtggaaaatgacgcaattaatttgacgcatatatccagttgacaaaaaagctcaccgaaacgttttatcgtctctacactaaatcaaagatgctcgacaaacaacaaaatagatacttacttacaggctttctacgggtagtatctgtttacctaccgtttgcagcaattggcttatttcacaatagtcatagacaagcttataacagatatgacataaaggttacatatacaatcttgtgttgtactgcttttgtcgaggcatttgccgcacatggttggaacactcctatgatggataatgttctgccatggttttacaaggtttcccagtgtaggttaataggttcctatgctggtggtagcaccaagtcatgtgactcagttgtcgacattatagaactggtactgcaacatttaaaatctgggtggaaggattgcataacagattttccctcttatagggcgtttagtgatcataggggtcaatgggcgcttcggcgcaacaactgtgaccaagaagacctggcttggagtcttagagtaccatttgatgaaagtgtccttctctggcacctcgccacagatttctgctt

SEQ ID NO: 54597 - DNA, 14570 bp, Oryza sativa
aaaagaataacagaaacgctacttgagtttgatttaggacctgtttagtaaagttttcacttatcccgtagagctggagttatacaactcgggtattctactcctaaaaattacatataaacataaagcgacattcttttcctccaactttaaaataggagatgtactaaatggaccttaaaaccttcctcccgccacgagccacgcaccacatggcgtagcatatactatgcgtatgtttgggggagctttgtagcagttgtatcttctctcagaatcaaaagctttcccaaacagtccagcttttcaagctacttctctcagtctcaagcttttatatagctgtgcggctgtgttgggcatgtgagtgcgagggtgtggcatcatgcaagccttgggcttggcacacgacgcaaggctaagttcactctaggtccctcaatttgtcaccgagttcgaaattcatccctgaaccgaaaaaccggatataatgtatcctccaacttacaaaactgtgcaaacaacgtcccttggtggtattatcccctggtttttgctgacgtggcacatggctcctttgactaggtattcatcccgcatgacattggcgtggcgctcacgtggcagtttggtgtaaaaaaaatgaaaactaaaaaagtaaacaaatatgcgggacccacaattcagttaaacaaagaaaataaaacagtgggacccacatgtcagtggccccactttcctccatctcaccctgagatctctctaactggaggaggagacgaggaggctgaggccgtaggcctctctgccacctcgtcggccaccgcgcgccacttgtctctccttccgattgccgtgtgccgttcttctatcccgtcggccactgcgagccactcctttctcccttgaccaccgtgcgtcgtttctctctccctgccgcgccgcgcgccgttctcctctctcccgttggccgccgcgcgccgctcctctctccccgccacgccacgcgacgttctcctctctcccgacggccgccggacgccgctcctctctccccgctgcacaccgcgggccgttcttctctctcccgtgagccgcctctcatcgctcctctctccctccggccaccgtgaccacaagtcgctcctctcgccgcttctctctccccgccgtgtcacgcgtcattcctctctatcccatcggccaccacgtgccattcctctctctcgccgtgcgctgctcctctccctcacctgtgtcgtgtgccgctcctctctcctgccgaccaccgcgcaccgctcctctctccccgccacgccgtgctccgttcttcaatcctgtcggtcgccacgggccgcttctctctccctcaggcggccgtgcgctgttcgtctcactctcgccggctgccactcgtcgctcctctcccccatcggtcgccgctcctctcttccgccgatcaccgcgtgccactcctctcctctctgcctgcaagttcgggcgcccttcccgcaacccgtcgctggtcgccggccgcctgctgagattggaaaaaggaggaagagagagataggtgcggagagatgtgaagaaacgctgacatgtggggcccacgctgactcatcgatgtaaactcgggtcaaattgccacgtaggataaaaccactcaccatactgccttaggacttatattgtgccggttttgacagttgagggaccgttatgtctggttttctggttcagggacaaaaattagatttgttgtctagttaagggacctaaaataaacttattccccagcgtgcaatgtgagcagctcaggctgggccgaggtgcattgtttggtgatgccttcctcggctaggcctgccttagttgtgggctaggaggtagcggcctggcctgcttggttggctaggccattcggcctgctttggctcggccgtctagatcggtcttcgtgcccaggtgagcctgctttggtttaaggaaaaagtacaccgaaggtccctcaacttgtcagcgagttacaaaatcatccttgaaccgtaaaaccggataggacgtatccctcaacttataaaaccagtgtaaactatgtccctcggcggttttgacgactcagcgtgagacccacgtcagccttttttcccctcccctctccacctctcttcctctctcctctcttctccaatctccacgggcggcggcgagggagcagctgcacgggcagcggggggaggagccacgcgcgggcagtggtcggcgggtgcaggcggcgggggaggagctgcacgggcggaagacgacggccatggtgcacgccgacacacccaccgcctgctcctcatacgccacgaaggcgtgggagatgtgcttgaactgcatctccgtgtggctgcgcccgtggacggaggcgtcataggaggacgatgacgacgtggatgcgttgatgaggaggagcgcggaggagcggccaacgaactcgatgaggtggagggcgtggacgccgacgggcgaccggctggacggcgtcaccacgtcgtggagcgtcagtagcgcaggcacgtaggccaggatgcggagctccgattccgggtgagcccacgccaccgtgcaccgcttgtagaacacgaggcgcccaccatcgccgtgaatccgtgatcagcgattcagtgtcgacacgaacaccagcactgtgaacgactggtaactcatgctctacacaacacaagcagctacctagccttaattaatcacgacatgcatcgcatggcgatcgattaagtaattaactaatggattaccccattgttccttgcaatgttgaggatgacgagctcgatgatccccttggtgttgagcagcagcccgatggatgtgccgtcactgaacggcatgccgaacacaccggcgacgccgacagcggcggtagccttcaagaccgcagagaccatggcggcgaccatgagtagcacggcagaatgcatgctggtgatatcccaaccatgaacaggtccttgttccccatagcctccacgctctgtatctccaccaccatctcgctcgcgttgaacacgtcgcgctccctgtactccaccgtcgcaccgtcgccctcgttcgccctctccaggaagtcacgcaggcacccctcgtcgcctcatcggccttccgctctttcagcgctttggaggagctcgtgcaccgccgcccagctgctcccccgccggcttccgcccgtgcagctgctccccacgccgcctgcgtccgccggccgctgcccgtgcagctgctcccccgccgcctcccatggagatcggagaagagaggagagcggaagagaggtggagaggggagagaagagattgacacaaggggtccacgtgggtactatgctgagtcaggtgccacataggacaaaaccagagtcaaaaccaccgagtgacctagtttgcttgattttgtaagttgatggatacgtcatatccggttagttcaaggacgattttgtaactcgatgataagttgagggaccttcggtgtactttttccttggtttaaggcctgagtagtattagagggtctaggttttattgggccttgtgtttgggccaggtcgacctaggaggagtgaagaaatttttataacaggtttgagaattctgaaaatactccctctgttagacatattccatattttggtttttccaaccaagttagttatatttgtagtttttgtgtataagatataaattaaatgtttaatcgaaacttgaggagctatcttaatactcattagttgcatatgtatgcatacacttcttgatcattgttacggtcccgtttcacacagctccagctccaaactctaacttacctagagctggagttgtgccaaacggtatagattgtctattttttcggagcggagtcagcagagctgctccattaatttgtactacgggggtggagctaggtttttgctgctccacagctccactccacctcaaaagacctagcaccctttttttaagtgtatttacaccaaaataccactgaactaccccttcctaccccatctcctcatgttctctctcctcctcatcttcttcccctcttcttccattctcttctcccatcagccaccggcgacaggatgcggcggtggcaagcagcgcatggttggcggcggcaacgacgtctacagggcgatggcacgcgcattcagaggaggtggccggttgagcgatgggcggtggcactggcggcgacagcgcacaggctaacgtgcggcggcggagggttgagcgacgggcgccgtcgccgtcggtgcgcaggctgacctacggcggcggttggtggagtgacgggcgccgacgccgcgcgggctaacctgcggctgtggtgggtggattgacgggcgctggcgccggtgacacgcggcggacctgcggcagcggcgacaggcaggctgaccggcggttgcggctgcagggcgatgcacttgctaagcgacaacggcaggaccacgtcaacaaggtgttcgataaaatggcgacgaataacgtggtggagtggagctgaccagtgtaaccaaacactttcatacgcaactcagctcctataggagacagctctcactggagttgaagttgggaattaggagttagagtttggagcccaccaactaatatgagttaatatggctaattctccttggccttcgtgataaaaataatatgttaattctcgcggatggagggtgtactttgcacttttcggaacacagtactcctttccgttttaaactacttgtctgtggtagatttgtccaagatttgacatgtctatatttagccactattttagaaatccatataattttaagaacatgtgaattatgtactactcccctgttccaaaaatacgatgatttctaggattaaaatcttattccactgtagaagcaaatggcgattggactcgatggcggttcggctgaaccacactagtggttcggccgaacccaaaagcccacctctcgggctatcctttggttgagaagcttcttattgcgcctccaacattatgtactatgttttggctcaattataagttgttttgattgacatatgggtcctccaattcgtgtaatcgcgtcctgattttctagaggtgtattttatcgcatgacgggtgattttcatccataaaatacctgcatacacatatttcaccaacactattaaaaatgattagtaataatccctaccactaagttgaataccatattttatttcattatgtgcagacattgaatgtcagatattattatttgaggaccgtcaaaatacagtaaaatttaattgacttttatttattatagtagaactagaatgaatcactagttttgaaaaaataagtacttaaaactaaatgtgtatagacaaaatggtcaacatacttaagttgttggattacttattaattaattgtgccaaaatcacacccagctcacttattaagttcatatactaaattgcaccctattatactagcacactcacttcttgagctcttacactaaattatggcccacctaccaatatatatagtgtaaatgcaatttatactccttatttctatctattattattatatactaaaagtccatcaaacttcctaaaaacactcttgagtcgccatgtggcacttctattaaaagtccattaaacttcctaaaaacgctcttgagtcaccatgtggtacttctacaaacgctcctagatcgctgtaatgccccgattttcgttcgagattaaaaatcattaaataatacatttcctagaaattaaataaaaatttaatcaatttaatcaagtaaaattatagagggaatttaaaattttcccttaaaaatcatggccgagaatattttgtaatattctctgtgctctaaaatactctccggatttttccacgaattttcggagctcaagaaatttaaaagtcacaaagttcatttaatcaattaaaataaatagaaaaccaagttaaatctccccttcctccttgggccattttcggcccaagatcttctccccctccttggcccgctcgcccctctctccttcccacctcccaggccaggccgtcctcccctcctccctcctctttgggccgctcggcctgttcgccctctctcccttgaagtctgcatcgcgtcccccaaccagtctcctctctctctctctctacctgacaggtgggacccaaggccccacctgtcaattcctccttccacctccagccggccagcaactgccattgttgccgacgccactccaccaccaaatccatgccattctttcccgttttctctggtcaaacgtgtggaaccgcatcctctccactccctccaccatttcccccacttttccccaatttttggcgccaaattgaacccctctactccccgcttcgcccacgtcgtcgtcacccacgtcgccggccgttgccgcctcgtcccggcctcctcgccacctcctcaccctataaaaacaatccccatgcctccctctctcttttccccttttttcccgagccctccgcatcctccctcgctctttccgcgccgagcccgtgcgccactgcattccgacgagctccggccgcctctagccaccactcccgtcgctgccgcactgcgccgccggccccaatagcttcgctgcgtcgtgccgcaccccgtccaccgctccccttcccaatccattgtcgaagtctaccccggcagccgctccattttccccaatagccaccggaaagccgccccaccgcaccaccaacctccgccgctcgccggcgtcgttcagccgcccaccgccgccgttcccgtcgccgtcgcgctgccccgccaccgccgtcggcaccgctgcgccaagctccacctcggcctccactatttccccattccagtgccggagctccgcttccaccaccaacccgagatcgccgtcgtgtttgctgtctccagctgtgtcgagccgcctccccggtcaacgtcgacctgcgtcgtcgccttccccggcaccacagtcctcatgtgtagctcggccacccctctgcctcttcgaatcgtcgccggaaccgggttcccttcccgcgccggtgagctccactaatttccccgatcttcggccggctttccgcgcctcctattcctcccctagtccctcctccttgttccccaggttccgtcggtcctcggccgcgcctccgctgtggtcgggagtcgccggagcgccgcctcgcctccatcatggggagcccgccgccgccggccgtcggccgtcgccatgccccatggcggccgctccttgtcggtgccagctcggtgagcaccctcctccctcctccttgccccctccccttcaccgctccccgcgccgcccgccggtcgccgtcgctggtggcctcgcgtgccgtcggtccaaggctcagctcctcgtcgcgcccgtgctttggccgctcgtggaccactcctgtggtccgggtccacggtgccgctaggccgcggtggaccgagtccaccgtgcgccctccccctttgacccgctgacgtgtggggcccgcctgtcggcgctggttcaccttgctgacgtcagcgaatgccttttcctttgagaaaataattaataaatgcgtcatagaccgataatagttatagaaattcaattaaatggctcaaaacttctaaaatttatatctaattcatccgaactccaaattgagccattcaacttgcaaaattcatctaaaattgagctctacatatttgtttacttttatatactatttccttggtttttattagtgtttttcctcgttttgcatgccagcgtgtagtttccgtcgtttcagaagtccgcggttgtgaggataagagttcggaagattgttcgaagaagcaaggcaagtcacacattccccttgagcattttgatcctactttacaaatgttttaccgtttgcaaataaatatgcatgttttgctaattacatgggatcagaatttacctatctgctcgcttgtgccatgtttacttgttatctgtcccttgtcaaccttgggtgataaatcgactagctcatgttacttatgtgacacagctagaactatatgctcagccatgcttaattgccactagctcagtagatgggataattgcagtattagacctttttagtatcagaacgagctgcgtgctcgagacatccggctatgtttcatggccgtaattatccaactaaaatgcgattgaatggtgggctgtgggtgcatggttttgcgagtcgcacccatggcaattaaggaccggctcatgggaaaccctggaagactaacagtgcttaccacaagcgggagtgggtaactacttgatctgaagtatagctcgaccctttcctaggcaccggtggcgagggtgggcgtgatggagttgggtcggccggggtgtccggttgtccagctgccgaattcaccgcggcgcatgaggggactacccgttgccttgcgaggagtgggggtgaaaccttagcgtggtgtggatggttaggggagagttatatgaaggatcttgtcacaatcactcgatgtggtgatgtgttcatcatgggcacatgatgacacggtgacatgccggtggattgtgttttgtgggtacagttgtgcacctctggctagagtaaaactattcgaatagccatacccgcggttatgggcgatcgaccagatttactgtgattagtctcacccctaataaatcgacccaatgcactgtagttcaggtgggttggttgggcctgttcaacgtggtgtagcgttgataagtgaagatctaatttactttaattaatcaactgttttactgttttgcttaataaaaatgttttacaaccgcctttatgcaaatagccacaaacccctctttgtgtccccttgcacgaatgcatagttggtgtggcttgctgagtacggtggttgtactcagccttgatattgtttcccccttttcagaagtgtagtgcttctgagctgaagacgaagttagaggaccaaggcttagaccccagttgagttttgcctgtggagtggagctgaagccccgctaagatcgcctttttccgctgctgctgctttcgtttcggtgtaaggactaagtgcctcttctgtaagtattttacgctttatttacgtttggaactgaatattacttgtcgttttgtataccctggctggttctggacagggatttaatacacaaaagtagtctggaaatttgggttaaatttatgggcatgacaatcgccacatagcattatctaatcttaccgtcgattttcatttaaattggtggcccctatatttttttaccattagattagatctgttattaaaaaaataatacattcctcccacacaagaaatatataactgtttgtactacgtacgattcaaaggaaaaaaaataaagcttacctactgtgccgcaagaaaaaacaaaaaccatatacatgtacttatatatacgatatatagaagaaaataaagccaaagaaacatatgtacgtgtactatcgttggaaagaaaatcgacgggatttcctacaatttttttaaaaataaaatatatctatctatctatctatctattatatactaaaagtccattaaactttctacaaacgctctcgaaccgtcacgtgatgcactaataaattagagaaattcctagaaattctaagaataaacaaaccaaatactatggggttccacctctcctcttctctcgggcatgtgtaggtatactaaaagtacattaaacttcctacaaacgctctcaagccgccacgtgacgctctaataaattagagaaaatcatagaaattctaagaataaacaaacaaaatactatggggtcccacatctcctcttctcccgcgcatgtgtaggtatacgtatgtacttacattcctcgcctcaaccgccgccggccatcgccatcaaccgccacggtgtcgtcatcctcctctatggtgtgtcgccgatctgtgtgctaggatggtgtgctaggatggtggatcgattcagatccgaaaaaaaggaaaaaatgaagtgggggcgagagtggttggttgggtacgggaaaataaaatatataccagaagtagagaagttgttttttattgaagtaaatcatttactccgataatggtggaagcacgatgcgggacgtggggtgggatcagaagcaggggagttgtttttattatcgaagtaaattgtttactctgacaatggtaggagtgggatgacgggacgtggggtggggtgggcctgggctgatgcatgtttggcgcttagaatattctatatttattatatatatatattataatagaaaaataaggtcaaagatatattttgtagaccgtgttattgtccaaaacttcaattagaatgaaaccggagggagtaagataatttccacttaaaccgtcatactcattactttgtactattattttcaaataatacactattttaaaataaagtttatacaattatattgtgtacctatcaaataaaaaatttaagatatatattaactaatttatacgtgcacttaaaccggtgaacccattatttaaatcatcggatcaatttttattacattggactatcattctcaaataatgtactgtttcaaaacaaagtctacgacattatattgtgtacccactaatttacacttacactataaccggtggacccattatttaaatcatcagatctattatttgctaataaataaagcgtccaaagttccctttttggcccgctgcacaatacacgtctgctcatttcccttttgcacacgtgacaaagcatcgtatctgaggcataaggtgatcacgaccgccgtagcactaccgctttgctacatgtcaaatcatatatggagatgataaattttgttaataacatgaaaagaaaattaaaggtgtgatgtagcgagagaagaattaagcaccgtgggttgtgttattaaaaaacttagctccatttaagccgaaccgatagttgattacagaataattataatgtattgtagtattgcgttatgtcgtattgaattttgtactatttgttcgtacaagtgaaagaaattattatattataaatgtgagcacaatattaacgaatatcactagaactcttataagacaagggagtttaagaccctctttttttcgactccatagtttggattttcatttgcacgctttccaagtttctaaatggtgtcttttttaaacaacattttaacttttagaagtcaattcattcgtttataccctcaaatagctatcatgtaaatcagataattcatcaatttcaattgtcctagaccctaagtagtacatatttttttcatgcgagtcatggtgaacagtaaattggggatcaacggatacccaaaatcataagatgagtatgtaagagctactatgaacaactgtaaataggtgccaaaattaattgcgattaattagatatctaatggcttgctagccatatactacctccgtcccaaaataagtgcagccataagtttccgcgcccaactttgaccgtccgttttatttgaattttttttataattagcacttttgttgttataagatgataaaacatggatagtactttactcgtaacttatgtctttaatttttttcaaaaaaattttaaataagacgaatggtcaaagttgggcgctgaaaaccatggctgcacttattttgggacggaggtagtaattaatttctctctacattcatgtatataaacattgacgaagctagaataaatattaccatatgccccacatatatatattacgcatttaatattctaattacatgtgttaagtcctttaaaatttcttaaaatactctccgtggtgctctaataaattagagcaaatattaaaaattctattgaaaaaagcaaagtatatattacttaaatcggtacgcctaatattataaaccgttagattaaattgatcttagaaaaaactaaatactacgaggtcacacctctcctctcacggcataggtgcgcacctacatacgtgggtacatacacttcccctcccttttttcattttcccatttgttctttctttttcttttttcattcatacacttcctttccttttttactatatcatgcgcctttatgagacgatttaattataagaattttgaatatattgctctcgcatttttcatttttggacatactacgcgatatgtatatggatggattgtatgatatataattaactagcaatttagtttgcctttaatctatttgacaaagttttttaacaaacaataatcttacctttcaataattaacaataatataagtgcccaagcatgcgcgcgggccaccttcctagttaactaaatgagaatattgaaatcctactattacgaggaagagccttataagagctgccaggaaacaaacatagactgtccacatcttgatagggataataattgcacttgtatgatttgccaaattttattagaggatttgactttataaattttaatttctaaatattaattgcatttatttgctttggtactggcaataaattaaagaaacaacaaaaatcatccgcagattaaaaaaagatttaaaactttaagttctccaactttaaattcacaactttgaggttgttaccttcctcttctagatctgcttccgtcgcggggcaacgcagacgccgaacagccacagctcgcacgcgatacggacagccagcccaagcgcgagcaacaactgatcccttgttggctttgttgcaaactgtcctactacacctccagagcaaggtaattagtatagagataatatgtagcatcattttctgatttgtagtatcataatatcggggtacaccataggatcgggataatattagattttacaaagtacatatttttatataaaatatataatatgtggtataaattaaagcatatataatattgattttgataaatttaattggtttttatgtaaacttaagcacatttgttcacagtatttttaattcaccatattttaaataatatttgatgggatcatagggatcgtagtatcggatactatctaagatttcttaaaatttgtaaaaatgaagattaagatcaagatactaaaaaattaggatatcagatgggatcatcattttggttttataggattgtagtatcataagatactagaatacggatagaagaatacggatagagatactaacaattttgctccagagatacagatatgctcaaattgattgcgtttctgacaattccgagactcaaatcaacccgagtcaggatctaactagtcatctccttcacctcgtccaattactccacgccaagctaggttcgttattaagcccgtacaccccatacttcccatccatccatcaatttatgtttcctggaccttgacatgtcgatcgctgctgcctccgaccttgacgcctcaacatacgcctccagcgtccttctcctcgtcacgtatgaggttcatcgtcttcaagctagcgtggcgacgagcttggccgcacaggcttggctcggattcagtagcggacgcagaatttcagcgagaggtacagagttactcaagcaaaagcattatccaatgagaaaaatatcaaagtgctaatatgtattattagcgcaaatagaaatcattattatatatagaaaaattataaaatagttaagggaaaatgataataatcttggaaaggataattacttacaaatgattgttttgatgacttaccggttaggtacatgtataccaaacatattaaatcacatttgtttgaaaaaaaaattggggtacaactgtacacccatctcctagtgtaggtacggccctgagcccattggtgatgatggatgggtgctcgtcatgtgcgggtgaaatgtataacatgagtaagactcatcccatacgcatccgcccatgtctctccaaagaaaaacaaggctcatccagaatcccttcaatcatcccatcccatccatccttttctctatcccaaccttccaatcaaatacaagtttatagttaaagcctcattctctttgcgacacgtgcggaatatcctccctcctgttctcatcaacagagaattgtgtttttttgatggcctggaaaaacctgtataataaattgtaatatgcttttctaaatcagtatcaccacttattattatatgaccactatctagcaattggtatattcttatttttctgtgcttaccattagccacaaactgaaagtatttggtattggaatcatcttccaacaagtcctttactttatcacgttggtaccacttaatctcctcatcttttagaagcatagctaatctattcaaaaactgctttaa

SEQ ID NO: 54598 - DNA, 17742 bp, Oryza sativa
  unsure (1)..(17742): unsure at all n locations
gctttaaatctaattcctcttgtgatagtaaatttattatcagtgtattaccataatatctacacaaataatagtggcaatcgttgtcgttgtaccaggttggtgatgggtggtaatagtggtgtggtggtggttgtggtaggtagtcaaggttacggataaaatatactctctatcttaggaatcatcagatatacggatacgttgtatcctcaagtataagaaagtatccatttgagttaaggaaatcagtgagttcttatggagatattctttaaggatgggaaatatcagagtactattcggaggggataaggaatgtatcatatcgtaaggggtccgttgtctctgtgttctggagagcaagatgatctgcggtataaacacatacctgtcagggttatggacccaccacataccatgtcctatacggaaacaacctgcggatataggagaagttacggataagaaaagacaagtagagttctacatggaaacgacaaggactactcggattgtatccatattaggtttccctagttctacttagacaaagggacacctatgggtataaatataataccccctaagaggagaggggggagccaccacaatcaacaatctacggaacaacaaaagccacaatgtacaagccagcatacgccaagacaagacgccggatatcgacttcagggataagcacggctagtcccctacggtgtctccggatactgtcaggagagacgaaagcgttatctctgatctcgccggatgccgattcgaggaggaaggctaccctgttgtcgactatgagtcagacctacagaccgccatgtgacaacagttagataggctatcccaaatattgtactggtgtgattatggtgaataagatcaataccggctttgcttaacaggatatagagttattacctgacaattcagggcccgaacctgtataaaaatcctcgtctatgtctcttttacctcagtctcgcgtataccctagtaccaacgatccccatactatgcaaataccggaatcgcgacatcaaacgtcgacagatttatattgaaaaaaagatttatgtgttggagacttcagtgcacaagcgttggttttcaggagaaaaattgcgtgttccagagtgctctatgtgtgtcgtgtgactcgtgtcccaacgagatcggaaccatcgtcatcaacaatttgatctcgcgagatcgaccaagcttcaggaaatcgtcgccgcagagaatcaacaatattcgctgcatacggaatcgatttgatatgagcctgttctggatcgggatcaatcagtgctccatcttccttcgtgcagagttgctgatcaagttctccgcccacgacatcggctggtatggctggtgcaaaagcatcagcagcccaggccgaacacgacgccgtgtccgagccgagcacagtgcaatgctacatactgcacggggactcgttcgagtacctatgcctttgtattactgtgttctaatcggagatgatcaacagagggtatttccctaatcacgtcacgtgcatatgcacacgcgtgcgagcatatgacgggtcatcatgctccacaagaccaacaaacaatcaagtctaagtttactgcatacatgtgtcttctgcagtgtgtagtagacactaacaaggtaattagtagattagattaatctaattaatctactaatttcatatatatatccggcatatatctacacaggtacgcaatattttatataaaatttatcgtacctatttttttagacttatacagcattgtcagatttataatttattatgtttacctagagcatgtttttatataatatctattgcgtgagtgtccccgatgttaaatcgactacggtctaacgctgggggcttgctctattctcttctgtatgaatcatgtttgtttacggtttacataatacctgatatttacatctgctcgttatatcctgataatactagaagatccatgcagtttttcgaatacatactcgatattatctgctatatgtcttgccttctagaaaatatttttcaggaacaattgagcactcgagtaggttgtggtcaagtacaccgcattatcgagaacgatctcgacgaatgcagagtcgtcgcgcccaacctgccaacgaagaccgacaacctatctcacagcaccggccatggctggactactcgagaaaaggttgttaacggataattcctcgcgaacgctgtcggcttgatcacccgacatgattgcgaacggacatccggatatgctacaagttgggtgtgtaagtcatgttggccacatgagatgcacatgtaataaaccaactatagcgcttccattgatgttcgagagatgattctactcactcgctggttctcgaaccagtacgtagcaaacttccattggtgttcgggagatgattctactcgctagctggttctcgaaccagtacgtagcaatctcctgcaccacaaacttccattggtgttcgggagatgattctactcgctcgctggttctcgaaccagtacgtagcaatctctcgcaccgcaaacttctattggtgttcaggagatgattctactcgctcgctggttctggaaccagtacgtagcaatctcccgcaccgcagcctccattggtgttcgagagatgattctactcgctcgctggttcgtgttcgagagatgattctacacgttcgctggtcctcgaaccagtacgtagcaatctcccgcaccgcaaacctccaatggtgttcgggagatgattctactcgctcgctggtcctcgaaccagtacgtagcaatctcccgcaccgcaaacctccattggtgttcgggagatgattctactcgctcgctggttctcgaaccagtacgtggcaatctctcgcaccgcaacttccattggtgttcgagagatgattctactcgctcgctggttcttgaaccagtacgtaggaatctcccgcaccgcaagctccattggtgttcgagagatgattgtactcgctcgctggtcctcgaaccagtacgtagcaatctctcgcaccgcaatctccattggtgttcgagatatgattctacacgttcgctggtcctcgaaccagtacgtagcaatctctcgcaccgcaatctccattggtgtttgagatatgattctacacgttcgctggtcctcgaaccagtacgtagcaatctctcacaccgcaacctcagatggtcgagatacgactacagcaataatgcagcggtcctcttaccacgacttcaaatgatcgagagacacctactcactggttctcaaccagtcaatcgtagcgatctctcgtacatttacttctagtggttgagttacgactactacctggttcttgaccagaggtgtagcgattctcccattacctctacttcaacaaagttgatatcaagtacacaatatcgccaagtgttttacctagagatcccttaccacaaagacacctagcattgaaacctatcctaatgtccctttacgccgtcttgacaaggcctctgaggaacctaagggaacttcggctggggacgcccagagtggataaggccttgtcggatcctttagagacgaaagaccatgtaagatctggtcgtgtaagagttctcgtcgtgcgtattaaccaagccgtgtaatcggaaattgggttttccaacttcacggctgggggctaggatcagtgcttgttcaaacgaggcaggtcaaaggtccaagagccttatcctccaagaacgattctccgacgacaaggctgggggctagggagagtgtataactcaacaaactgactgatcgaagtcgataaaagagtagacgctcatatacaaaacattggtctgtaagtttaattcattttcagttttccatacatattataacatgtcaccctttgagcgttcgctcggggggctatttctatctaatattcttatctgagtattgatttcaggaaaattctatttgacattatcgaagacttcatgtatctattgttctacaccaaaatcgactaaggcgagtacgacaaatgttgacaagacttcgttgcagattttacgccttctcgatcattcgagaaaggttggtggatctcggcaaggaatacggaatgaaaagatggtgtacccgccgagataaaatttcttgacttcaatccaaattctcgattacagcaagacgggagacttaattgtatgctctgtactttcttggttgacgtcggagattgactcagacaaaccctttaggtgcccgtacgaggctaataaaggaagtctaacattatctctgaactcaccgagaacggtcacgtgagctcgataacagttactccaaggtctgcagttgagaatatgaactcgctcatttgcattaaagtcgggggctactgtcagggttatggataccacatacctaatagtagttgactaaatctcggcaggacccaccacataccatgttctatacggagacaacctgcagatataggaggagttccggataaggaaagacaaccagagttctacatggaaacgacaaggactactcggattgtatccatattggtttccctagttctacttgaacaaagggacacctatgggtataaatacaagaccccctatgaggagaggggacatacccaccatagacgacacggaacatagatcaagacagaagatcaacatacaagcttacatacgccaagacaagccgccggatatcgacatcagagatatgcctggatcgaccctatccggtacctacagaggccggctatagggatctagcgctgtctttgatctcgccgggcacgaactcgagaaggaagactaccctgttatcgactacaagtcagaccttcagaccaccatgtcgacaacaattagataggctaccccaaatattgtactggtgtgattatgatgaataagagcaacgaccgtctttggctaacaggatgtaaggttattaactgacaattcaggggcccgaacctatataaaaatcctcgtctccgtctcttttacctcagtctcgcatataccctagtaccaacgatccatatactatgcaaataccggaatcgcgacatcaaacgtcgacaatacccccagggaggtacagggcatctaatcttagtataagacactcgccaccacaagcaatctgaagaacttgaagcctgctcgctgatagatctcgtcacgagtacttcttaacaaggatctcgtcagtaatctcgaaattcagttgttctcttttatactctgtagttttctctataatcccatataaactggattagagctattaccttacgagatgtctgaaccggtataatccttgcttttttgtgtgcttgatgtcgtatcatgtagatcctcgtatcaatgtaccccaatactctcagaaaacggttcatgggtatccccgtcgaaagtaatggtaggctctgttagtaatggtggcattggtagtattcgtttgttgtcgtagtagtggtggtagcggtaactgtaaaaggattttcttaagaggatttcactttataaattttaatttctaaatcttaattgcattcatttggtttggcactggcaactataatatttaaagaaacaagaaaaatcatccaaagataaaaaaaatatttaaaatttttaattttccaactttaaattcacaactttgaggttgttaccttcctcttgctcacgcgtgatacggccagccagcccaagcgcgagccacaattgatcccttgttggctttgttgcaaactgccctattatgcctacagagcaagctaatcagtatcgagatactaggtatgattgttttccgatttgtagtatcatagtatcggaatagtaccatacgatcaagatactatcagattatcgaaagtacatatttatattgtataaatcaaagcatataatattaattttgataaatataattggtctttatgtaaacttaagcatatttgttcacattattttcaatccaccttattttaaataatatttggtgggatcgtagtatcaggatactatctaagatttcgtaggattgtgtaaaaatgaatagtataataattaatcgaatattacgaaaattagaatactaggtgagaacagcggaggagaaaaaagcgttcatcaatcaattgcacaagaaaaagagggtctaggtagcaatgtacttggggaaagcgatgctcacgcaccaagacaaaaatgccctaatggtcccttccactttgccgtaagtgttacttccatactactgtttccataatacaacatcacctgtaattctctgcagcgaccactacatactatttctagtatatccgtgggaccacttggtcgtcgtgcttgatccggcacattatgccgagaagacattcacggaattccttgtgttgttgaacttgtaagtattgttatacactacgcaataactattggctcttgtactcacaattgactcaaacaaaatttttggctacatagagcacacaagtattacaaagaccaaagcggacgagtaaaggatgccagtaagagtaagcttctcgtgaagacacgatggccggtaatgaatggtatgtccgctatagtaacattttttatacttgttagattgaaatattgacgtatacagaattttcaacacagtgttgcaagcaaccaccaggcactaacttatgtggatactacatgtgcgagatgcttcaaattaatgggaggtacacaatagagtttgcagatatgagtctagaaaatatcgtgtacacattaacatattcaataatttaatttccctaactttcaatatgtatttttcttaaacagatcatgtcaattccatgggtagcaaacctgttcgacaaaaaaaaccattctcaacttgtgtgcagatatttgtcgttacatccgccacgatgtttgtaaccatttgggcgaattctacgatccggagagcgaccttgcaaagaatgacgctttcaaacgcctaagagagtgggagaaagaatttacgtgaaaaaacaatttagagacataaattgtatttggttttgaattattgtaaattccaagacaataattatatatatatgtgtgtatgtgtatatgtctattacatattttatgtgaatgtgtgcattctactttcttatttatatcataatgtgatttcttaattcgtgcgactaatgacaaccctgatatgtagaacgcgtaccatttgataatccggtattgctaccggttgagataggacgagatactcccaaacgcctaggttattgtatatagtgccgcacgggataatacatcttcccgtgcggttgggtcaatcgcatgcgaaaatttgattatcgcagaccttctcgggcgggcgtgccggccttccgcacaggaagatgcttttcggtccacacgcaaaaaccctttctatagtaggataagatcagtatcgtttctgttattttggttttgtaggatagtacgatacctcacatccatccatcaatttatgtttactggaccatgacatgtcgatcgctgctgcctccgaccttgacgcctcaacctacgcctccagcagccttctcctcgtgacgtacgagtttcgcgtcacgaggttcatcatcttcaagcgttgtgacgagctgggccgcacaggcttggctccgattcagtagcggacgcaggatttcagcgagagatgcagagttactgaagcaagaattatccaatgacaaaaatattgaagtgctagtatgtgttattagctcaaacaaaaatcattattatagaaaaattataaaacatctaagggaaaaagaatgataataatcttgaaaaagataattttgtacttacaaatgattgttttgataactaaccggctgggtacacatataccaaacatattaaatcacatttgtttgaaaaaaaattggggtaagctcctgagcccattggtgatggatgggtgtttgtcatgtgatgatgaaatgcaggacatatgagtatgactcatcccatccgcgcgtccacccaaggctcatcaaagaaaaatcccttcaatcatcccatccatccttttctctccaatcaaataaggcctatcccaacgaccttccaaccaaatacaagacaataacatctcatcatttcccactttatgttgaaatcaaacatatatatacctaggatacacatgaaccttacaaaagctcctgatgttatctgtttgttccttaactatatgtagtactatagttctcactccatgctattggcctcgtctacagtagttcactgtcattagcccatctaaagcccaatcaatccatctgtggctggtgctctctcttctgtccgtatgctagcttcgaaagaactacactaatattgtcttgttgcctaatggaatgagattgcaaattaaacttgcattatttggatggactttaagttcaaggttatcagtgtgttactataatatctacacaaataatagtggaaattgttgttgttgtactaggttgatcatgggtcctagtagtggtgtgatggtggtggtggtaggtaatggtaggttattgcagcaatggcggcattggtagtattcgtttgtcgtcatagtagtatagcagtagcggtagccataaaagtaataatattatctattagtttaaaaatataattacttctccacctattttctcatcttaactaatcccaattatatactatttaatttctcaacttactttttttcatctcactactacagacaagattttttcgtgcggtggtccggcctatttgcacccaggtgtctgtgaaaatcattattttcacgtgcgggtgggccgaccgcacaggataatcgattatcccgtgcggtcgtgttataccacccgtacggaaaaaaaaccaaaaataaaaaaaaacaagaaaatcgccgccggccgccggaccgcacccacccggccgccgccgagcccgccatcgtcgtcgctgttgagcccgcccgccgccgccatagttgtgccggccgccaccgccgccagatccgctgccttgacgatgcacgtgatgactaggaggaggacgacgagcgcacgacggaaccttgccttgccttgccggagcgcacgacgtctgttgccttgccttgccttgacgtagccgagcgcacaacgaggacgacgaccaagaggaggggaagcctggccgccgccgctactgccgcctcgctactcgccgccgcgcccggccaccgccgtcgcccaggccgccgccatcgccggcccaacagaggggaatgggaggaggggagggggaggaggaggggaagccggccaggaaggtgtgggggaggaggtgggaagccggccgggtgtgtggctgggagaggagtaaaaggaagagataaggtagagagagagagaggggagtggttgagggagaataaaagggaaaaaggaagagagagatgggaaaattttgaagtgggtgagagggaaaggacggaggattatcccgtgcggttggattaggacgtccacacgggaaaatcgattttcccgtgcgggcgacagcccagcgctggtccccctattttttcgtgtagttccacttacggaccgcatgtaaacaaaagggggggcgtccaggaaaatcaatcctgtagtagtgtcttaaaccaatcacaatcattccctatttaatttcagatactttttataaatccgtcttatattttaggataaatgacacattttattcgggaatacattacacaaattacacattacacaatattctttgctatagcatgtaggggggtcgccatagacagtgttattccaaacttttctgccatgtctacgccaccgttcttcttcactacttcaggcagtgtccactgaaactgatgaactagcgaggcaagcataacatgcagcattctatttgctaccggatatccgaggcagaaacgtcgtccggcactgaatggaataagttccatgttggtactacctgatgacaaactgatctccttttgtaggaatctctctggtataaacttgtctggttcaatccaaacctctgaattctgatgaattgcccatgtatttactatcacagtggtttctttggggattttatacccttgtatttcaactgggacggctgctttgtacattagcagtggtatggctggatgtagcctgtgtgtttccttgatgactgcttgaagatagggaagttggtcgatgtcttcttcatctatgcaagtttttgagccaatgacctttttgagctcttcttgtaattttgtcatagtttgaggattctgcagtagctcggccattgcccactctattacagctgagcttgtttcactgcccgccattagtaaatcctgaaattggttaagcaatgtaagtaatttagataaatcgaatatcttaaccaaaaagtcaatctttacagaattcaatcttaaaatatatggttatttgctactgaacaccacgtacattaatcaaaatattcattttcgattgaataggagagcaaaaatagtgcgaaaggacaaatatgccaccggccttggtcatttcgctagctagtacatttgtcctttcatactatttatctctcttttatttaataaaaatgaatattttaaccaacatgatgtccctagtagtaaataaccatactttgaaagtatctttcccaaagatcaacttttagtgtccaaaagctaaaaccacttaggagccgtacgtgatgtcctcccgtaaaatttgcctttaaataaatgtgtaaataccaccaaacttatattgaaaacacacccacgtgcaaacagaccaacccagagaaaatatttaaagcctaacaaaaacctaggcagatgattatagaaatcaccttatgcataaaatatagtttgttctaaagtgttttcgctccttcaatctttatttttcatgtacctaaatagttgtaaaaaattttggaaaataactttgttagagataactctagccgtggtcactgggcttccgtccacccattatgttttagtgactacgaagtctaattaatgaaaagtagccacaaactgtcatgccatgattattactatcttctataacaatcacgttgtttattgctcagtagcatttttttgcctctttgtaaaacatatgtgcatgcggtgagaaaagttacttttgggcgtggtttttctgttctgaaagggtgatgaattatccaactttttataatatgttaagatacaataatcgaacagattaactattataaagttgtaaagtaattggaaaaacatccttaacaaacctatactccttttttaaaatagatgatgtggctacctttttatatgatatttaaccattcgttttattaaaaataaataaatattattttattatgacatgttaattatgtattaaagaaattttagatatgatttatattttagaatatttatactaaaatttcaaaatatggcatacagtcaaaatataattaaaagtaaactgtataatctggtaaaaaactgagatatataggatacatatacttacggccataaatgctcttatcacaccccggttcatggtgaggctgctgtcgtcattctgctcctctttctccgacatgtccagcatcacatcaagcaggtccttctccttctccccgtgcgcggcgccgcagccaccggccgtttcccggccacgcatccgccgttcgacatggccgtcgatcagttggtacatccacgtgatgtgcctcgccgtccttcgccgcaggccctgcagatcggccatggccaccaccgggaagaactccgacacgttgggcgtcatcgtcagcagcgcgaactcccgcgccgcgtcgcggaaccggcacgacgtcgcggcgtcgatgcccgccgagaacagcgccccgaacagtaggctcgccatggccgcgaacgccgccctcccgacgtcgaccaccgccgcgccgcctccgccggacgccgcagccagctccgccacgtggcggaggaggccgcgcacggcgtctcggcgcagcgggcgctgctcctcgacccgccgtggcgagaacagctgctcggcgccgagccggcgcagcgcgcgccaccggtggtggcgcgtcgggaacgcgaagatggagttgccgtcgtgcccgtcggtgctccacgcgtccggcgtgccccggtcggtgatgctggcgccgtgcctgtgcaggacgtcgcgcgccgtggccggcgaggaggccacgacggcgagcatcgtgcccaggcggagcgtcaccagcgggccgtaccgctcggcgacgcacgccaacgagcggtgcgggagctcaccggcgacgtcgaggaggttgccgatgaccggaagcggcctcgggcccggtggaagacggcggcgagcgtctgagagaagctggaagacatgggagcagagcagcaagagtgcaagtgaacagatgcatccgatgaagatggccattgatgaacgctggactttggagaatgaatgaacctgtactgccgatcgatctcgatccatatggaaatataaaagcattacccgttgaagagtatgcgttttatgatttgatgtgaagtgacaccgtgacagaaattaagaggacaataatttaactgaacattttcgcttgagtcgtgtactaggctttcatctgttggcctcttttgatggagaagctagcagccattcaagaattctttagctttggttcatccgttgctttccattatgtccttgcatggtaatacatgggtttcttttcctgctagttgatactccattcgtattttaatgtatgacgccattgactttttattaacgtttgaccattcgtcttattcaaaaaatttatgtaattatcatttattttatcgtgactttatgttattatcaaatattttttaagcatgacataaatatttttatatttacataaaaattttgaataagatgaatagtcaaatgttgttcgaaaagttaacggcgtcatatattaaaatacggagggagtaataaccttcattcaacaaaaaaatccctccttgccccctcagtgtcttgcagattttggacccttcaatagtcaacacctttaccttacctcccgctccgatgatctcgttgatctccggcggcggcaacggcgtagggaagaagaagagggcacaggggaattattcctaacttctccaacgaatcaaaacaatccaattaatggctcaatattcctaaaattttagagggaattttctatcaaatgtagagtaggcagtctttttctttttcacataccttcttttcctctgccgattttgtataatgtttgtgttcatttctagctatatgcagaagccatgagttacacttcttaaaccaagacaacgccacagttggttgatgtagcaatttcaaattagatttggagatagaaggacaaacaaataacagaagaatctatagagttcatttggaacagacgaagaggaacgatatattaaaaaagagaaactttctcatgtacaccagagtttggttcaattccatctacgtccatgagtaacagaccgtcttggcctctcggtttctgtgatgaactgataatgcacgtgattacctgttagctaggactgttcatcgtttagttaattttgtacaatttgtgctaaacagaagaattaatgtgacatactattacttggtattacgagaaatgtgaataatggatggttctcattatttagctctaggactttgctccagatagtactggttcttctgcatatggttgcttaccactttaatttgcaagaagttttggaagctgcctatgccttaaaaaaattatccgtttaattgcttggagatttatgaatgttgggaaacttttttttagcaaagggcacagcttcattttcattaatagaaatgattcgatgagaaacagaatggaaaaacaaaagaaagcacaaacaaaagaaagcaccccatacatgtatgtatgtatgtgtgtgtatatatacatatattcctctgaaggggactatttctcgagatgagaatgacatctcattctctgctccactattcatgttctggcaagacaacgtagaataaaacaacttttcccaacacaaagtttatctaaattgtcagcttttttttctaggcaccttgaacctaaaaaactcaaggggcactctcaaaacaacataaaaccagctttcattccatcttctcgacacttagagtcgattgttggtagccctcatgccaacacggttgtgtcttcgatggtacttctcctaacatagctgaagacttgctgtttgcaagagaagagttgtatgaatagggtttggccgggcctaagggcattcttgtcctcatgccgaacagtaaatagtgtttgcttgtaataggttgaagttgtcttttggtctcgtgtaaggtctattgtgtgtgttgtaagggttcttatcctcttctttcttctccttaatataatgataagtagctctcctgcgtattaaaaaaacgtttttgggatctctctagctaaacttggacttgaagatcttacttgtgacttgtctgagcagtcagctcgccctagcacaatcttccttgctttccacaattcaagggaacctataattgataaaatgtacagacatgttgtatatatgtgaaattgattaaagggagatatggaacacactatacaccacaacatcaaataggaagcgttgtcatgcgcatgggttccatgcctttgaaacataccttcatggtttatcatatatatatagttatggatggaaggcatccttcgaaacctctgcaacttttctatccaagataacacagctgtggcagataaatgctactgttttgcagcgccatgtttacaccatcatcatcttgttgctgccatcagccatcatatttcacaagatatagtagggaaacagtagggtggcaccacatcaaacaaaggagcagtgcaatgaatatacaaaacgtaaataacaattaaacatgatacatatacgtactatgttgtacgaaatttgaacaattgacaacttcacgtactgatgggagaaatctacactggtggagaaaggggctttactcctggttcgtaacccccctatagtcccggttttcaaatcgggactaccaatccgggactaaagatcactatctttagtcccgggtgaaaaaaccgggagtaaaaatccatttttagtcccggttggtgttaccaaccgggactaaagatagagcctttttagtcccggttggtagagctagactagctagatccggttgctccattattattttcttttcttcattatattgatttcaccccatccccttcccaaaatcccaaataaattatccccaaatcctcaactccccaaatcgatacatcacagatacatcacaaattttacaaaattcatcatagatacatcacattcacatcacacacaaatcaaatacacagatctgaatcacaaattctaaaaagaagaagaaaaaaaaagcccgttgccactgccgcgccggccgccagccgccggccgccggagcgccgcccgccgcgaggccgcctggcccttcgccgcaccgcccgccaccgcaccgcccaacgccgcgccgcccccaaccaccgcgccacccgggccgcagcaccgatcggccaccgcgctgcccgcgaggccgcttgggccgctgcgccgcccggccaccgcgctgcccattaggccgcccgggcctccgcgccgccggccgccaggccctccgcccgccggcgctggtagaggagaaagaggaaaaggaggagagaagttaaaaggagaggaggaagaagaggaagagatatggaggaagagataaggccagggaggagatagaatatattaactgctcctcctcctcctcgatctggtctcgtactcttcgccgcccatgttgcgcatgccgatcttttattccggttggtgttaccaaccgggactaaagataaaaaaaaactctatccttttgaaccgggactaaagatatctttagtcccggtttttattgcaaccgggactattgtgtattttggccgaccgaccaaagatggtttctccaccagtgctagttatcttttctgtgcatatttttgaaggtaattaattactatacgtgttcactctatatatcaagccatatgcatgtaggaagttcaatgttggttcagtatctatatattcacagatgaaccaaaatcttttgcctccatccattaaaaacaatataatccacaagatttttttaaaaaaggagtctgcagtgaaaaaaaaaagtgaagtaatgaatggtagtggaaaaaaaatatcatgaagataactttgatatactttaaccaacatagatcatagaggctgaattggaaatcaataggaaaaataagctagatgagatgcaataaccagattttcatgcgtccaaaaatccaccttgatttcatacatgagtctcacaacagaagttacgcatgcagtcattgaacaacaaaaatcatctaagagagtacaacgagtacaaagtcattgcaacaaacatattacatgtattatttgtatcaaacaggttcaaatttaacgaagcaaaaaatcacaaggcatccaatccctaaaaactccattgcaccttcatcattaatcttcagcgacatttgttgtagcatgtcaaccctgttttgctgtttcttcactgccttctgaaaagaagtgatgagaaatagtgtgatcagtatatatgttgcactcaacaagcaatttaattaaaactatacagttatatttaattctgcagaaactttgtcaaggatgttctatcagacgacacatgttactcgagctacagcaaactttttcagtagggtaaaactcccacaaacagtaaataatggaatattcatatatattgcagtcgcaatatgctttaacaaatacggttttatatgttttcttatttgcaagggagttttatgtacattcatattcctagatcagattaactgagtcccaaaagtaccattgagctaagttttgttacatatttacagcaaataaaataactatttctgaaacagaatggccacatgtatcttatagtaatctctaaattaatgtaaaaatggctcaacggacaatgattgaagcataaccgcacagaaagctaaaaggttcagctaaataacaataattcacatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54599 - DNA, 5558 bp, Oryza sativa
  unsure (1)..(5558): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttgtcacaggggttaatgtgcaataggcgacagcgatatgtgtttgtgttcagttgctcgtgttgccttctgaagagaggatctgagaaaacgattgatgatgatgttggggcaactggtttagactacatgttggctgtcacgtttggttttggttgatgcaactacataatctaaccacgcctaccttcttttcggcaaggatatatggctttttcgtggactttgacatctcattaaaaaaaaaaagaagtataccacactgcaggcgtgtcagtttcacctagatgtcctgagacaataacagtcttgcgttgcagcaatgaggtcagatccagcggtccagcctccagttcacagtcagagtcctcttccatgtagtacatcctgcaagcaccttacctaaccaaactaaccgagtcaagcaaacaactaatcagtcgtgaatacgggatacttgtaaacgaaattctcgacacacaccaataccagtggctgttttcttgtgcgaaacgggcgcaggaaacacgagggcatggccaattccgttcaacaatcagttttgctgatgcaacttgagcatttcggggcagcaaccatacacgtctcatctatcgcgctggtgctagcacatcgcagttactccgctggtgcatgtatatggacagagcagcgggccacaccgtctccacgcagagtgtcggttcgtcggggtgtcacggacgaactcgtttccccgaacgtttttgtttttgtttttttttttttctggaaagagtgctggaggaggcaatggtgcgcctgtgcacaatttagtcgcatttcgcctgacgattttcctctccaccgtctctctccgttcctctcctctgctcatcttatctgttcgtctgaaaaaaaaaaaccgtttccggcggacgcacgggcggaggctcggccagcgttctcctcctccgcgacaccgactcgcctccgtcgcgcgcgcggccggcgagcagggccggaggcgcagtgcggacgggctgctgctccccttccccgaccccctaccgcactagtattctcccctgtgcggccggccggcgagcatctcggttcgaatcgaagtatcgaattgaaggtattccttctagtttcgtagccctcctctctcttcctcttccatgtgctggtgtgggtaagattgggagtcgattcggacttgattgatttgtttccctgtcacctagccgtcccacctcgtcccgatttgatttgtttgttgcgttcgtggtgcggtactaataacagttttgtgtcctaacaaatttgtgggggttcagctcaaccccgatatcccacgttagatccgccccctggagtgtagaactgtgctttggttgttggtttcgcggagaaatgtaggtatggagccaaggggctgtgacagtttggtaccgggatcagttagctagaactggttcggctccgagtatagtaggatcaccgacttggagagtgtagccatcacatcggtacatgccactctgcttgttaagaagggaatttgccggaggttggaggcactggtgggattaaggaggaggtagaagagcgcaattatgccatattgctgctagctcgacaggaggctgataacacttggacagaaatggcatgaaaggttgacaaatgttttgtgatggcagagacagcctatttagtggcaatcggcaaaacagagataggtgaaactttcagtggtataggagttatctctgacttaaatgatgcacggggcaattagtgacagaataagtactttatctccttggcatttcattttagagcaatgggtggcactgtagttatttgctcacagtaggtgatagtgatgtagcaagcttgaaagcttgacatgtgattttgttcattgtggttttaagatgaaccccaaaggtaagcgttctagtaattgctacttctacctccaacttccaggtattattaaatttaattaaatttaacaaacagcacacagtttgcctttatactctcaatggtcatgtacttctccattaaactcaactcttttgcagttgtgtggaactgtaatgatgcacgctgttagtgacttggtcctcattattgttatttgttaactttcagcctttgtggtgaaggcattaaacagaaatcaaagtagcatgagcaagcactaactgggaatctccataatacagcattccagtgagttgaggacttttttttgtcactacagaaactaaggatacctgcgtgatttcaaaatttcaatgtgtgattagctcagtgaaatcctgtccaacttgtttcatattcaatatgccaccatggtgggggaagtcttcatcaaaagaagtaaagaagactgccaaagaaaacctcattgacacatttcatcggttattaagtccaaatgagcaaaaggggagaacaaaatcacgggggaatcgtagacatagtaaagatccaactgctgagaaaggttgctggtctactgcccaatcacgctctgcatccccttcaaaagaggtttctcgttgtcaaagctttgctgcagccagagcacatgcacaaccacttccccttcctagatcccgtgctatggtggcacgtactgcttctgatattaccgaatcaaaggtcgttttggaaaagcgtggcaaaggacaacaactaccgctccctaccacaaattgggttaaagaaagacctgaaactaccgaacctgttgcagaattatcaactgcttctatctccagccatggttctatagatagcgatgatcctggagatttgcgacttcagggacctgtggcaaatgacaccgacaatgtggctaaagttgctacaaccggtaattcaaggtatccttcttaatccatgatttatccaaacacatttttgtttgtgtactttttttaaaaaatattcttatggatattgattgctctgtttgtgaagtgttgtgcataaggagtgttctagtgccatcaccagaaagggcactaaggaagtgacgatgccaaccaatgctttcttgagtaatcaaattctatctacaagtcccagaggtactgttgttgctgacagttaccagtcaaatttacaaaattcacgaaaggttgttctggacagtgctcccaatagtgtgatgtcaagcccttctcgaagcccaagaatattatgccctgatcagattccaagttcagcattttgggcagttaagcctcatacagatgtaacttttgttgggtctgctcagtgctccagtcctggttcagggcaaacatctgggcataattcagtgggaggtgatatgctagcccagctcttttggcaacctagccgaggtagtccagagtgttcaccaattcccagcccaagaatgacaagccctggtccaagttcaagggtacatagtggaagtgtctctccattgcatccaagggctggtgggatggcacctgaatctccaacaaggcgacttgatgaagggaagaggaagcaaacccacagattgccccttccaccactaagcatatgtaacaattccacctttttgccaaacaattccaccccaactagtcctatctcacatagtcctggtagagtagaaaatccaactagtcctggatcacggtggaagaagggaaagcttgtcggccgtgggacatttggccatgtatacattggctttaacaggtatgccctttcgatgctcggaattggttgatgttcatttttaatttcgatgcaaagcacaatatggttttcatcattaataaatcctacaatggtactaactcattcagctcttgtaatctctcccatatacttatttctcatactacatcctgaatcgtaataaatatcatggtttagtgattagtaaactggcatgttttaaacagagtctcattcagaaatatttcaccttcaaagcctaagacatcattattctttgagagtgtaattattgaagtggtcttgtcacaatgttgtttgtaacaagcactctatatatcctttgagtagtgtgccactgactattttattaggactgatcatcctttgtttctcttcaaatttgatataatataattctctgtcatttgtatcagtgataaaggtgaaatgtgtgcaatgaaggaggtcacccttttctcagacgatcctaaatcaaaagaaagtgcaaagcagttgtgtcaggtatgacatttttctccacgtttactgtccttttctttacgctatcttctctgctcttatattattctttatttaccaggaaatattacttctgaatcgtctgcaacatccaaatattgtacgatactatggatctgaaatggtataaatttatgccaccagttgttatcttctgttaataccactcctgttctttttttacttgttgaacatgtgtgatcattccttttctaacaacacattcataaaaaaaaatccttttctaacaatacatttataaaaaaaaattaaaatctaactacgtgaaggtattttccataacaaatctactagtaccattttcacatatcagatcttttttttttttgcatacactccatcgtttgtttctgttaggcgtatagtttttcaaacttttgcaagatatatgggctccatgcaaatttattaactatattccttatatgtccataattattactagtgtctctcctgcatttataagaagcatctcactaaccatctatttagctatttctaaggtatttaagtatggtaggatggtcaatttaactgctctttctcttggttctgtacaattattgttataaaagttagctgatatagagtaacgacgactaaccttctcgatcgcttcaatcattgatcacccaagacatgtcagatgacgactcaggaacacacgatatttgttaacgaggttcagccgaagcctacatccccggggctctgattatgggtgctcctccccaaccaatatagctcctagccgctacgagtccatggccaagccccatcatctccctgcgtgtctacgctacattgtagtcgccatgattacattgtcgtgcccccctctctatttaagagagatgacaggttacagagtccgactctactctacccctaacacctattacaactccaagtccaactgt

SEQ ID NO: 54600 - DNA, 3407 bp, Oryza sativa
ctagacttgtatgaaaagaaccactccttccttggcgtcacgtgaaacgagctagctgaatctaatatccacgcttctgcatccttagactgtgcacttgacattttgagaagatcacaaccatcgctatctgagtcatttaaaaaagtcgctgcattagcattagcttttcccttcagtattgggcacatcttgcttatatgcccccactcatcacatctgaagcaagcaccaccttcttctttttgttcttctttaccttatgcccagcatgatcttctttgactagcaaaccctccgcttgagatgtttcaccctctttgttctttctcatctgatcacgagccaacaacgcagaagtgatctttagttttgatggtctccttgccgtacgtcaaagtagtcaccacatgctcatacgattcaggtaacgaacacaaaagaactatggccttgtcttcatcgtcaacttccacatccatcttcacaagatctgtgactagttgattgaaaacgttcacatgtgctgtcagatccaccccttcctgcatctttagcccatacaacttctgcttcagatacagtttattgtcagagtcttggacataaactgagcttccaacttttcccaaattatctttggtgaggtctcctccatcacatggtacatgacctgatctgaaagacatagccttattgtcgcagccacctgcaactgcatctcctcccaatcgtcatcctccatcttggccggtttgacacccttcaaagcctttgaagcaccttgttgagctaacaaatctttgaccctagtttgccacaagccaaaatttccagagccgtcaaacttcaccaaatcaaatttcatacctgtcggcgccatcttgccaacccgcgacctgactggtctgtcgccaccagaatactcgcccttctcagaaccgtccgtattcgtcttcacaatcccgtcttgtgatccgatctcagacattcaacagcaaaccacctgtccgccgccgcaccgatccaactaatctgcttcacggtttttctccgtcctgcttttggttctgtccggtttgcacacacctgtacgcctgctgtacgatcttgccttgagcccagatttgtgccttccgtggtaagcttacgagtgtctcgatcaattgcccgtcgccttttctgccataggttcacgtcctgaccgctccttaaatagcatcagccaccgggataccgagtccagatcgacttcgagtccggatggacacgtcaagccgagtccgcgtcgatgacataatttcgtgccttatcagaaacggtctcctgaccagctcccacacggaattaggcctttgatgtttgacttctcctcacatcttctctcacggcagcaatccacgtcgtctgttctgcatgcccatgcatgcacgcagcttgtacgtgtcccacacaaatccaattgaaatcgtatgcactcatgcattaagatgcaactaattaatccatgcatggaattaatatcctgcatgcttgcaacaactcgtgcatatctcttgctcttggccaccatctgtacgcgtactgtatgcatgtgacacgtacacatacgtgtcgttcgtgcctctgcacgcaccgcagtcgcagccctcatgttttccgtccacgatcccgtcgtcatcggccttgcacgtccgccgcgccgtgccacgctcgccggcttcgcccttccgtcactggcctccctgccgcgttcgccgcgtgcgtcgggcgcgccgtccatggcgctacccctccgatctctccggtcgccttcggccacgctcggccccgtcttccggtcaagttccgccatcgccggtctgatcgcgagcgaggttgtcacctccgcaacgtcctcgttgtcgccatcgatctcatcgccacggctgacgatctcctgtcgatgcgcgacccccacctcgtgtttcctcctccacatgtcttcttgatccaatgttgaaaccttctgctctgataccacttgttataaaagttagccgatatagcggaacgacgactaaccttctcgatcgcttcaatcattaatcacccaagacatgccagatgacgacacaggaacacacgatatttgttaacgaggttcagccgaagcctacatccccggggctctgattatgggcgctcctccccaaccaatatagctcctagccgctacgagtccatggccatgccgccatcatctccctgcgtgtctacgctacattgtagtcgccatgattacattgtggtgccccctctctatttaagagagatgacaggttacagagtccgactctaactctacccctaacacctattacaactccaagtccaaccgtaaccaaataggactagtatattcgacacctattctaacaattcttaatctttgtgccctcaaaataagccttatattttgaaacagttggggggggggtactagctaaatgcaggtggctttgcaacagataaaaataaatgcatgtcttattggtacaaaatgtagttcatagttggtgggtggcagattcactgtcaccaccgctacactgtcttccttcagaaggagtacagatttgtgggttagtttcaaggtttgactgcatgaccaatgtgcgtacccgcattattatttcttgcactgcactgtactctctgatgatgacatatgccactgaactataatatttctctgaacacttctctgtaaggaaacgtagcaaaaaagttcatgccacattctgcagaattttacgaacttcacttttgcttgcactcctgactcctctgtttactttaaaaataactatacactatccatttattcaaaacaggttgatgataaactttatatatacctggagtatgtttctggtggatccatccataaactactccaggagtatgggcaatttggtgaacctgctatccgcagttataccaagcaaatacttttaggcttggcttatctgcatgcaaaaaatacggttcacaggtaacattccatttccttttgtcgttagttcagcacttcagttccttagatgtaagctaccaagttgtagattattttattatttgtcatgttccataatttgcagggacattaaaggtgcaaacatactggtagatcctaatggtcgtgtaaagcttgctgacttcggaatggcaaaacatgtaaattctctgtttcaaattgtaaaaaaaaaaatctttctcatttgtcaggaataactaaaatttaaagcaaaagcattattagatgtaattccttgtatcatcttcataggaagaaatggtgtattgtgctttaccctttccctcgtgttctcttgcacttgaggactaccacttgtgctagatca

SEQ ID NO: 54601 - DNA, 838 bp, Oryza sativa
tacatgcacatacagtaggagcagcaaactcatacctggcagggccttatgttggcttgtttgcttcacttgaaaaccaaaatgaaatccagatcgaatgtgaatttgtaccccaaaccgaaaccttgtaaagatctcacagaaaacacataaaaacacatagaaaccttgtaaagatcattaacagatttgcttgaaaattcatcaaccagaacaaaccctccctcagcggcatttaatcagagacctattgtgcagagtagagtaagtgtataacaaatgaatttacatcatcggtccgtttaagtcacaatcaaatagcaccaacaaaaggagtaaactggataggaggattctctttatatctcattaacatttgttagtatttcttttaatacaatcaaacaaaagtgcttgtccatagtattatatttattgacagaagtaagaaaattccttttttttcaataaaaaagtataaaagaataatggaaactggcaggtgttgcatgagtaatccaccaattaataaattaactcaagtcagctattacctgccttaaagggaaagctaatccatcactgcttcttgttgcttacctgcaaaacagagtcttatatcatagccttttgacacaaggaataaagtagtaactaacaggaaattatgtgtttccagagttaaaccaacagaaaactactcaacgttgtaacaagcacgacctgaacatcaaatcctacacatgatgaatccaaaatacttgccttctctgaccctaggcaagatgttttcttttagaaggttacatcgaacatcaaatgactgcacagagcaggt

SEQ ID NO: 54602 - DNA, 4866 bp, Oryza sativa
attcctgcagcccttacgtaataagataaaatacatatgttaagaacacaactacagaatatctttatcgttgtgtttgtaagtgctgtatagtaaaaagatggtgtggaacacgttagcagaacctgagcccatatgtagaatttgtcgagaccttgattggaggaaatctgctaattatgacaatgataccctaaaagaaagaacattgtttttcattggtgagctcttttttgcattctgaatggttactgctaattcttatgcttgatgcctcagacagtactaataactatagatcaaattaatggagaacaattacctggttttggggttgtccacttgtccagcggtgatgcgacagcgacaatgctcatcttgctggctcatcgacaggaactcgctcgtcgtgtgaatcatgagggcaaggaggcatgacggtgtgagggaaaccagtcgacggggcaatccggcggcggcatgacgctaaccgaatggatcagggatgatctgcaagagggcggctgcaaacaaatccagaagatgcagcgatgtggaaggaggtgacccacgagggaatgatgaggggcgcgatgcggtgagggtggagggaagcgacgcgcaggggagacaaggcgaagcgcagagggaaacgatgcgtgagggagggggcgaggacggaggtgatggcggcgatgatggtggcagacgggtgaaggtggaggcaaggcgcgcgaactcctcctagggcagtgtacagagacagtttgccgacaggaatacccattccctgtacataataacagcagcacacatcagcaaatgctttcaggtaaacatacatcatcacagctaaatcttttcgacatattcatgacagcaaaatcagggcaggaaatgggggaaaagatgcagtacctgacaaccaagatctccaaggccaagaatgcgctcaccgtcggtgatgacgatcacctggatgctcctctccggccagttcttgagcacctcaaggatcttccccctgaatccaccaacaagcaaaccaacaaacacagattcctgtcaggctgcaaattcctaatcaacctcaacatcagaaggaaaacagaatcctcgcaagaaaaccgcacttgtccttgaggctgatgtacaggccctgtggccgcctgtagatgctgccgtacttctggcatgcctctccgaccgtcggcgtgtacaccaccggcagcagctcctccacgttgtcgatcaggagcttgtagaacagcctctcactcctctcctgaaaaaagcacaaaagaaccaagaaacatgacagagtgttcagtaatcaacagttcttgctgcatgaacattcattatcaatgcatttgattttgagcgagtgatcaaagtgcgggtgaaggccagcatcccccgccggccaacctcacccctttctccatcggcgttgtcctattcctcctcccatgccgccgtcctctcccctcataccctgctcaatccggcgcggggtcggctcgcgcagatcgagtcggtgcagatcgggacacctcttccccgcccgtcaccagctcctttctacccgcacctcacaccgccacccctaccggcgttgccaccatccccaacgccgtcgaaaggggatggaggagggaggggagcaccggagccgactctgacgccgccacgaggggagggggatactggcgccggttacgccgccgccgcgaggggagggcgaagaagggggaagggggggaccggcgccagatgatgcacggcggcggcggggggatggcgtacggcgacgacggcggcggggcgacggcgtcggcgcggcgtggcagcgaggcgcgagagtgaggaagggaggggatgggcgtgatagggaggcgaggcgacggcggcagcgtctaggtaggcgatgcgagcgagagagagagagagagagaggatgggagggccggagcccggagggggatgcggcgcgtgagagtcgcgtgattgggggagatcacgcggtagatggaggtgggaggctgctgatcgatctggaccgttcggttttcaccagaaggtgggatcggcggattttgggaggtgggatcgatctcaatcgttcgattttacacagacgatctgaatcattgagtgatgaatgaaagaatgagtgaaactatttgtttaactatagggtagatataaacaccatttaacgagggacaccatagtatttcttctcaaaccttaatatatgctaaacaacagagaattacaattattttgggacggatgtagtactagtatgctgtttaggggtgaaaacggtacgaaaatttccgagatttttggctgtcgttaccggtttatactgaccgtttcaatcggtattagtaattattagaatatcttctagaaatggtagcgtaattaggatagtggtttttcggaccgttttctcgtaactgcatttgtccgataatttccatcaaaatttcgaaagttctctagcggctcagccaacccaacccattaaaagctcatgaatgaagaaagcttgcaacccattaggaaggggaagtggtcaggaaaaacaatgttaactctagggtgtggcatatagactttgttgaaatttgatctcctcaacttatcaatgttgaattattgttcaactttgtttatattgttcgttgaacttatcatcatatcactagtaatcatattacggtgttatgtggagtgtgatgatgtaagaatgaagttataaagtcatcttcatgcatagttaaatgtgtgattatgccagattgttgtttccgagatgaattttcgacttacaattaatatcggtagatttcgttcagacggtccagtttctgatatatcgatattatcgatatcgttactaattttgggtctatcgttccgattttgttttcaagaaaaaaaaatgaaaataaaaatggtagagggtttttggaccattttcatccctaatgttgctgctgtagggctactggatatcgaatcagctcaactcgctctggctcgctatgatactgaacggactctgctcggctcgctttctaactctagcgagctcgtttagcttgcgagccagagcccagtgagggaatggcaatctagagataggcaaggtaaggtctcaaggagtggccagcgacaggctatggcggcaccatgactcacttgcggctagtgctggtctccttgtgctgctacgggcaggtgatcggcggacggaggtatgctggatagcaacaacgatgacacaaggtaatttagtatatactgtacatagcaggcagttaacaaccggcagggcacgggatgatgcgaggtaatccctccgtccaaaaaaagacaaaccctggatttccgtgtccaactttgactgtccgtcttatatgaaatttttttataattcgtattttcattgttgttagatgataaaacatgattaatattttatgcgtgacttgtctttttaatttttttcataattttttcaaataagacggacggtcaaacgttagacacggaaaccaaggtttgtctttttttgggacggaggtagtaaaggagaagtgtgatgtcagtgtcaggcacgacagagcagcggtgtgatgtcagtaggcatgtcacaaggtgatattaggatgaatcttgacataggataaatttttaactcatgataacgtggacgaatctcaaccgttagatttattttggagggccaagatttaccctatatcatctcttgcgacatgcctatcctatatcactgaatctgaatcctgagaattcacggtgcaagtgcgagaggaggcgatgcaagagacgagaaacgcactagtggctcaaacgagattggtggcgccggggtagataggaagaaattttacgaccaaagatgttgggataatgagcgttgagacaactgttgtgcttggctgcctggctgagccttggcttgtttggctcatgatccagcctgagcttgtaaaaaagtgctactaacgtaccaagccaaaactgtcaaccctgaatcaaactagctagatgcttttcgttgttgcagctactgatagtgagtactctgtctgtttcataatataagtcattctagcatctttcatattcatattgatatggaaaaatatttatcaatatgaatgtgagaaatgctagaatgacttacattgtgaaacggaggagataactttttcatagagtgcttatttacccttgtttttactaactatgttccagccaaaatgtaagcatttctatttaaccagacgtatggaatgttaggatgaaaacgctcacaaatattcatgaccgactaacgctgtttttcaatttttactggtaaagtaatgtggaaattgttaccaacaaaaacaaaaacaaaaagatagaaatgataaaaagtacagaaatattgaaaacagagacgattttgatgtatactgagttactgaccgtttctgaattttactacatacttatggaaattaccttttctaattatggtaattactgtattttaaatactcaatatttattgttcatttctttatttgacgtatagtttagaggcccatcaacttctcaattaaataagtactccctttcgttttatacaagactgatatcaaactttaaaactttgactatgaataattttttaaacatttgccttagaaacatgatgaccgtacgtatgttttgatattttatatatatattattatagaaaatattgatcaaagttaagttatttttaagattgtgtccttatccagataacaattattttcaaccaggaag

SEQ ID NO: 54603 - DNA, 9396 bp, Oryza sativa
cctgcaccccttagtggtagctggtttatctaaaccagttaccactccatctataagcgaccatgtccacctatacttcaaataaaattttctcttaaaccactcatccgattacaccgttgtgttcgtaacaattaaatctttacaataagatctcacatgattatattttgataaaaaaatacaaattaattttatatatatctaaattacttcttatatatataaaagtaaattcaataaaaactaaaagtaatttacatatattatagaagtaacttataacaaaattaatgtaactttaatgcatgcctttttttcaaaggacatgactacacagctagtggtaactagtttgtctaaaccagctaccactccatctgtctcctttcaacttgaaaaatacaatagtatgtatctttttttaatctctttaataacttatatattttaaatcacatattgtttttaagatctatttgcatcattgtactccactcaaaatatgtgacaaaacaatatatgtcggagatatgggcccggggatatgcgaagtgaggggaatctaccttcccatcctgccacgtgtccctactgcctggtcctgtccccgcattctgcgaaccgcaggagcggccggggggtcggggcctcggggtgccacgtcatgcccctcgggcccttgcactcctttgccccgaggccctcgcctagccgccgtttggcggggggagcaagcgaggagggggcccaggctgaacttcctttaatgcgcgcaacgccccaactgccccctgtcgcatttaatgtagtggggcagatgtgcggcgtgctaaactgacgcgcgatggtcaagaatgaccagtctgtgaccggcctgacgccggtcacgtctgactggacggacaaccgtgctcccacgtcgcatctgcttccagcggagtggaggtaggtatgattcgtcccatcggggggtcattcggacggcggccaccacaagtcttcacctattaatgagggaatgacagggctgtcccccgtgtcaggcgagggacggcgctgggccccgctcaaggacaagctgtggtttagcttccaggcgaaggcacgggtcgagttccagtcaagatagggtgggtccctacccgaaagaagagtaggtagaggcggtgcatgtggtattcccttgaggtataaaaggaggactttgcccaccgagaaaggggacgactctcagaaaacctgagcttgtggaggagggaactaagagtgttctcccgagtttaggaacccttgtaactctcagtctaaatcctatacacaggagtagggtattacgcttgatagcggcccaaacctgtataatttggttgtgtgcgagctagctaggagccttggggacggatacgcgatttctagaggcgagcttcttcccccggccgaactcacgaaaggagggtctcacgatctcccgctagagaggatcattcctgacaatatccatattgaatatattcaaacattttattaatttaaaagtaatttattacatgttagaaagtatcaggaagtatccattacatcttgtacctatgattaattctcattagttattccatcaatgttatttacaacccatcaaaggttttatcttcttttctcattctacattaaaacaaaaatgaaaggaaaaaaacaatcggtgattaaacaaatttatgatagttacttctgaaccatgcaaatgttactttcaattaacattgaagttacttttaaaaattgttaaacttacatgtgctgatctgtgctgattaaatttaatttctagatggagtcatatttttatccctacaacgaatttacttctaatgtcgtgacaaagttacttccgttttatttttaagttacttttctaatatatgtaaattacttttagactttattgaatttacttttatatgtctaagaagtaatttagtcaaatttaaaagtaatttatgtatatgataaaagtaaatttcatatgtaataaaagtaatttacaaatataaatattttttcatcgtaatataataatgtaagatcttattctgaagatttaattgcaacgagcacaatggtgtaatcggattatagatcggataagtaatttgagagaaaactttataagaaagggaaaaaaaatgcatgtgtaatgaaaaaaggcatgcatgtgtcacacggttgtgtaggtgtcgcgcgttaagactatcgcgagaggcctcgctagatagattatatgtttaaaatagaagtattcctagttatacatctaaacgtttacaatcagaaatgcttagcagatagtaaaattgcttccgttctcttatagtaatgaaaacggtcataaaacttctcaaccattttcataaccatatttttctcaaaacccaaaaatagaaacagtattgagaatatgaaaaaccagaaactgaattatatcacgtaggtatcaatcagaaactggtaataatatcggaaacattgaattgtaaaaccacatatttagctttgcatataactatctctactactttaaaaaataagaggtgcttccatcgttcgtcaaaaagaccgggcggaaaaaatagagtgaaaaaaaaccaaatttaaccgatccaaaaaaacaggtgaaaaaaacgtgcgaaaaaaagaaaagaatccgataaaaaagggggcgaaaaaaaccagacggaaaaaaccaaatttgtttgaaaaaaataaaatctgtcagatcaaaaaaggggtgaaaaaaaggaaaagaaaaacgaatccaactccgtcaacgcggtaaaaaaaccgagcaaaaaaatgataaaaaaaaccacgcgaaaaacaaaccgtgcgaaaaaaaaaccaaatctgtccgatccagaaaaaaaaggagcgaaaaaaatgaaaagaaaaacgaatccaactccgccaacgcggtaaaaaaaggacaaaaaaaatctctatctctacttatctctactattataaacattgaagatgtttttgccgtcatccgtgtttaaattagttttaattttattttcagttttaatctctatatctttatctctacttaaaaagaataagaaatttccaaagtcggtaaaaaagaaaaagaagtccgactaaaaaggtaaaagaaaagtccgactaaaaaaatgataaaaaagcttctatcgttgtaagaaagaaaatcgtccgactcaaggaaaaaaaagtctcgccagtaagaaaaaaaagtccgtttgtgtttttttaccggcgactttttttttcacgcgaaagagttttttttcctgcgcacgcgttattgttttttttgtccggttttttaaatcacaccgcgcctcgcacttttggttttttcgacaatttttttcaccggttttttatcccatacgattttggtttttctcatctggtttttttaatccgatctattcgcggcatgtctaccgagttgaaccctggcgatgcgctagcgccatatcgatcgtgcgttttcacttcaatttgattgcaaaaaaaaaattcgattcctactcgtccctcatcattttctctgtaattttccttgctttattttgtcggatttaatctaatggttgccgatgatgacggcgatcttccccgattatttttatcctgagttttatgctctaattttgggtaaaacggaaagaggtgagtggccggataaaaaaccctcaaccaattttgagtgatcgagaaagattcgtccggattttatgggtcgaaggaagcaggccaaacgaaggaggtagcagaccgacctagggctaaaaagtaaaaacggcttcactcgtggctgggtcgaaacaagcagcctgaaaagtaaggaatgcttttggcctaaaacccaagaaatattttcattaactttttttcattataatatatagcgatcccgatgttaggattttcattaacttttttaattataatgtatagcgatcccaatatttcaatttattgctcagctcttaatataacattgaaaaatcgtatttacccgttgcaatgcacgggcattttttctaatatatacttaaaaagtaaagaaatttccgtcgtccgtacagagaaaagaaaattacgcgcgagtaaaaaaatgcgtgcaaaaatattttctgtccgattccaaaataaaaaaaattccgagcgaaaaaaaagtttccatcttcctacaaaaggaaaaaatagtgcgaaaaaaaaagtttctatccgaagggaaacacgcgcgaataaatacctaattaaaaaataaatatctatatctaaaaaaccttctgtcgtaaaaaaaagaaaaaaaaagaccgactcccgtatagaaaaaaaagtccgactcctgaaaaagaagatttctcgtccgtaataaaaaaaaggaaaaaaacatccgactcaaaatccgtaaaaagaaaaggaggaaaaaacgtcccggccaaacctaaagtcgcctcttgttgtccgtatatatctctttaactctaatctaatctatcgatctaatctaactttttaaaaagagaagtttccatcatccgttaaaaaggaaaaaaatgcgcaagaaaaaaatagtttccaaaaaaatgcgcaggaaaaatacggtttccttcgtctgaaaaaaacaaaaaaaaatgctactaaaaactatcagaaagaaatacaccatttctaaaaaatgtttcaaaaaaccacacaagacaaaaaacaccatttatagaaaaaaaaagccgctatgaaaaaactaaccgatgaaacactgtttataaaaaaaacagatcaaaaaacaaacggactcaacgcgcgaaaaaaccgctgtttcaaaaaaagttcgagaaaaccgttgtcacaccctaaaaattcaaaatatataaattgttgtttaaatggaatttttagaaataattttaaaagcctagaagagaagatctaattttaattaataaattccaatataaaatggggccagataaaatttcattaaatactttgattaattctataattcctagattttttttgggatttatttgagctaaggaagtatttttaataaatggaattgcatttaagaaataatttaaattgaaaaaggttttaaaaagtctcttttggctttgggccgaaagtcggcccaaatctcttctctctctcctcggcccaagtcggcccagtccgccgcccacgcgcgcgccctcgctgccgctgacaggtggggtccgtgtcacaccccgaagttttcctcccaagccaaaattgtaatttttataaatgaccctaagaaaatgcagatgaaatcaggagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaattttttttaattccagggaaaatcctttttctttttctttttcctctctttttcctcctttttttcgaatgggccgccggcccattccctccttccttccctcccccttactgggccggccgctggccgaggcccagccaggccgtcccgccgccctcctctcggggtcgccgacaggtggggcccacctgtcgggcccgtctccctcctcccgccgatctcgcgctcgcgccgccgcgccgaaaccgccgccgcgcccacgtccccgcctccccgggccacgtcgaccacgcccgcgcgtgcgccgcgtctcccgcgcccactcccctctctctcccgctcgcgcccgcgcccgagatggccgggattcgaaaatcgaatcccgcctctctctcttccccactcccccacgtcggccggcgattcccgcctctcccggccacgtccggttctctctccccctttttaagcaccgccgtcgccccctctcactttttccccatttcgccgcactctctcgagcctcccatcgcccccgcgccgtgcaacctccgcagccgccattttccgctactccggccgccgctagccgccgttagggtcgccgccaggccgcgccgtcgccgccgtcggattcgcgtggccgagatccaccccgtccacctctcctccgtcgaggttcgccgccggagccctcatcccctcgcgcacgggtgagcaccacctccaccgtcgccttcggctatggtttccgatcgccgtggtccatctccctctctctaatccctctcttctccttccttagggcaccccgaagctcgtccgctcgccgacgtcgttctcccgtggcttgccgtcgccgttcgccatcgtcttcctccgcgccggccaccctcggtgaggcacccctcccttcttttccccttcctctcctcttagtgtcgcgcgccgtcgccttcgactgccgccgccgcctcccgtgccgccggtcgccgccgtcgtcggccgcgtgccgttgccgctagacctagccggccggtcggttttgatgccgagccgagccggcggccgcctttatcgctgcccgtttcctccccttcctagccgccgttagcgcagccgcctccgcatcgcctttgcgccgtcgccttcgccggcaacgcgttcgcgcgcgcgcacgcgccgtcgccgcggtcggtcggccggccgtgagccaagccgagccggtgccgccgccccttctctcccgcgccgctgaccagtgggtcccgcgtgtcggcgcccttcctccctctcccgagtcgctgaccggtgggccccgcatgtcggcgccgcgccccgtgctgacgtcagccctggttaatattgcgcaataaattatttaaggatttttgttatagtaataaacacagtgaatcttctaaaattcataactaattcatccgagctccgtttaatcccattcaagtctcagtaaatcaagaaaaatgtgtagaatccattaaaaatgattttgttccctgtttcagtagtcttatagcctgtttgcaatgtttgctttgtatgtcgctagattccgatccttccgacgctccggtgtactttgagatagtcgccgaggttcctccagcagcagagcaaggcaagtcatgcttgtcacttgatcatattgatcctatattgcaaatgtcctaatgttttctttcaaataccgcatttgttttgcaatattactatgggatggttacctattgttacagccatgctattttgataccatgctcctttgttagcttgggttataacatgattagagttaggactagggtttgcttagccatgcttagttcaactagcacacaatggggagatctcatttaaaacctagactataggtttatatgataatgttagattagtgacaccgctttggtgttggttaattaaaatgaatcacatggtgggctgtgggtgcatggttttgctggtcgcacccatggcagttaaggaccggttcgcgggatgccctggaagaattcatcgtacttaccacaagccagcgtgggcaacggctgggcttgtagtgtggctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccgggatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagactcactttagtttagtctaatgaatttggatggtataggtggatggttgggcctgtcgcaacgtgggttagcgttggacagcagatggtgaaaattaattaattttttttcaactgtttaaatctttcaatttctgtttataaatgctcgctttatgccaatgaaccacttcagctcttctttgttaattccctgcatcatacccccgttccggtatgacttgctgagtacagttggtagtactcagtcttgctctacttttcccaaccccagagttcgagttcgggtcagatgaaggtttctctgaggagtaggcttcgtctgtgccgtcgaggatgcctgtggagtggtgttcccgctgcagtttagtcaaagtttagtcaaggcttagcccctgttgtttttcttttcttccgctgcatttatgtaagactttatgatgtttgtaagacgtggatctgtatgtcaacattgtcgtttgtgtaccccggctggtcctggacggggattttaatgcacattctgcttggaattctattcgggaatttctgggcgtgacagtccgcctgtcggagtcgtcgtcttcgtcgcgccgtcgcccggccgaaccctagcgcgccgccgccgccgttcctttccaaatctggccgcccctttccttctccggccgaattgatagaggggaaatgatcctcgggatctcctctaccttttctcttttggaaacatcggctaattcgttttggaagttcgtggaatcgagttcgattcggatcggcctctttcctccgaaccccgaagtttccttctcgtcgccggccgccgtgggccttcgccgccccctcctagcccctttaaaaggacccccggtgtctcctctacccgccgccaccctcgccttcgcctctcgccgtcctcgtccgccccttcgccgtcgccgaagatcaccggaacaccgtcgccgccgtcgacccgatctccgccgccgtttcaacctcgtcgccgtcgccgtccgttgatcttccgccgctcttttggtcaccggtgagttcgccgcgtcgcgctctacccgttggtgtcctccgttcgtgccgaagcgccgccgttcgccggcgagcgtgcgccgtccgagccgccgccgccggtggtgacgtcatcgccgacgtcatcgtcgccctctcccgtgagccggtcgtagaccgatcgatctcggccgtccgttttggatcaagtcgatctcggccgtccgttcgcgtgaaccgtcgccgtgcgcccggtccaccgaaaccctagcccgctgacgcaataaatctctttttccttttcaaaaataattcattattgcgtcataattcaattaaaatcagtttaagtgttttaatccgatttaatctttaaaaattcataactaattcatcttagctcggatttagttggttcaagtct

SEQ ID NO: 54604 - DNA, 4022 bp, Oryza sativa
ccccaaacaaccctttgagcatgttgatcctatttaaagctattgtttctattcaactattgcatttattttcgaatgtcattgggtggaattaacctattgtttgttatagccctttttgatcttgattactttattccttgataccttgggttattataatttgactagttgagctttatttatattggttcagctagatattagatataattgcttagccctgcttagaaacattagcacattattgggataacttatgactcactattatttaatgatttcacgatggtcaatcgtgattggttaattaattaatgtgccaactaaaacctggtaatggtgggttgtgagcacatggtcttgatggtcgtgctcatgacaattaaggaccggttcacgagtttcggttgtgaaacattaaccgtgccaaccacaagccagcatgggcaacggctttatcttttgtatagcatggtttattgcggggcaccagactgagaagtggcggagataagcccacgggggtcgctggggagtccatgccttgtttataagggggtgattatgatccaggaaggtgcgctgcggtggattgtgttatgcaaggggtattgtcacaactccgttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataactggtaataatttgattagctcctggtttggaatggtatattcctggtttggagatagaactgtgcagccgggatggttgttcagaatggttgggcctatacaacagggtatgttgtgtagcgttggattaatattgattaattattacttaactgttttattaaattctgaaatgtttattaaaggctgtttgtgcaaatggaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatcttattttccgctgcttagatctttattgattgagaggaactatctacctctgtaatgaccttttattcgcttattaattagagtaataattgtactctattatcaatttgttattgtgtgcctcggctgattcctggacgagggttcacacacatgtaagcgtttggaattttggatagaaattccgggcgtgacaaccgtccaacttaacgcaagaaaaaaaaccatcatttccaaaaaaataagttagaggaaaccatccaactcaacgcgagaaaaaaaccgccgtttataaaaagaatcgctctgagaaaccgtccgactcaaagcgagataaaattaatggacgcttgggtcggataagatccatcgattttttttccatctcctacacatcatttgtttcctcacctaatctcctgcattggagaccctgcacttttgtatgcaattatcattatcagacttttttttaagtacaactaatattcttaataacatattatatggaaatagtattaaaaataaacatatttttaattgttatttagagaagagtgcacggtgactattttgtgtagactttatcgttagtgtaggatttgattaacctattattggttgcaagaataagattgaaagaatattttagattatatgtatattgttatatgaataatctaattattttagttaaagcaagcattggtaaaaagattgccattatcgagtttgggtcattacataaagatgctctaattttctaattgtgttagctacaacgatccatataaacattatcattgatatgggtatgcttgaaaaatgtctattgtcattggattattttttttacccgttgcaatgtacgggtattttttttgctagtactattttaaaatagatgaagtaggtacctgttcccggtaatacacgagtgacggaacaccatgactcacttctacatagatctagaagaggtcttttttttcaatatggaactagagcagtgggcagctcctaatttgggtggagattaactccaggatgtaacaccaaatgcgctgcattttctcaagaaaccgaaaaacaggcattgactaagagtctattgcttaacgttttggagtttcttgaaatgcagagctgaaactcctcttcaagttaattgctttgattagagtgggtgattaatagctcaatgtgccacatgtagtggtaactctcgtgcgtgtgcagcttatatatgctgccttcttgcattctgttacgttctgttctctgaccccttcgatatggagacgaaatatagtatcttggagcttctgttggtcagtgccgagggcctgaaacatgctcatcacttaggtctatattcttcaccctatcttgtttcagaaactctaatgctcatgacctccgattttgctcattggcatggaatgtttgcaggaacgcaaagacactacgtgaacattcagttcggggaccaaattttcacgagcaagatcacacaaggtatacattcctgtatatacaacaatagtcaattgtcattgctatcgatagggaaaatcttgctttgacatctgcaagaaatgccacttgcaagctttgttcaggtaaaggtaaaaaggtttggtggaacgagaagttcagattcccgttgtcatcggatgaatgcaaagagcttgcaaaggtcacactgaagatcatggagagggataagttctctgaagacagtctagttggggagacaaagtaggagattgtctgagataaagccgaaatattttaactgaaattaatcgtggttactgagactctcaacatttgcatcttgatgctgtgcgtgcagggttcatgtcggcgacatcatcagcgagggcatcgagagggagttcttgcagatgaagcctgctccctacaacgtcgtgctggaggacggtaggtacaagggagagctcaagcttggcctcaagttcctccccaatgtaagcacgcacagaggtcgctcacatcgcatcaatgacaatgcgtctgaagctctcgatcgtgccagtatacgtagtatcttcgtaggcatttgtcttgacctggatgcgaatcgcaactgtgtatgaggtaagcttggagagcctggagcagtgcaccgtgccgccgcggaggcagacgagcgtcccgtacaggccttttctgaacatcacgctgccggacatcccatggaggaggttattcttcttctgcacacgctccaatgccaaaggaagcaggaagacgaagaacagttgatccgttgccatggtcgtcgcaaagcccttccattttttcttgaaatttctccgtataccctttggagctagctagtggtgtgaactgtgaagtgtctatgacttgcgagctttgaggtgccgatatgtttagaatttagatcaagtgggggttttaaattttgtaaatggaaatttcttaaaatattccgttaagatcagatttgtgattttttagtaaaaagaaaaagaaaagaaaaaacattaataaaaaaagaaaagaaaataaagatgccctgctccgtcggcccgtccttgctttggacttgtttggaccgttcgctttgaatcgaacggtgcatacgcgctgggaataaaaaaaaacagagcagcccacgcccaagttcgcgaccccgcttcctctccccttttctcctttcggtgcccgagtgccgccgggctcgccgcggggcggcacgctcgaaacaggtggcggcggagatggagatgggcctcgaactccaaccagctgcagcgccgtagt

SEQ ID NO: 54605 - DNA, 20389 bp, Oryza sativa
attcctgcagcccacatgcacacttactgagaactcagtgtgcatatcttgtccggtgggtgatgctgtggttattaattcagaacacacagatcaaaatgttgatggtcttatgtctcaggagcactctgtagacaagtattcaccacagctggaatcatctgttcaacatcgattttatggtgctgttaatctgaacaggcatgctgtggcaggagcattagctggcacagtagtcagtgtttctctgcatccaattgatacagtgaagaccattattcaggttaacagttctcgacgaagttcattctaccacacgttaaggcgcgcccttgttgagagaggtagtgtatttggatgaattttacgcacatcaacagagatactggcaactttgatagatttgatttatttccactttctcttgaattgctagacctttttaatgcttgacaaatcctatacaggagttttaggactttatggagggcttgctagcaaaattgcttgttctgcaccaatttcagcaatctataccttaacttatgaaatagtcaaggggtctcttctgcctattttgccaaaggtgacaatatgttcattcattcattttaattttttggctcatgtctatctagttttttgtttaccacagattttaattttgtactatgttgttacaatgccatttcttcaggagtatcattcaattgctcattgcactgctggtggttgttctagcattgcaacttccttcgtttttacacccagtgaatgcataaaacagcagatgcaagtgggttcacagtatcagaattgctggtacacaatctcttgcctcattcttataattcattgccactgctacgtgccttgtttctctattaaaaaaacacctcgatttcaatagaaacatgacactacatttttcctcatccccttatacaagtttatgacttcagggatgctttattaggatgtcttcgaaagggtggcattacttcactatatgctggatggggtgctgttctttgcagaaatatcccacattccgtaattaaggtatttcaaaagtttagtacctaatttactttcagatttgttaattgtgtttacagaatactggaaggccttgtttttctattttacagttttacacctacgagagcctgaagcagttcatgttgaaatcagctcctgctaatgccaatcttgattctgggcagacagttagtaccctgagctataacttgttaaaccgtctttgtgtctttgttatcattagtcaggactgaagttaaactcattggcattctcactactaaattcagtttttttctctaatgttttcgtgcgtaatacagaatttaaattattttacattatgtttagatcatagtgtagtatcagattttgtttcatcagtaaggatgtaactaaactacacctattgttagtatatttagcatgtttgatgatgccatgttaccagttcttgtatttgaacaaacatttgcccagaattctagtcggtagcatatgtatacttcaatatatgtttgtatgctagtgctgaaagtgggtagatgaaagcctgattggtatgactgtagattgtactgtaaggtatgcactgtaatagaagcaaagtctcgtgacttattaaacaaagtctatttgcagttatattatgcacataggctgtgttcttttgttgggaactcctttcctatgcacagaaaacaaagcacggattaatgtatgattaattaagtactccctccttcccaaattgatcatcatatatgtttatgcatcaagaccaaggataatttaaatcacatcatcaagacaccatgtacacattctctcataatgcatgcatcgattaaaacactataccaattacaccttagcatgcactcattctcccatgctgcatcaatcgtattctgatgaaattcgtgtccatgccatatgatggtcaatttgaaaaattttgaatttcattatatggtgatcaatttgggaaggagggagtattagctagtgtttttttttttttgaaaaatggattaatatgatttttttaggtaactttcctatagatttttttttcaaaaaacacactgtttagcagtttggaaagcgtgcttacggaaaacaagggaggtggagttgggaactcacgctaaagaacacagccgtattctgtttgttctttgttctctgcttggatcagcaccgcacaaaaatcactgccaaaatcattgatattttgcattgcagcttttctgtggaggttttgctgggtctactgctgctctgtgtacaactccatttgatgttgttaagacgcgagtacagttacaggtaacataaagcatgctttatatctgtaaatcattatcatcaattaaattgcttatctggttttactggctgaagtcacacgttggtcttttcaaaagtatagttgctggtatgttattggaagtaaactattggttacagcagaactaaactgagtattacccatgtttgttaggcactcagccctattagcaagtatgatggggttcttcatgcgctcaaagaaatttttcagcacgaaggcttgcagggtctttacaggtacggtcatttccgcaccatattggccatgctattgaatttaggttcttatacaagtactcaaattattaagcaacatatgtatttccaggggtttggctccaaggttggctatgtatatatctcaaggggctatatttttcacatcctatgagttcctcaaaacaattatgttttctgaacaagagcttcatgcaaggaacttttgatcacagaatgatgcagcgtggttcaggaacacttaaagcatctgagtttcaagaacaatctcatgaactaagtgggatggttctattaggctagaggattgtagacttgtggttactgaaccaaacatttcttaggtcttgatagtaaacatttgtacaagtgtacattacatttttggatacataggcaaccaaactggtgagcagccatttttgagtagaaatcacatctaggaaagcaaaattttgtatcatcaacacagtttgtaaattcccttacaagcaacctgtgactggatgtgcatcctaattcctgatattgaattctgacagaaaaaaagaaggcaagtctttttttacttgaatatatctgctgcacagctgcacttacatacatacttacatccactcaaaggaaagagaagtagtacttgaaggtagccctcctagcagctctctctgtgttgctgccttgtgcatatgcatgaaacacaaaggaaatacgaagcgcaaaaaggttcaagaagcgaccgacggcgcgtgcggcctcgtcgcgccagcgtgccgcgcgaacctgaccgagaagttggcctcgcactcgccgtcgccgaggcccccgttgtcgaagttctgggagtaaccgagcgggtcgtagttgagcccgctggcgctgaggacgtacgtccgcaagcgccggcgaggaaggccgatccacctaagcctccgccacagcgccgccaggccgaggccgaaccgtccccagcaggacgcggccgcgcggcggctgcacgacgcgcgcgtcgccgccgccgccccctcctctcccatcgcccggaagcgtatgcgaagccgaggagaggcggccgcagaggacagcaccgcgttcgcgcgcgcgcgcgttccagtcagtgtgacaggaggtgtggactgtggagtggagagcgttgcgccgtatggcccgtagcggcgtcacggccgcggcatggggtccctgcaattgatgcttagttcctggaatcttggtcgacgtggggaatcacctgcactggatgcgctagtatatgtgttgcaagttggcaacaattgaacgtgagacaattagacaaaaaacgagcctggagtcggtaattctctctggcaaaattggcatccgcgcgggcgcaataagacagttacatttatcttgtgatgtgaacatttgtggcttctcgttggtgcttgcagatggagacaaacttgaaaatgacccttttcccccctcttctgatgaaatgaagtgcatttttcctacacgggacaagaaaccgtttatcggatacgggaggcagaaattgactccaagtccaagctgacgaactgaaccaacgtactgacatacatctccaattctctccatctccctcctttaccgtcaccgtgagaagagctccgggcagcgcggatcttggaggggcaccttgcgtgggtgtcagacaagcacgtcgtgcgcagagcggtatccatctcgacgcagcacaggaacaattaaaaccaagtgaaaccccgtgcattattttgagaatttagtatgataacaataaaaaaaataacgtgtaatatagctagataacatcagattaagtaaattaatatggtttatgctaatttaaatttaaatagtatgtagaatggtgatttaaacataaaaaacaaggtgatatgactttatggaagaagaaaagtaggagatagtttggactgtagattaaacatctaaaggctaaaaacaattaatgtgatatgacttaattagaggaaaaaaaagaaagataatttggaccatagattaatcatttaagcactaactaagtgaggatgaactatataagtatatagaatatcataaaaaataataaagatatacattgaaacattatatgaattatgttggttgataatttaacatgtatgtatttgaaaagctcttaaattataaaaactataaagatataacatatttgtatgatgtttaaatatgatgattgttagtggatgataatgtggcatcttgttaattagtggattagtggatgatgatgtggcatctttgcatgttaagcttaaggagttagtgggggataactttatagaagataggattaggaacaggtataactcaggatgtaaattaggcctggtttagatccaaactttttcttcaaactttcaacttttccatcccatcaaaacttttctatgcacacaagcttctaacttttccgtcacatcattccaatttcaaccaaacttctaattttagcgtgaactaaacacactctaagtgaactgaagtcagaactcagaacattttcagaggttacctgacagtagatgagataatgagatatgctgaacaaaacgttcatgtaaaaaacgaactcagatattgagagctggcatgtactgcagactaacaccaccaagaagaaaaacgagaaaaaaactgagattagctctgcattaggctttcttcggtttagcatgttcttttcttttttgtaatggttacatttctgttaatgaaaatggggggttacacccttgattaaaaaaaaaaggttcatgccaagttgttgttgtgccaaccttcctaacaaaaaacatttttgttagccattctgcaagctgagagatgcatggagctgaagtctaaaccacacgatgttaattacagcccatacaactataggatatggattttcatccctcgagaggatgtcctctcattgtttgcatgtcatttaagtagttataatattttttaaaaaaaattgacaacatagattaatatgaaatatatcattccacaaaaatgcaagcctaaatttaacttctataagttgcaaaaaaaagaacaaaataaactaaaaatagtaatcgcacattcaattcgcagctatatttgttatttttgttacaactttagaagttaaattttaacttgcatgtttgtaaagtgatatatttcatattaatctatcttaccatttttttaaaaaaaatttatgactagatggcatgcacgaaatgagggattccctcgagggataaaatcactttctcacaagtcacaactttacatgtactgtatgttggtagcttattagcgtgcatgactgcatgggtatgtagggtagatcacccattaattcatcgtggatcgaacttacatacgaaaaggtaaacacgaagtgtgaccactccatatgaaataaatgttgtgaatacaagaacgatgcttgttcgcacttaagagctctcaagtaggagcagatacaaatgctctcaagtaggagcagatacaaatcaagaattgagcttgggtattaaaagcgaggagataactgcatttatgctgtcattactcatttccatagtgtgcagaattatctaccatttccttccttcacaatttcgcatgtggatgaaggcatgaagctcaagcgaagcgtgacggaacttgtggccgcaagctaggaaccttaatggttgctatattaaggctgttcatcgtgcaggcacaagttcatctccatgcattccagtaaagaccatttttaggacaaacacatcggtttcaaaaaaaaaaaattaggacgaacagagcaatctcttcgcatgcaacagcggccgccattttccctagattcaccttccattggtagcttggttgttcaccaatggcgcacttaggggcggtcctctgcatccgtgttgctctcgtcgtcgtcctcctcccgtcgcttctggcgaccgtcgccgtcgcgcacaacgacaccggcgagcacaagaactacctcatcatcgtgcgcaagccgtacgagtacgaccacaatgtgtacaagaccgtgtcgagctggcacgcgtcgctgctggcgtccgtgtgcgacacggccaaggaggagctcgccaccgaccccggcgccgagacgcggctcatctactcctaccgcaacgtcgtcaatggcttctgcgcccgcgtcaccagggaggaggtgtacgagatggccaagaaggactggttcgtgaaggccatcccggagaagacgtacaagctgatgaccacgtacacgccgaaaatggtcgggctcaccggcgccccggcggcctaccatggcggcttgtggaacaggagcaacatgggcgaagggatgatcatcggggtgcttgacgacggcatcgccgccgggcacccgtcgttcgacgcggccgggatggggccgccgccggccaggtggaagggccggtgcgacttcaacagctcagtgtgcaacaacaagctcatcggcgcgcggtccttcttcgagtcggcgaagtggaagtggagaggggtcgacgacccggtgctccccgtctatgagctggcgcacggcacgcacacctcgagcacggcgggcggcaacttcgtgcccggggcgaacgtgatgggcaacgggttcggcacggcggccggcatggcgccacgcgcgcacctcgcgctctaccaggtgtgctccgaggacagaggctgtgatcgggatgacatattggcggcgatggatgacgccgtggacgagggcgtcgacgtgctctccatctcgctcggcgatgacgaggccggagatttcgccggggatcccgtcgcgctcggggcgtacacagccatcatgaggggcgtctttgtcagctcgtcggccgggaacaacggcccgaacccattgacggtctccaacgaggcgccgtggctgctcaccgtggcggcgtccacgaccggccggaagttcgtggccaccgtgaagcttggcaccggggtcgagttcgacggcgaggcgctctaccagccacccaacttcccgagcacgcagtggccgctgatagcggacacccgcggtgacggcacgtgttccgacgagcacctaatgaaggagcacgtcgccgggaagctagtcgtgtgcaaccagggtggcaacttgaccggactccggaaagggagctatctacacgatgccggcgccgccgggatggttctcatcggccctgagttcatgggctcaatggtccaacccaagtcgcacatcctccccgtggcgcaaatcgtctacttgtcgggggaggagctcaaggcctacatgaaatccacgaagagtccgacggcggcgctgatctacaaaggaacagtgttcggcgaccgcaagacgccggaggtggcgcccttctcgtcccgggggccgagcaggcagaaccaggggatcctcaagcccgacatcaccggccccggggtgaacatcatcgccggcgtgcccgtgacctcgggcctcgccacgccgcccaatccactggcggcgaagttcgacatcatgtcaggcacgtccatggcggcgccgcacctcagcgggatcgccgcgctgatcaagaaagcgcacccgaagtggtcaccggcggcgatcaagtcggccatgatgacaacggccgacacgttggaccgccggcggaggccgataaccgaccagaaaggcaacaatgccaatatgttcggcctcggcgccggcttcatcaacccgacgaaggccatgaacccgggcctcgtgtacgacctgacagcgcaggactacgtccctttcctttgcgggctcgggtacagcgaccacgaggtgagctccatcatccacccggcgccatcggtgtcctgcaagcagctgccggccgtcgagcagaaggacctcaactacccgtccatcaccgtcttcctcgaccgggagccctacgtggtgagcgtcagccgcgccgtgacgaacgtcgggccccgcggcaaggcggtgtacgcggcgaaggtggatatgccggcgacggtgttggtgacggtgacgccggacacgctcaggttcaagaaggtgaaccaggtgaggaagttcacggtcaccttcaggggcgcgaatggcggcccgatgaagggcggcgtcgccgaggggcagctcaggtgggtctcgccggaccacgtggtgcgcagcccgatcgtcgtctccgcccaaaagttcttgaacggtaacacgagctcctccgatcacgcgggccattgattgttgattacgtagctttgccagtaaatggggtacttgattagacccccaaggattataaactgccccctgatgattgtcctcgaaaaaagatgaagagaaagacaaaataactctattagaagatggaccaagatgcgaagggattgcgtggccggaaaaaaaaaaaagcaacatgggattctttttccatgatggccatggcctggatatgtgcccctgaaccaaactgcttcgatattgggcttgatgggtttgttacggatttagacctttatacaattagcatagctaaaatttcgatcttattgttgtgggttggatattggatgatagcactacggcactacctttgtggataagggatatatctcacacacaattcattcaaatttagacatttagtagtagataaaatggtgaaaaaaattacattaacggcacacaaattttgataagattttcttttgttcttttgaaaggtctccgcgggggtagatctccaatgaacacgcacattcacaaaatttgataataattttttagaagtcaaccaatacaatatactcgcacagagtcattgatgcaaatagaaaaaaaaaaacaaaaacaccaagaaactgctcgccaaggacgccgtgctgatagagaaaatttccacgcgtatgtacttaggaaagttcctttttattaagaaaataggataaaaactttgtctcgtatatattaataaaccataagtattcaaaaacatgttgtttagccatgaagtcaacttctggattggtcgattggtcacttcggctctaccgttgtggctccaccgttgtgtgcttcgctataggctctgttcggctgcacttaatttcattgttgtgcagccaacacaaacaatgtgttgtgtctgtagcagcagctgtatcggccagccaaacaatcccatagagcgtcaaaaaaccataccgaaacattctcagtgcgctaaattttttttcatgaaaaacagtctaaataatcattgtcgatgataaataataatcccttcaccgtttggactgaacaatatagttagtttcgctattggtgataatatgttatacacttctagcgtatttttagagcaatcatacaaatacactttctaaaaggaaaattgcggatctcggatagtatccatttcgattttggaatgcgttgaagctccaacgggtcacagggttttgacaaggagagagtcgacctttatttatttctttcatttattgccaatataacacgcgctttgcagcttgctcggcagtcctggtcaaagtcgcctcatatttaatttatctttcacaacgcttttgcagttttaatgtatttttcctggcacaaacgtacaagcaaatatcaggttgcaaaattattttctattaaccaaatgggccagctgcaaacctacaagttgcaatagagtgtgttcgtttgaatcgtcaagtcctcgttttcttgcaaggttaggacgcgcaagactgtactacgcaggatgttggcctgctgccttgccctgtcgtgtcgtacagtacatagcatgttgcgaaactttctcttgaattgcccctacgcgttgttagtacattattattattttttcggtttgaaacatcggatgtatcgttattttgcttaggtcataaggtcattacaactgccaggttccagcagtcgaaaaatcgggtggcagacgacttttgtttgctaaaatacaacatattgaggatcagccgatcatgatgttttgctgcgattgcaagataatgatcgccggatgtttagctgcgattccaagataatgatggccgcttgcttgcacgttggcttctaatctaatgtaaagtacaggattaatcttcctgacgacgataatgtgcacgtcgcagcgttcattaacggaaaaatagcatgatatccaatgggtaaattgatccgtatataaatacgacggcatttgcaaaaccagaaaaacagttatacaagaaatacaattatactcaattctaaaataccttttaatccctttagtgtagtagcaaattcggcatgagacaaattcggttcctagtcatctatcatccaatgcaaattgccgcggtcccagcgaaacaagacctttttttaattttaaaaaaacagcgacccagagttgacttagctttaggcaccgtttattcttcgaattatctcatcgaactcatccctggttcttaaccgccgctaatgccaacatatctcctccctccccgctcgactcgactgtctccgtctcaccggcaatccggcggcaatggacggcgtcggcctcggcgtgcacaggcggtgggacacgtcggggagcgggtcgcagtacagcttcaggacgtcggtaagcagcgtcgcggagatatccaccgaggtgggggtggaagtgagcccgccgccgccgccgctggcggcggcggcggacaaggtgtttgtcgcagtcgccgcggacgtgaagtacggcaagagcgccttgcagtggacgctgcagaacctggccaaggatggcgccaaggtcgtgattgctcatgtccactgccccgcgcagatgatccccatgagtaagcctccagtcctcaatcatttgtttgatgatctgcgtcacaggagagagatttaagattggataccttttaatttcggtaatttagcgacgagtttggttatttggatcccgcttccgttttgaatctatggttagcagtttaataatggatatgattcgttgacattggcgacttgaaagccgaatgccagtgcaaactatgcatactccctttctggctttcttacagtacaatagacatttgcacgcccaaacgttgcttgacgaagtttctcatgagttgtatgattgtatctgccggcaatgctgacttcgtgcagatattctagaaaatacatacaattatttgttcatgtagcattattggtcctgtaactacttccaaaatcctattttgccgtcgcttcgtggaaaaaagtaacctagggtgtattgttaaaatgcaagaatttctatactaatttcaatatacctctacgtgggactattaccaaatcccaacaacactactacacatgcatcaaaggtcatcctcttattgcccagggtaacaagttcagaagcaatacgttaatatttgcaaacgatgcaactggttcacttctgatttctgacttctagtgcgatcagaaatcctccatgatttgtttgtcaccagtgcgatcagaaatcctccatgatttgtttgtcaccttttaaatagcttgtccttgattcctattgtttcagtgggggcaaaagttcattataccaagatgaatacaaaacaggtgaacgactataggaacaaggagagagaaaaggcagaggagaaactagatgaatatcttctgatatgcagaaaactgaaggtgttcttctcaaccactcttatgtctttcctaatgagcaatcaacaaagtaataaattacctaatacccaattatgcattctactaatattactcgagaagatatatcaatatatatctcaggaataatttgatcaatatttcgttttctcaggtcagctgtgagaaactaataattgaggaggacgacattgctaaaggccttacagatcttgttgcccgtcatggcgtcaccaagcttgtcatggagcagcagcagacaaacactactcaaggtgaccacaacctcataagttttttttttctgatgactagcacacacattgcacatttaaaactgtttcacaaaatattgtttcttccctgataagtactacctccgtttcaggttataagactttctagtattgtctacattcatatagatgttaatgaatctaggcacacatatatgtctagattcattaacatatatatatatatgaatgtatacaatgctagaaagtcttataatatgaaacggaggaagtagcattcagtgtttgccgctagcaagaattgagaaacagaaagtcccctcaaaaaaagaaatgagaaacagaatggtctgtaaagtctttaacagtttcgaacctggatgttttcccaatatgcaggaaaatgaacacacctaagtccaagacagcactcaagatattggaagcagcagatccttcatgtaagatatggtttacctgtaaaggacatctgatatgtacaaggtaaggttaagccaagcgggtcaaagcagtcttacgatagatggttttcagtgatactaacatcagaaaagcacattgaacaacacgtgaaaaatagctaagcttacccgtcaacattgcagggaagcaaatacaaccgttcctgcaataccaccatcacctgcacacacagttgcatcaacattgtcatcaagcagcatttccagccgtatgagatcaatgtcattgcacccgtcagagagtgaagcatcaagctcaagcggaagtccaaggcacaatctgaacagatcaagaacagaagtggcaaagtatccctcacaaggatctggcactgcaccatctcagttatttggacattcagatcaagatgtcaatgaccagccaacaagaacagcaatgggttctatagattcctgggatgaatttgagagatcgcaaaactcctgctacgattcatcaagaaatagtgatacagttagggtctctggatcagcaatgcagcagcccatgtatgaacctgatgatgaccattttgtatctcctcgtaaactggtacatatcgcctgatgtactgtgcaagttgaaaaacataagagtaggactcttctcaatgaaatgtaacacataactgaactttttgtgcaacacaggagaattcaggcgatgatgcagacatatatggtagactccaagaggctcttagtgaaactcaagacctgaagagagagacatacgaagaatcaacgaaacgtcggaacgccgaaagaaatctgatttcagctcttcaaaaggcaagtcattttgcttcaaaagtccataattcatactgtaaaataaaaagatagaacttatcttacaggtcaaagagttggagaacctgtatcagaaggaagtcatgcatcggaaaataaccgaagaggcactggagaaacagatacaggagacagaagaaacggaaaggcactgcaatgcattatatgacaagctgcatgatgtggaagaacagaagctcatggtggagcagcacataactgaaatggaggcagttttaaaagaacgcgaagataggctgcatgatgtagaagagcagaaattcacggtggagcagcgcataactgaaatgcaggcagttttaaaagaacacaaagataagctgcatgatgtagaagagcagaaactcatggtggagcaccgtataactgaaattcgttcagttttaaaagaacgcgaagagaagctcgcagagagcaagtatctactccaagtgctccaagcagataaagagaagctacaacaagagcgagatgccgcagtaagtgaatctcaagacttgcgcctgaagaacaaacagagaatttccatgccgggtgaagatctaaacaccgagttctcctcttatgagcttgaacaagcgaccagaggcttcgatcaagaactcaagatcggcgagggcggttttgggagcgtctacaaaggcacactccgcaacacaactgtggctatcaagctgctgcacccacatagcatgcaaggtcaatcagaattcgaccaggaggtaatccagttcatcagatcactcacataactccatcaaatcaagttggcaaccatggctaaccaagcaattgacaccattattgcagattgctgttctcagtagagtacgacatccaaacctcgtcactttgatcggctcttgcagggaggcatttggcttggtgtacgaattcctccccaaaggcagcctcgaggaccgcctggcctgcctgaacaacacgccgccattgacatggcaggtgcgcaccaggatcatctacgagatgtgctcggcgctgagcttcctccactcgaacaagccgcacccgattgtccacggcgacctgaagccggcgaacatcctcctcgacgccaacttcgtcagcaagctgggcgacttcggcatctgccggctcctgatacagacgaacaccggcgccgccgccgccgccaccacccggttgtaccggacgaccacaccgaaggggaccttcgcgtacatggacccggagttcctcaccaccggcgagctgacgccgcgctccgacgtgtactccctcggaatcatcatcctgcggctgctgaccgggaagcctccccagaagatcgccgaggttgtggaggacgccatcgagagcggcgggctgcactccatcctcgatccctccgcggggagctggccgttcgtgcaggccaaccagctcgcgcacctcggcctgcggtgcgccgagatgagccggaggcgccggccggatctcgcgaccgacgtgtggaaggtcgtcgagcccctcatgaaggccgcgtcgctgaccgccgggaggccgtcgttcgtggcccggccggacgactccccgccgccgtcctacttcgtctgcccgatctttcaggtagcaaaaaatccgtgattaaattattcctgaaaaaaatcgaggcaaaatttcctcgtgattggatgatggcttccatcggatgctctaatcagctgaagaaagagtcaaaattttcaaacttaattttaaaattaattttaagatattttaaacgtaattttttattgacttttaaattatcaagaatatatatatatatatatatataagtttacccaacaatttatttttattttctaaaaagccaaaggaatatgagtaaactatgggggatgattcaaactcgtgttgggatggatgtgaaagcaggaggagatgaacgatccccacatcgcggcggacgggttcacgtacgaagccgaggccatcaaggggtggctcgacagcggccacgacacgtcgccgatgacgaacctgacgctcgagcaccgcgagctcatcccgaacagggcgctccgctcggccatcctcgagtggcagcaacagcgtcaacggcatcagccgcaagaggaggacgacgactgtacatgagcaatctctcatcaatcatcactcaccgcagttgatatcctccatacctggcgcttcgcttcgtcctgactgtagatcctgcacatacattagcattagctttgcttgggttgaaatttgaagatccaagattgctcgagaaaaggggaagtttaccctgttcgtcttttgtgctcgttaatttgatttgcgatttccgctgtggagtacagacatttgcagttggtaatcctacccaattttacccatgttgaatctggttctgatccgtcttcccctgtatataagtgacgaacagcgaaaagagatgtgcacggaggcggcggcgggcggcctcccgtgatcgtgaggacgtgaggcctgatccatcccggtgcacagtggctggcccgtgaacagtggccttagtcactgagaaaagtttaatcccacaaaattcgtggcccatgaatgctaacgcatcggcccatccatgcctctgcttcgggaggtggcccaagcaaaacttttttatataggcccaagcagaactgttcgttgtacttgtgttgcgtgctcgcttcattgcttgacgctggtcttaaactataaactgcatcaacttgtcacgtccacgtcgaatgctcggtaatttccaagttactcagcttgggtccacgcggcaaacatcgtccctgcatacagtagtatacaatacatctccctttagcgacatacgcgcgtatgagctacgtttgcttgcttgatcacgccaacgcgagcgcaaatggcatctcgtcccaccgttgtgtaaagtcatagcgtcgactttggcttctggtcttcaaagaaaaaaacaactttgcgttattaactttgtgagtcaatgcatgaaatgaaaaatatattcggtgctgactacttctgctttcttctgtaacttgatctcgaaatttccattcatgaaacggctgggcagttactctgcagctgcatggtcttgtgcttctcatttctcaacgtcaggaagcagcaatggatagcgacggcgaagagtacgacgcgatgtggagcgctcggtgcagcgtcagctcgtcggccggctctctgcaggacgccggcgaccagtgggacgagcagagcctggccgccggcgaggacaaggtgttcgtggccgtcgacgaggacgtcgagcacggcaagagcacattcctttgggcgctgcagaacctgtccacggacggggccaatattgtagttgctcatgtccacagccctgcacaaactctcagtaaaggtaagcatcttgcttctcctgctttgacagctacaatcacctggtgcaattcagtttacatttctcgatggggacaaaagttcactgtaccagaatgaagcctgaagagatcagcgagtacctgatgttggcgaaggaagaggccgagaagaacctagatgaatatgctctgatagcgaaaagcacaggaaaagatatgaaggtaaaattgtctcattactttttttgttagtgcttgtgaaaaaaattacttgcatcaagtaacgtggggacgaaatgatgtttatcagtcaaaatataatcaatatgagcatgaacattaatcctactatttcagactgattgtcagaaagtactaattgacatggacgatgtcgcaaaaggactcgaggaacttattacccttcatggcatcaccaggcttgtcatgggagcagccgcagaccaacactactcagagtatggaccacatctgcctaatgtagcgtttttcctgtaatgttttcaagaaaattttactatttctcatcgcaaataaaaaaaaaggggagagagatagagagagaaatttattcctggaactggaggctctggtacttaagacggtgtatcggactatgtggataacttagtacttgaagctctgaagatttatcaggactaggctatcagcgtcagcaaattaatgaactaaaacttcagtcgtaaatttatttcattctacaccagcatcaggagtccaggactaatcaaactacataggtagcaggaatagatagaacattttatgagatgaatccatactaaatatatgtgcacaaaccttatgatattataacctgtagggaaatgaaagaaccaaattccaagatagccctcaagctgatggagactgcatccccatcatgcaagatatggtttacctgcaatggccatctgatatgcacaaggtaaagtcaagtgaatggtcatttgctacctgactttttgaacttcatagagcttagtgcatctcatgcataatagtacttcgtacagcatgcggagaattgtaggacacataatgctacatttgagtatctttacttctgtcaacgaattgaactaggataccagtgtattgcactcttaccaagaaaccaggaaaatgactaaaatccattagttgtgtgcacttacagggaacccaatgaaaaccttcttgcaatatatgtgccgcctgcacaaagcaacacggtaccattgtcaatgtgcagcatttcaagccaaatgagttcgatagagctgaagaaagaagcaccaagctcagaagaatatactttaagatcattggctcaatcggcaatgagtgattgggactacattttcgggggtgactaaactgactatcctaacatatttagaatttctaatttacacccttgcaaaaaaaaggttatattggattttcttgcttaaatgatttatgcatacagcatcaaattgttgttttacatgaattcaaggggccaaaaaatgatatgtagtttcaatagttctcccaaaatatagtttcaagaatccagaggtttcaataatttatagcttaaatttaatactctctgcagtcatgaatatttgatgttgaagacaatattcagtcaaacttataaaattccgaccatcgatagtttctcaaatggctagtttgaattctgaaaacaaaagaaatggtatgctagaattcgccttgagaagaactatcataatatcataaacttattagattttataaacttgttataatataaattaatggtcataattttagaagtttaaccgatcttgccctaaacgtcaaatattcatgaccagaggtactagtatgtttcttctttgcaagctatattcctgatctgtgatgaaattactgaagcttactactaggatttatacctcagaagtcataacttaaacagtaggacatgtagaagcagtgggtcaaaataatcgtttttagttatttagaacaaccgtgttaatcatatatctgcagaaagaaaaatgaactcctacatgaggagaacagatgatttgagccatgctgttggcatttctcttctaaacgtagtcatgctaatctctattttattcataataatgaactccagattggggaaggacagggtatggttcattaaggactgatgatgcaataagtattcctgaagccacaactctagctgcgattgttgacgatacaaacaaacaaagatcagtgatgcactctcctcaggaatctgacagtgtcaatttctcatcaccagcttgtgatcccgtaagactactaatgctaaatcattaagttaccaaagtaactagctgtaagtaaatctctcttaatgattggtggcatgcagcaacaagaagaagaagaaccaaatttagatgaagacatgcatgatatacttaatgaggcatgcactcgagctgaactactcaagaaagaagttgatggtgaatctagcaagcgtcgcaaagctgaaatggatctacttatagctcttcagagagtaagctttgttttattggctgactctgtagcttgtatatttgtagagaaaaataaataaagtaaccctcctttggccagcgtaccaaatgtgacatgcctccaaaatactgcttaaattaatttctctttttaggacaagtataactaaattagtcttacaggttcaagagtcagaaaaatcatatctacaggaggtgaaccagcggaaagaaactgagaggacacttgcaagacagaggctggagatcgatgaaatgaaaaggcgacacaatacattatatgatgaactacaggatacaaagaaacagaagcttctgctggagcaacatatatctgagattaaatctgctgcaaaagattatgtacaagagattactgaatattttatacaagaatcatgtgaggaagccaagaaattccaaaaga

SEQ ID NO: 54606 - DNA, 15551 bp, Oryza sativa
aaaactttatataggattcatctaaagaaactaagaggagaagaaaagctgagagcgagatgctctccgctcttaagaaggtaagatactaagacgtttgtttcagtggtctgtactcagtactatgaattgcaggtttgtcatgaaaatgtggagtactcttacaggttcatgacctggagcatcagtatctgaatgagttgaaaaggcgggaagcggtggaggagacatttgcacggcaaaaagaggaaattcaagaaacgaaaagagagctaaacaagatacgtagcagacatatgacagagatcaaagctcatgaagaaaagcttgcagaaagcatccgctttatccaaaagattcaagcaaagtatgacaaaacactacatgagagagacactgccatagcagaatctgaaaaattgcgccaaatgaacagggatggagcttcaatgatagcaaccacccagatcgccgacttctctttttttgagctgcggcaagcaacccaagactttgatacggcactcaagattggcacaggcagatttatgaatgtgtacaaagggttcatacggaacacggctataactgtaatgttgcttcatcctcagggcctgcaagggcagttagaattccatcaagaggtaaatgagataactaaagttgaagctatatagccatacatttccctttcagcagaagagcactgaatcatcattttctgtatatgtggcgtcataactgcaggttgttgttctcagtagactgaggcatcctaacgtcatgatgctaataggtgcatgtccggaagcttttggcatggtgtatgaattcctcccaaatgggagcctcgaggaccagctctcgtgcaagaaaaacacaccaccactgacatggaagatgcgtaccaggatcattggggagatatgttcagccttgaccttcatccactcacagaagcctcacccggttgttcatggtaatctgaaccccatgaacattcttcttgatgccaactttgtaagcaagttgcacgtctgccagcttctcagaaaatacaacaccggaaataacacttcaggaacatcctcctacattgaccctgaattcttgtccaccggagaactcgccccacgctgcgacgtgtactccttcggcattatcatcctacatctactgacaggaaaatcaccacagaacatcacaacaatagtagaagatgctatggagaaaaggcagctgcattcaatcatggacacctccgcagggagctggcccttcgtgcaggccaaccagcttgcgcatctcggactgagatgcgccaatttgagtggaaggcaccggccagatctcacgggggaggtgtggggggtgatcaagcctctgctgaaggatgcttcccagaattttggatgcaaacaagcatttgaagctctatcagatgacacacaagcaccatcctactttatctgcccgatcttgcaggttggtaatttgcgaccacatgataaattgatgtgatataattgatgatttcacacaaaattgacggggttctaggtcgatgtattagtagtgctatactggtttatccaattgggagtatgtattcgaacttaccagaacttttgctccgatggatggtgaacaggaggtgatgactgatcctcacatcgcagcagacgggtacacgtacgaagccaatgccatcagaaactggctcgacggcggcaacgccaggtcgccgatgacgaacctgagtctcgaaaaccgcgagctcacgccgaacagagtgctccgctcggctatcctcgagtggcgacagcacaggagatgacatcaacctattcctcgatgcggactcagctcatctagatgcttcatctcacctgtaaaatatagtgggggatttctggtgttacctgaacatggcgtgtgcctgtgcagaagtgtgcctctaaaatctcaatcaccatctatcggcgtgcacctactctactatcttaggtcacaaaaggtggatgctcatgagcggaatcggatccttacctgtgcgcgcggacggcggaggggcggcgagtgctggcgccgcgccgggccggtggggtcgatgtgacggcaaccgacgcgcgctccggctcggattcagcgcgggcggcggcgaaggcaagcggcggattgcggcagcaacgtaggtcccctcaccggttgcgcccccgccgcctcgccgcgaagggcgatgctgccgcacgctgcgctcgcctacggccgccacgcgctaccgctctcaccggcagagtcgagccggaaaggcagctcggttggtgagtccggtgggctcgccaattctcatgggcctatcgccgctacgagataaagaaggaataagttcaccggaggtcttaacagcgagattttttatgtcccttaagtacaaaatgtttacccctaaactcaatgtttatggcagtatatatatatatatatatatatatatgagtggtttcgctgacgtggcatcttagttagaaaaaaaaattaaaaaagatacgtgggacccacttataagttgcacatctcttttctactcgttttctttccccttctcttctctattctctcttctctcttctcttcttcaggccgacagcaggcggagagccggcgggcaagcgtggacgcaggcggcgggcggagagccggcgggctgctgtcgccggagctgcatagccggctcctctccgaccaccgcgcacccttgctctccctcctccgccgccgggacgacgagctccggaccaagatcaagtaccacctcctcgcgctcggatggaccatcgcctccaagcccaacctccctggcctcacgcccaggctccgctacgtctccctcgccggaagcatgcatgcatgcatagcaatacacaaacatatatatatggtgctcaactaatggctaggtcctcgcatgtgcagcggctgcaacaacaagagcacggcgacggcgatggtgcctccgcctccggccacctccgccgcggcccagtgctcctgccgccgacgacgccctccccttctcttgcgtcaccggccggcgccgccggcagccgaacctcttgtgacccgtgggccgtggctccgcgcacgcccgccgctccgctgccgtgctcgcccgccgtcgcgctcgcccgcagcccggcggcgcttcgacggtgaagagaaaagtgaagaggagaagaagaaaagtgaacaggagaaaagagaagaaaatatgtgaagatgacatgtgggccccacgtacttttaaaaatttttttgctgactaggatgccacatcagcgaaaccacccacgtatactgccataggacctttagtgcacggtttgtataagtttagaggtatacatttctggtttatggttaagggacttaaaaaaaatcttgctgttaagttgagggatctccggtgaacttattccgataaagaaagcccatagacaccccaggcggtgtgggccccattaaaggctcaagctcaagatacacggcccagtatacaacggtgggcctcggccatgttccgcacgttggcccgtgaaatgcagatatactcggccctgatcaggttcagggcatcttctcaaaataagaaaatccatgaaataataagtatcatattttttttaagaacacggcaaagatctgcgtatcatttcattaagataaagaacaaaagatgtacggtgttagaaaaaaactccgacactcgcccaccaagaatacaacagaatactatcgacgtttgatgtctcgactacggtatttgcatggcatagggatcgttggtactaggatatacgcgagactgaggtaaaagagacggagacatcgatttttatacaggttcaggcccttgaattgtcatgtaataaccctacatcctgttggccgaagccggtcgttgcccttattcaccataatcacaccagtacaatatttagggtagcctatctaactgttgtcaacatggcagtctgaaggtctgactcgcagtcgacaacagggtagtcttcctcctcgaatccgtgctggcgagatcaaagatagcgctttcgtctctactgacagtgtccggagacaccataggggactagccgtgcctatctctgaagtcgatatccggcgttttgtcttggcgtatgttggcttgtatgttgatcttctgtcttgatctattattccgtagattgtggtgggtgttgattgtctgtgttcgtgtcccctctcctcctacgaggccttgtatttatacccataggtatccccttgtccaagtagaactagggaaacaaatatggatacaatccgagtagtcattgtcgtttccatgtagaactctggttgtctttccttatccggaactcctcctatatccgcaggttgtttccgtataggacatggtatgtggtgggtcctgccgagatttagtcaactactattaggtatgtggtatccataaccctgacaaataccacacacccaaagaaaaaaaaacacaaactagtgcattagcagcccagtcctagcaaagagatcatgaagcctagcagctcctgctaggcaccaaagagcgccctcattagcgatagctcggaggacatcggccaagcataggatagcaccattaaatacacaattgttcatgtgcttccgatcgaatttcccaagcgaccaagatgattaaagagtttagccctttcttctcattagtaggtaaaccccttactgttcttgaccctcaattggcaaacctagcaataacctgggtttgaaaagctagagtagccaagccgttgcacgaccaaacaccatacttatcaagaaaacacacaagtgactaggatgtgactaatagttttctgagctagatcacataatggacatgtaggcgggtgttgaagtcctcgcttgtccaaccggtctgttgtccaacaacgattattaattgccaaccatataaacaatctgtatttcaaaggcatccaactctttcaaattcttcttctaggtgcaaaccttaccgtcccaacaaagatggcctcatatgcagatttagaagtataaattctgagtttgagagcttccaaacatgctgttctggaacaagtatcatattttaagacatactatcggtgaatataacttccaaaaaaacgtcatcttacgagtcaacgcgttgtagaaatgacatatattgctgttagagttatatccattttactccgttaacctcgtcacattttaacagtgagaaacggatggaacctaacggtaatggtatttttaggtaagttagcttgtacaatattttttggaagttgtgttgttggattttctcctaaaattcagcgggttactgtatcccttcgtcctgcagtccgcatggtcaagcggttgtactgcatggacgagctctagaggtgaacggacatgcacgagtacacaactcgagtcttctttacatcgtttttgcacatctcgcactcggtagcactgttctcgccgtacgcagaagcggcttcataccgctatttctactgtggtagcaggattcagaattcgcaaaattacataaggccacgaagggagacaggacaagacagcagggagacaacaatggcgttgtcgtcgtccccatgcacgaaggcggcaacctacacgctggcaaatcatgcaagatcacaggatacagaatcgccgaaggtaatagctttgggctgttccggccatacaactgaatggatgacagcattttggctggcagtgggccgtgcgccatggcgctgtccaagttctttaatcatgtggtgttattagcatctactcccggacagggtatatcgagttgtctttgcttggatggcttcttgtcttggataagcgcgagaaacctatcaaatttattctgccaggttgctttcatgaattattagtatttcggatggacctgattgatcttctctttctgtatgcatgccctgattaagctccaatttaaactctagctcgtttaagaaatccaaagtactctatggtttgtgttatgtggtaggcccatgctaatccaaatttatttccaaattccaaaccaatgatcttgcatctcccattatttgcctgttacatgtggtttggttttgctaagctggtacgtaacagaatgtcatttgcgtgcaaaagctgatgcttagtttatctatttctgttcatgtcaagaaaagccaataataatactccctccgtttaaaaatattatttgacaccgttgactttttagcacatatttgaccgttcgtcttattaaaaaaattataaaatatgtaaaactatatgtgtacatgaaagtatatttaacaatgattcaaatgatatgaaaagaataaataattacttaaattttttgaataagacgaatggtcaaacacgtactaaaaaatcaacggtgtcaaatattttaaaacggagggagtatgacctaacgaccaccggccctgaactatgagccaggcagtagttaggccctcactatattaaactaatatttgcggaagagaactgatcctcgtcgatagctttttatactttgctggaattgaatttcttattgattagttcatcctcgaagccaatcatttggcttcaatcatctggagcatatccacagacaccatcctaccagatactttaaattgaaaataaattcgcacggaaaaccctaaatcatccccataaattctgcaccacgcaaattaaaaaactgatctggaaaaaaaatcaaaaaactgttaagtcagtaaaccatcattcgcgtggctgacactggagcagttggctgtggcgctggcgccgcccagggggttaggcagctgccgggggcggcgcatgtgcgcgccacggacgtgtggcgtgcgcgccgtggccggcagggcgtgacgcgacgtgcacccgttcgagtggcgcacttgcgctcgccgcggtggtgacgctctcccggcactgcctgcctgcctgcctctcatcatgcggctggcacggtggcaatggacaaggtggtaacaaggtgaggggaaaaaaatgaattttgaaacttgattttaaattgttatggggtttttcatcgctttctttttaagcttgcttttaactgctaagagtgaaatataaaaattctatccttacaaatagcaattaaagatttaccactggattcacatgttataaactgttagcgataaattattgaatgccacatcttaaaattactaaaaagttaaatgctcccatgcactagttgcggctgatgaaagaaacaatgcaaagccagcgagatactgatgatacagtggtacggctctgcagctttgttccaacggcttctcgattttttcagcagcagaaacagttgtggcaacggtcatcactcatcggagctcagagtctgctccccccgccaataatacagtgatatgtgtacgtgttcgtcagttagtgcgagtacaattgcactgagaagaacaggagggaatagttctccttttcggtaggattattgaaggagatgggatgtattttatgcttgttttttcccatagccatctgaattccttgattctgtgggctgaacagctagactgtttcagcagtgaaatattggagaatgatctgttcttcggtggaaagattgaggtcgttcaaagctcgggaccgaaactgacatgcatgatagtggtatttttgtttctcaggatattcagagcatgcgaagtggctcatggaaaaacgttagttgcaaaatttcaagcacaagtgaattgatggtcttgtccctgctctttattttaggaaccttgttctttaattctgaagttgtacagttctgaatttctgatggctcatcctggactaattactgaaaattcaggtcatagaaattcagcaacgaaacatctgcaaaataattttggccacaatcatgccctgcttaggtgtaaaggacgaaagtttccatgcttagctgtagcatggggtctctgaattgctggaaactctgtgcaatagcaggcctctgaatatcaatcaagaacgtcacccaggctttttccgcaaacaaattcagtgcaacaactactgaaaaaacaagtactcctgtgcagctcgctttgcctcagaaactttactttctctcttcagatttttcagtacatgtagctgcactatacctgggccctttatcaccaggaacaccaaaacaatggcatcttttgactctccatggaagcgacaacatactacagtgtagcatcaaatgatatgggtcatcgagctaagtgtaacacattcaattaagtggtctgaagaaacttgaactccccaacaagttgcctatccttttttcattttgggtgaattgcactgcagtttttctatcattatgctttctggaaaagtttactgaatgatgaagccaaagtggttaggttcatgtttgcatcatcatccatccaaagcagtggcacagatctgtgctccattaagctgtgataaagcatcgacagtaacataactactgcaatgtaaactactccgatagtagtactcgtagtagttgttctctttctttaacacgcaactgtttaaagcaaagctgatcatatgcagcctgatgcaggaactgtatctgatcacgctaattcgacagtactagttaaaaaaggaggatttttacggtacattctactactagtatatactaccagtatatttaatttaacggtttaaaattcatccgatctcccttccaattatcctgcagtataaattgaaaagggtatatttgtctttttatctaattatgtgggggtaatttcgtgatttcacgtttcatcactggtcagatccgatccacggtcacccctttgtggaagtcgcgcccagtcgtcttcctcttgcgagcagcgagcgccgcctcgccgccgccgccattgggaatcgaatcgatttccctcctcctttcctcttcttgtgtcttttctggcgacccaaaaccctagttcttgagggaggcgatgggcaggcggagcagcagaagggtgcatgctgctgtggcataggcgcgcagcttccgcagctcgcagcggcaagggcagccatgcggcggcaggtcggatgcggggaagaataggctagggcttgagggagggcgccggggacgcgggagacgccaggcgcgtggaggttcggcttctcccggcgccggaggaatcgggatggaggcgtcggcgcgggagcaacgacgccggagcagcgacgcgagatgtatcgtgaagaagcggatgacgatatccacagaaaaaacaactgaaggaaattaatcccagtgaaaataattctctaatttaaatgaccaaaaagcccttttcagattttcacctaataccaaaactaccctttcatatactggtagtatatactagcagtagaatataccataaaagtccttaaaaaaaggtttctaaactcgaatcgaagagggttctaaactctaaaagaattagccgctaacatggatggactgtacatcacaaattctcacacacatgacacatatattataatcatatatgtgcccccatcactgtcctttcgacgttggctttggatcccggacaaaacagaaagaatccttcgaagtgagggaaaggattaggcatcctggctagtaggaggagtacaacagaagaagccatacttctagaattcagtattgcataatgcaattaggctgtgttcttggtggaagttaagaacctcacctctcgacacgaaaatggaacgatggactaacatacaattaattaagtattaataaaaaaatataaaaaaaaaggttaatatgatttttttaaaaaaagtaattttcaatagaaaatttttgcaaaacacacattgtttaaccgtctgggaagagtgtgcgaaaaaagaggaggagttaggctgcgttcggatctcggagatgggaactcattccctcctcacgaaaaacggagtggtccattagcgcgtgattaattaagtattagctaacttttttttaaaaaaaataacttttatatagaaaattttttaaaaaacacatcgtttagccgtttgaaaagcatgcgcatggaatactagtaagagcggttgggagtcctttgcaacgaaaacagccttagtagcaagcacaaactaactcagctttagaggcccctcatattgatgtttaacttgttatggggcatttatttctacacagtctcatttatcaactgaaactaaaaaggttgtccaattccgtcctccttttgtaacggctcgcaaatacaatgggttgtttagattcatgtcattttaaatcatattattttttataaagttatcaaaatgtacatatatttatttatttttaccaaactttactaaatgagataatccaacaaatggcatttaaagcgttcaaatccaagaaatgccatcgccgttatgcttccgtccgtttcacgccgttaaaatacaatgttcatcctataacacttaatggtgtggaatggacggaaccctaacggcgatggcatttttgggataaagtcgtttgtacgatggcatttcttagaactcatatttgtcgatggcattttttgaatttggatgattgtcaatggtattttttggattatctcttagtaaatacataaggaatcatgccaaaacttgacaatattgtcaacttatcaaaatttaattgggattattttggcgataatatgaacagcccttacatttctgaagaattatagctcaaatatggctatggccctgtttggattcggagggctatttaatagccctccggaatcttgctatttaagagtattaaacgtagattactgataaaactcattccataacccctacgctattctacgagacgaatctaacgaggtatattaatccatgatttgctacagtaatcagccgctaatcgtggattaatatacatcattagattcgtctcgtaaaataggctagggattatggaatcggttttatcggtaatctatgtttaatacttctaaatagcaagattccgaagggctatttaatagctcggagcatccaaacaaggcctatgtttagatccaaacttccaactttttctatcacattaaactgtcatacatacataacttttcagtcacatcgtaccaatttcaacccaaactttcaactttggaagaactaaacacagcatatgacagtgcagttcagctcaattttgttcggagcctaaaaaaaagaaaagaaaaaaagctcaatttggataaggctatgaataaactcaaaaaagcatccaacctaaccaccacactggcccaccagggcccacgctccactcccgtgatcatcacctccttccctttccagaaccaccttctccttccttcctcctcttcttcttcagtgtactctgcctttataacaccctactcctctctctcacctccaccatctagctcactcacacagtctccactcacacgcattgcagaggagaggcgacaatggaggggaaggaggaggacgtgcggctgggggcgaacaggtactcggagaggcagccgatagggacggcggcgcagggcgccggggacgacaaggactacaaggagccgccgccggcgccgctgttcgagccaggggagctcaagtcgtggtctttctaccgggccgggatcgccgagttcgtcgccaccttcctcttcctctacatcaccatcctcaccgtcatgggggtctccaagtcctcctccaagtgcgccaccgtcggcatccagggcatcgcctggtccttcggaggcatgatcttcgcgctcgtctactgcaccgccggcatctccggtcagttcactctcctttggcttcctcccccaccttcaagatctcaagtcttcaactttgtcatgattttgccttggtttgtcttgctagttgatacttacttgttacctgcactttgcttggctcagtagtttcttcatactagcatgctcactttagtaaagcatgaggtatagaatcatgtgtactactactgctccttccataagtagcaagactttgaggcatatggcattaacactgaataattgatgaaagacttttagttacctgcttttggggtgttagatcagtattagtaactggaaattcactaaatttgttgtccatgctcttgtagttttaaagaattattatagctttctacaggtgttgaatgcaccaaaaatttatgacactaccttttgctcttgtaccatcatgtaccttgtctgcgcaaagatttgtcgctggcatattgtactgctgtggtatgtgaattttgttcttatgcaaaggtttgatttacgactagaagattaaggatttaaggtcatccgattgatttaactcttaacccagcattttcttcggtagtgttctaactgttgatgctgaaaccacacaaattatcacacaaaaatatattatttttagttcatcaaaattgaatgtgcacttggagccttggaggcaaagaaatatgtgatgccaaaattttctccttggttaatcttcctaccagaatattaacaaaactatatgaacaagtaaatatcttgtgttgtcaacttatacagtctatcacaactcgcaatcttagaagttaatttctgtaccagttttatataatgcttcaaaatctcaaatactaccttgttaatctcaaaatatgaatacatgagggtacactatacagtcttacttcaactgtcatgacaactgaccacaaaacaactacggcaattaagggcactactaatatccattatattgtctgttactgcaacaggaggacacatcaacccagcagttacttttgggctgttcttggccaggaagctgtccctgacccgggccatcttctacatagtgatgcaatgcctaggggccatctgcggagctggagttgtgaagggcttccagcagggtctgtacatgggcaatggcggtggtgccaatgtagttgccagtggctacaccaagggtgacggtcttggtgctgagattgttggcaccttcatcctggtctacaccgtcttctcagccactgatgccaagaggaatgccagggactcacatgttcctgtaagtatccttctcctttttgcagtgtgatatgtgaaagttcagtagtagttagtgtggtctaatgagttatgcactgtgataactaattcatcaccaaaccctaaagtgataatgtgcaaatcactaagcagtattttggttagcacctttacatacctcactcatacagtatgcctttaacaatgaactggtgtgctcataacttgtaggtgtgcgccatttatggctagacttttaactagtttaatttatcatgtttgctcaagaaattgactgtatgcgtatagttactggaagtatatatgggttttttgtgtgttgcataacgtatttctgtcctttgttggtgaaaacagatccttgccccactgccaattggttttgcggtgttcctggtccacctggccaccatccccatcaccggtactggcatcaacccagccaggagccttggcgctgccatcatctacaacaaggaccatgcctggaatgaccatgtgagcaacctttcttctctttttacctactcgccgttctcagcaattggttcctcttacattatcagatattagtcagcacatcattgataatcgatacattttttgttggcaaattgaggtctaagctgataaacatgtcagtatatataatcaaatgttctcagcaattggttcctcttacattatcagatattagtcagcacattactgataatcgatacattttttgttggcaaattgaggtctaagctgataaacatgtcagtatatataatcaaatgttctgatactttttttggttatatttttctctttgtatgggtaggtctaagatgataaacatgtcactataaccaaatgtagcagcatgctcttgctaaagtttacttagtagcttaccagcttactagcctttgctcaagaaaagagtagaagacacgacaaagagtttttccttacaaattttggtatctaaattttgcagtggatcttctgggttggtcccttcgttggcgctgccctggctgccatctaccaccaggtgatcatcagggcgatcccattcaagagcaggtcttaagccccgcgccgccgctgcgcagccgacgacatgcaacgcaatcgtgatgtcctgtttcccgcgcgctactgctgcgcatctgtcgattccctctatctctagtccccaagatgtttttcctatctgaaccctgaacaactcaatcgtgtaatccagtactcagtcactgtatgtttttatgtgatggagatcttaattcttaagttatcatctctgttgctggaaatccggtttcctcttcgtgcatgaaccgcgcctttaatacacgtactagaataatcttggcaggcagcaatgctggtatgatcctacgaagcctgaactatgaatgtgaagggaagaacgaagcaaaagagaaaagagaacaaaaaggtagctctgtctagttcccgaccgagtaatgccatgaaagaacaaatgaaccctagtgagtgtactataccaggatgagtgatgagtccagccttgcatccatcaagggctagggcttagcgatcgatctgatgaggagcggcggtttgaatctgtatgaatgagttagtggtgggcctggcttatgtgcgtcaggacaacgataacgatgaagatgaggacgattgatggtggccgggcgcggtgtaaagaaggccggctggccgggtagtgcgatggggacccgctagccaccgggcgcacgctactactactacttgctacgtaccctacggcagcgcggcacatgggaggtttggtggggtgtttggtctcgccactagggacttggaggcgccgaggcaaaaggaagttgaaacttggaagcaaagcgtgtaaaaatataatggagcagtgtagactgtagagatagatagatgaagtactatactagatacctgggtcgcatttagccatttactacccttttgcatttcgccttcgtcatcctgcttcagggaaatttggcaccagggaatattgaggtttatttatcatcatctcatccctcaaaaatatatgctaaatggaaaattaaaatggaaccgttccaaatgatcctatgaggatgcaccacccatcccatggttcagacgatttcccacttaagagctcctttgaatcaaagaattttatataggagtctcatacgatttaaatcctataggaatattttctttgtcgctatttgattcaaaggattaagggtttct

SEQ ID NO: 54607 - DNA, 2045 bp, Oryza sativa
atagattttagaggaaatctagcaagagctagattttagaggaaatctagcaagagctccagcctcttcaaaaatttcatttaagtctatatctctcatccaattcttacattttcatgcaatccaatcaaacgaccattcctatgttacacgtgtgttttgcacttgcatttctataataatcctatgtttttcctattcctccgtttttttcattttcctattcctccattttttcactcctacgattcaaaaagggccctaagttcaagatgagcgcaaaaaggcaaaagctagtgtttggtttttaaaacatgtttaactcgaagcaatagttctttagaaagaaagaagtcgtacaggtgtgcagttattcaactcgtagaaaaatgaaaaagaaatagaaaaattaaatcacattggagctaggtgcaccatatgattgtttcatgttccacaaactaatcaagattcaagaagcaacaaacgcaaaagcaaaaagggaagaagcaacataatcatatagtcacgttgatttgattaacgatcagaatctctgtataatttccagagtaatagatacagtgaatggattacctgagtacagcaacaacgctttcactatgcaggctgcagctgactagttgcaaaagctcgcagcaaggggaagtactgagaaaaagaatgggtattgaatggttcaattgcctctacctttgcaaaatgtggacttctagttgagtttcctcctgtacaatggcctcgaaacccatagattgtccaaaggaaaacgaatgtagataccagagtatacaggtgaagaactactgttttgggtccttggctatctagaccctctgtaatatacaattgcatcaacgacgtgtaactggttaacacataacaggcatggtaatatggaagtcaacgcctgttcctggtgggggcatagctcacctgtccattcagaatgcactgtcagcaatagactatgactaagatagatatcttcactgtcccaaaaacgaaggaaaaaaagaggaagagttgaagattgaatggcgatatagagctctccaaagccaaggatatgtagttggcggtccccaaatgaccccagtaaataagcggattggattcacatatctaagtccatgtttcggaattttactacaacaaaggaatcaatgtttggcaagtaaatatagtaccacacaataatggtagcaagtcaaatttggcacctcaaagattctgttatttaaagataccaggcaaaaaactactgcacttgatgatagtacgacactcaatcactcattaagcccatgtactatatatatccagtgaaggtgtaaaagctgttaatgatgtagataacatagagcaattctttcaagtcttagagttagaataaaaggctattctttttctaaaaatgtataaatagaaatgcgagaatttgcagaaaactatgagaagggatgtacctttgttgagacggtcagcttctgaaataattaatgaaattattcgtgtactatgatacagtgccaggcttgcagtaaatagatgggcaaactggctcagcagctctcatcaagctccaactcaatgcctatccagcacacctttgggtgaaatcaatgaccatggttgcacccaaggtgtggtggaccagatctcaaatccagtggaggcttaagttttacccgatcctcaaagcccttctgtgaagcatgctcagaaggcagtggcttatcatgcaaattccacacgctcacatgtcccatccttccaaattgagggctcagaatgtcagcttcagggactgccctctcctgaaaacctagcgagggttgtttcactctaacaaaacgaccaaggaccggatctggaggctggtttggcaagggctcatcaagacatctcgatgtaattgtgaaaccctcattattgtaagctaggtgtcttgcatggttaaaaggaatagctccattaccaccagtcagaggagtggaagcacctgaaggggctgcaggaat

SEQ ID NO: 54608 - DNA, 1227 bp, Oryza sativa
ttatccttttccttttttatgtataggtgagattccatgtgtgctccctcctggtacctagtaccatgttcagaggcatgatacctatccgattcctccttggtatcatgcgcgcacagcataggctggtacctgatacttggtacccgatacccggtacctgcaggtacctggtaccagtatggtaccagttgcatggtgtgtggtacctgtggtacctggtaactggtacctgtggtacctggtacctatggaattgaaaggattcaaaaggatgggacgggggaattgataccacccatacaagccggagaaaaaatcagcaaggaaaccatcaagcaaaaaaaaaaagaaaaacacacatgaggaagggatgcaagcgacgatgaagcattgccggtgtgcggggggagggggtggaggaatcagtcagagtggaatggagtgcgaggggtacctgcaaggtatcgaaaaaatggatgcgagcagcggcgcagcaccgccggcgtggagaggaggatagacggaggggaacagccgcggtgcagcactgtcgcatgggggtggagggacagaggagatcgcggtcctcgtcggcgcgagagccgtgccgcgccacgcgttcctgaggcagcgggagcagctccacgtggcgctgccttccccggcgccggcgaaggagagcgggccgagcgccttccacgcctgacgcgccaccccgcacagctagccgccatcgtcgtctctgtgctcatgagggtgggagagagagagagagaagaagaagaagaagaagaagaagaagaagaagaagaagaaggggataagatggaagaagaggataagatgctagtggtcgtagttatcccatgtgtacgggataccgttgactagtttttctgttttttttactagtaccatgcccatgcattgcaacgggatttgaagatagaatgacaaatggtttttacatggttcagtttttttccaatcgggtttttttggtgggtcaattttcccgtgataatttttcaggtggttggttttttttaggcacggtgggttcttacctggggagtgcaatggttagggaggagaatgattccacttgtaaatagtagagatatccattactcccttcgtactcgtaaaggaagtcgtttaggacaatgtttaagtcaaaccttgagaacataaatcatgaataactctcaagttgttgagttt

SEQ ID NO: 54609 - DNA, 1060 bp, Oryza sativa
tgacttacgatggtatacatttggcggtagcaccagccaaaatcttgtcgttgaaaagacgagacaagtgctccatttataaccatcgttttactagagcagtcatcctgatattcagctggcgtcgaccgtaagtttatgcgggaaggataaacgatgtcgtcaataactaaaccgggaaattagaatgggaagatgacaagcagacaaaactgcacaaaccgatgagcttagcagtagcaggcagccttcttaagttcttattaccatttgaagaaataaaatacctagtgaaaaactaccaaaccagcaagtttgctaccaacaatgacaaaaatagtaaaatactgaatccatggtgatgaaaaatgagtgaaaaatagtcctaacaattaaaacggaggcaaagatgggggaaatcggacatgcatccactgcttctcgtaggccgatacatggacccatcctatctcctcaatcaattggatcttcaaatcataaagtcttttctttggttgctcagagtcatcttgaatcatgtcattcagaacctgtccacgaataaagttaagaccagcaaagtagtaggtgcatcggaaaaaaattgggggttaagatggcaagttaacaaaactaagtttagaatttctaggatgtcaagttgtttgttgtttttctttggagaaagtaggcatgccaaagtcaatcttctaatttttatttatgaaaattgatcgtttaattctggtgatgtggtttctcgactatagcattttacatttctgccttgttacaaaacaatatatcatgcagtgcaaattgaatgatattcaataatttgttctcatcaataactatagtcggtgcagcttctacaaaaacacagttgaaccatagcaagtgaaaacggagcctgatgcaaactctactcatatcacgatttaggcaaagtgcaataatcttactgtaatagatttattatagttcacaaaattgagaaactcaacaagatcagtaagttctactgaccaaaacgagttaagggaacagcattttactg

SEQ ID NO: 54610 - DNA, 839 bp, Oryza sativa
ccccatcccccccccccaacaaaatttaacagtaacaagaaaatgtttcaaaacattccagaagaacttatgctctatccctgtttccacaataacctgattagtacaatactcctctataggactgcaattgcatatgtgcaacctacataataatgatagaagttttggtggtggtgcaatatgcacaaatcacaggataatattagatgttaatgtacacaactctagtgcttacacatgataattcacacttcacagcatttttgactggctaaatttccatagttaccacccatacccccaaaactgaaatgacatggggtttgtttggtgaaagagatgatgttatttataatcaacaacatttacatgccctcaataaagcatgcaattaaaatatgaaatgagtctcgtactcattaacaatataggacacaatacctttttctctagcttcctctcgataaatagaaccaactgcttcagtttctccaataactgcacattgtcatgcctacaccatccattagacaaattcacgcaataaaccatatttttttactgaagcaacaaaacatagagtacgatctatgaaattgtcaaaaacaaccaacataagataactctgcaaatctacaattgaaaagataccaaaaataccatatggtgggtgcaaagaaatgtctcttttcttatgtgtattttatcataataatgattttatatctatcatttatttgcaaattgaaccacatcaccatggcacaatcactaagaaaagccctaaagaatgccaaggaaggctggaccgcgatggataaggaaaaggaaccatt

SEQ ID NO: 54611 - DNA, 1603 bp, Oryza sativa
  unsure (1)..(1603): unsure at all n locations
tgctgtttttgtggtcttgtataatatgctatactgcaagttcaggtttaaatccatattcaagatcatcatggaccctaagtattttccctctgtatattttcactctcatcattctatttcatattcaacttatatgatgattgtctaagacttgcaggttgataatgataaagaaaagggagtttcatctggaagaaagagtatttcagagagattggatgacgaggtaggagcactttagtccttaaggtcctttgaactcattatcttatatgaagtgttcttttcggaagatgtttcttggtagaaagtaaataaattctatatgcatgcaactgatcattaatgacgaatttgtgttggatagattgttgtggacttaagctacttagaaagaatcataacttctacctgttttaagttaatttattttaggtaaaatggtatttctgattgcaatataaaatcgtagggaataatactgtcttgacattaaattgattgatcaggttcgagacaccaagataaagttcctttctggctttaatcaagaaactgaggatgacaagtcttcttggacggcacttgttgcttctcttaaggtagcaacagcttctcttccttagtcatatttatcctatgatttgttatcacactaagaaagaccagacatgattattttattgttatatacatggtgttaaacttaaatgcatcactttgttaacaatatgccaaaaaagtggtcctttagcatccaaaggtcacaattttaattttataatactgaaagcttgcagttcgccttattagcaccaaaggnttaccttcgttcttctnatttagcattccgntcaaaattcaaaacttctgttggttttctcttttttttttatctggaaagaaagatgtggaataccaacagtaccctttgctttcttcctcctacaacccattccctatctcaaatgagatcagccatggttgccatggagactctcgccaccccattgagctcaccaggcatgaccagtcaggtctcaggtcttgagcttgcccagccgctgcagttcgagcctcaatctcgtctgactgctggaaatatttgtagtttgcagattcataacaaaacttgatgtcgactctagtttgttttccttatttattagttttatttatgagcatctgtagtttgcagaattgtgattacagtggtacatgtaatcttagttatttttaattaatgctaagatgttacaataaagaaagacaatgatatcaatgtaatttgaatttttattgcctaacatgttaaattgtgccattttattataaaaattatgagctacatttgtttatattctccaatgtcaattaaatcaccttaaccattattgcatattgcagccagagtatcccaagtatacacctttgcttgccaaaattttggaatgcatagttcagaaagcaacttcagatgataagtttagccatcaaaaagaggtaattaatatttccttttcattttatgtttccctgcatcttactatgttgaataaaaaaaatgttcaaacaattttaccacatctatggctggaca

SEQ ID NO: 54612 - DNA, 746 bp, Oryza sativa
catcattctggtttgcatgggatatatattctgatactttaaataataggcactcccaacatgcacatgtctccatgtagaagagccaccagccatgctgctacatgatgtgagcattaacattttcttcaccaaactaagatcttcaaagattgattttggcgttgataaaaagttttgagagctcagaccagttgagttttcagcacagcaagacatcaatgcatgttccttttgctctttgctgaagcacacaggttcatctttatgcagaatttcatggctctcggatatttgagctgtgccggaagattctggctggccgacaagattccagatcccagtcaatgctgatactaactgtggagtggttaatcttctatctatagatttgcttcctgactgagtacttggcttcgattggttattggcattacgatccttagtaagaaatgcatccagatcaaactgatgaccatctaatggaagacggtggtaattgattgttggttttctaacttttggagctccacattttgagctcatcttttacaagctagcagcaaggtcataaaggaaagctagtaatcaactgactgagatctgctagaggcaagaaatgatagagcaaatttagcacactgaagttcttgtatagtaccagaatttatttttttctcaataaaaatagaatcatctcactagcaaagaccttggggtgggttgataagaacagcagcaaaaac

SEQ ID NO: 54613 - DNA, 5662 bp, Oryza sativa
ccacaaaaatacttactgtatactgtatactaaaatttctgagtttaacattgcagtcttctgaattgatacaggactcacagctgatacactgagtgcgacaaaggtgagtcatgtgcggcaaatttgaggatcatgtatattttggtattgctggcaggcataagtctcaccattgagcgaaacaccacattcataagtttaacggctatttatctaaattcaattttgcaaaaatgaaagttttgtttaatggctgaaactgcacagtgctactatgatctcagaaccaaagaaattaattgtctgagtttcctaccagcaaattgatttgttcaaagatttaggtggtcacgggccataataaatcattgagaatatgtcatataacattcagtcatgtatcacaaacaatttgattttgacaaaattaggtaacacataaatcaatgtatgcaaacatccagatacctaacactattgactgcttttttgtttcgagggggctcactgcttatattttattgagcttagctatattgtatttctctaaactgcataaccatctcactgcatagcccatatctatataccaccgtgacaataacagctacatctctacaatcttactactggtaagaaatgaaggattggtggtacataaagtgcctcaagttgattgaaacaagcaaccatttgtagatccaaacaatatcgtcgttgttattgtcatacatcttgtttgtataacttacatatctttcagactcaaggtggcgaagtttgatctctaaaatagcaatcggtgttttctgcactcgaatatgtaaataagctgtagtgtgtcagatattacaatggtgttcattatagagcacacttgccgacaacattttgcagtgggcttatctatgaatattttttttattcatctgttgcatggttaccagtgtgctgtatgtttcattcaattcgacctggatttgtaggcacgtctaaatggttcatggttcatgagcacgtattgtaaacatgagttggattactaatcctaaatcttgtcgattaggtatgtatggatcaagaattggatttggagatataatcaataaccaaacaagtgtagtgaaacaggaagttcattatatgtattactattgattccttagaaaaataagatcatataaaaaacatgaaacattaaatattaaaagttattaaagatagcgtttagcacgggcgtattactagtgaaaaaaggcccctaaatatccatcatctaactctctgccaccgtacatgaaaaaaataacatatgtaatttggatttcctatcgtaacgcacgagcatctttactattcttaaaagaaagagaaaagagagagatgaaaggaaaatgttcacttgaggtctcttatcttgtcgttgagtttcaaaactgtccatgaactaaaataccagatataacagatccctaatcttgcaaaaccaggtcacattacgtctcaaggcactattgctccctggttttagtgatgcggtggctgagtcagcgtggggccatatgggtcccacatatcaaccgataatcttctcccacgtatctcccctttcttcccgtctcaacccaaacttccagggcagccgacaagaggtggggagaagagtggcgactgacggctgcatcatggacctacatggtgaagagcgcaaagaagcgaagtaggaagggctcctgacacgtcgtccccttgggttacactgtcacatcgttgcatggcagctcgctgcgcatctgcgccgcgtccgtatcgtggtcatatgtcagccacaccgttgagattggcgagaggatctccaagagttgggagatggagtatcgttgcgacgcctgagcatagtcgcgagcatcactgactccatgagtgttcgtgcatgcacacgaagaggaagccggacactgaatcgcgggagaggtgtgtggtggccgatgaccagcagggagaagggtggcggtcgttgggcggcggcggtaggtagaagcctgacgatgggtgggagaaggctggcagccaacaagaagcttggcagcggcggggagaagggcgcatgcgtcggggacgatgcgaccgcaatgtggtgtagatgaagttgacctcgaagacgatgtggcggaaccgcgtgtgtgcctctgcagacgagaggcggagctcggggacacctaaacacatcagcttttgagcagctcgacggggggcgactatgagctagggggataggagcttggccagtgtgatgaggcagaagcctcagcccttgtgcgtgcaggtgaagacgacattgcagttgtagttgagacccgcgcgcgcaaatccatgatgtgagcgctcccggccattgggagccacgtcagcggcggcctccgccgtcgagcttttccccaccgaccgacacccttctcccaacccattggcagatgccctgaaggtttgggttgagatgggagtagaggggagtgaggtggaagaagattgccggttgacttgtggagtccacgtgggacttagccgccacatcaataaaaccggaaaacaatactaccttgggatcaaaagtgatccggttttacaagattagaggagggtttaggaccgtttaaaactcgacgacaagataagggaccttatatgaacttttttgggagatgaaaaaattccagccccaggggcctgtgcatatgacccataggcaggcgacaccgcggcggcagagcgctgcacgacctccgcctccccaatccgccccgtctccttgcccgccgccccccgactcccgtctcctcgcattcgctcaccggtgagcatcctaatccatcccatccggcctcggcctcgaatttcgtctcctcgcccgccgcttgcgccgatccccatcctgcgagcaaggtggcgcccggcgtcctcctgcttccaccgcatcgtctatcgccggtgaccatccctccctccctatccacacctcatcaggtattctgcgttatccctcaaaaaagtttgggggttcaaccgaaaaccgacccctcaaccgaaacagggttagatctgcctctgcccagttgcacctactttcaacttgttaattttgatttttgtttttagcacatgtaatttggttactgaatctcatccaaacacccttagaatagttgcattagaacggaaaatgtaagctcacataatttgtactcatcctaactcacataaatttcttaagaagaatctataccacaaactactcatagtcactcaaaaaatctttttattaaggtatatattcttataagaagttttcattccataaaattttctaaaggacatactgtgacacttggcattaatctaagggtgtgtttagatccaaactttgaatccaaagtttgcaaaattccatcacatcaacatgtcatacacacacaacttttcagtcacatcatctctaatttcaactaaaatccaaactttggatggaactaaacgcagcctaatttaacatttttttctttattaggttataaattttctaaaaaacatattgtgccacttggcattaatctaatttaacattctttatcaggttataaattgaaaccatcgaacgtactttgtcttcccgtttctaaaacattgcgatatatctataatattttaatttcaaaaataatttagactaacagtatagatatttaaattaggtaattaataaattcaaataaactatagtttagaataaaaaacaaaataatatatgccaagtacaatctaataacaatagaatgttagagacaatgtgaattcaatatttttataaagtttattttgggacggaggtagtagtaaattagccgggaaggcacactctggttgatctaaccccgagtcaaaaccatttctctacctggcaaactcagatggcggagctgaccacagccgctgatgtcaccgccgccccgccgcctccacctgggccaactccaccaccggagcccgtggtcacggccacggtcgttgccgagcagaaggtctctcctactgctcctccgctcgatgtgccggcacccgcaccgccgccgccgaagaagcgtaaggtggaggaggcggggttccataactccgcctactacaagatccgggccaccgtcgccgacctccgtgttcgtttcgtgcaggtctgcgctctccccgcaaaatccctctcctttttttttccgctactggttactttcgctactggttacttgcagtgcttgtgtgtgggggatggcgtgttgatctccgtaaacctggggttttggggaaaaaaaatttaagcaacgacgctgcttaggagacctgccaaactgaactctcgcaagacttgtacaattgcacttgatatgtaacatgggatttcgcataatgatctgttctgagttacctactctctcttttgaaggtttacgaagctactgatttccgaaacagtgatgctgctcgcgagattctgaaaggtaaaaaaatgtctcgaatttatgtcttgttagaaagtcactaattgctccatttagttggtaggaatcaacctagggctcgtgaaaaaaacatgaaaattgaacattggttggtccaaatatcataattttgtgctttatataattccacccagtgaaattttcggtgctgctctcctgtctgttactgtggctgtagccggggaggttacttgggtgaaggtggagcatcagggcttatcgcttccattgtgaatgctcgaatggtgtaggcaggaggcagttgaggcattgtagtgttgtgtttagttcacgccaaaattggaagtttgattgaaaatggaacgatgtgacggaaaagttaaaagtttgtgtgtgtaggaaagttttgatgtgatggaaaagttggaagtttgaagaaaaagtttggaactaaactcggcctaggtgtgtgtggcgagttggtgactgggagctcctagagggactcatcagagctgaggtagggcccacacggcggtgccacatcttcaatgggaagctgctgctttacataggaagtggtggagaagtacacttgttggtgattttgagtgaatgagtgagacttctatgtgaggattgaatgttaatggaggaaagtgtttaataacatgggcgggattagggtggaataatccaacttgcatgtcagcacttgaatgtatagcaggaggttttatagtcgtagaagttaggatgctttggttctgacccttgatggcgatgcattgcagctgactgtggtgataatcaggtagcagaaaaaccatgtgcaggagaaccgtgcacaaatggcagaagaggagagaagcaaacgggtactttattcaggcccatatatggacaagaccaccctcctaaataaccaaatcttatgcgtaagaactcagttaattgcctaactttaagagctatctcatctaaagaagtctgtgctaatgcatcctcaactaaatggcaacttggctacaccagctgtagagtgccttggtcaacatggtagataaatgtgtagctgcaccagctataagcctggatcaacatggtagataaatgtgtatcaatattcaata

SEQ ID NO: 54614 - DNA, 2785 bp, Oryza sativa
ttcaatgctatttgtacatggcatggcaagatatacaatgtactcatgctacttctccagtagtatacagtgctatgtccagtcttcctctttcacacacaaaagattcttaaatcatgcatacacacaaaaacatagtatcattttcacaagttacttgtcttctttttaatataaaagggtatcattttgtgcactatacaaaaagataaatagctttcttatcattttacaatttgtttgttgttggtgtaaaacacatataatcgtatatctacacaaaatcgtgtgtaaacatcattttacattctctacatgtacactagtcttctatgtcagtataagcaacgcggcaaagtgaaaagatgtgataaatgtatctgccaaatcttatagctgtataaattagatggacagtggacatgcccagagatgcaacttcacatatctgcctttagtttttgccttagactttaaacatgtggaaatagtctacacgatccatatgttactttcgattgaaatgaagcatataatccatttgcatatgtttatctgacattcataacctattatgacatatgcttatctgacattcataacctattatcagtaaggaatgtaaatcctagttgacatttgaagttttgaacacatgaactttacaaagttttcattcttctcacatgaaaaacctatgcaatacattgtcctaaatctcaccagtgttaatgttgtgaaatatattctagaccacaccttttttcatacaagctatgcattgcatctttctttggtacaattaatgaatgatgtttatcatacctctgtaatccgtttagttcaacaagtcatgagatgcgcctcatgttctgttctacatttttcagagatcaaggtagtcatggagctagccaagaaaatgaggcatgacctcggtgccacttttgaacctgctaagccaccagagaagcctttagctggagttgtgaaggatgggccagtggaaccacctccatctgcagaaaacaatcacgctcctcagacaggtgagactacagtatgttcaaatattgtaaacaatattgtgccaaccaaccctaactcagatggtgcggcagagaagatgggggaaacaccaagaagtgagattgcgcaagggtcttgtgtgacaggtggatctcctatcggctggaattttcttgtgtggcctgggggtgaggtggtttactacgggcggacaaaagaagtgtttcgggcgggtcaagctgaaaattaaaatgtggtgttcaccctgtcttctgactggtaaagtggtaatgtatcattcaattgtggtaggacgatttatagaatgtggtgttcgcattcagtctttctgaccggcaatgtgccaatgtatgtactattcaattgtgcgaggaatggaggatgaatcgtagtagatcttagcattctgttgactgaggtaatgtactactgtattcaattgtgggagggtgatttttgctaaacatctgttagtactatgtactaactgatttctgcatgacattctggtcttgtatgagatgctcttacgatgcaccatcatcatgtttcttaaacttgcatgtagggatgaaaactgccgcagatcctgaggaaggaggacgaactgggttcaacgggttaggctgcgtccaaacgagattaatttgattaattaagtattagctattttttttttaaaaaaaatggagcggtccattagcacatgattaattaattattaactatttttttaaaaaaatagagtaatttgatttttttaaacaacttttgtatagaaacttttttgcaaaaaaacataccgtttagcagtttgaaaaacgtgcacgcggaaaatgagaggggagtgttggtaacttgctctaaacagtccttatctcttcattttctctctccttccttctctttctctatcacctcttatctgtgtgcccttcctctctcggcggtcacagaagcagccaaggcaacggccaagaaggacacgagcaggacatacagagcctcggatgcggtccgacgattcatgggtgcaagtcttacccatagttattaggatcggaccggacatcgaatcggtcgtagtctcggttcacggtttgattggttcgaccagttgaaccgccggcccaacacggtttaaataaattgggacacataatctaaccacacaagcatgcattgctcggtggtggttgagggttcgaacccctcagcccacatttttctcctattttcttccctctcccccacgtttcagcctgcgctttgtcctttctcacctacgttcccacgtgcgtctagtttttcaccggttctttccaaaaatcggcagtccaattggtttttcaaattgattgcacgccatatctttaaactgggttttttcaccggttcttcccaaaaaccggcggtccaatcggttttccctgggttgattgcacgtccaatctttaaactggaccggaccggttgagcccctggttccagtttattccggtcggactgccggcccagtccggtcctaataactagggtcttgccccgtgtgacaacgccctctccgccatgggtcgagtgcatgaccattgaggagaaaatggccattataccctcgccccccgtgcgacaacgccctctccgccatgggtcgggtgcatgaccacaggggagaaggccattataccctcgtcaaaacggggctttgctataataccatcctacaattgggatt

SEQ ID NO: 54615 - DNA, 6314 bp, Oryza sativa
  unsure (1)..(6314): unsure at all n locations
taccactttgaaacggaaccaaccctctctaatacccgcccacaatgtttttatctaaattaaaagaatttagtcctatttttctgttgagttgataaaattacccccataatcctttgcatcatctaaattagtctcagctggctgggaggctagggttcccggttcccctcgcaccgatccgggcaccaccctcctctcgcgccgccctccctcccctcgcgccaccgagccatggccgtcctctcgcaccgaccctgccgccgcttgtttccgttgtggcagacgaggaggaggagaccaccacgctgtcttcccctcgcgccgccacactgtgccgcgccacggccctcccctcgtgcagactcggccgtcgccctcctctcgcaccaccgagttgcggccgtcctctcgcgccgacccggccgccgcccattcccctcatggtagatgaggaggaggagaggagccgtgctgccacccctctccacgcgccagtccgttgccacccctatactctagctcactaaccagcttctccgacggcaccacctctcacctcgcgccagtcgaggggcagtttggtcatcaaagttgggagaaaagggacaaaatgggaaaaaaaagaaaagtaacaaaatgattttgatttactagaaaggaagaaaatggcatttcagtgaacttctcccggttgaaagtggtattcgggcggatcccaattgtaggatggtattcaggcgaagccctgttttgaagatggtataatggccattttctcaacacaaggggaccagcagggagctataaatgcggagacgaaagatgatgttgtgcagacgatgccgacaccagaaagccagctcgagccgtggcgggcctcgtcttcgtgctcactcctcactgtgcgtattgaatcctatcttactataaagttatcctccactagctccttaagcttaacatgcaaggatgccacatcatcatccactaacaaggtgctacatcatcatccactaattaacaagatgccacatcatcatccactaacaatcatcacatttaaacatcatgcaaacatgctatatctttatagtttttataatttaagagcttttcaaatacaaacatgttaaattatcatccaacataattcacataatgtttcaatatatatctttattatgttttatgatatcctatatacttatatagttcatcctcagttagtgcttaaatgattaatctatgatccaaattatctttcttcatttttcctctaattaagtcatatcacatcaattgtttttagcttttagatgattaatctacggtccaaactatctccctatttttcttcttccataaagtcataccaccttactttttacgtttgaatcaacattttacatactatttaaatttaaattatcataaaccacattattttacttaatatgatgttatctagctatttttatcataaaccataattttttattttccaacggagaaacggtttgggttggttttgttccatgggttgcacggtttgagcccaaaccgtgaacaggcccggccaggtgatcagtgatctaacgtgtgccccggaaactacgtaatggacacaagatacacctccataaacgcacggcattaacgcacgtcagtttccttttcacccctcccataaacagttgctaaaaaaagaacgtttgaagatttcagaaccggaaaaggcgcgcccctcgatctaccaacggaagcccagtcaggccaccccccgttttcggcccgcccgattcttgcgccaccacgagacgagacccagttttccgccacaaccgcgttgaatccgtggtagattaacggatccaccgtatcacgagttcatagagagagatcgatcgatcgatcgatcagaactctgatgatctgacaaactccgagtcctatactcccaatctctgatacacacagatacttcccatgaagagattccccccatcccccagcgtggccgcgcgcggcatgcacgaccggcgggcgcacctacgctacaaagacgccgcgcgctacgtgaccgcgcggcagaggatggtttgggttcttctcgcggtggctcgcgcggttgggcgcggatgccggccgtgatggaggagccgatcgatcgatctgtataggaggcagcgggcggcggcggcagaaggggaggagaggatacgcatcacgcgtgggtgggtgggtgggttgagatgggagggacggacggggcgcgagtgcgagcgggtcgcggagaggcgaccgctataagtatcatcaggccccttgcccccgcgcacgcgcacgcgcacgggcaaccccccctgttgttttctctcaagccctacgaagcggaggcggagcccctcggcgcgatcgagtcgacgccgcgcgccgtccccgcattgccccaggtaagcccgatcgatatatcgttgctccgccgtgcgtcgtcgaatcgaaacatctctttttttcgatgaatacattgatctgggtttctcttctcgacgaaactcgccgaaaagattgatcttgttttcggagaaggaatcgttctcggttgtttgaactgtatatatatatatcttttgttattctttactagggaaagattgtgccccccacggccccgtgatcttacgaaagattgaaactttattagggattgtgagttgttgttgaagagatggcgagctacgacgacggaaccaatgtaagtcgtaagatttctcctgcgcatcaatacgaagaattagcagtttactgcattgcagcattgctaattgctaacatataacattgatcgtaaatggctttttccagctcgtggacgatgaatacgatgacctggatgatttcatcgtcgataacgacgacgacgtggtgttaggtgaggagcagcaagatgaatttgaggaggaggaagaagaacaagaggaagaggaagaggaagaagagcctccggtcgggcaagtggagatccttaccctcagggagcaattgaaggcggacatcaggagaaaaaatcaggcacaacagggcgccaccgccggcagggctagctgctcgtcgtcggtgcagcctctggccaaggataggtacgttgcattgcattgcagattgcactgcatgatgtttctgctgccttatctttttttttaacatgaaaattatagtttctctcccagttgttaacagaaataatcgcttgcagatttggtagcttctttgggccatccagaccttcacttgctcgcagagtcatcgaggaaggctgttcatcaataatcaaagaaaaacagaacgtaccatccaacgtatgtactcctgaacttaatcttgctgaaattggttcatttttatttttcttaaagatccagcaaacgtgaaactttgataattgaattccaacgtaattatttgcagaaaagcagtgtttcttctgcttcaaaaaaacaaccaatcccaagcgggcagcagcagaaaccgaagtttgttaaagaggtatggatcatttaggattaaatatcaccaggttatgttgcttgcagcccttaaaaaaggattacgatgcattagttttgacctgtgattctgcattggtcgtttggcatttgcaggagaaaagaaaggtcgatgcactccgtcagaatcgggattattcatgtctgttctcggatgatgctgatactccacaggctacaaaggaacaacctgacaacatgcctgttttgcctatgaaatatggtacctttttaagcttttattatgaatacatatgatatgattcctacttccttccattcctggacaaatttctcacttgtttggtattacagatgttggagacattgcatcaaccagcaaacttataagtcagaccgacaaagtatcaaaagacagcggattgaagggaccttccattcagagtcgtgtaggattagtcggaaaggagcctcatccaaatacgaagaggacgatcgcttcttctgccaaaaatggatccagcctgcctgccatgaagaaaattcagagggtacagccatcctcaaatggccagaagatgcagcaaacactgcagagcaagaggcctcaggcaatgttgtcacaaagccacgggcagcagtctctgcaatctcggaagcctaaaccatctctcaatggccagaatttcaggcaaaaggtgtcagccccattagcacaaaaacatttggctccttcctcaagacctaaggtagcagcatataacgatttttctctcgtctattcttgctcttagttcaacttaggatagaactaccaagatgccaatcctatccagaatttagatttgcaattaagaatatcagctgttcaggaatatgcgtttgaatcttctctatgtttgcagccatcaagtgcagttcacaacgatcacggaaagggaaagacaaggcgtttagtcaaaaggaaatctaaggaggatggatgtgatgaagaggaagttgactataaatcaatcatcagaggaatgttcaagtacggttgcttcttgtccaatctgttaaataatttgttagttttttcactggttatcaacggcttttggtcttcttgtgctgttgtgcagctacaatcctgcaaaattcgttggtagagatgaagatgacagagacatggaagccaattatgccagcatacaaatggaagagagaagaaggtacttaaattccacctttccattgatctacacccctttttttttgtcggcaacaatgcaatcctgttgcaaaaaacgaccacctagctagctaacatttttccgttgctttggatatgcagtgcaagacttgcaagacaagaggacgacgaggagctccgccggatcatggacgaagagaggcgtgagaagcaggagaggaagaggaaaaagctagcgcaaaaggcagtagtagatgccagccaggactgaactctttgccaagccagtagtgtagtagttcgttagcaattcagttatggacaagattagatttatctcgttagtgctgattagttgtggtgatgctcctagtttattagccatctcgctggtggccacttgaacagatcaaaacaatagcttttgtaggtcaatttgcaaataacacaacgttatttgcatatctcannnnnnnnnnnnnnnnnnnnnnnnnnnnnnntatgggtacggggtaccattgccactactacatacttctcttattgtttaggaggcgtgcgcgtgtgtttgtgtgtgtgtggggggggggggggtcgcgattttgctaagggctttcacaatacgtctatgtgtcagtagaattgagtgtgtcatgtctgctggaaatacttcctctcgacgaaactagcgcaggcgccattgtgttttagcttggagcctcatcatgtcttgggcctagcaagtgtgtatcctgcactgctactaccctagacacatagagtggtcttttgtagtagatctgtggaaacctcaactacgaccgtttggtaaggtggctggaccgttaccaccaggtagggtagccaccttgaccatgttggcgctaaagcctctagagtggccttcctttgtagatccgtggtaaatcttgacaatgaccatcgggtagggtggttggaccatggggccaccatgtaggatagccacctttcgaccgtggcagcgctctttaacactagctcactaggaggggttttgggcaatctcctttaccatagacttaacctctaagggccatgcaataaagtcacgtgaaaatagaagctgtgttctttttcacaactccaaactacaagcttcatcgttttccatttgcacatgcttcccgaattgctaaacagtgaatttgtgcaaaaaaattctatataaaagtttcttaaaaaataaaaaaaaatatttttttaagtttgtaataattaatactcaatcaattatgcactaacaagacttcattttgcgtgctgctaatatgctcctccaatataggttcaaacggatgcactcggacatcatgtcgatcccacattgaattaatgtgtatgtctatcacaagtctttccatattaaataccacattaaatgtatacgcctaccataagtttttccctattagatgtgcatgtcttttataagtctcctcttgttgaattagttgaaaaaacaggtgtcccatctaatctgacactataatacaagaaaactagctgataccccgcgtgttactgcgggatagctagggctgcaggaa

SEQ ID NO: 54616 - DNA, 879 bp, Oryza sativa
atggagcaattggttccatttgaggagtgcctgcagctgcattccactgatagctctgtcatcaaaattcctgagtacataatggtgacaaacaatgggcgcactttcaagttagtaccttgtctgtttaagctatatgattttttgccactcttcatttcagtaaaataatactagtaaaatgaacttattggtgttgaccatatttgctgagatctcaagttcataagaacacacacatgtcatatacacttcgttatataactcatctacttcatagtccatgattgtgtatattcaattcacgtcctttgaagttgatcaatgatgcttaacttccatgcaagtagcaacctgactttgctgaaaatatattttgttgaaagagaacttcactgaaaaaatacatcaccactagagcatactccctccttcccaaaataaatcaacatttgtacatgaatctggacataggctatctccagattcatgtacaaatggttttattttggtacggagggagtatataacttacgatgtctcttcagttataaacaggatgtatgtcatgtcaaacgacacaactaacaggtgatacaaggactaatccaattggactagcaatattattagtaaattgtctgatcaataatgtatgctgcttattctgtcaagcgccataattttcatgtgtttttcctttgccttttgcagcattgttgtaaatcctgttaatatcagcagcggccttcactattatgaagtttatggtatagattgcaaagcaccatggcgtggacctattttccgcgtaccaatcactgtaataaagcctattgctctatcaggagagccacctgcattgacactttcaaatct

SEQ ID NO: 54617 - DNA, 6719 bp, Oryza sativa
  unsure (1)..(6719): unsure at all n locations
attcctgcagcccgacaattagtgcaaatgcttttccttaaacctaacgagaaaaatcagaaaagcatgttgtgccaacacataaagccttgagttccttcagaaagacacaggacaatatggtcagccattcctttatctctatttgaagtttttaagtttctaacttttttattaaagcaaaaaactgtgtggatccctattacagtgacttagaacttatccttttccatattctgttcagttttgctaattttggaacataaggcaaatttcctatgcagagagattatagtaaaacatgagcgcaactcctcgagtgagccatgaaagagcacccatcaatccaaatgttcagtgctcaaaatatacactcatatcatggtttatctagacaaagttgcctcgtaaaaagaacagcggtcagttttagtttctggaaaggttcaggacttgaggttggggagtaacatgatagtattagggactggtcgcataccatgtgtactccatcccctcagctggtgcttgtacgacacagtgagctccagcagccatagctggtgagacataagcgccaacgccaataatgcttgaactagtaccaccaggagcaccgacagtgtttaaagcaggaccattgtttccagcactactaataaatataatacgatgcttgtctacaacctgtgaaacagtataaagctccagttaagattttacagagcattctaggcatggataagaaataacaccacattaaaggacccacctcactagcaagatcaataaatctgccatagtcaggaagaagggtaggctctccatagctcatgttaatcagatcacatttgtgctggataaacaacaaataaaggaggcattaaagaaaaaataaagtaactgaagttcaagacgtgaatggtagtgaataaagaaaaacttaaatatcaagtagaacaagaggtaatacatgttttgatcgaatcattgatcctcaagcactgagcacttagttgggatgtatttacaaaataattgcattgaacagaacagattcaagtacattttgttatttattctgatgaattgatacaaaaaaaactaaggaagcgtaatcacctctactgcagctatcaaggccctaaccaggcctgtccctgtctccattgatcctaaacgggtatcgccaatcttgcaggaaatcagttgtgcacccggtgcaactccattgagcaaaggttcctgtttaaagacattgtcaacagatcagtgccattataattttcataaaatgaaaatcaaagagtcaaggacatacatcaggatgaaaagcagctgcaatgcccgcaacatgggtagcatgaggagagcaatcagttactatactaacaaggtttccatcatcgtaaatgtttgctacaaaagagcaagcatctaatttgctaaaaatcccaaacttccgctcaagtctgcagataattttaaataaatcaggaacacaacacattgaagataacctttcagtttgtacatctaacatggatggatggaataagataagatacaagatcagcatcttgtactctaaacaataagtgaaacatgggtaatacaatgtttatgcacttcataataaagtactatttcatatttgatcaccgtcttctaggtctctgactctacatgagatgcatgcagtttcataagttcaaattgggcagcaggtccagtcagaagaagggatgcagcaggaacagaattataatcgtataaaactaagcgagagagcacacttttgattaagggcttaaaagaattagagcttgcatttcagagaagtattcatgtgcctacaacacacacaaatagaaaaccaacaaataatacatctgggataagaaatgagcaatgaaccatgtgtctgcaaggaaggttctaatttacaacatcaataagaaaacaagattgaccatacctgtagtttgtcaatggaacaaaatctgcaagttttccacaatttttgttgccctcaaggccctgggtatcaacagcaaccctccacacatcaccatcgtgccatgcaacaatatcaattaccggccccctgtcatcgtaaccctacagaaacaaaagtaagacatataaagtagcagacgttggctaaaacttcacctcatgctatatgctcgttttccttacttctgcttgtttcctcaggtactcaagcctgctttgcaggtcttcacgagccattttttgtttggcgtcatcagatttactgtgtttctgcaataattttttaatggggttgagacattcttgcagaaagtgctcacaattttcatagaaggtagtgcaaagcagcaaacacttccccttaattaatacattaattcaaacattagcaacacataggccatttcacatttacttttatttacatcctacacttcaatcatatgctatatcacaaaagttcacaataattgacaacagcaaccgtgcaaactatccataaagaaacagacgaaagacacagggtgaatgaaaactgtaacaggagtgaacctaaaattcctaaatgcactcaaagaaagtcatctccaaccttttcgaattcattcagctgtttcaaggcctcagatattgcttcttggttgtgctcgtcccatttcttctttctttctttctgaagtcataatgcgtaagttcttacaaagatatcttgttacaaaccttcagaatgcaggcaccaagtacaaagtttaccttcaaacgagaggtaagtgtgtccgtgaagagttcatagactaatttacagccaacatgccactcttgagaagggttcttccatgagggatttatagtcagatgggtgcctgggtgaaagcagagttagcgtatcagttaaggcaggaactcaacgttcagaatatggtatttctgtagacatgggcccctgtaaaacacagttgatatagatgatatctttaaaacaaatagaattgatatcagaattagcatgctaaagtttgataacaaagaaaatttccacagaaactatcattaaagggaaaaaatcatgcgccaatagcttgaaattctccacgctatatgaataatataaataatgcagacctaaacggtcaatacaagcaaaataaacatgcttcaatagcttgaaattctcctatgcatgaataatgtaaacaaaccaaaaaattataagaccaacctgaagcaccaacaatagaaccatcatcatcagctttcaccactttggacgtgtcaacatcaccactacccgtgctgcacttaaacacatgtatgtgaataggctgttgaagaagcatgtcaaaagaaaaccaacaagcttcactatttcagaggggttacagcaccagtcaataacatcaaggatcttgggctttccatctgaagtagtctgcaaaccagctgcanccggatcaactccagaatctgtcacacatacaagtcaattggcaaccatatcttttttttttcgaaaccaatagacctacaacaatgaaattataataatatatacatatttgcatgaccaagtcagatatattgcagatcatccaaggactcaaacctctgacaagtaaattatatatcaaccttcctaagaagcatgcatgtagttcagtggttgtaatggcatctgaatagtaaagctttctccacatgtataattgactgtctactagcggtatagtgtcaattctgtgaaaacaaacccagttgtctttcttatttgaaatagagacatgtgtgatgtggcgatgccctatactccaacatcaattggacaagtaagggaaatttggttctacaagtgaatgcttctacattcacatcaaaacagattctattaatgccacatcattcccacaaaattcagttagctctttgatgagcgatcggtctcacacgatgaacattgcatcgatgggcataaattgccattatcaatagtaatgcagtatctacacaagtcgcaggggccatcgaactgagccagtaaaacccacagcaacaagctaaactagacttagagtaccgaaccactcaacgaattccaatctccagcctcggagatgcataaacaaaaccttaacgtggtcggcgaagagcaggggagaggttgctcaccgaagatggcgatgagcgcgccgcggccgtcgtactcgggatgcgcggcgaggaagcggtcgacgccgatctccttcttcggcatcagcgactcgaggaacgagggctcggtgaggcggaacccacccgctgcagcggtcgtcccctcggcggcggaaggcggcgaggaggacgaggaaggcatcgctctaggcgcgacgcccgcgctagggctcgggccgcctcgagtcgtagtcgaagccgccgcgacgttggaggctgcggcggggacggaccaggcggagactgcgaggaggaggcgcaggtgggcgaccggtttatgtagcgctgcggctgctgctgcggtcacggagctcctcccccgcaagtgccacatgaggtggcccgggccgattcactcacgtttatcgatttgagttcttttcagtctcagtttgtcttaatttagtccggtttagccggggaatctgcgtggaaagcacggctttaatttgacacgatgatgaggcaatgagtgtattgagtggactaacttttagctgtgacggataaagttggagactgctacactcactgccgcagcaatggcgaattggggctctgctcgccggcggcggagggcggaggctgaggccttggacgctagctgctgccggtgcctggtggttggcttgggccttgggggtacagcagcgtggctgatgctgggcagatatttcccgcgtggctggtgctggattctctataaaataaagaatatggtttcttaaagagttcagaacaaatattaaatcctaagtatgttgtgtttatggtaattttggtgatgggtaggttgagccacggctaataagccgtcgaaaaataaatgagacaacccgaaaattttaagatcagacttatacttctattctaaaatgtcaaaagccatggccgaatattagaaaacaatgaaaaaaaaggctaaaatatactccaaaattaacttctaaattctggctacgtttgataagccaataggcagatagtgatagatttagtgttttcgttgcaacgtatggaagctttgctaatgtttttttctaaaaaaagaagtcaagcatatatgaccttgatggaaccgtaactttataggaaaactcttccttccttaatagaaagtaattagttttactcatcttggtttttttcatcccaaatataagaaacaactactactaacgcaaaaaaacagaaaaaaaaatatcacatttttatttgtatcactctaataaatataatatatgtatcgagggtgaaagatttaaaaaataaattcatgggagaggaatatggtaatatattacatgcatacatttgtgtcttatattatgaaatatatatatatatataagttaagcattagtatattttaggtggaggaagtacttctgagttcaatgggtgtgttcggctgcccaactgcagtggctatggtagaaattatgtgttgctattgtagctactggctactatctagtagtcacatcgaacaggcccaatgcacataaatgaaacttaatccaagcactacactgcaacataggaaaagagtggtgtaatattgtaacaaagcaaataattaacaaatttgcttacagctaatctgaatgtatagtttatagttttaatttaactgagatttatttgcaggtttaatatctagtggtgctcactgttcgaaatgaaaatcccagtatcggttttcttagccgatagcgtttcgttcttgtagagtagataattggattttgattgagttatttttctaagggaaaaaggaaaaggaggattcaaaatccttttttcttctgactttcccaaacacaaaatacctccttgtattcgcactctcaaatgagagtggaagaaattcgactttcatataatatcttaatagtaacccacaatagagctatatttttccccaacacaatagataactgtaatccctctacccacaatagataactgtaatccctctcccctcgagaggcgcttccatgcctcgcctgcttaatttggagtagcttttacctgagaaattatcaattatcgtagatttatcaaactctgcaacgccctttttttggtgcgtctttcgaaattcctatcttagaaaaatgagcatcaaatttccacgtatcaaatacacaaactacaaatgttttggaataccaacaccaaagtatcttacattctcgagctttgttgggtgccaacttttacaaaattctcgggctgccagattgctaatactagctttcaactggcagttgccaataaactttacagcgtcccaggaagaacatcttaatacacgaattgggattacagtgttctatgtatacaagttcttgaaaaactaccaactagaccccttcgtgaacctattttcggcagttagccctacaaaatgcaaaatggcaccaccattgattattgatcatcgattgattcgcacattatggtatctgcacttcattgcccccgggggg

SEQ ID NO: 54618 - DNA, 1447 bp, Oryza sativa
ctgcaggcactgtcttataaagtctctgccctcttctgagaggtgatctggtattggtggaagctccttactgtttcctatcttaaacactgcagcaatctaaaaaacaaagcattgtgtcaacatctggctcataacagatcaatgatttattcctactgccaatccatacaaaatatttaaaaggaacaaaaaagagaggggggggcacttttagaacgaatgttactgcggaacaagagacatgtcaagaatataggaaagaggtgtcgcagattgttaagtagtatttctcataagggcaccttcaacgtgaagcttagatggatgctttggggaaaaaaataggatagcaaaataacatgatgtaaaatccaaaaatagaatggaattaacactaaaaactgctagatctaggtcaatatagtgataatcagtatgcattataataaataaaagattccagttttgacgccaaagggatccattgccccccttagcgaatacatcatgatgcaatgtctcaaaaagtccaagataaatagaaggtgaagaacatataaagaagtctaacatgcaaaacctcaaccaaattttcaatatacaaaaaatatataagcattcacaggtaccggtcatcatgtggttcctgtaccacttgtctgttttatattcaacataaaaaaatgaatacaaaattaaatcattgcatctttaaacaacctttttgttttggaatttttcaaacatagtgtcatgttggattcgtcagatttcatcaaaggggatgctgggcctcctggccaccacaaacttttgctaactaaaaagagcattgggaaaataagacaaaacaatgagccatgctgaacttgtttttttaattaaaataagtactgaagcaaaaccacaacaatgatacagtatccaccattcatcttctatagtactcccttcagccaaaactatatgacatttgacttttttatggtcttcaaaattcactgttgaatcaaatattgtagcaatgtgcagttattcaaaactcgtagcaaagtgccattattcaaaattcaacgttgaatcaaatatggttttacattagaataagtataaaatcttgtaagtttatgatattatgataatacttttcaagtcgaatcgacacataccatttttaagttgaactaagcccattagaagttatgatggtcaaggtttcaaaagtatgaccgtatattgtcctaaacgttcccctaaaaagatagtccgaaacatcaaatatttatgaccaaagggagtaccttctcatgaaaagaaaatgtgtgttgcacaaaaacataaaatacagcttaagagcctagtataagtactaaccccttcatattggctccatggtggttttgaggtagccatctctaaaaccgtgcatcctaagctccatatg

SEQ ID NO: 54619 - DNA, 923 bp, Oryza sativa
atggattgaaaaggaagggaaagcatcaacatttcaagaggtagatttggggaattttatgagtctgtttatattagcaccaaattgaagagctattttaacatattcaagtactccgttgtactgcgccccggtcgctaccgagacaacatcaatgccattatcctacccacaaccgccatgccacaaccgctggatcgagcagtcaagcaccccatgtatttgcgtaaaccctacaatagtctacatcgatccttcttctaattgtgttgaggtaattttttaaaaaatcatcctaaaattagtgggctgcaccaattaccaatatttttatgtataatagttttgaacatggtgtttgctatttgaaatatgatgttgctctcatgaccaatgaagatttacattaactacttcaggttagatttgtaaattatgtagtttttccttaatgcataatcattggctgtgtttggtgctaaatactgcagtttcttttaattttgtaggaaaatctgtaagaaattggaataacagagcaaacctgaacattttcttggtatgtacctatacctggtattcatattgatgctattttattaagtgaatagccaatatgttgatctttcatctgaacctgaattactagattacaatgaattcgttgggttgatacatgagcaatacacataaattttatagcatacgctcttttataaattgaacataccacgttgtctgctacaggtcatgtgattaccggtatatcatgatcactttttttaattaggatttaaggaagttggaaagtaaattatgaacaattggtgcctacacatgctttggcttctattcacacgaggtaattagtcttgatttagactaaatataaagggaaccaattatacttttctagaagtgaa

SEQ ID NO: 54620 - DNA, 50892 bp, Oryza sativa
  unsure (1)..(50892): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttagtaaatgctgatggtttatcttcggtatatgtgccgcttcaggggtcttggatagtaaagcaaagtgtgggaaagaaagcctgtttggttggtcaagcactagagatcaattatttccgtggaagcaattatttggaggtaaaccctcagcatgacatgtatctccattagtttctcatttcattccgtcatcagaattcagatgcttggtgtggcaatgccatacttactggcttcaataagcagtttatccaaagcattatgtctcacttacaaatagcgcagaataacaatggattgaattttggctactgttgccacttacttgcgcttacggttgacttcatttaccacaatctacgactagcgttacaaagattgtctgaaataaatcgtggcgtaatgaatctgccattctgtttggtacatccagctctgaacatctttacatgcatttttcagcttggagttgatataggctcgtcaacagttgcacggggtgtggtgagccttgtgcttggctacttgaacaacctggtgattgaaatggccttcctggtacaggtaattgtggcatatctaatcaagtaattacacaacgagcttgatgtttcttttacttctcaagattcagaacagtgctgtttcttttttcctttaatgagataaaagattcagaatggatcagtaaatagtgctatgagatgagagtttcagaattgctcttttccttcttttttttttgagatgagagatcagtaaataacacagctgaacaacctcatgaaagaactccttgattccttcctactatcatgaaacaaaaccctgtttgtgtcgtgcagggcaacacgcaagaagagctcccggagttcctcctgggcacctgccgactgaactacctcgacgcgtccaaggcagtgtccatagacgagtgctgaaggcgtcatcagccaccattgaccccgccaacattctttctgaggccaattacagtagtacagcgaaccaaggaaaaaaagaggctcaagtcattcgtttcccctgccggccccggtccaaagatactccttgtattgctccacacaaaagccgaagaattctggctcattctgcctgcctgccagcactgtacattctcctcttgccgacaggtattgcgatgtaatgatgatagcaatctacgcccattctttggcatgccatcatcgagaaaaagagaaagggaagtgtatcctaacggtgacccccgtggcgttcattctgacctgggactcgtctcagcttactgtgagtagtgagattgcatcattagatccaactccaaagcaacccattaccggacacttgactactcctgttccataatatttctcctgagttcgagtgagtggtggcagccatgattataccagagggactcgtcaacaactgaaagcgaccaaagtcacagggattgatatactatgctcctaccattggtaaggaaggaacacccaggcagacgcactcacaacccaaaccctttctttttgcctagtcacttgagctagaagggagggatggaacatgagcaagtggagccggcatttccctttgttcttgagaaaagacaggacatgcaaactatgcttaaggcagggacggatagagatgatggtgtgtgtcgccgtcgcaaagcggcgagacatcgtgtggtcgagatcgctgtgcgtcgtccgtcgtctgcgtgcttggctagctaacctaaaactaaaaggcttccgtctgcccgtgcaccccgtcgccgctgtagcagccgacgtgacaggtgaaccgatctctcctgcattttttgctcacacaaattctgtaccactagtagtagtttgccgcgtcatcgcttcgaaatggagagagattagtgtggggagaagtatatttaagtggacacttgcagggttagacagaattcccatttccattgactcgaacggatcccgatgacgccgccatcgccggcggcggctgcggcggccgggctgggcggggtcggtcgcgcgatgcacgggcccgtgcctggaggccgggctcacgtgcaaaacgcaaacgcaagcgaggccttcgaagccaaaagaccctgtgaaaaaacaaaccaaccaacaaataccaggaaggtgccaagttgccgtgtctctggatcggtcgcaacgtcgccgccggtgaacacgatgaaacgaaggtttaccaaaccgttttaggtcgggacgattatcatgagaatattattgcacatgataaccacggtaaccgtacacggaaacagccgcacgctaacgaacggtcgccggccgtaggatctgccgggatcctatgcggcggcgatggagtcgtccggcgagcgaacggatgagttgtccgggatgcgtcagcggctggtggtggaccggtgtttttttaggggtaggactgtgtaggattaaggacggatgggacgggtttcgtcgcgttctttttttgattgaagcgagaaggaagaggggaccggttgtggtgcgagccggtggtacagcgagaggcaacagtttgggtactgtttgggcgtgtggggagcgtcactgcatcagcatctacttgcggccacccaccacaccggaggattttcttttatctttttttcttttggagtattatttcagaagctttcttttgataaagtttggtttgataaaaacaacatattgtgtagtaccagtagacagtagtacctaatttgtaggaagtataaatccgaaagatattttgcaatgcatccgctagaaggacgatgttgtcgcgtatgttttggagggttatagattgtgatgggttggcggcacttttttttttttttgctgtcacaaacttatcaaaagtgtttgtttttcaataaaagcggtatctaaaaaatatattgcagagtgccttttaaaaaatttaccgctaaaatctcaccttatggagttggatgtagtaaattactacgatatacaatgcactacatgatgggtagctataatgtctaaaaaggtgaaatgactactttcagttcattatagaagaagagagttgacacagtttatgagagaaattagccatcaaaactttacaattgtatagttaattaaaggcaaccaacaaaaacctactgaaaagactaggacaactgtctaatgcaactcatcaccacacaccaatgacctacaactactaagatctatcacatatcattattgtcaagctcatcgcaacaagcagtcccgacttcccatgacgacatgtagcctggacaatcaacatcgttgataaaaagatgtttatggccactcaaattcagggaagtatctaacaacatcttaatagaggacacgacataaaaacattatcaatgtttgttgggaacactggaactaggttttcatctaaaggataatatgagaagaaccaaaatgatgcctttaaagagggaacggtgtccacatgcatcgatgtcaccagcatcacgcgtaaactaggcaagacttttgccgagctcccacatcctaccatcgcaacttccatgagcaaggtggtagctataatatcactatacgcataatatataggacatagtgtttacaataaaattctcagaacaaattctcaccatcttttttatatatgtagggttgtcataacgcgtgaatgagccatgttccactaagattaagaccctatttgaggagcaagaaatggtaagaagcaatggtagtagactagtagtagatttatttttgaattttgttgttagtgactttcttaacttggagagagaatataaactgtaaagaaactagagatttttgaagtagttgtaactactagaagcatagaagaagctttttaagtaagtacagcctagggtgagaggccgtgggtcacgcaagaatgaataaataccaaaaggcaggagagaggcgtctaaacttagcagctaaattatgcaaattagtagtagcagtttattccttccatagagaggctgtgtttagatataaacttccaacttttccatcacatcaacctgtcatacacacataatttttcagtcacatcgtaccaatttcaacccaaacttctaactttggaaataactaaacacaaccagatataactcaaggttagaaaagcacagtcatgacagaaacagaaaggggaaaatggaaaatgaagctccttttcgtcaacttctctgagaagcccccaagttaattactccctacgtacctaaaaaaaagataaaccctggatttccgtgtccaactttgactgtccgtcttatataaaatttttttataattcgtattttcattgttgttagatgataaaacatgattaatattttaagcgttacttgtctttttaattttttttataattttttaaaataagacggacggtcaaacgttgggtatggaaaccagagtttgtctttttttttttcggagggagtacagccttacaggaaagttacaccccacagattgtacggtgatcagtgttcctgtgtgcttgcttagagtagcataagcagtgttaccactagtactactgctgctgcacgacgtgaagggcatccacggtatactccaaaagtagtccataggcaacataatatttgatttagccacctagcaacattgtgaaactagtctttaggaaagaaataacaaaagctacccataagtatatggtctgcccatagagaataaaatatattatttatctttatctcttctcttctactatttgctatccatatacattgtaaagattatatatggatcccatctctattgactaatttttgttgttgcctttacacagagagagacagagaaaggcctctctgcttgtggaggaattttgcagtaatccgatcctgaggcgagatgcggtgtcagcagccatgaaagtattactcctactgtgtttagatacaaagtttatccaaacttcagtcttttttcatcacatcaacttatcagacataattttttagtcacatcattgtcaatttcaactaaaatctaaactttccgctggaataaacacagccttcagctgagagcaagttaaatagtatagccaactactggctctaaatcatctatagtcaatttaatagtcaatttatacaatagttacttataaacatatactacataattaatatctagtcacacctatcatacaaatatgcactttagagtccgtactatagttggctacaaatctatagcccgctgttcttctttcttctcttttatctcttgaaatgtgtctatagcttgcttataagctgctattgtacctgctctgaaatgacagtttccagaggtgatgttccctaggttggttcagagattacgctaccctatgccatcgtcatccacgcagatgcagcagtacagtgtgggagtatacaggtattgtgcagaccgaaggagctgctgctttggaggaggattaattggtccaagcttgagaggattaattggcccattggaggactcgaagctgttccagtcaaaattacaaatccccagatccacgtcttaaggcattgttagaaattttgtctcgttttttttttcaatttatggtgtattctgacatctgaccacgagagacatcggttgctgctgagagtttcagctcttcaggccgagtttagtccaaattttttctttaaacttccatttttttatcacattaaaacttttctacacataaactttcaacttttccgttacatcgtttcaatttcaaccaaacttttaattttgacgtaaggttgaaatttaaattttagtacttaaattaattttaatattttttactcatagtttattgtttaacattagtttttaactcgtttagaacatttgtataaaagtttgtatctacaaattattatattttttgtcgctaataagcgtaaaggtttacattcagttctagttaaaacgatcagcctgcagtttgtgttttcggtggacgcaactatagatcatttatgatcatattttgtataaagaagtttttagaattaattttaattagtcgttaacatgtacattagacaagctattattacagatatcataaatattaacattatgttaaacatgttagttaccatttaaattgtagatgataataacaaaagaagtgtctacgtcagtcacagcttgctaattaataatttcgatttttaaattatattaataaaaaatagcccaagctaggtaagatgtcatatttataaattaaaaattttcaattaaattagagaccgtgttgttttcatttgcatgatatatttaacatgtacgattcaccgaattaattgttaggtttttctagttaacgcgtgtgctccttaaaacatccattagtgcggtatgggtatgtaattgacttcttattaaatactacattattaaccattacgaaaccaatattgccacaaatacattaaaatatgtatatccgtataggttttaacaccaaatatacttgtaatttgactaattatttattaaaataaatgaagtttgacatttcgaaataaaaatatattccttaagaaaaatgtcatatgaaaagagtcatggctatataattacacctatcacggtacaggtcctcttacctacaaacagtaaacgtgcgtggtttttctttttccaaataagagtgtgtggctatgtttttaaatcagcctttagcaagcctagatttatcggtgatctctgtctctgtgatagtgcgttaaagatatctatttgcagggattttgtttgtagtgtattgatttttgaaaaattacacggaaatcatacactccaacactatttatacgtttgaatgaaagcattgataatgatatgcgaagagaatactcactgcttcctccgtttcacaacgtaagactttctagcattgtacatattcatatagatgttaataaatttaggtatatatatgtgtctaaatttagtagggcagtcccaaccctccacctaggatggtgtggtattaactacattgtcatgtaggacttttaggttatgtgacactatattaattaagagagagagtgaagagaggaagaaactgggtctcatgcaagacacagcttcaacaggagaacttatgtactagacactatcaaattttgcattgggagagaatagtgtcttcataatagatgaagaataaatatgattggtagagaagagagatgatgtatttattaatggcccactttaagaaaccatgggttgtaaaatgtagtttctattgtgatgtcttattgacatggtaccatagacactacttataaatattatgtgttgagactacccttaacatctagtatatgagtatgagtaatgctagaaagttttataatattaaacagagggagtattcaattaaacttgtacttttaaaagcgtacctgcagtatcaggctatcagcatccataaaagaagttactccactccagcagtaactactcgttaaaaccacttgatcaaaataagacactttctagtacaaatgacaaaatacggaggtcaggtcaccaccaaaaccccgtatcagatttccctgccaaccctgcctgtctgcggtacactgtttattacaccacgacaacccattcaactcctgtcccatcaaaaaggccaagaaacacatactccactacagtggactccaatgttcatctcccatatcgccttgctccttcaattcgtctgtcgatttccaggtcggattggatcatggattcctttggatccatttcatggataatttcaggcctcattgtttgtccctttcctccaaaaaaaatcaattatagttaaaatttaaataaaaaaatcaagttaattgtaagatatttataacgcagtttctttgtcagcattacgtgtgtttgagagaaaggaaaagaagaatattgataatatacgtaaaatgagatgagttattagtgtataattaattgagtattaaatattattttttttaaaaaataataatatgattcttaagcaacttttctatataacttttttttgcaaaaatacacagtttagcagtactttccttattattccctccgtcccagaatatagcaacctaggatcggatggaacatatcttagtacgacgaatctggatatgcccctgtcattcgtagtactagaatacgtcctattcggttccaattcggttccaggttgctatattttgggacgaagagagtactaataaaccattttggtttataatcagttctcgactaatcaatgaggctccttcagccgatcgatgaacagaaacacacagaaaaggttggctgtaaaacgcagcggatggcgcccaaaaggaagaacattacgatcacaaaaaggcagagaaacaacagtcgcgtgcgtaccgtatgccgggcgacacagtaccgcggttggtaccttgctagtagtgatcggcaacagagtttttgctgctacacagtgtccgaataatgaatattgtttgatgagggggatcgcttttgtcatttgatgagctacagggggagagctaaccgtatctgccagcaatggtgccagtgctatagactgtagttctggaaaaaaaattattttggccccggcatagttcggccaaaacagaggatggtatatattaaccatgcatggtgataagatcgagctttgtttggagggtaattttaccattcttcaaaaagtattaggaggtaccacactttcaagtataaaatttggtacctccagatatactaaataccttgagttacaaaaaatttagtgtaaagttgaggtacctcgagatactttttcaaggatcataaaatttcttttgtttggaacatgggaatttttatagaaatgggttcaattcgcgagtccgattatccttgccctacacaagattacactatatgctacgtagtgtagtacatggtcccatttgagatagctgaaattgatatattcatagataatcagattattttatagctatttgagggcataaataaagaaattaactactacaaagtattccataaaaaattatatagaaaattattacgcaaaacacactatttagaagtttgaaaaataaaagtttgaaaaataaagaaaatccagaattaaaaaaggaacatggccattgtgttgagtaattcatctaatactcttgtactacacacggtaagaatttactttacatcagctatatggtaggagcagtagaaatttacgatagaacaaactcggatgccgactcttcgatgaggagtcgcattcactgacatggtagggtatcatgccttttggatgggcttgtgttgtgtgggtgatgaacttgcgataggggccatgcactgttctagggtcaatgagcaaagatgcatgggtagtttggctatgggtttctaaatccaaattcagtagttggggtaatgatagtgatatataaggatgtgcacgtttttccttacaaatgcactgatttggatgtgttgtggtatagttctttttaaatattacgactttaaatcttattccaatgaatattacacaaatctagaagcgttgtcaataataatttagtaaggacatgattcatcttaactctatcttttttataaacttgccagcattgtccgttcaaaggtcatgtgagttggtatcggaatttcgctgcttttttttgaaaaacaatcctttttaatagaaaaaaaaaatcttaaaatcaagacaacatggaaaatatatttatcgtagtatcttcccatcagaacaatatcccagcaatttctctgaaacatgcataattccactaattgagaaccaaccagaccaaaagcaggagacgctaatttgtctctaaccaccatcattacccatcactaaacactcccccaaaacgtgtagagagaaccactgatgatgttgatgatgatgatgatgcatgagatgacttcgatttggtttggttaatttcttcatcagctggccggccggtagcacgagcggcctcggcgagagagagagaagataggggttgtgtttggacaacccaccgatccggtgctggatccaacggaaaccgggccattttttacaccgatcacgatgagatctggggggagtgcacgcacgcagatgagtgcatcataaatcaccgaaaaatctctctctgagatgggagtttggttgacctcgacattggcctgccttcctgtgagctggctcccgtgcaacatttggcctttttttttcttctttgttgcaattgatctagacttcggaccagcacacgggcatgtgttgtagattgtttcgccaacctacaggttgcacggattatgattatagatactataaatattaaaattttaatattatactatatgtttactaactttgaaatcatagcttcttatagtgaaagaagagctcatatcagttacaatttggtaaccgttaatcttaatttttagaactaagttaataaaaatcattaattgaaagtccgagatagatacgatttcgtatttattgattaaggattcgagagttatcaaattagagccatgtcattttcagttacgttatttgacactcaacacgatctacggccacgataatataatcatttagaacatatgaattttatatgattttttataaggttttagtgtctagtttctagctccgaagaaggtctaagatgtcttatcatccggactactccctccgttttaaaatgtttgacaccgttgactttttggtacatgtttagccattcgtcttattcaaaaaatttaagtaattatttattctttttatgtcatttgattcattgttaaatatactttcatgtacacatatagttttacatatttcacaattttttttaataagacaaacggtcaaacgtatgctaaaaagtcaacggtgtcaaacattttgaaacgaagggagtatatagtatgttgacattatttatcgctttgtgagactatatagaatgttgacattatctatcgctttatgatatagaggagtaagaatttagctctagcttctgacgaagaaagacaatgattttttttcttcattataaaataaatgtttgtctgaaaaacaattcaccaagaacaaccataacaccgcaaccaccaattcccgcaaaagcaaagatcagttttctgaatgaaccagaaagtcttgcggcagtaataaatccccacaactgtcacaaaattaaaggagaaaagcacacgcatagatcatcgtcaactacagtcgcgcgaaaccgggcgatgtgccccgtccaactccgacccgtccctgtccttgcaattagccctacgtggcttgcttaatttgcttcttgtcccaacagttgttgttggttggatccaaattcccggtaatctgtttctttcttgcgctagagatggcaccaaatgatactagtatttttgttttgttttgtttgtgagggcacaaaaatggtgattagtaggacattggtggtaaggggttttgatgaactttgggagacgattcggccggttttggtttcatcagatggtccagcttccatgagcaaaaatggactgttgcttgttgtttcggaggaggtttgatctgtaataattggagaaattcccttcttcagttgagagctgctgattccgatggcgtgttcttttttctgtcatggattactgtgggtatgttttctaagacgaactttaatactctctgttttaaattattataattttaattttattctaagtcaaatattttaccattaatttgcatacatatataatttaacctcttaagatttatggtttagatttacataccatatataattaacatgccgttaaaccgcataaatttatgcccaagaataaatacataaatttctaaaattattagtgaaagttagcaaaattttgatttagaacaaaccgtgaacgacaagtaattgagtaagtaacattccttttcagaatttctaggtttttaagtattttttaactttataatatatttaattatttcatttgtgccctagaataatcgacaaacactctatttcgtcccccaacgcatcattcataaaaactttataacattcttcatccgacacattaaaaaacaaatgcatactacaaattctaaaccatcctaggtttgtgggagtacctaactagaaacatcatttagattgcataagttcaaaacaaccacgcacgaaccaaatttcagtggagattatctagcagtctgttcgggtagcttctgtaaaaaaaaaaaaacaaaaagaaaatcaagcggacacaatataatgtgtttagttcatgcaaaaattgaaaatttgattgaaattgaaatgatgcgatgaaaatattgaaagtttgtgtgtagaaaagttttaatgtgataaaaaaattgaaagtttgaagaaagaaaaaagttaagaactaaaccaggcaatctgaattataaattcagaaacattctgtaaaaaaaaaaaaccacaaccaaaccactcggtctcatctcatcagtcgtcactgatccgcagactccgcgcccgtgcagcaccccgagcccgagccccaccgacaacagagtagaatccgacccacccactgacacgtggtccccacccaccccacctgtccccacccgtcatcatcactctcgccgcgctgtccgcttctcgcgccgccgcacccgatcccgacctgacgtgtgggcccgtctccactgcactaccagcagcagccgcagcagcgaagcgaagcgagcgacccctctctcctctaagccaagcaaaaacacaaggagaactcgccataattccaatccactgtgccctagctcgcccacctcttcctcccccgcgagagagagaggagagagaattcgatctcttctttctccctttttttctgttcggtttttgcggtgtgggagggggcgtggatttgatgtagattattagggactaccaccaccaccgtttctgttgcagttgcggaattggaggattgtgtgtttggtttcttgatctgaggaggaagaagacatgagaggtagtatcgtttgtgtttctttgtgatgatttcgattcagtttgcgttttgtgttttgtttttttgatttagttttggattggcaaggtttggtgggtgagcggtgatcgcatttgggggttggagatgaaggaggtgggggaggtggaggaggtgaggtgcttggacccgcagctatggcacgcgtgcgcgggcgggatggtgcagatgccggcgccgcgttcccgggtgtactacttcgcgcagggccacgccgagcacgccgacggcggaggcggggcggcggcggcggccgcggagctggggccgcgcgcgctcccgccgctcgtgctctgccgcgtcgaaggggtccagttcctggccgatcgggactccgacgaggtgtacgccaagatccgcctcgcgccggtcgcccccggggaggccgagttccgggagcccgacgagctctgcccgctcggcgccgccggcgacgcggcggagccgtcgccggagaagccgacctcgttcgccaagacgctcacgcagtccgacgccaacaacggcggcggcttctcggtgccccgctactgcgccgagaccatcttccccaagctggactacagggccgacccgccggtgcagacggtgctcgccaaggacgtccacggcgtggtctggaagttccgccacatctaccgcggcacgccgcgccggcatttgctcaccaccgggtggagcacgttcgtgaaccagaagaagctcgtcgcgggggactcgatcgtgttcctgcgcaccaggcacggggagctctgcgtcgggatacggcgggcgaagcggatggcgtgcggggggatggagtgcatgtcggggtggaacgcgccgggctatggcggcggcggcttctcggcgttcttaaaggaggaggagagtaagctgatgaagggccatggtggtggtgggtacatgaagggcaaggggaaggtgaggatggccgatgtcgtggaggccgctagcctcgcgtcgagcgggcagccgttcgaggtggcgtactacccgagggctagcaccccggattttgtcgtgaaggctgcgtcggtgcaggccgcaatgaggatccagtggtgctccgggatgaggttcaagatggcttttgagacagaggattcatcaaggattagctggtttatggggacaatatcttctgttcaggttgctgatcccaacagatggccgaattcgccgtggagacttcttcaggtttgcttgatccagtgttatttatagttgttacatttcacagaattggcgctggatgcatgccctgcattgtgttgactaatatctattgcttctcagtgttgctagaacttgctgttcatatattatcagttatgtttgaaattagctagagtggcaaactgctgttgaatgtcaatctcatcaattagtgatggtggaacctgagtgggttactagcctgatgttcacggttttcagtgaatgtgttcttgtcttcttggtcttaaactgaggtttctctactcaagttatcaacatattgattaggaatttgtacaatggtgggttcgggttccaggttcctactttatttaatgaaatcatgcaatgagtaaagccggtgggaatcccagggtattaggacttaggaggatgcaataggtaggaacagcagagtgttcttttctgataggtagtaacaaactcgttatgaaggaaaagggtttttggtccttgggagcttgcttggtgcttaaaagttggattgtctctttgctagttctacaagtggctgtattcttttttgacactcggcagttaacccttttaattccgagtgcagcatttaaattctcccatgcaactgccaaattgatatcagatgccacacctttgcatccgaccttcacctcagtccaaatgaagaattgaaaaggcatgatatattagctggacacaataaacaacagaaattgggctgttgggcccagttaaacgagcaacggtatgtttagttgcattaacctaggatgtattaaacaaatttctaagcatataatgaactgcatatttttagaaagtaattattttacctacatgaaactacactgtttgatagacccattctgaatcctgttcccttcaaattgatagtatacgctgcatcagtctcttccagtggtcaataattgagatcagggtcttcattgtcagaagtttcatttgcaatcaatcatgtatcacagggcccatatatcatctttcatgcttgacataatcatttaagagcatccattagccacacaattgaaatgtgctaaaaaatgtccttagctttgcatctttcaaaaatttcacgaggaaaaattttatcacccgacacatcgaaccactgaatgttgtatccgccatatgctcagcctacatcccaccttgtatccacgtcattgtgcccttttgctctcagccgtattgcgcccactaaacatattgtatctgctaggactgagagaggcagacccatgtaaatttgtgtatattggggggttgtagggggcaaagaaaaacctgccagaaattaattatttatggtgttttactatttttctgcccattcgcttttcattggcaaactttctcaccccagccctgcccaagagccacttgttctggcatcatggttatccgtcgccaacaccactcatctacctctgacacgaagttatagtttgaaagcgagattaaccttaaacaatatgtgtttcctgccaagtgccaaatactgcatacactttttaaaacaaatgcaataaattgggtggtaacatcatatttaatatgctattagaaggaaagctattagttgttaccggtactagtataattgtatgctagtagcagtagaacttcaagtgagggagtgagctatattgctgtccacatgtctcaataagtatctccttcactgccataaatttgtctttttcaccagtttcccctcatatgatagctggctgatattgttaatcagcacataccagacatcaacttttgaagaggagattaaaactaatggtgctggcctagctgaatatgctagttctattggcagatgtgccatatgattattagctccttcctttcctgtcaatatacattggatgtcagcttggcatgtacaataaggcaatgaagggatacatgggggatgctttgctagtattattattaagtgagatgttggaaattcatgctgcttacgcagtcatagcagatctagatagagttggcttgtgaaagtgaaacatcaacggtagttgccagttttgcctattttagttgtgctgacctcagtgtgcttttcttcattgctgcactatatccttttctaattctcatggttgcaatttgcaaaattcttacaggtgacatgggatgaaccggacctgttgcagaatgtgaaatgtgtcagcccatggcttgtggagcttgtgtcaagtattccaccaatccatttaggaccattttcgtcacctcgaaagaagttgcgggttcccccacatcctgacttcccatttgagggtcatcttctgaacccaattttccatgggaacccacttggtcctagcaacagcccactatgctgttacccggacaccgctcctgcaggcatacagggagccaggcatgctcaatttggtttaccactaacagaccaccagcttaacaagctgcaccttggtctgttacatagcggcagttttaacagacttgatgctattactccaccttcccggatatcaaagggctttgtggtcagtagtgcaccagcccatgacaatatctcttgtttgttgtcaatcagtacaccacaggtcgcagagaaatctgatgacagaaagacgacaccccatataatgctgtttggaaaggctatatttactgagcagcagataacttcaagcggatcaacagagacactctcccctggagttactggaaatagctcacctaatggcaatgcgcacaagacaggaaatgcatctgatggttctggttcatcaatttgcattggtttctcatctcaaggtcacgaggcttctgaccttggtttagaagctggtcactgcaaggtatttatggaatcggaggacgttggtcgcaccattgatttgtctgtctttgggtcatacgaagaactgtatggtcggctggctgacatgttcggaatcgagaaagaagaaatcataaaccatcttcatttccgtgacgcagctggtgtagtcaagcatccgggtgaggtaccattcaggtgaggacctcattatcatatcgttagtttttttttcccttacaatcctctaacaagtttattgcgattgcgatgagatatatctaatccattctatttacgttatagtgacttcatgaaagcggcacggaggcttacaataatagccggcgacagggagagaattgagagacctctcatcgaatgcttagttgagcaggcgtgatagttcaataaactcccgtttgaatttaattctgaaatatgaatcgtagcgtgaaaagacttcctttgttacatgtacttgcgttgggctgttaactaagcagacctgctttgtattgtcagtgttgtggattgctcaagttaaggtgtgtgtgtttttatcttgcctcggttagctgtcagtttctttgttgcaatcagtggtcatgttcttctgttcaagttcgtaaaccaaacacttggatgaatcttagtcaaaataaaagttccttgggaaatcctacaatttcacagctcactgttactacttgctagtgccaaatgcatcctgaatctgtcagaaaagcatcagggcctgacgcaatttttctacttgtccaattggtcttttatagtagttgcaatttgcaagtcgggaaaccacagcctagagttggaacttggaagtggttttgcttacgatttcgggcttcattttctgagatgagtgaatgagaacgagcccttgcgtgttgatctgggaagggagaaggcaaaaacaaactatccagtgtcttttggtcaaaagagagaacagaagtagcagtacgtagtagtaaatttgtggcataagcgtgtgaaaaaaaaaaagaaagatgcgatcactcgcacacgtgcgcaagttaccaagaacggtcggtatgtacgacgtgtagctatcatcaattaattaatcatcgtcatgtggttgtgcatttcgtcgaaagagaccggcagagtagtttagggtttgtttaggttgcgtttagatccaaagtttggatccaaacttcagtcctttttcatcacatcaacatgtcatacacacacaacttttcagtcacatcatctctaatttcaaccaaaatacaaactttgcgctaaactaaacacagccttagttggtgaaataaaaatttttaggtgtcacattggacgtttgactggatgtcggaagggattttcggatacgaatgaaaaaactaatttcataactcgcttggaaactgcgagacgaatgttttgagcctaattaatccattattaacatatgtgggttactatagcacttatagctaatcatggactaattaggcttaaaagattcatctcgtgatttacatgtaaactgtgcaattagttttttttatctatatttaatgctctatacatatgtataaatattcaatttgatgtttttgggaactaaacatgctcttactagataaagcaccatcgtgaaataatccaaacgacatatttgcaaacgaaaaataatttctgaacaaacattttaatgcgtgtttctagcgatataaagtaaaggctgaaaaataaacttgggtgaagaaaacactaaaatcagcttcaaatttaagattgaaaattcaagttttgactgataagtatgagtataagtgaaaagatgaagctgaggtgtacactgctgccaaaagttgtaggataacgtgtactcatatcaggtacaaaatgaagccggggtgtacactttgcacaataacatcttaaatagaacttcagttatagaaatacaatattacagcttcataagagaaaaaaaaagacaataggccaataatccaaatactaaaacataatttgaggtgatccggcaacgttagaaatattgacgacgtgactttataaaagaaaagagataatagatcagatctaaatgtcataattaagatgatatacacatataaagtttatgagagaagatggatagtttgcaccatagatacttcctctattttcttcatttgaaaatataaggcacacccaccattaatctaaagataattattatcacattctagtatgtatcatccaaaaaatataatacatactagtatggtagatgattattgctagttcactataagatctacaaaagttacaccgatactatgatacggatgcacgatacgccattgctggttaaaaataatataaagatgaagaaacaaaaggttaagattttaaatatagaggagacggcaattcaatttaatttaatcaataggacgatcacacaatccatccgtctaaaagtataaaaatataaagtgcattaatttttgcacaataatactttgatcattggtttgtttcattatatagcatcaacaactacagaattaatattacatcatatagcaaatatgaatttatcggtattacttggatcatgtaacactaaacaaatatattgatgccttagttattaatcaaaagttgcacatattttttttgggggaaaagttgtacatattaattaatataactgaatacacgcatgtcgttttatattttgaacatgggataactttgatttaggcttgatatccaaactagaagtgtcggcgaagtattaattaagagaagtatccagaattaatttattattttgaaaaactgaaaatcacctatatgtgaatagtacatatatagaaaggttgattagtcctgcagggataggtgtaatttataaaaatatagacataatgtccatactaaagtgtatgatgtagaaggatatcagttaaatattttattctatttccatattatgttagttggatagaagtataatagtttgataattgtgggcaatgagatggaatttgtattccataaattcttaaagtataagtcctgaacactatgaaatagaagaatgaaagtaaatagtttattaataatatattatctgacaagaagcataatagtttgatagttgttgctaggaggtagaacctgtccaaaagcaccacctaattatataatagattgaacataagatttgtgttcagtagattaaatgctttaagatttatttcaaaattatgctggtgattaaatgttttaagaagtctaagagcacatattgatggtcctaaagttttacataattatgtgttctgtgttgtagctgttatacttttactattccttatacaaatttataatacaattactataaaagatctataacttgtccataaaggaatttggcatgcatgtaaacgtgacacttaccttagtaaaagttagtaaaaggacagatgcatggtattcatgatttatactaaccaaaagtattagtgatagaaagtggcaccatttgaactgcagaggaaccatgaacatattatattcaaaccatcttattattttgagattataaaaggtttgacacattataatgttgttaagtttaaaaattaagaaggttattgtacctcagttgatagttctaggtttttttagccctccgatcagatagttggtagttctagttttttttttagccctccgattagatgtgagagttgtgtaaaccgaagagttttttttattgacaaagttgtgcaacatagaaatcatataataatttaatgataaaatgtaagtagatataatttggatcgtcttcttatttctacatgagagaatctcaatagttttttatcccctgcgttttttctgctaccttccggatggttctttttttaaaaaatatttgtttgactaagctaatttgactagcactgttaaccttttttcatctggaactatcctgatagctaattggtgtattatcctaatgatctaacggtccacctttcttcccactattatcctagggctattgttattcaggtgacgtggctcatccttgttggagagaggttgttgctttcacatatgtagatacataataaaattagagatcttgaggacaaatgatttaataataagttaattatatgcatgcacgttttatattatgaaacatctaaaaaaataattgtgttttatattacggaatgaagggagtaaatgatttaaatgttaaaaacaattgaggtgattggactttatgagagatgatcagagaattaatattgactacatttattgagaacaactttatgagtgtaggattatgcccgttaataagctttatctcacttatagcagctttaaataatatatgtaatatgctggtgtactagcatcggcaggtttaagagatcacgtatccggatcaaccatgagctttggatacactcgacatgtccgggagcgctagagagcaaggaaaatacatgtcaagacatatagattcaggcctctcgaaggattcttggacactgtcagcaaagtttatacaaggtttatagagctctcaagctagctaacaagcatgtagttcttactgattctaccatccaattctttctataaagcgtggctgccccctcctccgcccaggaacaaagggcactatacataatcataagcttgaattcctttttactccatgctggttttattgtgtagagcaaaacatcacatgggactctatctcattgcatcaatgcggtgagaccacataagtttaatagtgcagccaactactgactccaaatcatctatagctaatctaatagttcattcgtacaacagttaactataaaaatatactataccattaatacttgatcccacctcttaaacacacgtaacgtcttggagtccgtgttgcagctggctactccctccatctatttttgatagtcatatttcatcttggcacaatgaccaagtataagtaattctacttatcatccatttaaacatgttactagttattcctcgtaaacaagcgattcattaatatttacatttctcaatgtccatgtagtcaatcttgtgtggaagaatggagagtcacgcattaaatctgagaaagtcattaagaagatagatggttggattgaaatatgcctatcaaaagtaattttttttaaatttggaaatatacctatcaaaagtagatgtagggagtataaatttgtaccccgcttttttctctctcttctcttttcttctcaatatgtggttatagctggcttatagcctgctattgtacctactctaatggaatctggagttaatgtgatgtatagactctgcagccggctcatcagtccttagggtgatgcagaatccaagcagatacgcctccattacagcaagtttaatagtatagccaaatgttagctccaagtcatctatagctaatctaatagcccattcatacaacagttacctataaaaatatactacaccattaatacctggttccacctctcatacacacaaaatatcttagattttgtattgcaggtggttataaatctgtagcccgctttcttctttctcttcccttttcttctcgatgcatggttatagctagcttatagcctgctattatacttcctctcagtcctcgatacgtgagaacaccacctatcccttcttgagtcggtgaggggttctctcatgtgacattctgattgtgagatccgatccatcaccggctgtattcacacagcctcaagcaacacatacatataaacaacaaagaaactttatattcaagtacaagttcgcaccaaacttaattcatattaacacacaacaatatcgcatacttacagaaactatctagaagttataaaaataaagtaatttagaaaatccacaaaaactgtttgaaaccgactcacacttggagcttattagtctgaccgccgagctatccggttagaccacaccaacacctttgatctgaatgacagcatctgctcggtctcataagcctaacaaaaccgataacactattcaccacctgtgtaggatcgaatcacaagaactaagccaatcagaggggggtgaatggttggtatacccaaaaaccgaaaacttttagcggaaataaaagttaccctcgaaatcgacggaagtcggtctgaccgagattgatctgccggtctgaccgagtggatgccgccggtctgaccggtgttgaatctccggtctgatcgccgaagtcgcctgccgcacctgtcgccgccgccggtctgaccgcctcgctcccgccggtctgaccgccgcaatgccgccggtctgaccaccggtgagttgccggttagaccgctgaaacccggtgaaacacaaataaaagaattcttaaagtggatgtcgactttattacttctctctatgtttacaaagtgcaacaacagcactccttacaaaaatttcgactaaactctaaaccctaaaccaaaactcaactctattgctctctaaagcgatacagaagcctcacgctccctttctatttataccacaaaaacccctactcaaagtaggtgtagaactcctatacacaataggactccatccttcagtttccatacgttttacaatttccaaacgtgcagcaaacaaccggccgcaccagaaatccaaaacggattcgctcccaagctgacgtccacgcgtgaccgtctccgactcgctgccagctgggcccttgcttctcctgggccgacttggcatgccgccaacagccaccgaaacccaccgagccgctctcctgctgctcggccaaccagtcatgcacacatacatgcttcaccatgcatgtatcgatcacacatacatgtacagcaccgtacatgcatgcatacctgcacgctacagtacctcgtgtactgtagcaccatatactactccaactttacaattcccttcgcgaacaccggcacttgcacgcacacctcgtgaagcccgttgcaaagatctctcccacacgatttccatccaccgtatgccatcttgtatccaactttgttacccggtatccttgaccgtctggacctcaactcctccctgagtctagtcccgattcccaccgttgaccgaagttgacctccaagaatccagactctagtcaccttctcacatggtatcccgaccgcaatagacctctgcttctccctgagcatagtcccggtcctcaccattgatcaaggctgacctcaagtcacctgcacacaattagacaaaacaaccgtttctgagcacagatatcacaacctgacccacattagtcacacgcactcacaccaacattcacacaaactctcaaaccaattatttgattaaatcatttgtatagccaattgttcatcacaaatattaatcatgacaatgatttcacaacctggaaacaccttgatttcacatctggacccaaaacaacttgaatcatgtgtcgaagagctaaagatgcataaccattttctcaaaaaaaaaacaagaaaaacgtatagccataatcttttacggcaaaattttgcaattcttttcgttttgatccctagcggatcctttgaattaacaaaagtgtatgtatgcgccatggtacagattagtactggcgctgcacgtgttgcatgacgcgatcgagagaggaggcagccagcaagcctccctcagatcattattaatccatggactcctccatgaccaaaaattggcccgcactcgtacgtatcgttcttactgcggtacattcgtgacacaacccacggaggctagctgcagctggctgctggcatatcatagtaactctctccgtcccagaatataaacaattttagctataaatctagataattatgtgtccagatttatagctaagggcccctttgaatcaaaggatttatgtaggaatttcataggattcaaatcctataaaaaattttcctttttggccctttgattcaaaggattgaagctttctaaattctataaaatttctatggaatgacacattgcatatggattttggaggaaatttagcaagagctccaacctcttggaaaaattcctttgagtcattctctctcgttcgattcctgcggttttcctgcgctccaatgaaacgactttttctgtgtttttcatgtgttttgcaatcctctgttttaccctttaatttactgtcagaatcctgtgtttttcctattcctccgtttttggccctaaaatttgttacattttgggagggacgctagtacgcatctacagatatatccaccacgcgacaaccggccggcgcatgcatgcacaccccaccccaaccccaacccggttggcttcctgcctacctgcaggcgtacgtacagacacagaccagctggggtcaaggtagtacgatacatatgcacaagtacgcgtacagtcgcgcacacgcgctcgtgcacgcacacgtacgtgccgccacgatggtaccgtgcctgcctctgccggcggccgttttcgccgggcatcatcatgcgcatcttggaaaccccggccggctgcctctgccgatgacgcctctgcagtgaaggatgcaagcgtacgtacaagtctcatggcggagctagctagcgtcgtcgtcttcccgtttatgtttatacttatcaaccaaaatttaaattttcaacattatatttagagttgattttgaggttcttgtcatcaaaatttattttttaatatttttttaataaaaaatacatatataaaagttttatttataccgtacgaataaacgaaacaatggctcctgtcgccgtcaagacaatagcagtagctgcccgacctgctcgggacgtagctccgtcgctagctagccagctcgattatcaggccaataattaacgaggcaacgaacaggcccaatgaggaaggaggccagacaaggcgaggctagtacctttgaacggagttggatggaagggagaaattttggcgagtagtgaatttgccgtcatcctaccataaactaagagtctgtttgaaggagctttagattctgagaagcaactgtttggtaaccagcttctgaaaatctggaaaagctctgaaacccagcttctctagcttctgccttcttagttcatttttcagaatatgtaactacagattctcaaaagctgtggactgtttggggcagcttctagcagaagcagcttttgggaaaagttgcagctgggacaagcttccccaaacaggacctaagattgcttgctcctttgcatgtgaagatgggaagcaagaaaacaaagagaaattcttggtcgggcatagccttcgatacgagttaaagggaagaggatttttgtaaatatgaaacaaatattgcgcggattaggaatgcaagtgggtaaacccaaatccgcttatagacaaaattaatagataacccacgggttacctactaatttgatctataaataggtttatgaatcgatccacttgcatctctaggtgcagcaaaccagaccacgatgcggaaacccgtgggttaccacttatttgacagataagtaggttcgcgggtcgatccacttgcatccctagtgtggactaaagggtccacctgttgtctgaatatacccatttctaaattccattgcaacacccaggcaattttaccagtaggagtaaaaacaagaagtttttaaaaaaattcaatgtgttccatgagaatccacaggccaggcattgcgcggaggggggggggcatccaatttttttctcaaggtcaaatgatgcacaacaacacgcgctacctgccgatccacacggaccagcggagccccgcattgtacgaatctttctgctgcgaaatgcgaatcactgccagtataggcctccggcccaaccgaatgatgccctctttgaatatacatggtaccctacaccttctctcagtctctggcccttctgagacacggcccaactacagcaatgtaatggatgaattcgtcgtcttctcttttgtttcggtttttttatatatattttagtatattgatcttggtacccaaaggaggcagaattattgtgaattcagttccatttctgaattgcatgatggcaattgtagtacaagaatcttgtgtgtgccagcctctgtgctgtgggagagatccatgaattgtcatttcaaatctatcaccatgagaagtatagtcatttcaaatctactatcaccatgagaccatgagagaatagatgtatggaagtacagtatactatttcctccgttttaaaatgtagttatttctagcacaatgtcttgtcctaaaaatgaaactattcctcatctcaaccaatctcacaaccattcttcttcacttactttctcttttcaaccaatcatacacttcctctaatcattctcatctacttttttaatacccgtgccaatcttaaaaatgtctatattttgggatgaaggaagtattgagaattacgagtactctcgattgtcaaatagttaaaaggcgtcggtctatacagctaatggagatacaagttggtttttttttgggacacagggtgtatggattattcgtgcctcggttataaaataccatttcttcaaaaaaaaaatctgtgacagcattttatttatctgtattaggaatttatctgtccacaatctattcaatcgtgcagttaagatggacctaagctagacaagttttgtacgtatagtctactgcagtttcggattggagtgaccattgagagacagcaatcgacctaaccttcagaactgaaacctctcaccagacaagacctctgcagggagctgagttagccaactgcagtatacagcacctggctggagagacacctgaactgcttacgagttgaacactcttttgtttgattgattaattgtggtctaacgacgagtagccaatgacactgacatgatcatcgacattttggattgagattggcaggtaagcttcatctcaacgtacgatcatgacctgctgaccataccttttatttgggatagctttaaattttgagaaacggttgatgagaatatggtcgagctaagaaaaccagtttttaacttttagttcattttatagattctataacaaacttttcttaaaatctagtagatgaaaaactaaacaatttagtctctagtttccctgtgcaagtacatgattggtcatttcataagattcaaaaagaaaaagaatacagttctcagttttcccaagattcagaaagaaattaaatgtccaagttttcttcgtggctgaaatctgatagtcactgcaattaaaatggattactgcagtggactagtggtaacttggagtgctgtacgttagtcactgaagaaatcagatagagctagccagacagcagtagtgcaagaatggctgacgaaaggggcagtacatgtttcatcggtttgttggggggaatttttaccggcgagagaaatgccaagtgactgacggacgcaaacgccatgatggcgccttggccttaagctcacagttcgttacgcgtcgtcttcaccgatttttcagcgacatgtttcctccctgcatcgctggaacaacgcagacacatttgctaccccccctgtttacaatgtccactgctacataccccttccgtcccaaaaaagtttagctatgaatctggacacacatgtgttcaggttcgtagctaaaaggagatgaaatgaaatggaattgaagcacttctcgagctcgtaaacggtgttatttttgcaaagactccacatatgaatttctcataatattgttctaaatgcaccttttaactttatactaatagttaatttattcttgtttgtaccctcgaataattatcacaaattactcatctattcagcattctgtttcattcaaaagactatattttgccaaaaaaaatataaaatatatgtatggacaaacattagaaatatcatcactagattttaaaatattggaatttaatatggtaaggcgatactaatatagacctatcatataaaaaacacttctgtaaaactatacttttgataacacataaatatatagctagaaagagtagtgaaaaaatctagctatacatcaaacagtgtccatgtctaaaacggagacattaatattttcttcttatacaactgaaagacatgcatgcgtagtctcttttgccggctacctcgtaagtgaaattctctactcttatctcctctaagttgtcggcgtattattaatttatgtatccctgcctgctttgtactagctacaactatctgtaggagcattacaaatttacactagcgatctctttctagtcttgattagtatactaaaactacacaaattaaggaagtcatcgtcaggtagacctgcttaattaccatatctttgaagtacggacatgtactaataaacagtttgtgtagttggacagtacatgttgcaccgtacaatgctaataatatactcccttcatactcataaaggaagtcgtttagtacagcgacacggtctccaaaacacaactttgacttcttgtttctataaaaatatttattgaaaagtgatatatgtatacttttataaaagtattttttaagacaaatctatttatataatttttacatttttaaacttaacaacctgagagttattcatgatttatattcccaaggtttgacctaaacattgttctaaacgactttctttacgagtacggagggagtactaaagaactgtagatcaagtgtagtgtactgtatgtatgtctttcgcatgcttgcagggaaggagatagagtaattagattgatagatatatggccggccatacaaaagtggtccatatgttaagcatgcgagctagcaatttgtcgaccattcttgccttcaaagtctcttccacatgcacacacaaacttgattttagctagctagccaatgttccatgtggatgatcaagattggacatggatggatgggacttggcaatgttttgacatggagctagggattagttgtgcctagccaattgagcaaagtgtctcaattatctataagcatcataaaacatcatctagtactatgtgagaatggagctagggattagtagtagatggagaagacaaaaactcaaagtgaggatgtgaggagaggacagagcagcagctagcttagccaaatagccagccagtcagggtgccctttgcaatcaaagacaaaaggaaggaggcccctctagctagctgatcatctgtgtaaccaaaagggagattgagatgtgtgctacacctagcagatgatgcaataagttttaatcagattcatgcatgaaatgcatctttcacacacactcatggcttagctagagacaacatgcatgaatgaatggaatggtcacaccctatggtggggtatatatgtaaatttggtgatgtttcaggagtacacacatggcagaccgacaaaatcaaacctaatctcctcgaaacaaattaatcaaaattaattagaaaaaatcagcgcacacttttcctaattaattaaagaagagacaacaatgtgtaatttacaaaactaattaaattgcatgctgccactgtagaataaataaaatatcatgtggcctgtccagctcggatggttagggtttttttttctttacgtgtaacctactcatgtggtttaaatcctaaactatacaacgtattcgtcggcaataagatataaaggtatatatgtcgattggtctcctctatcaaagatattcatagggtaggatgtacacgtatatatatttttatagatgagtatgcgtgtgtatacgtaagagcgtactccctccgtctaaaaaaacaagtttaattttaactacgaatctggacacatatatatccagatttatagctataattggacttttttttatgacagagggagtacatgtttgtaccctgttttaaaaaataataaaatataatgtgaggatatgaaaaatgaaaaaaaacgattggatggattcatggaatgcgtcacagtcgtaggcagggacagcgtgcatatgcattggccacaaccgtagcggtccaaaataccaattggcacacacacatgaattgaatggcccatgcctgccttaattaaagggtatggatggcgaaggtgatcaatgtgtccaaacatatatgcatacatactcctgcacgccccctatacccgccaagatctcggtatgtccgataaatttgtcggattttgcatacattgtattgtaccacacccccatccatcttttttttgtccccttgccctaattgatcgctgcacggcagcgtttgtattgcagaccccaaatgtatccaaacgtacgcccatctatcctacgtattcgcttcgtcctaaaataaacttttatatacacgaatctatgtatatatatctgcctttaattcacatgttatatttgtaagtggacagtgtacgtttacgttagatgcagagatcgtccacaggcaaggcgctatagggtggccctaatatatgagcagtagtatgtgtgtatatcacacgcaacgcgaaaacgcatgggcgtccctacgctgaggtacggagagattggaacagcccaacgtacaagctagctaggggaggaggaagaagatgaagagaaacaaatgcttggtcgaccaagctagtgataggtgaaaaggaccagcgttgtgcaggcttggcaaagagagaggatcgaggaccacttgatcgatcgatcgatcgtgccggtgccataatttgtgaacctagctagccaaaaaataagcggcgaaaaggcctatcattgtgtttagtaaaattaatagattcgaaactgttgaattaatgtgttctaaggttcacatatatgaagattaatattttttgaataatcgcaaaaatccacctcatgaacatgcatgcatgtgaatctttagtaccaccttgcatgttcttaaaaaaaaagtaagatctccttaaataggagagtgcttttatagttacttaagatatgtgtggtgaagagtactagaggaactcgcgcactcacttgctttgcttggctcgggttgggaagcgcacgtacgcgacatgctcgtgaatagtccaccaaaaatgggctcctcatgcttgcgtagacgcgacttccttttgtagttttgtttaatgcataattcggcgtggagtccaaataagtaagtgcacgcgacttattcggtggccgcctcctcgcaacacacacgaaatcaatttagggtttatctcttcctttgtactgcgtcgccgctcatagtctactccatcttgctcaccggcgtgcacctgcgaacggtagagcaagtcttcgggaccttcgccttcgacgtactgcatcaggagaagatgataataaagtttttggaaagcgtgttgcgtgactacttgctattcctctaccacggctcatctttcccttctttcaagtgttgtgcgccgtcgtcaacgcccggtaacgcgagttcttactgctatgcagttaaacgtccagaaccctcgatacatattcaccatatttcacatattcgatctgatcatgttttactgtctagtttacatgtgtagatcttatgatacgattatgctagttttaagctagtttacatgtgtaatgatatgatttatttattaaatatattaaattaatatgtgtttatatattcaacaggaaaagtatatttgaaaccttatagacggttaattctcataccaaattgtgtctattggtcaagaaaaaaaaacagttatgggttggtcagcaggcggctttaccaaacgagattatcataacccaccgaaatcgtaagcaacagtgctctgtacagaagtctgtcctcttctctttttttttgggaagaaaattaaggctaacacaaattaacatcacaattaattggtgtgaagaaaataggttttggaggccttaattaatagatgcggcgattaccttgttttacaaaaagcttagctggtactgtacccagcttgcacatcacatcttttttgaaggacagtacgtgattacaatgtgatatatggccacatccatgcttaattaggagcctgaaactgaaagcaaacaccactggcaaccattgattactgttcatgcatgtcattcatgggcctaccaactgagtaacaaaaggaggtttattatatttttttttcttattgttgatggaaaagacacaaagaagctgcctttgaaaatatgctgagatttgagaggcaacagggtccctgtagaggattgataattcaaagatggatgagcaaaacctaaattattttccaaaggtgacatgaagggccctacaatgttgtatgatttgcaccccctttctttcagttccaatctcctttatttgcttctactaccatgcattcttttcctttttcttttctttcaagaactttgagttggacaggctagctttggtcgagctggtcgaaacattgtatcaaatgcttgagacagacatatatattgacaggtttgctgatctgaccacctgacataaaaagatataataggggtatatcacactctgcaggataaccatcccctgttttttttttctttccacaaaccaaagaaagcatctcctgttaattagcaccataattttgttcatgtcaacatctgtatataatcatagtatcataccatacttttaaactgacaattataaagtcggaacactactgaagaatttcagatatgctgtcaccatcaaggagtccttaaattaatatttgctccaaagcttggcggctgactcgattagtactatgcatgaatgtaatctaatccatgttacattttttttcccttttggaaaagctaacccttgtcccatcccccttgttgatacattccaattgcatctcaaagcagagggagatcatcgagaaaaaagaagaacactactactgctggtgaaaaactaaagggaaaaggagttcgaaattaaagctaaacccagcagcaggaagaacacatgcatgatcctattgggatcaacaacgacgaccataccgaattttttacatcagcctcggaagacaagaccataccgaggcaaattgcctgagaataccattttggggctaataatgctttgcctcggaatactacctctagtatgcaaatacttggtactgtgtggaactattcatttatgtgcattgagcctttgaccactcatctttttaaagaaaacaatacaaatacttaaaaaaacaatatgattaaagtttgttgcatgcagagtataaccatgaaacctttgcgaagggagcgtgactcgactaattaagtttcctgtggtagaacaagtccatctagatttaagtcgtagacttgacataggtgctcgtgttttcggctaattatttttatgataggtgatgtacccgtcgacaataaagtacttgtggtcacttcattaatttaaagatatgtcggtccaacctttcgaaggtactcgtaagagtagggtgtgcatgtgtgtattcatagcgtgagtgtactcgtgttgtgagcgcgtgtgtttgtaccgtgtttctaaaaacataaccatcgaaccttcatccactattactaaccattttaaaattactttgtggtcaaagttagaactgtgaaattcaaaattgccaagtaaacacaaactgaaggagcttatgaatcttgaggctagtccttagatcaagaagctgcctcggacaggctgcctagctgaaggtcagtggtggtgcagttgatggcgcgaaagcgagataacatggagagggaaaggggaatgttttcttctgcttgctgcatggtccaagcttaattaggcactgtttggttctgacgcacatggaacgtttgaacatctgtataaagtgttaactatatgctaaaaaataactaattacatagattataactaatttgctagatgaatcttttaaacctaaatactccatgatttgacaatatggtgctacattaaacatttgctaatgaatgattagtgaggtttaataatttcatctcgctatttactgatggattctgtaattaattttttattactgtctgaacaccttatatgatactctatataatatccgatgtgacacgctaaaactttacaccctgcatctaaaacaccccctagctaagggtggaagaagatggagatgagactgtgatcaagctagctagagagtggcctctcctacacctagcattcatccaaaatgcaatgcaactgggacgaccgaccgacgatcgatcgagctagctgctaaccacccggtcgctttcggcttaattttgccggccggtcagccgcggccccggcctgcgcatatatcgatcagtcgatctactcgatggatgcgtgtgtcctttctgcatctgtgtgcgcccagctgggttcatatatgctcctttcttttatttaaatattatctctgtgcgccgttgagtttttataaatatttgaccattcatgatatttaaatttccttttgtaaatataaaaatattaaaatcaagtttaaagaatatttaatgataatcaagtcacaataaaataaattataaatgaacatttttttaaaaataagatgaatggttaaatgtatctaaaaacgttaacggtgtcatatattaaaaaccgggcgtggagcatatgttattttataaaaataaagtaataaatataagtggaaggaaaaagtaattattagaaagttatcaattaaannattttntnaagcnccnnnnnggggggggggggggggttgccgtcggtgtcgtgaaacgcatgtggtgcggtgtatttggatatctgctctcaatggtgacggaacctatggtcggtagctaggtcctcaactcgtccatgactagaggtgtgtactatatgactggccactcataattatctgagagtacatttgtcatttgtctcaagctaagagtgtacatgtctgactctcgtagggactgttcatattatagtcaaaataaatcttaccaatactaaaattttagcaatttagcgatattgccaagtttttacatgattcttatatatttattaaaatttggtaaaaaaaaacctaaatggatgcatattttttataactttatcaaaaattggtaaagtttaaaatggcaccaatctgaacaaccccataatttttactagtgtatggtaaaaatggaaagaacccttcattaaggaccattaaacctgaaaaaatagtttgtaaaacctactatcgcgcttagaatagagagggaaactattgcgctgcggattgtctacaaatacattatatatatttaaaaataaactcaataaatgattagaatatatggtttaagcaatatagcaaaaggaaaaaaatacgtgtattaaagaatactcctttcgtccttaaaaaaacatagccaataagtcgatatttttttaagtatggtaggtgtagtttaggatgaataattaatcggttatatactgctcactctatctcagaataattcattttcatccattttacacatagcaatacaaaactaaaaaacgatgatatcttcactttaccaagtctcaatgtgattattcctactttatttactcttgatacatttatagcctgctttttacaaatttcgatgtaatgattatttagaaataaatttatatttgaacaaataagagtggctaaaaataaaacttattatgaaagtagtatatcgtactcctccgtccaaaaaaaatccaatcctagctacgaacctgaacatactcccttagtactcgtaaaggaagtcgtttttgacagtgacatggtatccaaaacacaactttgacttctagtttctataaaaaatatttattgaaaagttatatatgtatacttttatgaaagtattttttcaagacaaatctatttatataatttttacatttttaaactcaacaacttgagagttattcatgatttatatttccaaggtttgacttaaacattgccctaaacaacttgttttacaagtacggagggagtatgtgtgtccagatttcgtagttaggatttgtttttttacgtagtggtttgttataaagagagattaattaaagcgtacgtaaacgaagaaagaaaggtggcgtccgtacggggggcggctggtgagattaacaaagtggatcggccccacgctcgtgcggaaaaccgttagttaacttgccacttaatcaatcctgcaccatgtttaaaaagactgacagtagcgggcagctgcagacgcccttagctaagctttgccgtctctccttttctcgcgtgcctacatgcaggcataagatactgctgctgtctgtgtaccctctcctcccccaagctaccttgtctttcgcccatcaccaccccacagcccagccacccaattaacctgcaggactgtactctgtgcatcatatatgttttggagtagcttcctctccctgcatgcagccattgcaactttgcaagccatgccaattcttggatcatatcatactccttccaaaaaaaataacgaatccggagggagtattatctaagctatatcctggtgcttggacaatatggctcggtttagagcatgtttatcggggctctaacccttaaatctaactttaagagtagagtctgaagtatggtcgaagctagagcagtccgaactctactacttcaccgttcattttttctagatcacatcaatccactcaattttttacttggaactatctagttgagctgcagcctcataagggatggagctgaagcctcgtccaataagcctttagaaatttgttttttagctgcttccaaattacttagcggcatagctaataatttatagcttaattttctaaatgatagatgtttgctaacaattcgttagctcctaaaaaaatatgtccatagatacgtgccaatctctgaataatagattgatattgatgtggtctgtaattaactataactaatatatccacacattcaacttagctttcggacgttgcccactgtttgtcaagtgattggccctgcatacacatggccttgtttagctaggtatgagtaacgagaaatggaggccacacccagcagcatgcaccgacatgcatgcagagagaaaagggaagatccattgatcagcaagcaaaggatgcaattgcagctagctggggcatgcagccatggggtacgtgcaaagcgagaaacaggaagcccttatactagcttagcttagggcacattctaagcagcttatggtcgaatggatatctctctctagcttaaaaaaaaaaccttttacatgagcatttacttaaattacatgactggatctgcagtggcaaggggtgcgtggattaacctgaggtcccatgtttaatatctaatacgctcacaatttcttcttaaaatatatttggagggacgtctctcactccaaatcttgtttttttacatgttttaaactatttattacctccctcttctctagtacatgacaatgttaactacgttcgtcttaccttaatttcaaattatttttaaatgattatggatgttagtaacttagtatggttatattagtttacggtacttcgcagttcgataatataaacatatatgtatatttgagtatttgtaatttttttaaaaaataaacgagcaataatcacaatttaaacttaatagtcaattattcgagagaacattgtgcgctgcaaaaacaggccctgattaaagctgaggtgctgcaaaaaattacggcctctacagtttaatttaactagtcgtccactccatctccgtcacggagctgatcatctcagcttatcatttttcttcgccttttctttctctggcctccttcacgagaagcacagtcttcgtctccggcaggcctgagcttttcttctgctttactcctccaagtggcagggcctgggtttgccgggcccacatcccagccccgcacaagcaactagctaggggatcgcattacgcttatatgtattttttatttttcgttcatacaggagtgtatagtattaacgtgtattaatttcagcctttagtttattattatgtactatatccatcacaaaataaatcaatctcgtattaggatgtgacacattctgttacaacgaatctacacatactatatatccagattcactgtactatgatgtatcaaattctagtatgaggttgtattattttgtgacggagggagtagcgttataagcggattagatcattcgtggattaattgtagaagaattaagtattatattgctctctccaacgcaaagcataaagaatttgtaattatatttatagtactacttatcttatcaatcagctctcttttacttttttttttcatcttactcacctatcttcccacttccccttattaatttattaaagagcgctaaaatctattcttcttaatattgctaaataaacaacttaaaaatgaaggacaatatagtatgactcttataataaagccttaaaacttatatttctagaaatgttgagtactctctccgtcttataatgtagagtactagctccctccatcccataatatagtaatatgtctcatcacattctagattgctatattataagacggatggagtaaataatccacgttaataattcaattggttggataagccggaaaagaaacgttaccttttgcaatattgctactgtagcaacgtagctctggaccatggtacatgagtgtacaagatcagacacgagatgatcttaattaatttctcctagcgtgcgtggctacagtgcgtaagaataattgaaatttgatcggccgacacatgcaatgcatacgtacgtacattacgtgccaagagaaatatatggatggatggatgcgaagatagccgaattggcgcgaataatccgagacgacacgacgacagtgtcacagtgcaagtgtgcactaccgacgactacagtatgcatatgccccccaatcgatcgatcgagttgacgaagtgcatgcatccgtggatgcaaaattagagcacatagaagtatatgacagcttaatttcttgttaattcgtgcatgtaagcatgtttgccggtgtactacatctagagaggtgcgagtatactcattcaatttcagaataagaacattttgtactcttcgtgtttatctcaaaataaggtttttttaatcggattttatgaaagtaggagataaatgtaatgggagtagattaagaaaaagtaataattacactgggatttgatagtggaggtatcctagttttttttattttgtattggtaaatgccagatagatgaaaagtaaatttaagagagggagtactctgtattaatttatgtgtgattacctacatatatacggaggatccataaatacgataaggtatgttcacaatgcctatgttcacatggttactgtagtttaccaaacggccatatatatacctatgtttttttaacacaaacaactttattaagcaagaatagatattaggggataaaccctagtacacgatgaaggatagtagctgaaagcaaaagagccatcacttaaaaaaagagggttaactgaactacagaaacagccttcctgatgtaaccgaacaacagaaaaaggagcaagccgacagggagctgcggcgaagctgtgacgactgctaccttgggcctcattagaagtgcactccgcttgacaaaccgttaatcctcatcggctgcctccacgggaatggcacaagactgaggttggttgatgtgccgtagattttggtgtgtgcgtcaccggactcaacaaagaatccccacgggattcgtcattgaatctagggaactctaacatcaaccctgtcaaccaaaattgcgcagggggtccgagctcaactcgaatgacaaactatgcgcggtttctgctgctaggaaacaaaagagagagccaaattatagaccaaccaaccttcaacattgggggcattgagatgacttctgtcttgctgtgaggacgaagatggctaagaagaaggtgacttgcaacttggaaccacaggattctggccaaagcaaacacccaatcacaaatatcccaaagacttcggcctagaggagattgtcgtcgtcgagctagccaggactgcttccaacaagaccccaaccaacagaggcagatgctgcaccaggagcagcgcaagccagggcgcagcaaacagcgggagcacgatgaagggcgacgacaaccgcagcaacgccgagcacagcgcacacgccgccaccacagccagcatgagcccgctcgcatgcaaggcaccaccgacgaccgccgccgaaaccgcctctaccaccaccaaggcaactcagatctggaatcttcaccacccttcgggaccattgcgggaggatgtttccaccaccagagctgcgattcgccatcctagaagcacaaagccactagctccaaccaccaccgtcatcaagggcccctacaccggccgtcgccatgggaggcaacaccggcaaaccctaggacatgagactagctagaaacaggataaatctgactaaatactactaggggaagatggccatcggcaaaccactggaatcgaaggggaagaggggccagagggaagggattttgggaaggttactgtagagagaggaggggaatgagagaggggagagagatgactgccacaatatctatgttaacatggttaccgtacgtttgtttgcagttgttaacttgcagtgataagtgtaactacacctaatccaaattcgcgttgttacggaggagacagtaaggccctgttttcccaaacagaaacttttcaccctgtcacatcgaaagtttggacatatgcatggagtattaaatgtagaaaaaaaacaattacacagattgcgtgtaaattacgagatgaatcttttaagcctaattacatcatgatttgacaatgtggtgctacagtaaacatttgttaataacatattaattaggtttaataaattcgtctcgccgtttacagatagaatctataatttgttttgttattagacaacgtttaatacttcaaatgtgtatctgtatatccgatgtgataactaaactcagaaatttcctccatctaaacattgttagtgagttgcatattacggaggagacagtaaaaaaaaaaacaaagtgggtgtactccagtgaaaagcacctgtttgtgcggatgtgacataacttggtcgcggcaggacagcacggtaaaaaaaaaaaaacgtgaaagcagctgccgcagtggcgctgccactgcacgcgttgcactgatgctgctcccacttcccttgcctctcctctcacttcaccttcacggcgttcacttcacgcgcgacgcgcctctgttaaactcctcgcctacgcgacggtccaccaccagctacacaattactgctccaccggccgggcctctcacgctgactggtggggtccacttctcctcgctcgccgagaggatccagagtcttctagaacatccctgcagcaacagacactccgtcgtcgtctgaatacatgtccagtagtattttctttttaaaaaaatcaagtgagctgtggtatacccgtactcccttcgtcccataaaaaatcaacttctaactatgtatcttgaatataaagtatattatactacctccatattttaatgtatgacgctgttgacttttttttttaacgtttgaccactcatcttattaaaaaaatcatgtaattttcatttattttattatggcttgattcgctatcaaatgttctttaagcatgacataaatattttcatatttgcactaaaattttaaataaaacgaatggtcaaacgttgatcgaaaagtcaatggtgtcataccnncccctacggagggagttatatatagtagtacaatattttttaggaacagagagagcactactatttgaaaacacagatttatgcctgttcagattgtggagaaaataaaccttgccaaaattttggcaagatggcaatattgctaaaattttggcatgatttcttatgtatcaaatttgacaataaattaaacgtatatttttttaactttatcaaaaatatggtatggttgaaaatgacatcaatctgaacaacccctatgtaaacggtgttgcggcacaataaacggagcaatgtgagtaaacacttcggcacatggtactttcttcgtttttaaatacatgggcccggtttagatcccacttcaaaattttttaccccgtcacatcgatcgaacgtttgaacacctgcataaattattaaatataggctaaaaaataattaattgcacagattacaactaatttgtgagacgaatcttttaaccctactccatgatttgacaatgtggtgctacagtaaacatttgttaatgatggattaattaggcttaataaattcatctcgtggtttactgatgaattatgtaattagtttttttaagtgctcgaacacctcatgcgacaccctaaataatacttgatgtgacacaccaaaactttacatccttggatctaaacacccccatgacaatggccttgtttggatcctcggggctattgaatagccctccgaaatctattaaacgtagattactaacaaactcattccataacaaaccctaaatagctcagaggttatggattgggttttattagtaatctacgtttaatactcctaaatagcaagattttggagggctatttaatagcccagaggatccaaacagggccaatgttaagttcggaacgtacatttactattcatctcagtagaaaaatatataaatattttaaacataatttatatttttacatatttatgttaaattttaatgaaatggatggttaaacattcgtatgcaagttcacacatatttaaaataaagatggtacagttaagtacaagagtctgaaaactaatatatctgatttgaatgaggttatatagaaagacttggtactttcattacgaaccttgccacgagtgtcatgcacgtccctagtgtctcttaagtccaaaaaatgtaccagctcactaattattaaactggaccattcgatcactgtgtgaaataagtccagatagtctatttaacctacctgtaaacacataatttattgttcttttttttatcaaagtggattaatttgttacgcacagaaaataaaaacgtgcttcggaaaaatgctatttcacgcacacatgctagcaaacataagcgcgcaatcatgcaccttatattctctatccgtcaagtgtatcatttcctacttttcgatcgctcctcttgatttcttccaactcgagcgttcgattccccacatacatcctcccaaccttggcacaccctagcaagacacggtaaacctgtcgctcctctcctagcaagataccgatgaactcacgatcctcttttccttccttccacgatcctcttctccctcctctctggtggcgggggtgtgatgctccctgtagccgtcttcctcctctatggcaagacgtcggcgagctatgatccccttcttccttcggtgtgccgctcctcctatccgttgtcctcttccatggcaagatgttgatgggcttgggatccccttctttttccttcgactatatctatttttaattgaaaactttgaaataaaaataattataacttaacagtttcaggggttttgggtatgatgttttgagatattagttaaaagtttcatatattgaatcgagaatcttaagattttagttgaaagtttctaatttcaaatccagagtttaacaagttgagatacgcaaccaacaaaacccaactcaatactatttaatattcaagctatatatatatttatgtgcaagtacaattcggatactccatttaagacatggtacatctcgttttcactttttttttaaaaatgaattgtttcacgtgtagcactccgtatttatttacaacgaaaataaattgaattgttgagatttctgtcaagtgggtaaaggagccgcaggtccgcagcaaaccagtagcaatcccccagctaaccccccgccgtcaggaaaataatttcgctcctgctgcacgatagtgacgacgctgtacgtacggcgaccactgcctcgtggccccccccaacacgcaagcacacggtgtacatccatgtgggccccagggtccatagaccgagcccacgtagaccacccaccctagttttaccgcacattttttcccagctcattcatcagattattttctttattttttaaaaatatatttaaaaaccctttctatattatagtattctcacatttgaaataaacaaatagaactggatgtgacatacttcacccgtttcataatgtaagactttctagcattgcccacattcatatatatgttaatgaatttagtcacacatatatataaatgtgggcaatgctagaaaatcttataacctgaaacagtggtagtatattagtataagtagtagtttttatttattttaagatggtaatccatccgtactacgatataagaaattttacttagatggaattatgatgctacgaatatccttagtattagaatgtgtccaattaaaccaaaacttcttatatcttgtggaacggaaggagcactagattaattgttttaaattgtttattaattttatttcttaaaaaatcaagtgatttttatagttattgagataatctgcgatgataataatcttatcaaacgttaggcagcgctcgctagctttcgccaactcctcctcctcatcacgtcgctacacaggctagtgtagctcgcagcgtgtacgagctgagctgagctagccccctgccactctctctctctcgctgacgctccctggcctttaaagctgtcgccttttgcctccccctgctactgctgctcctcctcctcctcctctctctctctctctctctctcccgtgctgtgattgctgcctcggggtgggcggtgcgagctacatacagcacaccggcggcggcggcggcggcggcgaggctccgggagaggtccagctaggcgtggtgggtggtggtttcttgatttcttgtgtttgggctgtgtcggcggcgggtgatggcggcggcggctccgtgcgccggagcgcggggcggctaggggcggctgtttctctgaggcgtctctcccccggcggcggcggtggaggtatgttgtgagcttctcttctgctgctgttcgtcgcttttggggttttccggggatggttctccgctgttcatatcctccttgccattacggtttttctaacaattttttttcatgattttttgagcctttggttcatccaaagcttcaaaccccgattcttggtagattattaattttactcgatttaaaaaccgtgctcttcgcctccaatttcgcgactcccgcggcggcggcgtctcatcgccggcatttcgcgtgctttgctctgcagaatcggcgcgtcctttgcgtgcttttccacgccttgttgttcaagggagaggagaggagaggaagaggcaagcttgcgcaatcgcacaaccgcctgtcgatttctctctttcttttctctctttctttctctttctttttttcatttccccctttcacatgtcaggttatttttttttctcctcgtctcctgacgatttcgcttttgctcgaaatctcccaggtttgttgttgttgtgttgaaggcggagaagaggggaggctttggtggtggtggaggaggaggatggcggcggcggtggcgatgcggagcggcagcggcagcgacggcggcggcggcgggtacgacaaggccgggatggactccggcaagtacgtgcggtacacgccggagcaggtggaggcgctggagagggtgtacgccgagtgccccaagcccagctcctcccgccgccagcagctgctccgcgactgtcccatcctcgccaacatcgagcccaagcagatcaaggtctggttccagaacagaaggtgagcctaatcatgcacacatatactatcatactagtttgccctttttttttgtgtgtctggatgtgaaatgttatgatcttatggataaattggttgagaatggagcaatagcaatggtagtgttcaattgtttgcctttgttggtattgtgaggatacaggaagaaagttacttgttgtggggttcttgaatgtgtttgctttgcaggtgccgagataagcagcggaaggaggcatcaaggcttcaggccgtgaaccgaaaattgacggcgatgaataagcttctcatggaggagaatgagcgtcttcagaagcaggtctcccagctggtccatgagaacgcgtacatgaagcagcaacttcagaatgtatgtcttcgtgttgttgagctcacatcgtgcttcgggtggtaaaggcgctgccctttctttgttttctcgcctgctcatatcatctctgttcattgtttgcagccgtcattgggcaatgatacaagctgtgaatcaaatgtgaccactcctcagaaccctctgagagatgcaagtaacccgtctgggttagtgaaatttcctttgaatgttttggttttgggcaattggaagcggctgccctctagggattggtttgccattttcttgataaactagttatatgatttttgtccagactccttacaattgcggaggagaccctgacagagttcctctccaaggctacagggactgctgttgattgggtgccaatgcctgggatgaaggttgattgccaacttctcagattcactctgcctgcatcaaatgacgtgtgcattcgaatgttctaatttgtgttcccttttctttgataagcctggtccggattcgtttggtattgtggccgtttcacatggttgccgtggtgttgctgcccgtgcctgtggtttggtgaatctagaaccaacaaaggtaatagcattcatcagtacttcatttatttatttatttttaattcttaattctacaacaatgcctgctgtttgcttccaagaaaaagaattcctaaaccagcttcatctgcaagtaactatgctgttttcatgctgacatactttcgatcaaagaaaagtcctttaaagtacccgtcacaagcacaactagctgtgctgtgcatacatgaactcttttttacttgaggggcagactcctttactagaatgaagagttgccaagttttcggtctcacgccatccacaaaaagagaagttctcgctctctctggcttaacagctaaggtgttccacatccaaagattcattgcaaaatcttctcttcatgcattttgttccatgttggacataattcttcatacgtatttggttgatgtgaatattttctagaaagctgaaagactttattgttttcagaaaattgttgggagattcttatagtgtgctatgcagatcgtggagatcttaaaagaccgcccatcttggttccgtgattgtcgaagtcttgaagtcttcacaatgtttccagctggaaatggtggcacgatcgaacttgtttacatgcaggtgagcgttacatcctaacttttttcttgaattaagtatcccatcattaatttttgccacatgcattccctttttatttatcattcttggctttttcgctcagatgtatgctcctactactttggttcctgcacgagatttttggacacttagatacacaactacaatggaggatggcagccttgtggtgcgttgagcttgagcatcttcattttattttagtttgcctacattgtaaattagcacaggtgtcctaagtccatgtatcttgcaggtctgtgagagatcattgagtggttctggaggtggtccaagtacagcctccgcacagcaatttgtaagagctgagatgcttcctagcggctatctagtgcgcccatgcgagggtggtggctccatcgtgcatattgtggaccatctggatcttgaggtgtgatcttcaagttctgcattctttctagttagatgtgctctgcatttgagtcattatttcttttattaatttacttagattctattttacaggcttggagtgttccagaagtgcttcggccactctacgagtcatctagggtagttgctcagaaaatgactactgcagtaagttcctataacatttcctgatctgcttttatcttgacaattcaatgatattctctcttgttacatacatatatatgaagaaatgcccactgtttccttatgattggtcatttcctcaagacctacaattgcatggtgcaatcccaatgttaagtacccactgtttgtagttagattagacggttcatacattgttcagtccccatagtaagtattacaacgcctacacctgagaagtgttgacatatcactaaattctttgtttcctgaaagtctaatagttttggagagttaaggttggggtagtgcttgagcctgtaatgtcaatttcatcatttttttttctagaggctacttagccttattcaaataagtatactgaagtgctttaagttttctttcatatatattctaatcatagcccatctttgcatctttggactactgaaatgatattaattttcttcgtcatataatgattactcttactataaaggcactacggcacatcagacaaattgctcaagagacaagcggggaggttgtatacgctttggggaggcaacctgctgttttgcggacatttagtcagaggttgagtaggtatgtccaggatataaacttctttcgcttctactgtttatattggatgttttttattctaacacgggctgcagg

SEQ ID NO: 54621 - DNA, 4740 bp, Oryza sativa
caatgatgatggttggtctgtcatgggtggggatggcattgaagatgtgatcattgcttgcaatgcaaagaaggttaggaatactagcacttcggccaatgcttttgtaactccaggaggtgttatatgtgctaaggcatccatgctactgcaggtgagtgttaaatataaatttgtttctatcgatgcaggctgcttagttttcagtgcctaagatgtgaattcacttacgttttgttttttattcttaactgtaacatttcaagagcttacttttttttttaatttgcatcctagagtgtcccacctgcagttttggttcgatttttgagggaacatcgttctgaatgggcggattataacttcgatgcatattcagcttcatctctgaagacaagctcatgttcacttcctgggttgcggcctatgagattttctgggagccagatcattatgccacttgctcacacggtggagaatgaggaggtatgctgacagatctttaacatttcataacttgctaggtgctgttccgtgactattttcattattaggttttttttatttatatatagtatctttgaatatgttcttatttatctagtttattgtcatttttccaattgatgatagaggatttctatgtagccttccattgttattattatgtccctttagtagttggtctttgtgctactttccttgtctagtagtgtgggggatccatttgtctgttgttcacaaagtgagctttataaaagtctatatcatttggacaaaaacaactgacaatttgcatttatacaagataagatttatcacttttcatgctactttgttgatgagttttatcaacatacagattttagaagttgtccgtcttgaaggacaagcacttacacatgatgatggtcttatgtctagagatattcacctgcttcaggtaataattctcttctttcggcgctatctggttttcaaaagagcactattaccaatcgcagtaaaaaagagcaaattattctaataattaagtcccgttgcaaggaattcctaatgtacctcccatcttgcctgatctttcagctttgcactggaatagatgagaaatcaatgggatcctgcttccagcttgtctctgcaccaatcgatgagcttttccctgatgatgctccgttaatatcttcaggctttcgtgttataccgctggacatgaaaacagtgagtttttctcatgttagcctttctttttaagtgcattagttctgtgttgtatggataattcttgaaatttttctgttctttttaactcccatgtagtgcataccatttttggtagcttatgggttaaaagccttctaacttctgtaggatggagatccattagacctgaacatcttgtttctaccttgttacttctatctggtttgattttcagcagctaggattttaaccatcaatgtcttccacaggatggtacacctgctggtagaacattagatttggcatctagccttgaagttggttcaactgcacagcccacaggggatgcatctatggatgactgtaatctacgatcagtgctgacaattgcctttcagttcccttatgaaatgcatctccaagacagcgttgcaactatggcccggcaatatgtccgcagtattgtttcctctgttcagagagtatcaatggctatttctccttctcggtctggcttgaatgctgggcagaagataatttcaggcttccctgaagccccaacgctagctcgttggatttgccaaagctaccagtaagtacatgtttatttcctatatatcttatgaatgccttttggtattaatagataggagctgcattattgctctatacggctataccactacctgtccaaaattaaaaatataggactattaccaaatattaacttgtattcaagctgataaggatttgtggtgtttgcaggttccatttgggggtggagttacttaggcaggcagatgatgctggggaagcactattgaaaatgctatgggattacgaagacgctattttgtgctgttctttcaaggtactataatttttcccttgttcttttcataatttccaacttgtacattttatgtcgttacatttaagtgagaataagctttgcctttgtatggctcatatatttggcactatatattctttcaggaaaagcctgtgtttacttttgccaacgagatgggactaaacatgctagaaacatctctcgtcgctctccaagatctctcactggacaagatatttgatgaagccggtaggaaggccctatacaacgagatcccgaaattgatggaacaggtagagagccacttgcaaaatccccattttcttttccccatgtaataacagcaatgtcctaaccgctaaacacaaaccaagtagagatgcaagaactcaccgtagccacagagtaatctttcgatttcgattcaatctgttcttgttcagggttacgtgtacctgcctggtggagtgtgcttgtccgggatggggcgccatgtttctttcgagcaagctgtagcatggaaggtgctcggagaagacaacaatgtgcactgcctcgccttctgcttcgtcaactggtccttcgtgtgacccaaaatccaatccaccatgctcgcagtcatcgtcgttgtcgtcagatctccattttttgcaatctctgtagaagagaggacaccaaaccaaccacaaacctgtcagctgttagctaatgattctactagcttttctagatctttgaaggcaaaatgctgccggtgcctgtaaagagtgtgtgcgtgcgtgtgtaaatttgggcgcgttttgcactaatttgatctggggtaaggaggcgctggctgctgctgtgctgtagtttggtaaaagttgagtacactaaccttggatggtctcgaactgtatgatgaaattcctagcagtaaaatttcaacttggatccgtgaagatgagcatgtttcttctcccgatggctctcgtatctcgttgccgcaatgggggaggtgatgtttgggttggatgtttcgtcgcggggaaggattggatcaccggcgagtcgccgtcggcggccggtggtggtggtggtagactggttgccctgccctaggcgagagcggctcggatccgcctctcgcagcggcggaggcgggcgccggtccgcggctctgtggctgagcagagcagcgccgtggcggcgcggccagcttttggcggcggcggcggcggcgcaaccgccgccatggatggtgtggggtggagagagaggcagcgaaggcccacacgcttttcggcccacggatcggtagccgtgggcccgcaaccgatgtgctcagcccaagtagctgctaggagtaacaaaacctttcaagcacaggaatccatctcccaacaacaatttcatgaggccaggaaaagacgccttagcaggatttacaaattacaatttgagataatccaagaaataccattgacaagtactcaattcaaagaaatgtcatcgacgagtatgagttccatgaaataccatcgtacaagcgacattgtcctaaaaatataatcgccgttagggttcttgaaaacaggttggtttttgaaaaaaaatagaagtggctatacaacattagatagttcttttatagaaaactttcaaatataattgcattgttcttcttgttctttatactagtaacccgcctacccagttaaacctaatccatctacctagccagaccctaatttggagggtgatcacgaacgcatttcgtgaaattcaaatctaaagcagtaaattcgattgaaagtcgatcgaaactggtccaaaattccccagttttcgacatctcgctgaacccggagcctcaggctacgtctacgagaaacgtgttcgtagagaccctttacaacatttaatttcctgttgactgttaatcttaaagctccttcaaacctgagaattttctctagctaagatcctgtttagatttcaacttttttcttcaaacttttaacttttttgtcacatcgaacttacctacacacaaactttcaaattttccatcacatagtttcaatttcttcaaacttctaattttgacgtggaactaaacacaatctaaattccaaagaatccctatgttacaaaagaaagtttgtgatgcacatacatgcctatctcctcctcggatcaggcatctctaccttcaaactacgtgtgcctttgtcactgaaatatgggaccaataaaccatggtcgcacatgtcagtgataaaggtacgatgttttgaaggcagaggatctcaatcccactgtcggtgatatgggcccgggggtatcaggtttagagggaggaggctgccccccgatgccacgtggccctcccccgaggggagtcaggcccgaggtggggtggcggcaactccttccctaaagaatagtcagaagaggttgcccccaatgccacgtggccctcccctgaggggagtcaggcccgaggtagggcggaggccactccttcccaaagactggatggaggaggctgccctccaatgccacgtggccctcctccgaggggggtcgggcccgaggtagggcggcggccactccctggccgagactagagggagaaggccgccccaggcgccacgtggctccccctgaggggggatcgggcccgaggtcgtgcggcggcc

SEQ ID NO: 54622 - DNA, 5205 bp, Oryza sativa
ttaaatggtgactgacaggggcaccccccgtgtcaggcggcaagatttgataggccccatcatcaagacgacgtgtgcttggcttcccaagtcaagagacaagacatgcatttaatgcaaagattataatacttctccaccggagctaggttaggttgttgggcccatgtggtaaccccttgaggtataaaaggagattcaggcctagtggtggaggggggggggacttccgagcaaactggcgcttgggtctcgcaaccccaagcactggtgttctacattcaatcaatcatgcacaggagtagggtattacgcttcatcgcggcctgaacctgtataaatctcttttgtctcatcgtcttggaggggcctaacaccctcaagatcacacagctccgctcatcaagccatcgaatctcacccgctgcccccggccgaactcacaaaggggggcctcacggttccctggtggaggagttcattctccgacatctgacgcgccaggtagggggcgcgttcgtgatctttgaggttctttcgagcgccggcgtagtgagtgtcgcgccgccgctacgggggaaagcgtagcatcctcaggagtgttgcgccaccccaggcagggggcaaggcccctcacatccccaccaggtaagcttggctaccaggtctttgtggcgagtcttcggaatgtccgagggcccccaaagctctagccctacctcaccgagaagtacgacgatggcgccgacccctccgagtccctccagatctgcatggcgatcatagaggcggcggggggtggcgaccgggtcatggtgaacgtcttccccatggccctcaggggccaagcgtggggttggcccatgaacctgctgccgcctcggttcactcctgggagtactcttgcagttttgagctccgggtgccgttgaagcccgggaccccctattctggcttttccgtagcggctagctttggtcccgccggctggctacggtgcccggcccggctcaactaatcgtcctctcatgttttcagtattttcaaattttcaactcatcaacctagtacagcttgaaatcttatatttatttccccccattctattctcatggccctacgacgcccgcgtgttgcgcatttgtttgctccctcggtggtaagagcccaacccctctcccatctacatgaacgattcttcgctaagtgtggggggctaagttttctagccttatcctagccttaagttgagccccgggtgccgtcgacgcccgggaccccctgtactggcttttccatagcggctggctttggtcccgctggctggctacggtacccggcctggctcaactgtggacggggattgctggctctagagttttcagctctcacactcatgcgaaagtaatcgtccatgtagaaggaaaagagattggaaggaggccatcgaaaggaaagagcaaacataatgtgtagcgtggggacacaagctcgtgggaacctgacctcgtttgctaagtggtcacaggcttcccaagatggttcggaacccatggtggggggccctctgcaagcaaggtttgtgtttgcttcattcatacaaacaattctttgctataagtgtgggggctacgattcctagctctgtcctagccctgcgtcgagctctgggtaccgtcgacgcccggggccccctgtgctagctcttccgtagcggctggctttggccccgtcggctggttacgacgctcagcttcgcttgatcgcaggcgaagattgttggctatagaaagttcagtcctcacactcgcgcgaagataatcgtttgcatagaattattattgcttatatttatctctcgcctatctcttcctcgcggtcctgcggtacctatgtgtcgcgcgccggcttgtctcccttggtaacaaaaagtttgtattcgcttcatccattcaaacgattctttgcttaaagtgcgggagctacgattcctagctcattcctagccctgtgtcgagctctgggtaccgtcgacgcccggggccccctgtgctagctcttccgtagcggctggctttggccccgccggctggctacggcgcccagcttagcttgattgcgggtgaagattgctggctatggaaagttcagtcctcacactcgcgaaaataatcgtttgaatagatgaagtagaacatgaacagaggttaacaaatggcaggggcaagcgaggtacgcggcgtaaggtcacgggcccgagagaatctaacaacgtttgctgaatatatatagaaaataagttcacagcctaaggtacgggttagcgagtcgccctcaggctggggcgaaaaaggcgcatgggtcctagtgccagcaaagaaagaataagagatcgggcccacatgtcatttgactaacagagtggcgttaaccctgaccacctaggaaaagttttggtcagggctaacgccgggggctactgtcggtgatatgggtccgggggtatcaggtttagagggaggaggctgccccccgatgccacgtggccctcccccgaggggagtcaggcccgaggtggggtggcggctactccttccccaaagactagtcggaggaggctgccccccaatgccacgtggccctcccccgaggggagtcaggcccgaggtaaggcggcggccactccttcccagagactggatggaggaggctgccctccaatgccacgtggccatcccccgagagaggtcgggcccgaggtagggcggcggccacaccctggccgagactagagggagaaggccgccccaggtgtcacgtggctccccccgaggggggatcgggcccgaggtcgtgcggcggccgccccctcccgtgactacgggtcgggctcccccgaccccttctctaggtcaccacgtacggtgggttaggtatccgcctccagggcccacctacccgcatttatggcgtcccgagcggtcgcgccacgccgcatttaatgcggtgtgcagtgcactcaaccggtctatgaccagtcgaatgactgatgggacccaagatgtcaggcgcaccatcgcgtgtgtcacgcgacgtgcagcccgacatatcccatcaaataatgatgatgaaaggttctcatcctcttatcccagccggagtcggtcctcccgctctggtcaaagtaaggctcccgtttcccggtgtaataggagcccagaagtcttcacccattaaatggtgactgacaggggcaccccccgtgtcaggcggcaagatttgataggccccatcatcaagacgacgtgtgcttggcttcccaagtcaagagacaagacatgcatttaatgcaaagattataatacttctccaccggagctaggttaggttgttgggcccatgtggtaaccccttgaggtataaaaggagatctaggcctagtggtggaggggggggggacttccgagcaaactggcgcttgggtctcgcaaccccaagcactggtgttctacattcaatcaatcatgcacaggagtagggtattacacttcatagcggcctgaacctgtataaatctcttttgtctcatcatcttggaggggcctaaccccttaagatcacacagctccgctcaccaagccctcgaatctcacccgctgcccccggccgaactcacaaaggggggcctcacggttccctggtggaggagttcattctccgacacccacctcctctcgcaggatctcgagccgctgcagcctgcactgcattgcctctggctcatcagcttagctccaacggatcaacgcagcgacatgatattgcagtcgtagagctcagcctagcacagatagcagcagcagcacactgtatgagcactatgcgtgtgcagagagagagagagagacatatggccgcaagtcgcaataaattgtggttttgaaggaggagggtgggagccagcagcagcagcagcagctagcagccattaaattgggcgccctccggttagctggccgtccatgctgccgcatcaattctcctccatcgcattgcacatcgcattgcatgcactcgctagtgtagtagtagtagctgctatagcttcaccccaattattagctccggttggcacggcacagcgagctggaaaacgatgtctcctctcctcctcctccatggcgaattcattgctggttaaatggagcaatggccattggccacctctacatatagtagcaccaggactagtctgttagcatgttactccaatgttaccatctctgttagcacccaaggctgaacacatactatgaacctgaatgaaaaggtccgtccatattcgtagcaccaaggctgcgttcggcaaaaggagttggaaacccactccccaccttttccacacgtacgcttttcaaaacagttaaacggtgcatttttttaaaaaaaattctatacgaaagttgcttaaaaaaataatattgatatattttttaaaaaataactaatacttaattaatcacgtgctaatgaaccgctccgttttcggtgcgggaaagattagtttccatcccttgctaccgaacacagcctaatatatgtctcatctgaatgttgctatattttaaaacagaggtagcagacgtgttcaaagttatactgctgctgctcctgccaatctcgttgcaaaaccctaaccgaggtagcgaccaatcgaggcactttaatagaaaaaagttaatgcgtgcatagagggggaggaagggggtggagtgattgacatgtagggcatccagccatgttaaaatcatttatttacggaaaaaatatgaattaccctcctaaactatcgtggtcggccgaattaccctctaaacccgaaaaccagacatcgtttaccctgaactttcaacaccggataaattatccccctcgacccaatccagagcagttttgttctacatggcgtacacgtggcaatccagtcagccttttctttttttttggtgggtccacctgtcatatatactctatcacatgtctctctcttgccccctctctctctcgggccgtcgggagtaggtcaagctgtggcgggtggtcggcgcgcacacgccacgcggggagcgggtggtgagcggcgagggcggcgggacgtggagcaaggcggcgacacgccggcactgcggtgtccgcccccctccc

SEQ ID NO: 54623 - DNA, 4271 bp, Oryza sativa
tccgccggccacccgagcgacctccgcctccgccgccgcagccagcccccgagcaagttctgcctacccccaccctcacccgcttgccaccattctcggtgccgtccgcgcggcctccgcccccgcccgccactgtctcccaaccccgtctcctgtcgagctccaccgacgagcgcgacaggggaggcggggctcgctcaggcggcggatggcgccgcgacggtggggaaggaggatcccgctgccatcgctgctgccacctcgctccacgtcttgccactgttcgtcggacggagccacctagccatacccaccgccgcttgctcgctcgcccaccacagagagaaagaggataaggtgatttatatgacatgtgggccctatattttttattttttttactgattggattttcacgtcggcgtcgcacgtatgccacgtaagattaaaaccactttggaagtgctcaggggggtaatttgtccggtatgaatacttgaaggtgtaaaatgtctggtttcgtggttcagggggaggggggggggtaattcgatcgagcgtgatagttcgaggggtaccagccaatttcacgtcgaggggcggaaatctaacaatttgaaaaatcattaaccggttcagttggtgagggactcagggctaggttttaggctttagcaagtctacccggctatgatttatgtggcatcaaaactttgttggaaagctttgagtagctatagcttctttcaaataaaactcttcacatagtctatattctcatgcatatcctataaatctgtagctatataattcagaaaataaattgaagtcaggagctagaaaaccaagatttttcggattcccgtataaaccgctcgtcagaatttaaacgcaggctataaaactcttgccgagagatgcacttaataattcagaggcagatgatgtgtagtttcaaccacgatgtcccgtgttcaatcctcagcacgctcacaatttcttcttaaaaaaatttgagtgaaatatatggccggtccttaaacttgtgaggtggtgtcacataggtccataaacttaaaaattgcatatttaaatccgtgaatttggtttaatgtaccacccccgtttaatcgtcctttgaccacgtttgaccgccaatgtagcatgccacgtaggcaacacttttatgctcagcccccttcacatatatcttcgcacataacttgccctgaccaatgcatttcaacccaaatccccaaaaatatccctaaatcgtctagggtttcgacggtgaggttagcggagggagaccaaaagacagtggttgtggcggtcttgcagtgacattagcggcaggaggcagcgcagtacagggtacagcaggattagcggtggcacactgcggccagatttgtgatgggaggcagcgcaatgcggcttgcacggtaggcatccccatggattctacaagctcaccctcgtcttgaagggccggaagaatgtgttgttgatcaagtgcccgttgtgtaaggatgtaaggataagtttattttggagtgtggagcaatagcaattgctaatcggaaccgcattttctatacatgcaaggagaagaatgagaggggagaacgatttgatttttttttttttggattttggtgttactatatatagctataagaagatatatgcgatgtgttgtgatgtggaggggactgagagcaaaagtgttgcctacgtggcatgcggtcaaacgcagtcaaaggatgtttggaccggggtggtacattaaaccaagttcatggatctaaacatgcagttttcaagttcacggatctaagtgacaccaccacacaagtttagggaccggccatgtattttacgcaaaaaaagttatttaaagagacgtctttcccaccaaatctcgttttataaatctcttgccggtgaaatatgtgcgttgagtgttccggaccagaacgttgctagagcgacataatttttggccatctcacaccacagtaccaccactactgctggggttaatctctcccctgcaccgttgtggtttgtctgttttctcgtacaagcagtcaagcagatgcaggcagcacgcatgcattggcattggccgccctatacggcagcaccggcggttgggtcagcacactgtagccgggtcaaaacccccagtaagccacgccaccaacgcctgtatccccagctgctgctgctgcgccacatgctctccatgcattgcaaaaccccaaaccccagctgctgctgcaatcctgcaacggcaacttcctctgctcctttctgcagaggagaggagaggagatccatcgcttcatcagcaagtgagcaaatgattatgggtctttgttttgttttcttgccgttgattagtagctgtttaatttagtacttacggggtttggattggagctcaagcagcaagtaccagctcacaggtaggtaggtttgtggtcaccaagccagaacagacagacacttgattactttgagctaacccctccctctccccagccctgttgacaggcaaatgatgtgatgtttttttaaggtaagacaatgatgtgatgttaatcgcggaactgaagcaaccgtaagccacaaccagcggtcccaaattcgctcatggccaagaagggtcagggaccagctgccagtaccatgcagcaatttctaacatctcacacactcattccgaaaggacaaaaattagtgagaaaagatagttacttctacagctctactatcaccaacttctaaacatcagcatggcaaagcaggagtataatagtaataagaggattaggagaatgactaggagaaattttaggaggtaaaactgccgccacataatttccttccctagaggcaacaacaatatccacctcatcattgggggtaaaagcagaccaccaactgcatatccagggaagtataaccaaccatccatctccaaacaacgggcaaaccgcctaccactgcatgtatgtcttgtccatttttttccctctcttctgaacaaaaaaaaaagctaggtgtcccctacgagaaatgcagcttgcccagcgcccctaatccgaaccaaaggcaaacaaaactaaaacagaaaagggatgtgcataggaggaggcagctaattacaaaatctgacagaagatgacgccccattcgttcgttgacgctttctgaaattatttgagctcgagatgcctgatgatgtcctccacttcttcagcatccaccgggagatgatcatccttggcgtcagcgttgtcggcgttggcggtcttcaactgggttttcggaagagagtccggcgatgtatcagccttgcattgcaccacagaagaaccagcaacaggttgtgaagcttccttgacttcagctggagcctcaaccttaaccggaggcctaatcgctggcaatggaaccacccccttaccgattgacactggttcgttccgaggctggagttgtacatccttaatctgaacagggatcgcaggtgacagcgcttccttcggtggctgggattgtacatcctttatctgaacagggatcacaggtgaaagggatcccttaagaagctggttttgtgcatccttcacctgaacaggcatcacaggtgaccgggtttcctttatttgttggtgttgcacatcctttatctgaacaggcatcataggtttcggcccttggactgctgaaggagtaaaaagaggaggagctggcctgatgcgaaccggggaagccattcgaattggcggcgggtggctcatgagaggaggaagctgttgtgtccgcgcacctgggggtgggagaggtggagcagagaaaacagggatagaagtcctgactgtgactggaggagccatgctatggcaaggcatacggaagtgcccaactgggacataaggagccgcctctgcagcggggaaccttgaccttggatttggactttcagttggccggaaaggagtctgtgatgctgcatcagacgctgctggcgactctggccttgaccttgaattagacttggggcgaaatagagggagaatcttcgagtagctggagtgagaggattgaggaaatgctgtcctcctctcgggctgcatcggaaatttctttgggaagggtgaagcatgtggattattggccatcgccatcttctccttcaggcgatagttgagaagagctcgagcaatcctgatctgctcctgctcatcattgctctc

SEQ ID NO: 54624 - DNA, 24834 bp, Oryza sativa
  unsure (1)..(24834): unsure at all n locations
aaccccgactaacaaaatttgtgtgtgccaaaattgtggcattaacggaaggcaaacaaaaacattcctaccatgataaagtggctttaaacatgaactttcttgcagtcatttagtgttaccttaatgtggttgcaacttacatgtccggaggaatgaataaaggttttgtgtgatcctaagtgtacgtaacatggtgagaaatgtggtgttaacaagcaaccttgatctaattattgttcatactaaatcaacattactttagagttgcttgtcttttcccaagataagatccaaagttgtcatataattcctcctgctctaatcaaattgtctaatatggatattacagtctatggagcatggaccagtacatgtcaacaacaaattatcatctaatcaggtattcttccacacaaactaaaacaaacattatgaccgctagataagttcaagcgcacaacaaacaagtgcacctagctagataagttcaagcaaatcatttatattctgaaggacctaaaccaaaacaatcacttctaaagccacaatgagcatttctaacatactgcaaaatcttccacacttttttgtcaaacatgattattgcaggaaaaaattgaactagaaatggcaacactgtttgtttaaccaatggtacagtggaacgaactatgaaaggaactggtgacagtcacactcacattgtctcagagaagaccaagctgctgaagcagcatttttttcagcttgtttcttgttcttagcaggatcacctgtaaatgtaatcccagctagctctactgtgcatgtgaaaaccggaaggtggccaagcccagatcgctctgttgtatacgaaggcaatggtgctccaaccctctgtgctacttcctggagaaggttcttgtaaacccctgtttcgtcctgtttaagagaaacatatcacagtatgtattaactgactggaaaatttacagtacaaaccaaggaatgaaacttgtgggtgccagatcatattgcaaggtaacataaatcatagaaaatgtaaaaggttaacagacagcttggcaaaatagttcatgacaggagtacaatgatgtccatgttagctagttaaacttccattaatactcagtcttgattgaaacagaagtaaccaaataaaaaaaaagaagaaaaggcaccagaatcctaaggaagattgacttctggattaaggtattgctgaacagaacaatacttcaaatgtaaggataatgatttaaaagaggttaaatatggggggtgttagttgagcagtctgtgaactgatcaggtgataataaaggggcaatgaataagaaggaacatctatcaaactaacagaaacatacaagtcaactccaagttagctaggtaatttaaggataaaatgaaccaagcttttttcatgtatattagttaataaaaattgatacagagtgcaaccatcagcacttaaaagactgtattgagttgaccgcaagttcaattagattaatgaatcagatgatacttttttagcattgagtagcatatatgtaaataaattttcaagacacaaaaaagaaatgctatcatattcatggcagcagtactggagtataagtgtaagaacaatagttccatgtatagtcagctagtgagtttactatatcacttaattacttacaaggccattgttgacttagtcaattgatatggtaacttcttctgtagttaaatatttcttttagagataatgactgattttgaaaaaaaaaaagacagatcgtctagcaaatggtcaaatcagtttctgtcagtcaaaaccctcagtactagtcaactatgaggagctttgaacacgcctaacatttgaccagttcttgttcaaaatcactgtgacaactagcaagcttttctatttttgcaaaattttagttattcatattaaacgccaactgacagccgaagtttttttttacaatggcaataaacagtatgacctttacaaacaagaaaatctgataccaaatcacccccatttcaacaaaacgatctccatgcagaccaacacacatcggtggcggtcgcaccaaaaggcccagcctaaaaaggcaagaaccaaagcgacgcccccgcaccatcaccaccaccaccaacagcgacacgcaccaaatcctcccacggataatttccaagtccccttaaagccaggacagggagaagcaaacaccgcactagctagggctgaggcggcagcagacctcaccacattcccccaatggcagcagcaccaccatggcaccatccaaccatgaatccatgatccatcatccatggtggcaatggttgcaatgcactacaacacctcccgccatccatggtgggctgtgtgggggcctgcccgccactaaatttcccccgggcccactgccattgacctgcgatgccgggttaggtgcgggcggtctccaattcaattccccccctcacccactcccacgccctcgccattaataccaccactataaagacctaaacctaatctctactcctccctcctccatctcctttcacactaatctccccccctacgcgctcgctaatcccactaccaccctcaagtcaatcaacaatcgcgtattctcctcctcctcctactagtagtggactagtggtagtggtcgcatacgtgttctcatggaaggctagcctttcactaccaaatgagtcaagttcatacggccagtttttaattgccccctcattaatgcgccattatacgtaatcagggtttagcggttaatggcacggagactttcgtgattagtactcgtactaccgatttccacacccgcggtaattaattaacggcgtgaaaagggaaagaaaaaaaaagaacggaaccctaacggtaattccgaggcgcggggtgttgctcctgcttcttttattaccgctgcgaaagcggcaattaatgcggggtgttaaattcaagtaccgtcgccgttacgtcgcgagagagagagagagagagaggagccccatttaacgagaaattaaaaacggagggggattaatggccggcgcggagtacgagctgattaagaggcttaattgcgcttagtacaccgtgttagtgtgggaagtaagctgtggtgttcattaaattaactccgtgtcaaggtaaacaaattacggtgtcaggctgtagtcgtactaaaaataaaatatggtggatatttgtttattttaaaataacgaactgattaaaaattgaacgaactagtactactcgtacagtggctttttccatcgctcggaatcgaaggaatccccaccttttgagagaggaggagaaaagtttgcggaattttttgaacgcgaaaaagatttgccactttttctctctcgctgattacttgctcccagttcatgccgctgacgagagagaattcaacggaaacagattccctcgaagctaggaccgacgaacacagaacaagtgaacaactcgggtggtttcgttgagaaaaccttcgaatccgatcgaaagtagagaaaacaaaacggaaggaaaaagcgttttcgagccagatttctcccgtgttcgccaacattttgctaaaaaaaaacatcataaaatgtcccaaaccctcgcggcatgaacacccaatcacctaggcacggatatagctcacgacaattccacgacgaatcgtggcagcaacaacggtagcagcgatgattcgagacgatcaaacgagtaagaaccctaccagatcccccaaattccgccatgagcagcaaccacaacaagaggggaaaaacgcggcgaggaaaggagttgacgaggagagaggcggtcaaacagaggggaggagggcgtgggcgtaccaggatgcgggcggcgagggagtaggaagggccgcggcgggcgagggcggcgagggcgacctccgcggcggcgtgctcggcctggcggagcgtggtgaagaacccggggctctcgaactgctcgccgttgaagttgaccgccgccttgaaccgcggcgcgtggtccggcccctcccgcaggcaggtgtacgccggcaggttgaagcagctccgctgcgcgagctcctggagctggttcttatacatcgccgccgccgccgcagccgaggccggccgccgcacctacccaaccgccgccgccaccgccaccgcaagccgctcttcgccccgggacccccaccgctgcttctaatgccggccgccgtggccggagaaggaggaggaggtggaggctgcgctgccgcgagagatctaccgaaggaggaggaggaggaggaggggggaagtgtggagtgaaaggagatggaggggagccggtttatatttttctttttcttttggatttatttttcgaggatgtttaatgcgggtgcctgcggttactagtttggctggcaggggtgaggatgacagctgggcccgcatacactcttttatttttatttttttttaccatttgtcaaatttaaaaggatttgctggtttaaatttgaaaggatcggctgatttatcattctattctatggtttgtaatggctttgtcttaaaaaaaaagttcgacttcaacgtgatttttgtggtacaaaaaataattttcctctcattcttggcttccaaataataattatcgaaaaagtgaatgtatttcagtatatgtgagtactaaaaaaatacacaaaatgaataacacacgtaatcatatcttgtgccgatttaatgtactagaataaatatttcagtgctcctatttctagccgttgttaattctagctgttgtccatgtgtttttaaccgttgtcaattctagtcgttgcctaagtttaatgcgccatgtggaacatcaagttttatttctcttaaaatgagtttgatattctagctattgttgatgtttaacgtgacaggtggaacaccaagtgataagcatattttggagatataatcgtttaatgtgctgaggaatacgttttgaaatgattggatatatattttctactgattaccatccttattcggtgttcgttcccattttacacattacaatcgttaaatagggaaaaatatcaccttatttagcattatccatctatttttgagaggatactctgatgcgagagatctaccgaaggcggaagttgagaggagggggattttggagtggaaggagatggagggggagacaattttgtttcttttggatttatttttggagaatatttaatgttgatgctttgcggttactagctaggatggcagtgggaggatgatatgttttaaaaggatttaaaattgaagaaaatcacttattatcattttatcccatggttatgaacttatgatggctctctattaaaaggagttcgatttgaatattgttttttctgtgatattgaagcgctctctctctctcttaaaaaatagattgatttaaacgttggttgttgtactattttttttaattttatcctacgattatgatggctccttttttttatttgaagcgttggctcttgtgatgttgaattctatttgttctcatttttagttttaagtacatacctttactgatattgaattgcctccaaacaatgggtgctagatgagcggttgcattccagaagacaccaatagtaacacatatggtctgaaaatctgttattggaatgacacgcatcatcacaactgtcctgattaaatgtacaagattaaatatttcttgttgctatttctagctgttgccagtgtttaacgtgccaagtgcaatattaagtgataagcatatcttttagatatggtcatttaatgtgctaacgaatatgttttgagaagattgaattctaaactaattgtcattgtcatttagaactattcctattttacaaataaaaatggtttaataaggaaagtatcactttatggagcacacatccatctatattttctttgttatttatatgttgggatataagaaggctatttgagaggagcgggagtgaagtgtggagaggaatgtgatttagttttgttttttactcattttgtggaaggagttaaatgatggtgacgatgattataaggtggtctccctatggaaggatgataactgggagctggaaaaatgccacacttttattcgtcatcaaatagtaaggaaaatgtgaagcccacttttttgtccatgataaacattctcccgataaaaaaagtttgatttgaacattgatttctaatattgaattcctttctctcctttttggttttagataattgcttagcatcagattattcccaaaataattacagatgctagaggttgctacaagagaactatcaaaagagaatgtggaggacgaggaggcagtgaagtgtggagtggaaggagatagagggggaggcgatttattattatttttgttatggatctagttttggaggaagtttaatgctggtgcccccacggttactagtttgctttaggtaattgtatttgctcatattgaattgcttccaaacaacaattgtgtgattgcatttcaatatacaagaatagtaacaaattatctcaaaatgtaccaactgttcaatgacatgcaacaccacatattgtcctgatttaatgtaataaaatattttttccatgatcccatttgtaaccgttgtcaattttagctattgctagtgtttaacgtatcaactggaacaaagtgatatctctcttaaaatgaatttgatttgaatgtgattcttgtggtattgattttttttctctcattctttgctttaggtgattgtatttgctcatatgaaattgcttccaaacaacaattgccatgcaagtgatcgcatttcagtatacatgaatagtatcacattctctaaaatgtaccaaccgaatgacacgcaccaccacatcttttcccgatttaatgtactaaaataaatatttccatgctcccatttctagcccttctcaattctagccgttgttaggtggaacaccaagtaataaacatattttggggatttagttgtttaatgtgctaaggaatacgtttcgagttgattggatatatgtttaatattgattaccctattaggaattgttatattttatattgattacaatggttaaatagggaaaaagatcaccctattgagcaacatccatctagttttgagaggctatttgacgggaataatcccctcgccggagaaggttgctctactacgagagatctaccgaggaggaggagagggggatggtagtttgaagtgtggagtgtaaggagatggagggggagacgattgttttcttttggattcatttttagaggaagtttaatgatggtgctctcggttactagttgggttggtaatgggaggatgatagctaggcccgcatacatgccttttgtttactattcatcaaaattaaaaagattaaatattcgccccggaccctccccctccccccccactgctgcttctaatgccgaccgccgtggacggaggaggaggctgcgctgctgcgagagatctataaggggagaaggagggggtgaagcgtggagtggaaagagatggaggggagccggttcatatttcctttttttctttcggatttatttttcgagcataattaatgcgggtgcctgcggttactagtttggctggtagggtgaggatgacagctgggcccgtatacactattttatttatttattttaccattcgtcaaatttaaaaggatttgctggttgaaatttgaaatgattggatgatttatcattatatcctttggtttgtaatggcattgtcttaaaaaaaagagttcgacttcaacgtgatttttgcggtacaaaaaataattttcctcccattcttggcttccagataataattgtcgaaaaagtgaatgtatttcattatatgtgagtactaaaaaatacaccaaatgagtagcacacgtaatcatatcttgtgccaatttaatgtactataataaatatttcagtgctcctatttctaaccgttgtcaattctagctattgcctatgtttgacgtgtcatgtggaacatcaagttatatttctcttttattaaaaatagtttgatttgattgtgactttttaggtattgattttttttctatcgctcttggcttcaggtaataatatttgctcatattgaattgctttcaaatgacaattgcctctcatgcatttaagtatacgcgaatggtaacgcaatctctaaaaatataccaattgagtgacacgcatcaccacatcttctcccatttaatgtactagaataaatatttgtgtgcttctatttctagccgttgctaatatttgacgtgccaggtggaacaccaagcgatatctcttctaaaaagaatttgatttgaagatgattcttgtgatattgaatttcttcctttaactcttggctttaggtgtttgtgttagctcatagggaatgcttccaaacaacaattgctagataagtgattgcatttctatagacgcgaatagtaacacattctctaaaaatgtaccaaacacattttaccacatcttgtctcaactttatatacttaaataaatatttttgtgctcccatttctagttgttgtcaattctagccattgccaatgtttaacgtgataggtggaacaccaagtgataagcatattttggagatatagccgtttaatgggctaaggaatacattttgaaatgattggatatatgttttctactaattagcattcttattccgtattgttctcattttacacattacaattgttaaataggaaaaaaatatcaccttacttagcatcatccatctatatttgagaggttgctttgatgcgagagatctcctagaggaggaggaagttggggggagggggattttggagtggaaggagatggagggagtgggggggattttgtttcttttggatgtatttttggagaatgtttaatgctagtgatttgcggttactagctagcatggcagtgagaggatgatagctaggtccgcacacacgtctttgtttattgttcatcaaattttaaaggatttaaaactaaaaaatcactaattatcattttatcccatggttacgatggctctctattaaaaagagatcgatttgaatatcgttttttttttgtgatattgaagctctctctctctctctctcttaaaaagagtttgatttgaacgttggttgttgtaatattttttttattttatccttcgcttatgatgactcctttttcgatttgaaacattggctcctgtgacgttgaattgtatttcctctcatttttagttttaagtatgtacctttactaatattgaattgcttccaaacaatggatgctagatgagcggttgcattccagtagtaacacatgctctgaaaatatgctattcggagtgacatgcatcatcacacttgtcccgattaaatgtacatgattaaatatttattgttgccatttctagctattgtcagtgcttaacgtgccaagtggaatattaagcgataagcatatctttaagatatggtcgtttaatgtgctaacgaatatgttttgagaagattgaatatatttctaaactaattgtcattgttatttagaactattcctattttacaaataataatggtttaataaggaaaatatcactttatggagcacacatccatctatattttctttattatttatatgttgggatataaggaggctatttgagaggtctagcggaggagtgatgtgtggagagaaggtgattttgttttgttttgttttaggattcttgttgtggaaggagttaaatgatggtgaccacaattataagatgggttgcctatggaaggatgaaaactgagagctagaaacatgccacacttttctttccaatcaaatagtagggaaaatgtgaagcccaccttttgtccatgacaaccgttttcctgataaaaacgttgatttgaacattgatttctgagattgaatttcttcctttcctttttggttttaaataagttcttagcattagattatttccaaaataataacaaatgctacatgatgttataagagatctactagaagagaatgacgaggacaaggaggggtcaagagtagagtgggaaggcatggaagggggacgatttatatttatttgttttggaattatttttggacgagcagaaagaaagagaaaaaaagggttacaaatttatagatagttgtaacacaggctccaacaagttgtgtatggctacgacacgactgcatgagcttttaacaagtcatatatgagagaggggtgggtcaggtattaatcgtatagtatatatatccatagttaactgttgtataggtttgctagattaattacaaataatgtgtcaatttctataactagcggttgactattgaacttgctcttacagtaatttattgttaatactagcagtaaaccttaaaactcaagaaaaagacgtacagtacactttctacacttactcgtagaatggatgcccgcactccaagagaaatttatgatattgttcgtattagtttgatgttgttcatataacgccaaatctgattttgcacgatagatttaactaagtagcacatatttcgaatgatttaatcttaacatacacgcacccttctatttctcttttaataacaaccaccgaggaaatttctcttaaaaaaaacaaccaccgagatactacggatttaatatcaccacgtcattgtactaggataaaattgtgggatgcggaaaaatcgttcctctcgtgtactaagtttttacgtaggcatcaccacaagtcaaaatcactcgtatgaaatgggtaatgtctaactttaatttttgtagtattagaggtgggactctcatacaaaattcggagaattgaactttcaaataacttgtgttggagctggagaatccgaacactgcccgtccctcccgcccctgacactcgcagcgtcatatatacatcgtacaagcagacaccacccccatggtgtcaccaagctgactccagcaacagttgcggcatatgccgtctagctaaaaagctttggcagtgaaccaacacagtccacagagcccagccaccggccgtccatttcgaagcaggccagataatcaacggctgatccagaccggccgcgcgcggctctcgtctccccggcacgcgccgctgcattccccgcgcgcgacggcgagcatttccaccggtcgccgcacgcgcgccgtcatggtcgtcgtcgtcgtcgacaacgggtgcattctaaagagctaaggtggtattcttttctcctgaaaataaagatgtagttttttacacaaaacgatgtggtattaacgtatgattgattgagttttaattattacaaacttgaaaaatagattaatatgatattttagagcaactttcatatagaaagttttcgcacgaaacacaccattcagcattttgaaaagcgtgccacgaaaatcttaatcttcatccaactcttcttggagaaaagaacaataccttagttgtttctttttttattaccacgtatgaaaattttctaaatagaaaatggtctataaattaaatagatatgataattatgtttctctaattagctaaaactatatccctaaaatattgtgcccgaaacacatcttttccttcgtatgcgtgctagtactaccatatatgaacgctgctatacgtcgacgcaggcgtccgaccaatgtacgacttgtgatagatcacaaactaaaaaaaatcatctcgcgtatatgtcgtcgttgtggtcgtacaagagtcgtacatcacactcatatgtatagcattttaactatgtattctgtataaatcttgttaattgacaagtactatctctggtttaggttataagactttctagcattgcgtacattcatatatatgttaataaatctagacatatatatgtgtctaatttattaatatatatataaatatggataatgctagaaagttttataatctgaaatagaggtagtagtatattaatctggatataggctaccgattaatgtataaaagttaacttttttataaacaaagaaaagtgctacgttatgaatggatagtacgtatacgacgggtacgccatgatcgatgggtagtagtagtatttgtgtgtgtgtgtgttgactaccagaatcgatgtatacgtatgtactagtatgacgtgcgactggaaaagtatcgtggagactagcaacagggcacacagctagccatacgtgcaggcccagtttgtggttcgagttcttggctgccttcagctggtgatgtctctgtcaggctgtgtaaaatgtgtgcgattgacagcagggtttacgattccgacatgcccacattagcgaaattcggaatttcacgaaatccggtgaaaaactgataaattccgaataaatttcataaactaaaatttgaatacaaattccctgagtttgccgataagttctcgaaaaccggtcggttttggcgaaattccgatcgaaatcatcgaaatttcgatcagtaatttgtaatagaggtaatttgctgaaattatttcctttcctgatgtaagtttcagtaaatacacacaatgcatcatttttttcgaaaatttatatccagtaggttctatgaatatcaaagtatttataagattttatttgattttttttctttttttatcaattcaaatttgaatttggatgaaactcctcgaaatctcaaacggtttctacttccgagcctcgtcgaaacatcgaaatttcgcgaaatccgaccggatttcgtcggaatcgtaaaccctgattgacagttcaaagttcaaatctgctttgatccatgctactagcttctccactcctccttaggccatgtacaacacgtgaccctggcctgtggtctcagaactccacgtcggagccgagccaagctggcacgagtttggatggtctcgcaggctatcagtgagcttgcagaggaaccggcgcaagcgctgcgcctggactcgggagccacgaagccacaagccgaagcctcgtgttggaggagtcggcgccccgcgcgttgcctcattccgtcctcctatgccgtggtcgtcgtcgcctcgctagatctgccgcagctgccgtggtcgtcgtcgctgcttcccgccgccgccagatctgccgccgccgcttccccgtcgtcgctgcttcccgccagcggatccggtgagcccgctgccgccaagctcgccacgccgtcagcgagcttgtacgtgccatcgtgggtggagcaggacggcggcgtcgaggaaccgccgcagccagatccggcgagcccgcgcccggatccggcgagcgcgccgtcgtggggggaggaggacggcggcgtcaagccatctgccctcaccgctgctccccatcgccgtcagatccgccgccgccgccaccgctgctccccgccttcgctagatccgccgccgccagagctcaagcggcgccgatctgccgccgaaggcagagggaaaagagagagcggcgaggggaggggagaggagtagagcgtcggtggagaaatcgaagagagagagaggggaataaaaaagagagggggatgggaagaggctgacagtgggtcccaagttgtttaggggtatacatatatttattttggttactatagggttcaaaatataaagtttcaataggtttgataatacaagggctgacatataaatagataggggctgacatgcaaaatacgttttggagtggcttccactgtgggtagtgtgacctttgtgtggttctatcctacgtggcgtcttgagaccacagttacttatggctaccattgtacatgcccttacgtagtcccccgtcttagaaaaaaccaacttaggctgcgttcctataaaggaaatgggaaccaatctccggcgcataaaaaacggagaggtccattagcgcgtgattaattaagtattagcttttttttcaaaaatggatcaatatgatttttttaaaataaatttcgtatataaactttttgcaaaaaacacaccgtttagcaatttgaaaagcgtgtgcgtggaaaacgagggagaggagttgggaatatgtggtgctgaacacaccctaaccactggctctaaatcatctatagtcaacttaataactaattcatacaatagttacatgtaaacatatattatataattaatatctggtcccacctatcatacacacatgcaccttgtagtctgtggtgcagctgctgtagcccgctgcccttctcgctcattttttatgttcttaaaatatatttatagctggcttatagtctgctattctacctgctctaagggacacgagggagaggaggtgagaatgtgacttcacttattaggacaatcaattcgtacgactatttatccaaattcgttattctagatagagtcatattccaaccttaattgatttttttttgattgagggagtccgccgggtcgccggccaatgccagcgaagaactcgattcccccacctgctgtccgttcataatcgatcaaaccgtgctccggcttttaattacagtcgatgagattttaattccgtttcaaatgtggtgcagacacttccatatgattttcgctgcgatttctaaggcaggaatcactttaccaagagaaactagaaaaaaaaaacccaaagaagtaattaattgttgtttaattaccagaaaacttactcggtcaaaactagtgaaaggttcagctaaacccactcatgcttcttttgaccagaccttggagataccgagcttagtagactaattaggttaaaaccatattaccctacatctttttattagcaaaatgttatgcaatatgtttgtatgatgttggattcgtgggccatacagcgtggttttaaatcctagtgcgtattgtgcataaacatgcatgtgtgtatccctatttgatgcagagaccgaaagtaattttttcattacctaagaatatgtggtaaaatcaatgaatgtgtttcattgcaggtctggaccaaatcgtagtcctggattacagtcacagaggaaacagaggtacagtggaagtgcatgtgtgctacagcgaggctcaattgctcaagtatggccagatgccatcgcccaatgggcttttggcccaacacatcgtatgcattttcaagcccaaaaatggacgcgtgctgcctcgctgcttgggcccaaatggtcttaggaccagataaaggaaaaagtgcacccaaggtccctcaacttatcatcgagatacaaaatcgtcccccaatcgcaaaaccagataccagacgtccctcaactagcaaaaccgttcgctttagatccctcggtggttttgaccccggttttgtctgacgtggcggccgagtcagcgtgggacccacgtggggccccacatgtcagactatccatgtcagcctcctctcccttccttctctcttcctctctcctacacacaccgagacgagtcgtcggctctgtcgacggcggcggcggtagcgtgtccgcgcgtcggcggcggcggcggtagcgcgtctgcccaggagcggctccgtcggcagcgacgactgttgcgcgtcagcagcagcggcggtagcgcgtccgcgcgtttgccctggagcggcttcgtcggcggcgaaggcggatgtagcgcgtcggtgcgtcttcgtcgtcgtcgccgccgccgccatcggcgacaacctcctggagccggcaccgtcgtcgcgggcaccatcgaagaagcggcaggagcggatgaggacggcggcggcgaaaaatcccacatgcgaagtaattaagatcgatcgacagccacatatttacaacagccaccacgcacatcatctcttcatcatgcatatatatacgcacgcatgcgaagtaactaagatcgattgatcgatcgaattaacaaggacaatggagaccaccggcggaggaggatctcccaaggaggcggtggtgccgtccgctgcctccggcgacaccacactcggccgccacttggcgcaccgcctcgtgcaggtgggcgtcagcaacgtcttcgccatgcccggggacttgaacctcacgcttctcgaccacctcatcgccgagcccggcctccacatcgtcggctgctgcaacgagctcaacgccggctacgccgccgacggctatgcgtgggcccgtggcgtgggcgcctgcaccgtcaccttcaccgtccgtggccagctgctgcacggccgccgtcgccgcagccatcggttctggaatcaggtgacgggcgacgaagccggcgccgccttcaggaatcaggagtgcgcgggcgcggctccgtcgttgccgtcggcggtagctcgtcggagcggctccgtcgttgtcgacggcggtagcgcgtctccatcatcgccgccgtcgccatcatcggagacgacagcctcctgggaccggcacggttgaagcgcgtgggcgtgagctcgaggccgcgttcttcttttccgggagccaccatcgcgctcctcccccgccgggcctaccgtgtccactgcatcggtgacgcactccccttctcccgcgtcatcgccgccgagcgacggctcgcttgctccgtcggacaagaggaaaaaaagtgagagagacgaggaagggagatgaaggggaagagagaggaggctggcatggatagtctgacatgtggggcccacgtgggtcccacgctaactcaaccgtcacgtcaaataaaaccggggtcaaaaccaccgagggacctaaagcgaacgattttactagttgagggacttccgatacctggttttgtgactgggggacgattttgtatctcgatgacaagatgagggaccttgggtgcactttttccccagataaaaccttgcatctacatgaggagctctaaaagcacggcccatgggctaactgaacatatggcaaattgatccatgcaaccaatatgaatgtttgggtgtccttgataatattttccaacttcttttcttgtttgtgcgaaactgtcttcaactttcttctcatcttgaaacaagttaattttgacaactttcttcaatgcatgtctggtgccctaaaaatatattttggaagaatgcggtgggactgcagccgtgtgttctgaacctgtagcactaacaaacctcaattttaagcaggttaaattgaactcttcactctctttctcgggccaaaactacacatattgggggtgctgaatgagacgacggcctcacaagttcatgggtcttccgattcacaagttgatagtgagtaccagtggagaccgaagaacggaaagtctatagaatgaatcaaacaaaaacatcaaaattggccggtacgaagtacttcattggtactacagctctacagcttagctagtactatctgtactactaccactaccatgatgacgagtactcgaaaagatcagaaaccattgcaataatttctttttgcgtcacaagattgaataaaaaatcttaccacactcagcgaccatcgttaaaaaaaagattaaaagaaaagagagatccttttcgtatcgttgcagacgacagatttgtggtcgtttctcctttgcgacccgaaagctagctgtgatcctgaggcatctgatcgggcaaaacggatcgaaatctccgagcacaacagaagcgtgacaacgaccgacggtgcaaaaatttgggaccgggaataaaggtctttcgagttagtacaaggctagtaggaggagtactacccatcattatctttttttttttaaatggaccgcacaagacagtgcgagtttcatgtattgataaagtaggagaaaaatacaagtctatagtcctgaaaaacatagttagagaaaaaaaacagcaacactgcacgtctataacaacatctgctgcgagagcaaaaacaagaactagcgatattcgacacgacgttttcaggaagggaacaacgtcgagagcgctgctgccggctgccccgaggagccaggacatggttgcctcgtcaccgtaacgtttactatttgagtgctctctccatttttaaatacacgacagtatcgttgtatgttccattagtcgtgtttaagaatgacttatactttcatatttacaattgttaaataagacggataattttgaaacatcacactattataagccaaacttaaagtgtcataagtcatgaaacaaagtcacagtaaaataaataatacttgcatgctactttaatgaacaaatagctgaatacatgttcaaaagtcaataacaccgcgtacctaagaaacagagagtatgttactacttcctgcggtcacaattattattgttggtatcgtatatactactagtaaaaatgtcgaactacatgtccaccacataagttcttcgccaagtgaaacgttttggttttctacttctcttatccccttgatgctgatgtattactagacatgtactacatccatcccaacggaggtacttagtgtctgtttagagagcttatagcagcaacagcttcttataaaatctccagctggcagaaactcctataaacaattcagattttcacttagattctgagaaatgctatcgtaaaatcccgctactatgaattttccccagttgtttctccgaataatattaagctcccagagccatagtagcgttccgcggctcaccagatttcaacatcacgttaccctttgtacaagcgtcggcggcaacaaaccacgcacggacgcacccaccgaccgaccgaccacgccgcccgcgcgcgcgcccatcgatcggcgcgcggcggccaaagatcgaacgtgacgaaaccgggtcgtcgcgctccaccggagcacgcgacgcgcgcggccgcgcgcgtgtgcgcgtgccgtacgtaggacgacgcgaggccgccgcgcgacgacatccgctgcaacggccgccgatgcgcgcgggcgcgcgctcctagctagctggcgtcgcgggcgacgtgtgatgtcggcacggcctcctctcctggttgggctttggctcgtctcatctccctacggcgatgttgatctgctcgtggagacgccgacacctgctggcccgtggcacgcggcacgcggagaggtgaaactctctatcgcttttgctgctgctgctccctcgttggtttcgaaatatgctccccctcgatgccacccatcacgcatgtgggggcacttggcaattgccaatcgtccgtccagccggccgtgcgtgcgtgtgcgacgggaggtagctaccaccggcaccaccggcatggaggctcgtgtcgccccacacacactttcggctgcttaagctcagtgttaaaaaagtatcgaaattttccgatcgtaccgatgccgtttccacaaaactaatataataatatggttaccgtttttaaattttagttttttaaatttctgtcagcgtggtattgaagttgacactaaatagatgaattcataaatatggaaatttcctgaccgttttcgttcatttcanaaaaagtaataaaataatgtaccgtttccgattatttccaaccgttttcatacctagtgttactacaattatattcagctgatctggtacagtcttagaataattccatttgtaatcctttctattttcttgaaataaatttatttttaaactatcatttcgtcgaagtttgtaaaaatagtgtataaatgtattaggagtaaataaaaagaaaaataattgcaacggcatttgataaagtagtaatgatctaatattttttattttgtattgatatgcgtgtgatgagtaaaaaggaactattttaaaacagagagacaactacttcttccgtgccaaaatgtaaacatttttttattagcatggtattagtaaagtaggtgatactgattggagaaagtgaataattagttaaaaagataaagtagatgaaatataatggttgtaaacttgtaattggttgagaggagaagataggtagagaaatagctttattttgagacatgtaatatgctaaaaataattatattttgggatgacgatcgtacataagagcaggtacaatagcaggctataagccagctataaccacatatcgagaagaaaaaagaagagagagaagaaagcgggctacagatttgtaaccagctacaacacagactccaagacgttacgtgtgtatgacaggtgggaccgaatattagtagtgtagtatatttttatagttaactattgtatgaatatgctattagattaactatagatgatttaaagccaatacttagttatactattaaacttgctctaacagaccaatcacaccagcaaagtatcctagtctataacagaccaaacaacaagaccataactagtctataaagaaagcaataggccaactattaactgaccaattattcggtccgcacgtactgactctacaaactggtccatgatggcaggagtaagataagatcaagaccgaagcgcggtccaggtcaattatttgacaaagcacggaggatatggttaattgcaacatcttaattacattgtcatggcttgtttctaggtcgctgctcccgcgcttacgtgactttatagaaagcttgagattttgacaagttgttagccagtttctgataatttagaaaaactgggttttccatctttcaccttttagtttattttatgaactctataactataatttcttataatcgaaaaaaagttaaactgcctaggagagtttttgattctgaaaaaaaaaatcaaaagctccccaatcaagctctatgtcattttacaaacctgcatctcacgattgcaccatctcctctccttccatcttaaaatgtgatatatcttattattatgaatctaaacagaaatattattagaatatatcatatcacatactactatgtctcaaaagaataactcctagctataaacttgtatacgcatatgtccagattcgtaacttggatttgattttattcttttttagacggaggggtattaaatttgtctattttcaaatgaagggagtacatatgtgacccccatgaaacgtcaagggaaaaggttgtctcccactagcaagattggtgcaccgatggataatgtaactaaacgtgaaacaacccatgttgtttctgttagccttcgccactaaagtgccaatgttcccgccctttagtcacagtgctcaccgactatatacccgtcagtccatactctaaggcatagtacttgattataatgtcttagcatcctctttcggtcaggatcgatggatcgatctagtcatctatagccactaataaagctggtttcgttttgaggaaaaacatgagatttggaattatgaggattaattcataacaataccattcagatcgtatgaataaattctaggaaaaccaaagaatttggtttcctacaagttgtaaacaacgtagaaaatttacatccacttaaatctcttaaaaattccttcatttcttttcttattgtaatgggttaaacaaaattcaaaccaaataagctctaagttatgagacggaaagctgggaaaaattataaaatttggtgtgatttatacatacaaatatcattgaaatggttggtgcagtgttcctcttgccttcctttcttccatcaagatgcacttattcgtatgttagagtgtgcactcgtggatgcgcgtgtatagtggcgtgtgtgcttctttcgtataattgtaagaaaaatattttgaagtggaaattcgagaagataccagaagagaaatgcatgagtttagtatgcatgtagttgtttggacatgagagatgacaatttatttgttgtaatgaatatatcagattttctactctcagtgatggagccaggataaaattataacgggggctaaaccaaaatgaccaagagtaactaagagagatttagggttggttttaagactttttgggccttcctagtcttttgggccttctaacaacctcaaataaagtctatattagcccctcatctataaatatatagattaaaattttaggggggtattatggaggctctaatggtatattagagggtagggagggtctaaacaccccccgcccccatggtgtccccgcccctgtctactcctaattttcagttacgaagagattcttaatctttcgatggcctaaagttgagctttagcaagtctaatttgtattttttattaaaactttaatatccttttgcaatggtccctgggcctccaagcaacgtggcggcaccaccttggccactagatgggagaaggggagtgatccaaacattgacaaagatagctccttgttgacatactcccttcgagggagtatagaagagttaggaggagagatagaggtggtgacgttcttgatagatggagagggaaggaggtggcggggtttgtatacgaagtaagaatcgatcatgaggagaggacttgaggagtgttgggtttaggattacattaaaagtttgtaaccatttaaaagtgagcgttgtataaggaaaaaaaagtaaccaattgacaagtagaccatcctaaatgggccaatttgctccctaccatcgtaaaaattatggtctcgaaagatatcttcatatatatgtcatgaatatgtggattcgggtcccatatataattctcatcgtattttgcaactcacgtgtcctacattagtgttcttcaacaaattttcatccaaatcaaccaaaaagaaccatatactaattagggtgtgtttagttcatgctaaaattagaagtttgattgaaattggaacgatgtgatggaaaagttggaagtttatgtatgtaggaaagttttgatgtgatggaaaagttggaagtttgaagaaaattttggaactaaactcagcctaaattaagatatggcagttgagtaaattgacatgtgtttagttcacgctaaaattgaaagttttgttgaaattggaacgatgtgtggaaaagttagaagtttgtgtgtgtagaaaagttctgatgtgatgtaaaagttgaaagtttggaactaaactcgtctgttgtttcatcccgtttatctgtttggttttgacgtccgtatgccgtctccttccaattccatccctagctctacctaccacgcgctgccaaactcttcctgccccagccggtcctccacctctcggtccctcttctgctgcgaccgagtcagtcgaggctcgcggctccgaaccaccacgtacgatctccgcggaaaagctgggtcgcgttggcaggcagcgacttgttcaccccgtactccgctccgccaccatcagtccatcaccacgcacagcgacctttttgttttttttttacgttttaaaagtcccaaacagaaaaggcaaaacaaaaaataaaaagaagagtccacgactccgtatgtcaagtctactcacacaccctttttttttccctctcgtgtcagtgtcagagaatacgtatccgcttcttctcttctccgtggtgatgagcgacgcgtcgcgtcgctctctcgatggcggacgcggcaatactcccccgcccgcttcgcttgcgtttttgcgcgctcccgtttcgtttcaacggataaattcgcctagtggtagcttctgcaccgcaccgtcctgccttctttcttgttgctttccctgccaatttcctctcaaacatctctccttttaccttttccttcaccaccgcggcgaatattcgctgagacttttagttctcaatttttttcttcaaacttctaacttttttatcacatcaaaacttttatacacacaaactttcaatttttccgtcacatcattctaatttcaattaaattttcaattttaacatgaattaaacacaccgaagacttccatccccaattatactccttccatctaaatagtaaaaccaatcttttattccacccatatcaaaatataagaatatggaaccggattaaatgttttctagcattatgaatctaaatagaaaaagtctaatctgattatgggttcttatattttataacgtttcgtaccataatattttaagtcggagaaagaattggataatacgttttccaataccatgaatctagacacttgtatccagcatgtcccatccaatacaatttaatttctgtattatccacagcgtttcgattatcgtttttataactttgacaagtttaccattaatcttggactgttgcaagaacggagctgtcgttttctcgcgcggtggtctcggctcggctggggagcaaagcgggcgagcatattctctcttgctttgccgttaagtactccctccgtgtgagtgtgcgctaactaacctagttaatgcgaggtgtcgacatttcgctccccccttttctttctccccactttcgcgttcgattaattcttcgtttgatcgtttctcccccaaatcgatggatcgattgaacagcgaatccgtgagatatgattactgcgatgattagttaagagggaacagaacggtaaagacgagtgatgaactaattaatattaattgatcttaataatagtgaacaat

SEQ ID NO: 54625 - DNA, 17921 bp, Oryza sativa
  unsure (1)..(17921): unsure at all n locations
ggaagtgggcgcggcgggtgggcgtatgtatctacggcgctgccactggggtcgagacagcgcgtcagtttgtatgggaagcgccagaaaacggctgggggattgtgggggggtggaggcatgggtgcagcatacgtgttccggtcgtcatgggcgctcagaaaaaaccaataggatgagatttgaggttacttagtacaacgaatttgagtaaactaaatagttaaatattattttaggtttaaatatttttaaacggagggagtacgtgttctgcccaaggttttgctttgttggccgtcatgggcgtcgcacaggttgaagcatgtgaattgtacgagtgggtgtgccgccacacacactggggagatgggaagttgcagctgcagccattcctgcgtgctctctaggtttgccatgccaattgccagttttttttttaattttaatcctctgaaactttgatgagagtatactgtcaatagtggcggacgcacttttaaaatatagatgggacggagaacggagatattaattcgataagagcaatcgaacacaacatatatcgtatttatagtccaatcacataactggatcgatcattgtttgtggcatgtgtgctatgaagagatggactaatttgttggacgttcacaccttattatatctattttttgcggggttattattatatctaattttgatggcccataactaccataaggggtagggggtcttaggggtgtgaggtgacacatgtcgtagctgattcagtcgatccacactgtctattagatagatctgcccctaattactatagtccatagagtactcactccatttcaaattatttatcgttctagcaaatcggcacatggttatccttgtcaaatacatcccaattagtttttcaaaacaggtggtacaataagagtagtgagtcttgtgactatattaatgtatgactgcattgaagaagcataggaagcgataagtattttgacataaaatttaaatcttataacgatacgtaatataaaatagagggtgtaataagttttgcgtaccagataatcattacgagaatactctatctatataaatattgtggacttattttaagggtagttgtggacatctttttgtttttgcagaaacgtgtttatttggacatttgcgtatgggggcggttggagtacagatgtatactaacatttttttttaaaggaaatagtatacggtatgtagcatgtatattaggtattaatacaagtagttggatccaaaacaacaactactattataatgccaccaatgatacctaccattactcctgcatctttgtgatacactgatactaatatcaaatatcactagtattattacgtcaagtaataggctccggtgtggacaatgtgcactcttttttttctctacatagtccttcacatttttattttgaacaatgatatattttttaaaaagaaaatagagaggcggatctatcccattttattactagtacaaatgaaggattaaaggttttagcagatacaaaccctagttcctaagcccatcgatatctggatgttaaatataatgaaggattaattgattatacgagcagaacaatatgaaataggtcatatattgatatattggtatacgggttacgagtaagaggggcatacatattatcttacttaacttaaacatgatcatctctacttaatacaaaatttatctaactaaccttgtttttgaagccattgaagccaattgactggtgaattcctttgcttgtcgttcttgctgttattctttttcttttctttcttcttctgtttttcttttgttcttctccttcttaccctgagcttcctgttgacgcaaagagatgatgtagagatatctcatgaacacttttcagcgccaaattgattggacaattggttttaaggtatttttttagtttagactttcaagcgtcccatttgcctcttttctttcttttaaatgcgacgccggtggggctcaagagtctatctccaaaatagaaaacaaattcgttttttctacatatcacacaaaaacaaattatttatttctatttttttatcgttaaggattaattttctcttgatctttattgatagcaagccaataaaatcaaccaacaagaaccatataccaattagttcgatttaacgacttcgacatataaaaaggtaggaataagttcgtaaaaactcttggctagtgttcactgtgcagtaccgcactcttgccatctctctttcaccgcacgatgctctgtctgagagctctttgtcagtaaataatttcctctcttatgcaatcaaaccccaccaaagctgtgcgccctgtgcgcccccgccatcattgcattgttgccgcaacgtacgagtacgttccactttcgtgaaaacccgcttttcagctccgaaagcgcctctgcgccactcccacagcctctgtatagtctgcaccccaacctctaaaagaaatccgacggttcacgtctccccgatcaatccgatccgacggcccacactctccccgtgacgtcggcgcgcggaaaacgacaaaaggcaggggcgttccggtaaatttaccccctcccaatctcttctctctgtgatgccccctgatgcctttcgcttttctgctccccgttgtcgcgacgtgggggtgggggtgtggtcgttgtggcggggcggggtgacacgtggcggagagggacacctggcaggccaggagaggccgtggcagctggcaggccggcacgtggaggtggggcccacgtggtagtgggagtgtacctctcccctgtcgcctgtccgacgtgggcccacagtatccgaggcgaggagatgagatggtgagacgtggagtactgccgtgttgggtaaaagggagcagccgccgtcaagtgcacaggagagagacgccgtcacttcgttgttacagctagcgagagttcgatgtttttgaactggtttcatatttaaaatccttcttgttttgcaccacgattgctagtagtagtacttttttatcttctttcccttggttgatgtgcgaagcagtaggagtacttcgaaacgaggattttaaatctttaccaaattccaagaaaatcaatgcaactactctatccgttactatatttgaagttagttgtgggtttctgtatctaatacatgatcattcgttttatttgataatttaaaaaaaataaaaaatcatacataaagtattatttatatttttattatctaataacaataaaaaaactaatcgtaaaaaaattttaaataagacggacggttaaacattggacacaataacccacaactaaactttaaaatgggggcggagggagtgctgacctttgataatgagccgattgatgttaagtaattaggccctgtttctttcagcctgggattattataatccagattattgagagtaagctgaaaggaacaaacaacttattaaagtagcttattataatctggagcccagcttattataatctgataagctcatttaggtgagctttttccagattattaggtgaaaaattacccaccatgccaccccactctctctttagacttgcaaacccaataatttaggctctaataatctaggaaagaaataactaaccgcttattctactacatattataataatctaatttatagtaatctgactcaataatctagattataataattccaatctaaaagaaacatggccttaagctacagtagcatggagtttttattatcactagtggtactagcctgtgcacacgtgaaccggttaaagtattggtttgtactcgccataaaccgggggatcaaatcgtcaaacgccagagaggaccggaccacggttgacttcacgattaaccagccactagcgtggcatcttgccccaaggacaaggcacctcaaagtcaatagtaacgctgtcaatgccataataaacacagtaccaatactagaaggctctttagtagtactaagtcaatgcgattaaatcaacaccaacctataaactttggacaaaatgattatatcaacccaatgtacaaggaattgctaaaacgcagccacaagttttttgggtaaaacaaaattagatatacttataatatagttataggtaactacaatataattacactactgctacctccatattttaatgtatgacgccgttgattttttgtccaacgtttgactgtttgtcttattcaaaaaaaattatgtaattatcatttattttattgtgacttgattcatcatcaaatgctatttaagcatgacataaacattttcatattttcacaaaaaattaaataaaacgaatggtcaaacattgctaaaaagtcaacggcgtcatacattaaaatacggagggagtacattgtaactatatttaatctctatatcgggacggaggtagtaagaagtagcttcccaaatactctaaattcttatccaaagcttaaaatattatggttataaaattcagaaaatgaaaactcccttcatttttaaatgcaaggccatgtggtcatcaagtcaatgcgattaaattatcaccacgcccatcaactttggataaaatgatcaaatcaaaataatactggtactactctatataggctgttttaatttctcaagataggctcgtactccttgtcctattttaagtgcagccataaattcccgtatacaattttgattgtccgtcttttaaaattttttataattagtatttttattattgttagataataataaaacataaatgtaactttatgcgtgtcttatgttttttattttactaaaaatctttcaaataaggtggacgataaaagttggccacgtaaactctgtactaataaatttaggtgtggaagttggcgctgggccagctgagaatctcatcaaagtgggccgagggcggtgcgggcccacctacagtgactagtacgagctatccacgtgtactgttggtccgtacctcatcttggctgcagcatcttgcttcagctgcagttcagaaaaagctcgctcgactacactacgcttccatttgatattgagtactgtatctagtattccgtatatgtgtttacacccaatcggtcgatttgatcaaacaccacgcaaagggacgcgagatgcagaatcttaatccggattggcagttcaaatccttgtgctaataaaatgtagtacaacagaaaaaaatagagagattacacaagtgtattggatgccagaatctagtcaatgcaatgcgcaaatctcagcgcaccaattatagaaaacttctcctcgctttgatttgaacggatttcgttttttaaaaacagcttttcttggaggagatttgtatatatactatactatactgcagttggtcccaattggggagaaaagccgatggggagatcagatgctttgctgcaccatcacggccggggtgaacacgtgtggatcgtgcgtacgtgcgcttcaaatttaattactagtagcctccaaattgctgcaaaaacaaactttcaaacgccacttgttcctcaagattgatgaagcactgaatttactgaaaagataatgcgtgttttttctctgtccttgtagctgaaaccggaggcagagcgagatgggggagctgatccgaatcatatcgctgcagccattgtacatttggacatttgccaagtggccagagtgatctccagcttagctgtggcacagtgcatttttgccgacgatcgcccgtcgtcgtaaacggtggtctgggagtggctgtcgacccgccattggaggggttactgaagaagctcgtaggtgttcagagagtgtgagattgacagttgagagatgtgttcttctgcaatggtgagtggccacttggagcaaggctgtccactgattggttttatgaacacataacacatgtgtgtttgggactaactgtcatgtcacacttgcaattgaatgattgcgtataagcagctagtagtactagcgtttttgggatggtaatcgatgtggtgtagatcaagacatgaagtactagctgtcaacacttgtgatagctctgagagcaagtttaatagcatagccaactattaacactaaatcatctatagtcgatttaatagttaattcatacatagttacctataaatatatactacacaattaatacatggtcccacatgccatacacacatacatcttgtagtctgtgctgcagctagttataatatgtagcccgctgctttcctcttatatctcctcaaaatgtgtttgtagctggtttacagtctgctattgtatatgctgtaagaacaagggaaaaacataatgtgagctgaaaaaagaattaggggtgaggtgagacggattaacaattcaagtgccccatgatcactctgcctttgtttaagccggagattcgcggtgtagataacattgtttgcaatggcaggaaaagcgaagcgagagaggtcgtcacctgccacccatgatcttatccagtgcttggtctttgagcaccttttgtttaatcctgcgcacacaacttgtcctgattttaaaaacttcccagaactgtattacttgttcttcgttagctgctaattaatctattcctcatttgttctgattctgaagctttcatgcttaaaaaaacaacaaaaaaaaaactaccaggaaaaggagtgcttaatttgtttagtttagtgtcaggttgggaggtgtcaggaactcaggatcaggaagaatttaaagcgtcaagtcataagttgtaaatcaagtggtagtttttttggcgcgttttttttttaaaaaaaattcgccacatggcttgtacgcttgcgaggtggatcattgcaacgaggggaaaaaaacaattacaggagatgagagatgatcagccgaaagggagattgcgccggtgtttttgctggcgtctgctgccaacggcaggagcgacgcgccggccgacggtgcacgcactgcggcgcggtggacggcgccggcaggaaattaagctgagaggaaggtgacgatctgggcgatctccaccgctggaaaaccggcgaatgtaaagaattctcgtctgtcgccgcctccgatgcagtccgacgacgacgaggtaacaagtggcacaaagatagagcacaattctatcgggaggttgttaggcgcatcaggtttctcgagccgccggggccggggttacctcgcctcggcagtaagcacggttaccatggcaaaccgtataaaaattatcaaaattttaaattatttttaatatttatttgaattcaaggagtttactgtggttttccttttgcggtaaccgacggtttggaaaactctaaatttcacttatcgcaccttcctcttaggagtcgtatttggtttaacgggctcctcagtgccataggattgtttattttgttgagtatcaccaacagtctacctatctgattcccaaaactgattttgagggattttagtccaaaaaacagctccaatagatcccctaccctcctatccgagttttggagttcaattctcccgattcctcgctctgtttatatgcgggcgcaaaactcattcccaatctcacactcccgcctctctccttctgttcccacgtgtgggagataacgatctttctgtgcgtgaaagaaaaaaaatgaaattttctgttggtagtttaacagaagggcccacttttaagggcatgttcagattgtagccaaaataagccttaccaagttttaacaatgccaaaattttgacaagatgacaatattatcaaaattttggcaggatttcttatgtattgatcaaatttggcaacaaattaaacatagatattttttttggcaactttgccaaaaaatggtatggttgaaaatggcatcaaagtaaacagtccctaaattttggggattgaatttaggctatctgttggagggaggagttttttcacatcctatttcagtttaggaaacccaaaaacaattttttggggaaatattattgataaaattttgtttggttccttctcaaaatttggtaatgtttttgtgggaaaaagttccgaagctattaaattttggtaaaatggctttttttttgggaaactacgtcgtgtgtttaaggcaccagcctgaacttttattgaaatgaagaaacatttacaggagaggtgttacagggggtgagaaggaagaaaaaagaattaaaaaaagaaagaaagaattaagagatagttacataggggtaggaggcccagttacggagctgttgcttgctctcagtatttttacatcggtgggaccaaagatcaatgtcactagcacaatgttggagaacaaacgaggcgggatcgtcaatggaattgaagaccttattgttgcggcgtttccaaatactccacatgacggcaagcagaatagtgcgccagactcttggagtggcgggttgtcccggcggaggaatgtcccagacaccttcaagctgcggcattgataggttaatgtttagttcgttacccaaccaaaatttggtagtgttgaaagtggcaaataagcaaacataccttatatatatatatatatatatatatatatataaagagagagagagagagagagagagagagagagagagagagacacgcacaaaattacaatcatgcgggctggataagttgataagtgagtaaagtctgtggaatgattgggccgcaaatgtttcattgttttgtttgcgccagacgtatttgtctctgcatcagtaatcaagattgttttcttttggattaagtccactttaaccccctaaatattggtctaatatggtttgtatccttcaaccgccatactagatatcttgacgccccccaacacacacaattaaaactaatgcaaaatagctccctcgatggttttgtgggcggttttcgctaacgtggctcgttgactggtccaacaggatgagtcagcatatgagatccatatgtcagtgcctcatctttgtccttctcattcttttctttgtattccttcctcctcttcctctctccatctattctccatgcatggagggcaatggcgcgcggaggaggaggcgccttggctcctccagacttgaatcgctccttgtagtaggtgggggaattaggtggaggggtgggagttggggacataaccggtgtgggccgccaccgccgttggccgctgacaaagaggatgcgaccgtcaagccagggaggcgggcgtcatcgcggcgccggcttgcaccctttcttgctccctcaccgccgcggccactaccgccttccatctctgccacggagtggggatgagaagtggcggttgggagtgtgctctccatctcccctgacgccttcctccgcaccattgttgtctctgtcgtcggaatcgtcctgcctgctgcattgcgctgcacgatgccttgtgcactccccaaccacccgtccatgcctgcaccccttgccgtccaccgagaaacacatggggagagagagtggggtagagaagaaaggagagaaagactatggagtatgacaggtggaccctactttatttttttttattttatttgatgactaggatgtcacgtggatgccaagttagcaaatactactatcaatactagcttaggagttaaattagaccggttttcacggttaaggagtcaacatatttggtattgcgagggagggtcatgaattagatttggtccactttaagggagccaaagtggacttactccttttcttaatgacagaagtggattaagattgatgttgggccgtgacctgatgctgcttagagaaatgtcagtccaacgttgcttagcgtattacaagaggccaacaatatgttctacaaagtgttgaagaacctcgtacctcatgtttccgttaatcttcttctgatgtatgttcccgctccctcggttcttaaatgaatgacgctgcttactaattgtttttggtgcaaataaaaaataatgttttaattgcctttataataaaacaaatcactacaaaataaatgataattatgcagtcttttaaataaaaagaatggttaaacgccatatctaaaattcaataacatcacacaattaaaaaaacagaggcaatactttgcagctaagaaaattcaagttgtcgtttgccatatgacttacaagctctcgctgaaataaaattttgaaaattaattttgaagttgactttgatgttttttccaacacagattcttttaagtcgttaagaacacgtatgtaaatatttgtcccacaaattatatttttatcactaataaaccactacaggcaaccgatggagccctcagatttagcgcagaagcacacacgatttagaagtacggttagcctgactagtattttttaatttgttttccatcctctcctcggttagctgatcactaacgcgagatctgatgccatcctcttctcggttagctgatcactcaccaaccttagatctgatgcagattagcatttaaaaaatccaagaacgaggagttagtcggccaatcggaatcttcgaaacgagaaatcctaaacttcattaaatttattcagccacagccatttttagtcgtactctgatgagtgtgttcgttgtgttcagttgcagtttgcaaacttgcagtatcatcttcacttgtaagaactgaaaagatatcaatggctatcagccaggaggagcagcacgccggcggcgggagggactacgccgagccggcgccgcagccgtttcttggctcgtcggagctgcggcggtggtcgctgtaccgcgcggcgatcgccgagttcgtggcgacgctgctgttcctgtacgtgacggtggccacggtgatcgggcacaagcggcgccaggacgagggcggcgacggcgaggcgtgcggcggcgtcggcctcctcggcgtcgcctgggccttcggcggcacgatcttcctcctcgtctagtgcaccgccggcgtgtccggcgggcacgtgaacccggcggtcacgctcgggctgctcgtcgcgaggaaggtgacgctgctccgcgccgcgctctacgtcgccgcgcagtgcctcggcgccggcctcgtccgggcgctcaactcggcccacttcgcgcggcacggcggcggcgccaacgtcgtcggcgacggctactccaagggcgccgggctcgccgccgaggtcgccggcacgttcgtgctcgtgtacaccgtcttctccgccaccgacgccaagcgcagcgcgcgcgacagccacatcccggtaagcgatagctcaccacagctcatggtgttcgacatggagagtatagtgaggttctcgtcttctccggcgagtcgctcgtctgcaggtgttggcgccattgcccatcggtttcgcggtgttcgtggtgcacctcgccaccatcccgatcaccggcacgggcatcaatccggcgaggagcttcggcgccgccgtcgtctacaaccagcccaatgcttggcacgatcaggtactcgcaatcatccattcgttgcgtcactgatcagtagctgcagggattcaatctatcgttttcagcattggcatccgggttacagatacaaccgattttttttctgaaattccgtttttcgggccgaaaatacttgatttttgaagagaatttggtcgaatttaaacaaatattactaaattcacaaaaataataaaaacccaaaaaaatcagtaaaaataatatcgaatcgagtccggtacaactgaaaattttgaaataatatcgtattgggggtctgatagaactgaaattttggacgaacaaattcttgaccttagaatctgaaattctgaatctttcccctttttttagtggatcttctgggtagggcctcttgtcgggtccgccattgcgacgctataccacgagcatgtgctgagggcgagtactctcaaggcgttgggctcattcaagggcgccagacaatgagttcttggatcaagtggtgatcactaatcagctagccatgcctggattgaagtgcatccagagacaacgggctcagatggatgatgatgatgataatgctcatcctccttaaatgttgcacaagcacagtctttttttcttcctccatgctcctcccttttggatcatgtgctgtgctgtacatgaattagccattaaatgttgagaagctgtactgtacttgaattagctgttgtactgaattgggctttggatattttctccgaaacacaattgggtttcagtttttgatgagcaattttcattgtgatgttaacatggaacataatcttaattcaatgagacagaagagatcattcatttcttcatcagttctctccattacaaaattcagtctcacacgcacgactattacaacagattacagaccacctagctatacactgtactatattttttttgttccatatccctaatcggctagtctctcaaaagtccaaaaggagcaatcatatactagtacaagacatgcttccttgtgcatgattacctacagatatttaaactaacaccaagattccaagcagcaatctgcatccaattaacaatctgcagaaccaccaggcattcttagctagcctgtcagttaaaattaacctacaggcacatcagaatgtggcacaaaattcagaaatccttctgttcccactccattaagcaaagaacctgtcctaaagaagcacccctcttcagagagattccaagcaaaaacacagtactgataagctgccagtaacacacaacacattcagacaagctctgaatgatactgaattactgataacagctagtactcctgcaggcgctacctgcgtgtaggagaagaagatggagtaaaggcgacgggacgtgggggcacggtggcgccgcacgcctgtttcgattgctgctcaaagctcgcggtttcctcggcatgcggcgtggcgccatgctctttgagtcttgaggagcagcaatgataattcggcatggtaggatgtgatggatgggtgaagaggaagaagaggaggtgagaatgatgtcttctgctgcattcctgcaggtgttgttgctgccaattggggcctctttggtaaaagatgtaggagagaattttgaaatttcaaatgtatatgattcagggtggtgcatctacccaattccaatcaacactgtagttagattgttgtagttcaacaatataaaatttgaatggggtagctatacaacattggacgttttttttctttttcgaaaactttcaaatgtaaccatagtataattatactgcgactacaatcaaacttacatgtaactagtagtataaaattaatcaagaagtgaaagcaactcttaggctcgaccctgcctcatatagcaaacccgtctgtatattgagtgttggtattgggcatgtgaggaacaaaattccctcatgttcagctgaaatgatttgatgaattttctgctaattttgtagtatgttgatacctgctgacctgcaccatgatcagttgatcgcaatagccattactaacgtgatttaagaaaataagtactccctccgtctcataatataagagattttgactttttgtttgtactgtttgactactcgtcttattcagaaaatttgtgcaaatatagaaaacgaaaagttgtgattaaagtactttggataataaagtaagtcataaataaaataaataataattctaaattttttttgaataagacaaatggtcaaatagtaaaaaaaaagtcaaaataccttatattataggatggagagagtatatgttgataggctttactgataaatgaccaccatcctataccaaacaaaaatacacaactcaccaatacgtacgtacaattcatccaattaactgcacggatggtacaagaacgtcctaagctaataccatctgtggcaaagaatgcttccatcattacaaggccaaaaccaaaagcacagataaagcaaacaaaaagttgcttaaaagtcaccaagtaaactaatagtcctctgagataacttttgagggagtatgactatcagtctatgattgagcccccactagcctggataaacaagattaaaattttgaaaatggaacaaattaattaaggatgtgtctcagcctgtgactgtgaggcatggacatccaaaagatcaaaaacatcattccatctctccacacctcgccatcattctgcttccctttcagcttgccactacaagaattgaagtagaagcaaagcctcaacacaatttgtttacttgcttactcctgcatcttctatatatatacacccaatgcaatccaagaacacaagatcatctgcacacttgatgtgattgctgagctcgagctccgaaaagatcatggcaatggcggcggcggcgatggtgtttcttgtgttcgcgccttgccttgcacaggccgaggagcggccgacggcggcgcacccgcacgggctccccttcgagagcccgctggcgctgtcgccggacgcgtacgagttcttccaccccagcgagcgcgcccggcgcgggcacgccgccggggcggcgccggcgctgtcgccgcgggcggcgccgcgcgggcagctgagggagtccgcggcgagcgtggcgagggccgaccaggaggagggcggcgtggcgcccgccaggaaggtcggccgcggctgcgcccgggcaggcacggtggccggcgtggtcgccggcgccgctgccgtggcggcgtttgcggcgctcgcggtggcgtacgccgtggcgcggcgccgcgtgggcgtggcggcgcacggcgacgccgaggcgtgcgcgcgcgcggcgccgaagacgagcgcctagtgggccggcctggtttgctccatacgtatgcgtgtagtagttgagttgggctttatggctatatttatgtgggcccagataggtgggccatggtggtgctgtgtaaaaatctggaaatgttttgtgggcccagagagttgggccatgctgttttgggaaagatggccgaaactatttagaggaggctttcgcttgcaatgtttaagatctctctttgaactcgagaaaaaaaaaaaaccctgtcgagtcattgtttatttttgggagtatctggaaaaattgtcataagttcttgagtcaaaaactttcaaatataattataatataattaaaatgtaactatattgtaattacattataactacactataactatgatttaacttataaaaaacttgcattgaattacggtttagttagctagcaataagatcttacgcatgatgcgtgtgaaaattttttgtagcaattttatccttcacacacaaatcttaaggtgatccgatgatcacaaatctcaaggttttgtgggaataaaacgtacgaaagttttctagcaaatcactttcttaacgtgctttcactaatgaccacagtactacagttggtaaaatgcataatacttaagaatctccttcgtcgaaacagattattcatcggattatcgacacggatcatttggaagctaacaaagccctcatcaaatcagcttagctgtgaactcgaccaatatatcaacatccggcatgacgtccacgacggccgggtgcccgcagaagcgatccgcccaggcagccaggttggggaccttcgcgccgccgaggagctcgacgccggcgatcctctccaccgccctgatccatccgaggtgcgatccgagggcgatgtccaggtagccgatgctgtcgtcgccgaagtattgcttccctttgctgcactcgacgaatgcctcctctaaatacagcagagcggttgtcatttcgtcggacgcttcgtccttgtctccggggacggttcctctcaatatccgaatccttggaggaaactgcatcgaagcaagagtggaaacctggaaattattcgagatacaaggagaagaaaaagtttgaataaattcagtttgagaactcttgttttcttaccggtcgtaaccaaaatttgatttttggtaattgactttagagttgatttcgagggtttttcatcgtagttttgttttttacatttacttttaaataacggataataaatacaatataagaaactagcatggtagcgtcattatattttctctcatataatagcatatatgttttctcattatattattcaaatatattaaaatgacaacataattttaaattttgcaataactttacaaaactactaatgtgtaatattcatattgtattttatatacatgttagttattaattatttttaatatcaaattttagttatttgtaaattatatatatatatatatatatatatatatatatatatatatatatatatatatatatatatattcctatattactcgtcttttaatatttttttaattccgaattttcttaatattgtatttctatatagactctatgctctttttccaatattatttatttttatttctgaatttttattatttctaattgtatttctatgtggactctaaactcatctttcagtattatttaatttttaatttcgaatttcagttacttctaaattgtattcctatatttactttaaacttttcttcccatatttttcttaattttgaattttatttatttgtaaattatatttttatacggactctaaactctacttttaattttattgtgtttattccaaattttcgttagttttaaattcctatatggacactatactctacttctaatattccttattttttaattacgaatttctattttttttcttaattgtatttctatatgaactatatactctacttctaatattccttacttttaattctaaatttctattattttctaattgtatttctatatggactctatactctacttgtaatattccttatttttaattacaaatttcagttatttcctaattatatttctatatggactctatactctacttttaatattccttatttttaattccgaactctatactctacttttaatattccttatttttaattccgaactctatactctacttttaatattctttatttttaattccgaatttcagttaattcctaattgtatttctatatggactctatactctacttttaatattccttatttttaattccgaatttcagttatttcctaattgtatttctatatggattctagtctcctcttctaatattccttattttttaattccgaatttcaactatttctaaattgtatttctatatggactctagtctactattctaatattccttattttttaattccgaatttcagctatttctaaattgtatttctatatggactctactttttctttttctccgattaatgtaagaatttctagaccatgagagcgaacgtggaggcttctttttctattcctttaataatataatagatagattgcctaatcctatgtagataattttcaggtctaccagttgggttctgatgttgccatgaaaggagcaggatactatacgtgatggtgctatagttttagaattagtagccaagggttctcttttccgcgttgaatcacatatgtgattcaattcaagtgatccttttttttcctcactgctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54626 - DNA, 1224 bp, Oryza sativa
taccatggatgcaatttgtctgtacctttccagtaagagtaagttttgcacaagttgggttttcaggatcaatcttcccacatgtcccaagagggaactcgctaagggtaaaggaggtcctttcatcctccaatgcatctctcgcagtgggatctagcgttgtcagatagaagtaggggattccatggctctcacctggcactccatcactatatgaaactacattgctgtatgtacaggaagcagggaactaagttcagcaatcagaaagggtttgtaaccatgtgcgttggttgttttcaataccaaaacaagaaatattacccaaaaggagctccacttagatcacttgatattgtgctgcaaaaagaaattgcatatgtgagtgaacaatcagtggacatctagcagatacattattaaaagaaagtcaaaacaatatacaatagtgttttaaatagccaactgcactcgcgtaagtattttttgacagtgactgctacgctattgtagtatcatgtaaaaaccagcgaaggcagctatgacaactctgctaaatccactaaatgctgtaccgctactcaatcaattagtttttatcaatttagttttattttgcctgggcttaatttgaaatttgttttcttagaaatcaaaactatttagaatcttgaatatccttgttttcacctgaacaagtactaaaatattagttaagaaactttcatactttttatgaactttacaattaatttcaagtaatacatgacacatatgagtaacttatgctctaaataatatggggggaaaaagctatattgaccttgatgctaaaaccatagcttttcattactagataaaaatctgtctggtatatttgacctaatgatgtatgcagacattaaaacgtggccagaggtttccaacttcacaccaatttgaagaatattgtctatatttatttattttctttgcgaggaattttgatggaactgtaagttttcgttatccaattggcacagtaggacggcaatttagcaaaacacctattcaattgtaaatcatgacactgaatgtcacacaagtaagggaagagcaccaccaatttctcaatactaagcagcctcaggcgattagattactagccactaccaacacttgcccgcgctaagaacccccaatttcgatcgaaccacccattgtcatctcctaaagaaccgaggc

SEQ ID NO: 54627 - DNA, 1241 bp, Oryza sativa
atctgcatacaatctccgcttttgacccgagagtacttgatggaaagctctcatagtcctctttgcaacgcatccagcctcatcgccaaattccatcctagtcatctgcagatgaagaaacaatgtgctacgtcacctgtcatgggcctttgggcttgtaactttgtttgagacccggcccaagtggggcccgcgtggggtgcatcccaaccaggggagcatgaccttaggcacccccaggtcctccttccctctcttgggccgaatccggcccatttccctccccctctctctcctctccctgcggcccactcggcctctccccgcgcgcgcgccactgacgggcgggcccgcccgccaccctcgctgacgggtggggcccacccatcatccccttcctcccgccgctccgcccgcgcctagcgccgccgccgccgccaaatccgccacgctccgccgctcccgttcaaaattgaatggggaaatatttcccccgattccctctccctttccccacattttcctctctctctctctctctatttcagatggaaaccccccctaatcccgccggcgccattaatggcggccggatctcccgcaccggtttccttcccgccggccgccctctctcactcccaaccctttataaaccctccccgcacctccctcgtttgtttccaccactcgccgacgacctccggccggcccactccgctcgccgggaccgtctcccacctcggcgtcgtctcctccggcttcgccgtgccgtcgccgaccccgtccaccacctcgccgagctcgccgaccgccggagcgccgtcgtccccatccacccgagccgctccaccgcctttctccgctccggccgcctcctttgccgtcgccgtcgacccggggtgagccgtggaccgccgcctctttccccctacccttcccctctcttggccgccgcaccgccgtgcctatggacgctgccggcgaccataggggcgcgggcgccgtctcccgccggccgcgccgatgtggccgcctccgggcgcaccgtgtggccgccgcgtggggcccggccgtcaccgcccgtgccctcgggtgcggctgacgcgtggggcccatggcgccggccggtgtgagcccgggtgcgcccggtccaccgtggaccatgaggctgccgcgtgggccccactcccgtggacccggtccgcgcgccccctcccctcggctgatgcaataaattcttt

SEQ ID NO: 54628 - DNA, 1115 bp, Oryza sativa
ccctatcctggaggatcctcctcacagcagcagcagcagcagcaacctcgccccgcgccccgacctccatacgtggtgcgcgtcccacagccgcagcagcagcagaatcagcaagggacccgtgcaccccgccctcctgcaccggccgtgcagcctggtcaaggccgcagggacgctcaaggtcaacaacgtctgtgcttcaactgcttcgagcccggacactttgcggataaatgcccgaagccaggcgccagcaaggccaagcgcctccccgccccaacaacggtggtaaggatgtcactgggggttgtgtgaaccacgtgactgccgaggatgtgctgacaactccagacgtcatcgttggtacgttcctcattcattccatccctgctaccattttgttcgactctggagcttcccactcgtttatatctgtgccattcgtggggagaaatcagctgggggtagaaaggcttaggaaccctctactcatcaccacccctggagtggttatgacaacgaagtattatagcccggccgttcctatagaaatccagggaattcctttccctcggatctgattcttctggacaccaagaacttggatgtgatccttgggatgaattggttggctcaattccaaggagtagtggattgcgcaaggcgcactgtcactctgtaccgggggcccgatcaaccagttgttttctttgcactccaactcccgccggcacttcagtacttcatcaactaggattatccgtaatctccatcgtcagtgagttcggtgatgtgtttccggaagagctacccggtatgccgcccaagcgggagattgagttccggatagatcttgctccaggagccactcctttatacaagcgaccctaccgtatggcagcaaatgaattggccgaagtcaagaaacagttggaagagttgaaagaaaatgggtatatacggccgagcacttccccctggagtgctcccgtgatttttgtggagaagaaagacaagacaaagaggatgtgcgttgactacagagctctcaacgaggtcactatcaaaaacatgtaccccctttcccagatcgatgatctgttcgatcagcttaa

SEQ ID NO: 54629 - DNA, 729 bp, Oryza sativa
tcctgcagccccgataaatccacccttaccatttaattaggcacatattcttccatcaatcaagatcgaattgatctgccatggcatcaaacaagcaaattgatctcgagtcccagaagccggcgacgtcatctccggcggccagcgtttcatcggcagcagctgccaccgcgccgccagcttctagctcggctgtacccgtttcagttggcataaccaaccgccacaacgtgcagccagagacggagcctctgctgctgctggcgggcggcgacggcgatggcggctctgacgacgagacaacgcggctggagcggaccatcacgcgggcgttccggagcacggcggagctcgccaagcacctgcccacgggcgcggtgctcgtcttcgaggtgctgtccccggtgttcaccaacggcggcaagtgccaggacgttaaccgcgtcatgacggcgtggctggtggggctctgcgccgcggcgtgcttcttcctctgcttcacggacagcttccacgacgggaaagggacggtgcggtacgtggtggccacgcgcgccggcctgtgggtcatcgacggcaccgcgccgccgccgccggacgtggacgcgacctaccgcctcaagttcatcgacttcttccacgccgtgctgtccctgatcgtcttcctgtccgtcgccatgttcgatcacaacgtcggcgcctgcttctacccggtgatgtcctacgaca

SEQ ID NO: 54630 - DNA, 885 bp, Oryza sativa
ttcctgcagcccagaaagctcgaaactcgtggctcggatcggctcgtagcaagctcagctcggatccattcgaaatcgtagtcttaatgagtcgagtcgagctagccttttagctcgtgagcttaacgaggtagctcgcgagctgctcgtttagctcgttagtataaaatatcaccatatcttataacttagtgtttctttactagtgcttagtcttttagttacatcaaatctattcatatttagtgagtttatattagttagtgtttattattacgttaatacataataaaatgttaaatttgaaattattaatatgatattaatgagatatagctcattaacaagcctaacgagcttacgagccagctcgtgaaccgagccgagctagccttttagctcgctaacattaacgagcccggctcgttaacacaactaactcaactgagccaagccttaacaaaccgagttggctcgttaacacaatgagctcaaatgagccaagccacccctagacgaggaggagaaagagaagaagatcgacaagggttgctaccgaccacccaagtcatcgccgccgtcgtcatgagcctcagcacgccaattgatcaaacctcccttttctggtgttgctcctgctgtttatatagtgctctccctttgcttgcttgggcctggctttaagagtagctgacagcccataggcacgcccaattgggttcctaacaaatcttcaccaagaaattggggaccttctaggagttttcagtaggacttgttctagcattcattaatcaattaaatgtaagaaattcactaattaattaatcacgatttttgtttacatcaacaattgcataactaacttaaatgaacattacatat

SEQ ID NO: 54631 - DNA, 2724 bp, Oryza sativa
tccgggagtgacacttacccactagacatgtggaagtacggtagtgctttgcaacagaggcccaaagaccggtccttatgtggccgaggtgctactatcaaaaccatgcaccccgagcccagcctaaaaccattttgagggttttgaatagagggggaggtgtgtgtgtccaattccacaataattcaaccattccatagtgtccaagtgatatgaatattcccaaagtctagagttacaaaaccacctaatgttgtctaattgatcagcgaagcatctacctaaattcatactagtggaaccatgaatagagtactcactagttggggtttgtttattctagggtgaacaagataataataacaataacaataataataaggtcataacaagggtaaataggcatggctaaataaaacagtgataacgcgggaatttaaataaagcgataatgcattaatttaaatcaaaataatttcataaactgggattcaatatgttcaaagatgatgtgacttgccttgctcgctttcccaaacgtcggcttcaacctccacgtagagcggatcttcgaagctgcagcgtctacacgaccaacggaaaggaaaaatgcttttactctaataaactccatataacaagcaggaacaaagtacaaaaatgggttcttgacttcttaaggaaaacttagagacttgaacggtccaattccgagttcaaatggccaagttatggccatttgaagtttatatgctctttaagtgaataattgtgaatttcttcatttaaattttaatttaaaaaagatttattgcgtcagccaaggggagggggggtgcggaccgggtccacgggagtggggcccacgcggcagcctcacggtccacggtggaccgggcgcacccgggctcacaccggccggcgccgtaggccccacgcatcagccgcacccgagggcacgggcggctaacggccgggccccacgcgacggccacacggcgcgcccggaggcggccacgtcggcgcggccggcgggaggcggcgcctgcgcccctatggtcgccggcggcggccataggcacagcggagcggcggccaagagaggggaagggaagggggaaagaggcggtggtccacgtctcaccccgggtcgacggcgacggcaaaggaggcgtccggagcggaggaaggcggtggcgcggctcgggtggacggggactatggcgcttcggcggtcggcgagctcggcgaggtggtggacagggtcagcgacggcacggcgaagcttgaggagacgacgccgaggcgggaggcggtcccggcgagcggagagggccagccggaggtcgtcggtgacggaggagagagaggacgacggcgcgagctcgattctggcggggaaacggtgcggcaagtggcagaaacgggcgagatgtcacgcccggaatttctatccaaaattctaaacgcttacatgtgtgttaaaccctcgtctaggaatgagccgaggcacacaataacaaattgatagtagagtacaaataaacagctatttaatattcgcaaataataatttattacagaggtggatagttcctctcaaagaataacattctacgcagcggaaaaaaaaaacaaactacgcaacagctatggcgactccactccacaagcaacttaacccggaccaagcctagtcctctagattatcaccttcactgaagtactcctcctctgataaatgaatattgcaagaatgagcatatgacatactcaacaagccacacagcaaatatgcaagtgcacaggataacaaaggatggcataatatagctcatttgcataaatagcatttaataaatatttaagagaatagtaaaacagttgattaattaatcagtattaaataaacaccatacaacacacccgtgttgcataggcccaacctcatctgaacaaccaaccccggttgtacaaatcaaacctccataacaggaatataccattccaaaccaggagtcaaattaattagcacaattaccattaatgaataatgtgagactaattacgaaaaacattgctcaactcacccataaccgcgggcacggctattcgaatagttttactctgatctaagatgtaccactgtacccacaagacacaatcccacaatcccacaacatgtcaccatgcgcctagtaccaccacggtacctcggaaaggaactgtgacagtacccctcgcacaatacaactcaccacagtgcaccatacctggatcataatcaccccctctacaaccagaggcatggactccccagcgacccccacggatgtcacgtcccaaaacaaccttaaaatatatccttcaaattatgcctagaataattaaaatctgagtgaaagcctccaaaaaattaaaatgtgcaaagataaaagtcaaataaggcttggaggatttttgtatatttcctaaaagcctaaaatgtgtaaataaattttagtggaattttcagagtacaaataataattattaagaaataaacaaagttgaaaaggttttataaaaagaaaaaccctaaaaacctcctcccctctcatgggccgaatccggcccatctccctccccctctctctcctctccccacggcccattcggcctctccccgcgtgcgcgccactgacgggcgagcccacccgccaccctcgctgacgggtggggccc

SEQ ID NO: 54632 - DNA, 1466 bp, Oryza sativa
aaataatgcataagttgaaataaaacattagctttaaacgggttcaacatgctcaaaaggttgtttgggatttgtgtgacttgccttgagcttccacaaaaacctgtgaacattcctcaactgaaacgctctcctcgggaacgtcgaaactaaagcaaataaacaaaaaatcaacaaaacagtaccaaaaacaaggcataaacagtacatgtggatatttttaacatgtagatctcaattttagaaaaatttagcaacttgaaccactcgaatcggagctacgatgaattagttatgattttccgaagttttaatctatttcatctattaaaaaaaactaaaaagaaatggttatgacgtcatgctgacgtcatctatgccggccatggcaaaggcgacgacctcgccggcgctaggaggctcggccgggcctttggtgggtacctacgcgtagagggaaacgatacgatctcaaaggtgctcaccgaagcgacaaacgacgacggacggcgcccggcgacgaggtggtgcggcggcggcggctcggtcgacgacggcggcggcgctacggcgaccggagacgacggagagggggcggccgggattctactccctcacgcgcacctaacggcggcgacggcatgcggcggcgacgacgcaagcggcggcgcgacgcgacccgaggtcggccggcgacggcaagcggctagggcgacgcggcggcgactctacggagcactagagagctcgggaaagggggcaaacgaaagaggacgactagggggtcctatttatagccttggattggagagatcggactcccacctcgagtaatcgagccgggaaaatcttcgggtttgttttggggataaactcgaatatgagtccgattcggttaaaatactcaacgatttactccgaatcttgggggcaaagatagaggagaatgaggggatcaaaacccctcaatcaataggacacggggagaccggattggggcggaatcggtggaggaaggcagcggctcggatgaactcgggcggctcggccggaggttgaagaaggcccgacaggtgggccccacctgtcggcggctggagaaggagggggcgggcggcgtcggctgggccggcttgggccggctcgcccgcgcggagagagaagatgttgggccgaaatcggcccaacgacttaggggaggattttttatactttttaaattaaattaatttgtgaaatgttgtttcatttattaaaaatacttcccttgctcaaataattcccagaaaaatctagaaaatagaggaacaagcaaagtatttataaaattttatctagctcaattttatgttgaaaattttgctagattattagagtttagcttgtaggcttttaaaataatttctaaaaatgatttaaaatatgcattattaatttaggcgatttttagggcgcaacacgaggaa

SEQ ID NO: 54633 - DNA, 1767 bp, Oryza sativa
ctgcagcccccctggccgcgagcactccctctccagcctcctcatcgccctccccgccagcgccgcgcatgccggctgcctcagcctcacctggcagtagcagaatggcacgtcgcatgctgccgtcgtaccgttcgctcccacctgcgacgttggcggcagcggcggcgacgcacccaccggagcagagcgcgctccgccacgccgacgcactcctccgcgtcatcgggaagcaccggcaagtccaccgcaccgcaagccgcagaacatcaacgtcgccgtcgccgtcgacagccagtggctcaatggcgggcaggtcctggcgctggacgagcggtggtacgagatcggcgggtcgttccgcgtcgagtccaagccggcgtcgcgcgtgatgctgtacgtcatccaggtgcgcaagcgcgatgtggtggtgaaggtgaaggcggccgacgcgtggaggtgcggctgcggctgatgtcgaacagcttcccgctctgctctgaacacggcatctgcgtgcgcggccactgcatcttctgtgaggtggacaacgcagtgcagcagtgggtgaaggcgcttcccgccgacgagctcttcgccgccgtgagcagccgcatcaacgtcctgctcacccggtacaaggcaagttccggcactacgatgtcaacaacgagatgctgcacggctccttctaccaagacaagctcggcaaggacgcgcgtgccgccatgttcaacacggcgagcgagcttgacccagacgcactgctctacgcgccgcgccggtcgttgtaaaggatcgtcgggacgaagaggacaagaaattagaggggctgacatccttggcctacatagggcaatctggcttttttcgattgtttctctctccgtttccactaaaaataataaaataatatgtccggtgtctaatagctaattaccactttttgcaatgttctacagccgattcatgtttttgtggtgtctcacggctaattacacgtttttttaagtgtcctgtaaccaattttgccaaaatataataatttgtccaccaattctcttcccactccatctacctaactcttttttatccaatcacaaatttttctcatttaattatatctattttcaaaaaccgagttaagctcgtaaaattttatattctgataccgagttgatggtagtagttcgtttagaatgatggcagagactgcttgcgacatgcgtgccagattggcagggagtagctatatttatggcgtcatattttttatcaaaaaatagtcggcatgtatttacattgtaagtccctaaattacatatataattttagtgtatttacaatgtaagccccaaaattacatatgtaagaactaaaattacatatgtaaatcccaaaattacatactaattacatatgtaagtggtatataagagaggtgtaactactatagttacataggaattacacatgtaactatagtacaattatactgtaattatatctgtaactgcagtgtaattaaaaacagacttgacggtgagctccctatcttcgcttctccttttcttgtccttttgcatgccatctgtgcatggatcttgttttttactccgtaatgattagagatttgagatagtatcagcaatagtagtagttacgatggcattagagtctcgacatgcacgaatctctgaactaattgcccagtgaaaaaattgactgtaaacgggaaagaaatatggcgtcatatgtatagcaatt

SEQ ID NO: 54634 - DNA, 919 bp, Oryza sativa
ccgactctggctcagatgaaattttctggccctttctggatcccatcagcaccttaggctctgcaacaagatgttcctgctcaatagagaagctccatctgcggccatccctgtcgatggagaaactagctctccttgagtccttcaagctcgagaagcttgaccgacgtgcttctgtctcggctgagaagctgtgccgccgcccaaccctgtcactgcccgatgaggccctactactgctacctacccgtctgcggctgctcaaccgtcgcagtttcctgtcctccttcagtgctgtcgatggggagcagcaattgcttgacctcctgcccttcatctcttgctcctctttctcaggtcctggaacagaaacttcttcctgagcttccgccacagtctccaccatctccagcaacggcaattggatatccctccctgtagcttctcctgacaaagctacctccaaaactgagtccttccgaacaattggtgcttcctctggctcaatcttctcttcatcctctctgcagtcaccgtactcgctcgcttcttcaccaagatctccgcattcagaggtctccactgcttccgtctccagtggatctacttgtcctgcttcacaaccatcatgtagggaaccatcacactcacggcatccagcttctttagtggaaaccgctgaatcacgagcttgctctttgcattccttatctgtgtcagcaccatcttcgtcttcctcatcctcttcctcctcttcgtcgtcgtcgttttcgttttcatccttgacattgtcaacctgactgacatttgccgctgcaggggagccccagaagcgagtggctaatgcagccatacgaacagggtccgacctgcagcgcatcagcagcagcgcgtttcgcggcgggatgcagacgctgac

SEQ ID NO: 54635 - DNA, 2028 bp, Oryza sativa
aaggtagacgagatcaagaagatcgtttcccctgaattgattcaaccggaaacggaaaggcacggccgaatttggaaagggcgacggcgcgtctcggttagggttcgaccgcggcgatggcgcgaggtagacgacgggcctgacaggcggctccacctgtcagcgggcgaacgcgcgcgcgcgggggcggctcgcatgcgggccggcttgggccgagggagagagagagagaggtttgggccgattttcggcccaaagccaaaagagaaatttttaaaaactttttcaatttaaatttttcatgaaatgcaattccatttattaaaaatacttccttggctcaaataaatcccagaaaaatttaggaactatagaatcaagcaaagtatttaataaaattttatctagccaaattttatattggaatttattatttaaaattacgtcttctcttgtaggcttttaagaatcaattctaataattccaattaaacaacaatttatatatatgggtttcttagggtgtgacaccaccacacatgaagacaaacgaaaaacagcggaagactagggcgacgaccacaggcgcttgacggcaggcacgagatagacaccaaagccttcatcatccaggaactcctcttctaggtttgggaaaaactgagcaagactgaatacaaccaccgtacttaacaagacacacccacgagtgcagaataaatgcaaaggagtacaatggagttataatatcgggggtaggggttgcataacacatcattacaagacacttaactgctcaaagctactttaagaatacgatcctagagctatacaatattattactcaaggccgtgaacccacacgtcaaattaaaaatgcatattttaaatcattgttagaaattattttaaaagcctacaagttaaactctaataatctaggaaaattttcaacataaaattgagctagataaaattttattaaatactttgcttgttcctctattttctagatttttctgggaattatttgagcaaggaagtatttttaataaatgaaacaacatttcacgaattatttaattgaaaaggtattaaaaatcctccctaagtcgttgggccgatttcggcccaactcccctttttccctgcgcggccaagccggcccaagtcggcccaagccgccgccgcccctcctctcacgcgggtcaccgacatgtggggcccacatgtcgggcccttctcctacctccggccggccggccaccctagcccgagccgcccccttctcccttcaaatccgcctcaaatccggccccctcgagtccgattgattgaggggttttgatcccgtcatcctcctctatcttcactcccaaaaatcggagcaaaccgttgagttttctaaccaaatcgaattccttttcgaatttatccccaaaaccgaatttcgattttcttggatcgatttcttgcggtgggagtccgatctcttcaatccaaggctataaataggaccccctagttgtcctctttcgtttgccccctttcccgagctctctagtgcgccgtagagccgccgccgccggcggccaaccaccagccgcgccgcgccgtcgccctagccttcgccgctgcctcctctcaccgccgtcgggtgcgcgtgattgagggaaagcccggccgccccttcgccgttgtcaccgaccgccgtagagccgccgccgccgccgcgcctctcgtcgccggccgtcgtcggtcgccgttcgtcgttttggtgagcaccattgggttcgtgtcgttgccctctacgtgtaggtgtcctccaaaaccccagccgaccctcctagcgccggcgaggtcgccatccgagccaagccgccattgatgacgtcaagctgacgtcatcatcccctctttttcagttttttttaatagatgaaatagattaaaacttcggaaaatcataactaattaactgtagctccgattcaagtggttcaagttgctaaatttttctaaaattga

SEQ ID NO: 54636 - DNA, 769 bp, Oryza sativa
agcagaagttcaagatagagctgccactggttactggcgctgcaacatatgcaccgtttgttctgaagcgctgcaaatcggagccgatgcgatctcggcacggctggcgcccgatgcctgcttctggaaggaccggcataggcccctcaatgccaccggagttggcttttgattccagccgaacacaacctctggtatgcctagttagctaacgagtgagttgagagttttcaagctttgtcgtgtaatagtgatgaagttctttcatgcttggtgctgttatgtgatgtggacaaacaaataatagcatgttaagttacatcagatagattagggaggagtatatgtaaatctcttggggttgcttcatgtgtgtgctaaattccttttttcgttgatgatcatgatgttgtgcagtgcagctatagttctttctttccccccatcaacatctgcttgtttttgccacatgttaggtcttccttcaacattcagcttcatcattccttcatttccttgcaaataagttattgatccacactgccaagttggtaggttcacatggcttgatttataaaaaatgccatccagtcaaactttagtagcattgttgatccattacatattgcacaattagatacttatcccaattggctgtgaaactgtgaatggtgtcgcatcgtcgttcaatttcattccacctttattctgccatgacactgtcttgccgtttggggtttttcccgttccttgcttggtcgcgttattt

SEQ ID NO: 54637 - DNA, 1712 bp, Oryza sativa
ctgcagccctaatttcagtggttgcttcgtatcccacagtaggtttgaggtgggtgtagaggtggtgacagcccgcaattacactgaagtcctccctgtctgggtacgcaatagagccatatctgggagcagcgggctggtcagtgcctgatgtatcgtgttaggattaaattgagctttcgccggatccacccaccgtcgcgaagccacaactacacccgagggcggcagatccggccctcctgagggcggcgccgctggatccgccgcccactgtcgccgcccgccgttgcgaagccgcagccattgccacggctgcaccttcgctgagccgccgcccgcccatcgccgcccgtcgtcgcgaagccatattcattgcctcccgttgcacgaatgcatcattggtgtggctttatgagtacggtggttgaactcagtcttgctatttccttcttttagaagtggagcgcttttgagctgaagacgaagttagaggaccgaggctcaaaccccagttgagttttgtatgtggagtggagctgaagccccgctatgatcgcctttttccgttgctgctgctttcttttcggtgtgaggactaagcgcctcttctgtaagtatgcacgctttatttatgtttgaatttgtatattaatttgtcgccggtggcgagggtgggtgtgatggacttgggtcgcccggggtgtccggttgtccagcttccggattcactgcggcggacgaggggactgcctactccgggttaggggtcggggtgaaaccttagcatggtgtggatggttaggggagggttattcgaagggtcttgtcacaatcactcgacatggtgatgtgcccgcgcaggcatggtgacatgccggtagattgtgtcttgtgggtacagttgtgcacctttggctagagtaaaactattcgaatagccatgcccgtggttatgggcgatcgacaaggaattcaccttcgcgatgattagtgctcatccccttaataattggttaatgaactggtgtagttcaggtggtttggttgggcctgttcaacgtggtgtagcgttgatcagtagagatttattattatcttaattaatcaactgttttaccattttcaactataaatgctttacaactgcctttatgcaaatagccacaaacatcctttgcctcccgttgcatgaatgcatcattggtgtggcttgctgagtatggtggttgtactcagtctttctatttctccctttcagaagtgtagcgcttctgagctaaagacgaagttagaggaccgaggctcagaccccacttgagttttgcctgtggagtggagctgaagccccactaggatcgccttttccgttactgctgctctcttttcagtgtgaggactaagtgcctcttctgttagtatttacgcttttattgatgtttggatctgtatattaatttgtcgttttgtgtaccctggctgattcctggacaaagatttaatacacaaaatagtctggaaatttgggctaaatttctcgatgtgacatcgctggtcgtcgatccaacgtggttgcctgttggtatttcttaacgatattactagaaatattcattcctagaaatggcgacaaaatagtcctggtatatttatggctactgttggtatttcttatgatcacagatagaatccgcaagcgcacggatataccg

SEQ ID NO: 54638 - DNA, 1209 bp, Oryza sativa
caaaagttgtggtattaattggcacttcccaaattttgtggtattctttgaatttggcaaaatctgtggtatggatggattttcctcgatttgaaattgagaaaaggcatactttatagaaaaggttgggcctgttaattgtgctgacaaacttgacacatctagggatatgaagcatctctatcaaatcaatttgcactttatttgtcgcagttgcctgcaaaaaaagaagcaggccttatttcacattacagttaaaatttaattattgtaaaaaatggatattattttcgcaactcacagttaaagctatcataggaacactgggaaactggacctttaaaatgccaagattcttgtagtctgggcgaaaatcatggccccattgactacagcagtgtgcctcctgcatgataacacttaattacaatgataaattggtaatcgcagactctagatacacatgtgcttaactgcttaaaacatatgtcaactagctatgctcacacttgataagatcattatatgatgagaaacataataaaaactaaaaaccaatatgaataacttataaaatgtgaacagtgaataaaccaattcatcataactgctcattttgtacaagtgattagcacgagtgtagacaatggcaacaagtcttcttcgttttttttgcaaatcatttttttctagtccaagaaggatgggttagtatttaaatagtaaaacacactcaaagcaaaacaatattcttaagagagacagagtaagcaaaagcatgtacaagcacatcatccaaccttaatcagagtaaacatgctttattgtgtggtaaaaaactcacatctattgcaatgagagaaagacgccctgcatggtggcatttctcaagcttagacatgaaccttttacttttggatatcttttcaggtgtcacatacaatatcttcagttctccttcacctttatcaagcgccttgtagacgaacttctcgacttccttattggtagttgaagccagcatgtatgcttgtatacctaaagctgctagtcccatgacctagaattgaacaaatcaaataatggtaatgatcatatacaagataaaataaattctcatggtagtcatggtggcctagacaacaccatgtcagcaagcagactaggcaggtgtacaggcattgcctggagaagacaagagacttaaag

SEQ ID NO: 54639 - DNA, 6442 bp, Oryza sativa
  unsure (1)..(6442): unsure at all n locations
ccagacagataaagctttgacaacacagatattatcctatctctctcatacgtgatgtccatgggtgtccttttgtctacttgatgacttggaaaatgcagtgaaaactacgatcttgaaagcttaaatacctggtcctggataagggaaagcaaaggactaacaaccaatgtaattccatcatgaagtacagcaggtagttgatagcagaggctcttccctccaccagcagccattatgaccagtacatctcttccactcatgatggcattgattatctggaaggttgcaatatgcttaaaaggatgcaaaataaagaaactgtaagcagtatagcaagttgtggtatgtacatctagggctaggctcaacagtaccaagagaacaaaagggaaagaatgtggggatagtaacataattctaaaagattatttctttttgagcaacacacaagttaatgataaataatagaatacatatagcagcccatgtatgtctgaagcacaccaaatatatggtttcttcgctaaatgaaatgattatatgaatctcactttgtattttatttcgtagttgtaagcagtgtccaacataaaaaaagataacttctactcttcttagttgtttaagcagtgtccaacataaaaatatagataacttctactaaccttacctctctttgattctgccggtatgaagaaatcccaaatacattaaaacgaacatcatcagcccgagagtcccataagaagctcccagaccaatcttttggaccaactgaaggggtattattgattgtgttgttggatgctttagatacttcgagcatagctttcagctgtgattcacgctcatacagctcctcttgacgatcaatcagtgcactaatttgccctgagaaacatgaatttaagtgagaaaatgaaaggataatttgtaatatgaggaaataacagagcactagcaccacaaaggaaaaggtggccactgctgatcataatgcaagtgaagatacataatgacattagcagcctatttatataggcatagttgctttgtttcatcatagtgtaaggtgataattagacttcatgtaaattaatgcaagtgaagatacataatgacattagcagcatatttatataggcatagttgatttgtttcatcatagtgtaaggtgataattagacttcatgtaaattaaagactaaatagtcccggcnaaaatttatgaatcccggcaaaaattaaagactaaagagggatgtggttttgtattatttgtatgaaagtacctatggatttataacaattagtatttgtgatgtaatatagacagtgataaaatattcatcaatgagaaaaacggagcaggagatgccaatctaacccccgaaaattgttgtacttgctataatttaattcaactgcacttagatatggtgagctagaaacccctgcctcccatttatgtattacacagaagggttaatcacttgatctcatccgaggaacgtttatgaatcaaagggatagcacatattgcagaatatgcatgattagcggtgaccttggatgtcatcaagttctgcctgaacgagtaacaattctccctgaatgttgtcttcctcatacatgctgcagccctgcacaatgacaagggaaaaaaaaggcaactgactttcttagnnnnncgctgccttaaaaacgagtattgagttagagtccatgaaacagaattgtacactttgagttgggactatcaaaaggcatactcggacccaacatcaaaacacaagacctaattatagttaaacaattgaggtaaactaatactgacatgtccatgtataacaagcatcgatcggcatatatatggcatttgttcaagagaaccagttagaggctgatttggtccattttcagaaatacagaatcctcattctgccacataataagtaattctttttaaaaatagtctagggcataccacatagcacatccatcttttcaaaatcaaagcaacacaacagttaggtggtgaatcgaaccgaaccgatatggaggcaggtggacggaggtcgggcgcgtcgccgtcgctactcccccaaacctgcacgccccgcccgccgtgcgcgcgaggaggccaaggccggtggaggaggccgtgcgcgcgaggagggcaaggcaggtggaggaggctagggtgtctacgaggcttctctctctacagccgcgcgcgcgactgaggcgaggcgacgcctgcgtccggctcgcaccgcaccacaccacaccgcagattggggaatcgggagaggtaggtagagccgaggtgcggtgcggggaagaagatgaataaatactactactccttattacaagtcgttttacttttttttccttgcaaactttagatttttaacgtaaaacaaacacattatcaatatatatccatattaaatttaataaaactaatttgattattgctaaattatctataaacctagtcaaatttaacaaagtttgattaagtaaaaagtcaaaccaggggtgtagcgattaccccgcgcgttgcagcggaaaaatttagaaatatgtaaaaaaaagctttaagaaaagaaattataatatataaaaagataatattttaagcttgatatctggtgatttaaaatttttattgtatatgacacataaattgttatataccaaacatgagaaaaatctaatgtgtctataatttatctaggtgacatgtatggttctaatggatatttagatttattataatataactacagtaagtaagtatgtggccctatgcatgtcaagcttttggttctaactatataggatatataaattacgagggtaccctttctggaaaaggaaaagtacctatactaatcgggcagtttatacgagttctcaaattaatgaaaaaaatctggtcgttgatttgctagattgtattatcaccaccgtagatgacaaaatcaaattgtgggacacttttaaagaaaatctaatctatgtaaaattgtgggccacttttaaagcgaacctaatctacgtccgtcggtgatatgggcccgggggtaccccgtacagagggagaaggccaccccaaacccatgtggcaccccccaaggggggtcgggcccggggttggagcggtggctgcctcccgagccaggggtcggcccgccctgagcccctcctcgctttgattcgcgtgtgtgccacgggcttgcattcccagcgtccaactaccgcgtttaatgaggtcctgtctgctgcggcacgccacatttaatgtggcgagcatgcacactaacaggtcgcttgcagcgggaatgaccgatgtgacgacggataggcataggacagggcactatgcacacgcgcctgctgctggcaggggacatggcttgcgtctgccccgtcccgtcgccattaatgaggggtttttttgcctctcccttagactcggaccaacattttctccacgccggtccgttcgagagatccctaccctgtggtggagccggatggccagaaatcatcgacatttaaggaggaatgacatgggcggacgcccacgtcattcggcatgatgggatggggcccatgtcacggtaaggcgcgcatggcttcacacgtcgagaggacaagacacacattaattacctataaagaatattattggtaaccccttaacatataaaaagatgtccatgcgtgggggaaaagggggacggagggcggaaagcgcttttatttcctcaccagatccaaccacacacaggagtagggtattacgcttccatagtggcccaaacctgtatagaccgtttgtgtccccattgctcccgaggggcccgaccccctctgcatcaccttcccttcatctctcaaaccttcacccgtgtccccggtccgaaccaaaagaggggcccccacagtcccccgcttgaggagtttaccctccgacaacgtccgatatatttcaaagcccttctaccgatcttatctcgatcagtaacgggagaccgagagcagatgatgttgatgatcatgagatcacaagtagaccagagctgcttgagtcgctattcaggtgccagatcatattggcgcgatttggggctccccctgtatacatcatcagagcctccacaagcaatgcagggttttgccatcatagggggtgcttagatctaggggtgtaaagttttgacgtgtcacatcggatattatatagggtatcgcacggggagttggggcactaataagaaaactaattacaaaatctgccagtaaaccatgagacgaatttattaagcctaattaacccgtcattagcacatgtttactatagcaccacattgtcaaatcatggagtaattaggcttaaaaaatttgtctcgcaaagtagtcgcaatctgtgcagttagttttttaagcctatatttaatactttatgcaagtgttcaaacgttcgatgtgacaaggtgtaaaattctggatgggatctaaacaggctcgctgctaatcattgtgttgatcggttgctcatctaatatatattgtcaatttttgcagtcaactgatgttaaattgaaggtaaattgcatgttaaggttccttgaatatgggttctttcttgagaattagttttctttatactcgcagttgaataattaaatcttttgatgcaaattagaatccttcaaaccagctgaaaatagcgcctcctgcgtttggcgctggcatagatagcggcaggagtcgacgcgtcacctccgctaggagcttgtgcggatggtatttttgcaaaaaaaaaacccccttatttccgtagataatatgttaacaaagtatatgccatttgctgattccattttattgtacagcttgagaacgaggtggccgaactgaccttctgattgcttcctgcagatgacggtgctccctctccccgcagtctcccaccatcttctcttgtcaatgtgtaatcatcacctctattactgttaggttcgtaccaatccttcccctcaagtgcaatcgcatttgtctgccgctgttccctgtgattcatgaatatattgtccttgtgattcagagctttctgatttgagttttcaaggaaagcattaatattatgtgattaatattgtccaacttaactctctaatatctcatgtgcagtctagatttagaaaattatactaaatatgttcttaaatctatgttatttttactttgctttcttatatttttagaaaacattgtgtgtaagatgtttttagttcacaaggattaaacgtacatggctacttctaatgttgctgataaaatttagaggcggcgcatgttgatcgtttattcttttgacatggtcggcagagatgatggatgggaaatatccagtgtcactgtttttttagaaatgtgctcaatgtacatatatcttaattgttcgctgcgactgtttttcttatattttgccatatagtgattatgatgatagctaaattcatggcttatttaataacacaataccatatcatattcacattgttttgtgtaactctagctatagacttccttcgtggtttatatttcagtctaataggtcaggatagagatcatttacaactcaagagttcaagtgtacttttggaagacaagaatatctcattgtagttcttaactttgtacatatacatctattaattatcagatgaactattttatccactactttctctctgtcaatggagtgtgtacatatatgcatgtataattatcagatgaacgatgacaataccttctatttatacagtcctttctgtaccttctctagccgtgatgtactccgaaatttaacttttaagggtgtgtttgggaggaggggttccacacacattagcgcatgatttattaagtattagcttaaaaaacttttgaaaggattaatatgatttttttaaaaaaacactgcatactatgccaaccaattccaattcctgccttaagatttcatgacaacattatatttcttgcaaccaaaaaacagaaacctgccacttatgtcagataaactgatcgaatttcttttgctaattatatcaagctaaaactgccaaaagtaatcactaacactccattctgtctccaccggtgcagcgcgcgtcccacgctagtctgaattaaataagatgaatcgtagtgcatgcatgtatactctggtcgcaagctgctgcgacaaaaacgtgtttgcagtgtattcttgggtgcttcttatctagaaaattgccaatctaaacttcagctctaacattaacgtgggcagagaaaatcaacacaattggccatggcaccaccacaccgtgtatgcctaatgggatctgtatcgctgccttgtcgcttggga

SEQ ID NO: 54640 - DNA, 1006 bp, Oryza sativa
  unsure (1)..(1006): unsure at all n locations
tatcaaatatcgtgcctcggtgtcgtcatcatgtttggatctcctatgacgtttcttccgcatttggtttctgatgtgatttcggggccggttttctaacaagtggtatcagagcctgcgggagatccatggtagaggtacgagggaggtgctccatgccgcgacgactacacagggtgtccagggacggacatggacgcaaggtggagcacggcggcgatcaacggaatttgatcggtggatcgaacacttcaggcggcggtctgaaccgttcgatggctgctttcaacagggagatgactagacgtggtgctcgggtcgatggcggcggaagcgattggcgatccaatcggtgggtcggacacttcgggtgggtggcctggactttccggtgagctactctcaacaaggagacgtggggccccatgctcgggttgattgaagctggaggcgatcggcgttcttggtcggtggatcgaacactctgggcggggtggcctgagcctttcaatgagctgcgttcgacagggagatggctagacgtagcgctcgggtcgttcggtggctgggaagacggcatgcgacttgtcggcttcggctcgcgactagattgatggcgttcaatcggaagtcggagcgggtggatccaacaggctgttttggaggtgttaacgacaagtactgcatggaggattgctacttagcagcgtacatgcaatggattgctctggaaccaggacgttgctaggggtatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54641 - DNA, 851 bp, Oryza sativa
ttagtaaatctatggagacatactaccaggtacatctaattatttaaccaactttcttcttttctctgactacttggtccattttaaatagatcttattgattttaggaaagtggaagggcagggagagatggactaccttcagaatgtattctgtattatcgacctggtgatgttccacgccaagtaaactaaagatgtcttcctttttctcttggtgtggcttcttgcttcctcttatcgatatgctgttttttcaatgagcagagttcaatggtcttctatgaaaactgtggcctgcaaaatctttatgacatagtacgatattgtcaggtaaattcccagtgctccgccaaaatgaataatatttgattttcttaattctttataccctcaacatagattttgttagtctcagttccgccccttttctactcataactgtacaagaaagtcatttatgtataatctcacactgctgtttaagtgatcaatccaactgaacttcctgcctggaattttgtacaacactccaaaaataacttccactgaaaatgtacaggagcatagggatcaatatacctttccacagaaaatggacatcataacttgctgtcggatctctctctctaggaataaaacatgcaataggtccgagataacataggacaaaagttgttcatacaacgaaaagtaatattgtaaagttttattgcaatatacttatactagagtcctactcggaactgtgtgaacagacttaggcctatataacaagtaataaagattaggaaatagtttgaagctcattaacttacatgacctgagcatgctatatttgccataattagc

SEQ ID NO: 54642 - DNA, 5832 bp, Oryza sativa
cctgcagcccttatactcgatcgggttttggtatgtgtgactgcaaatactgccatgcgaattcacaagtttattaatggtgattaatgtccattatgaatctcacattcaggtttataattcacctagtactgctactattgaaacatttatttggagtacttcacttgtaacattaaatgtatgtttatataactactgcaagttctataagaactacttcaaccatggacaagggctgagcaccacacactccagacccagcccaaaatccaagaccatggtgtaataccagatctggtttagttgtatatttattggtttgttttatttttatttttttctgtatcttataatggttttatattccccccatttgtaaatgtagctgtgtaagacagcagaataagaaccaggttccagtggttgctatactcctggctactagctgggatttcataaacttgcataaaccaactggttttgggaaaccctgtagatttgaaatgagcattttgctttgataatggcaatgtggaaaatagtgctaccttttttctggttaactacacgacacattctctataattaccatgctgcattgtcttgtggtcaaaataattatattttgccactaatgttttgagaaaaaaaatcaataaacgttttgaagcaaaggtgtttgtgcttgtattgtggccatccccaatctttgttttccaaaaatgaagcttttgcttttataatcttatatatcaataaaaagcagtagcaagatcataacattatgaaactattttaacaaaaagtctaataatatggtcttcacattttcatagctttagctgctttctttgtttgcctcaaagaccttgatttgatttgcaatgattactgaagaactgtttatccctcttagaaagaagaatttcagcatacagcatatgcaaccaatgcatatgttgccttgggaccactgtggaagccagcactacaaggtaaatgtttctttctcgtgaactttccatcttattttacgagcgatggatgaacatcttatgtgtaaagttcaacgcttgaacacaccactatctttgttattgctagatggattgtgaccgtacactaattaaaattctggcccttgacctgccttaaactttgaggtttttcttgatgtggtcatgtgttcatgtttggataatttaggaaattgtggaacgtatgtgaatatgtttttttcgtatatatgcagggaacagaccggtcaagcttagcgttgcttttcactctcaggataaaggtagtggatccaaacggactaagcgcaaccagatgagtaatttggaagctaagcttgatgacctgcggagagagctctcttccagtaatggaggcgtattcccacatgctgttctttctgcccagcaaatttccctcctgaaccgccaaaaaccaaccactgttgctgaggtgaggtttggttcaaatattctcttatcctacttagtgctatcctaagtgtatatatggaccgtctctaatttatatgtacattttatctgcggcctgcagcttgaaaagcttataggaaaggttaagacaggtaagtacgggagcgcgatcattgagctcatgctgttacatattgattcagaagtagccggaggaaaggcctgtgcatcgaagaggcaaaagaaagataaggaggatgttatttgtgttgagagtagcgaggaggaggatgtttaagcgttatcatggtttttcttttgaaggctaacgaggcaaatttattgttgaaccttgagtgaaccttgagttgtgttgggatttaaacgagttctgaaatatatgtagttgaggaattacagtgtcaagctaaggcaaatatggaatatctagggaatgttttggtttattgtcattttcaactttaccaggcttggtattttttagaaaaagcaacaaaccatcgtccgctaattagctatcatatcacaatttgataattacataagttcacttataaaaaactataccaaaatttgacaatccttcaaatcgaacacattctaacattggccgtgtttagtttcatgcccaaaatttttttaatgtatatggacacacatttaaagtattaaaagtaatcaaataacaaaacaaattatataatcctaccgtaaactgcgatgtgaatttattaagtctaattaattaatcattagtaaatgtttactgtagcaccatattgtcaaatcatggcgtaattaggctcaaaatatttgtctcgtaatttacatgcaaactgtgtaattggtttttttttccgtccatatttaatgctccatgcatatgtccaaacatttgatatgacatttttagccaaaaatttttacaatctaaacacacccgttactaaaacttcgtagcattgtcatattttggaaaggttgacttttttttctttcaaaccctatttgggagagcttgaaactagtacaactctcagaatctctggctcagaatttttcccgaaatagggcctgactgatgttatagaccggagaggtcagaaaggcagcatgttggaaatcaaagatgatgcaatatcccaacacgttgaaatgaaacttgggaaataaaaatggaaatccaacaaaacttgaagccaatttggcatggtaatgagtggtgccgccagtagagaagtgctattgccaattagtagtactccagtagcaatgaggagaaactaatcaactaataataatgcgagcaacaatcatccattctccagtccattgtgaggagaaaattagtgagagaagacgattgttgattcacattcaccatccaccggtgcggagctgagagagaagaggagagagggagcaggagcaggagcaggagctgctcagtgggagcgggcggcgtagcgctcgacattttggtcgttgaggttgatgccgacatggcgtccccgaggccagcgctgacgtcggcgaggatctccggatcgctgtagtgggtgacggcctgcacgatggcgcgggcgcggcgcgcggggtcgccgctcttgaagatgcccgagccgacgaagacgccgtcgcagccgagctgcatcatgagggcggcgtcggcgggggtggcgacgccgccggccgcgaactgcacgacggggaggcggcccagctgcttggtctgcatgaccaggtcgtagggcgcggcgatgcgcttggcgtaggagaagacctcgtcgtcgtccatgttgcggagcgcgcggatttcgcccatcacggagcgcacgtggcggacggcctcgacgacgttgcccgtgccggcctcgcccttggtgcggatcatggcggcgccctcgcggatgcggcggagggcctcgccgagcgtcgcggcagccgcagacgaaggggacgcggaagttgtgcttgttgatgtggtgggcgtcgtcggcgggggtgagcacctcgctctcgtccacgtagtccacgccgatggcctccaggatctgggcctccacgaagtggcctatgcgggccttggccatgaccgggatggtgacggcgcgcttgatgtcgcggatgagcgccgggtcggacatgcgcgcgacgccgccctgggcgcggatgtcggcggggacgcgctccagcgccatgaccgcgcaggcgccggcctcctcggcgaggcgtgcctgctcgggggtgaccacatccatgatgacgccgccgcgcagcatctgggcaaggcccaccttgacggagaaggtggcggcggggggcttgcaggagaccttgccgccgccgtagagggccacgacgccgtcgtcagaggacgccatcctgtggatcttgccctggacgaggtggagtggaatagtagtggattggtgggattttttggcgatttgggatggaatgtgatactgatatggttgcggtggccgtgctcgtggccccaaatgaaaacgttaaggtttatctttcccacggactttccccatatttcactcaaatttactgtttaaattttcaaaaactgtcccgaaatctacttttatcctgtattgaaacctcaaatttatgtggtttttggttgaaagtttcttatcgagttaaaaattttctagtttgagctgaattttttctccgcacaagtagaaagggggtgtatttttttttccgcacatgtagaaagggggtgtttagatctaaaggtgtaaagtagagtgtcgcatggggtgttcgtgcactaataaaaaaattaattacagtatccgtcaagtcaaatttattaagcctaattaatccatcattagcacatgtttactgtagcaccacattatcaattcatggagcaattagccttaaaagattcatctcgcaaagtagtcgcaatatgtgcaattagttatttttttagcatatatttaatacttcatgcaggtgtttaaacgtttgatgcgacaaggtataaaattttgggtgggaccttaagtttctattttgaatcatttgttttttacaattcttagttgaaagttttcatatttttcgaataaaatttttaccagagtttaaagttactaggattttaaaaacaaggggtgtatgcacggtatactaccataatccgacttcttatcgtatcagatatgggaacacggctgcacgtagcaaaaaccccaaatagagacgtctgcgtgatcacggccctgactcctgcctggcgcacctgcgcacgatagcaaaccgcccacacagcacgtttatttctggtaaaacttaacgaaagcctcaactttgtaaaggttagtggcacagtttaggggtaaaacccaaattattgaccaatttaagctaagcacgacttgtctgcaaattttatggccggaggattattgggcacgaattctataggtaaaattttgcatcagaataggacttctcccagtcccaagatcattataatactctattttaatataggctttgctgacagagtagattgtacacaagccagatggtattctttatcttcttgtttttccagggcgaaccctgctcggctccgttcttttctccaataaaagttggatgaaattagatattcatggcacgttttttaaagtgctaaacggtacgtttcgtacgaaaactttctatatgaaaattactctaaaatatcatataaatatatttttcaagtttataataattaaaactcgattaatcatatattaataccacatcgttttgcgtaaaacacgtattctttatcttcatcttcatctttatctatatgagtttcaaagggttcccaggtgtaactttatttcctcctactcttttgagtctgaaatccaaataagtcacatactccctcaataagtcattactctcaccgtttcatactacaagtcatttaaccttttacttagtcaaatttctttaaatttaatcacgtttatagaaaaatatactaatattttttaatataaataaatatatttaattttaaattttaaaaactaatttggtattgtagatgttgctaattttttctataaacttagtaaaacctatatttacctaagataaaagccaaacgacttataatatgaaacggagggagtagtatatagcgaaatgagtcacatagtatatagcgagataatcatgtgcattgtctcacttatgatatatagcaggcagggagcaaagcagttaatatcatcctaaatctgattttttttcagctcgatcgagctgaagcctaatccatgacccctcgtcatcagctagcattagaccc

SEQ ID NO: 54643 - DNA, 1193 bp, Oryza sativa
tcagacaagctttgaacataaaggcaccagtcaagcaagttcacaaacggtacaagcaatttgcattctgtaccttcaggtggtctgcgatctttgtcatgttgtctatgtactcctctagtggcacatgaggtccaaggccggatgaatgggcagcaaccgaatcattgccaccaaagtaaactattaccaaagaaggttgcacgggcgaatcctaagacaaaaacggagtttacaaagtaagtaatttggtaacagtcagctaaatttgaacctgcaaatcgtaatgaataacatcatagtaaataaaatgtattaattctggacaatgattctcaagactatctagaaatgggatgctgaaagtactccagaaaattgttctctggcacatttgaagagtaacataaatcatacaacaactgagccactaaatgatagccaacctgcctattccaagcacggaaacatagagccagatttgttcttgttagatgaacaatgaacaaaagaaggggatatcactaagataagaatcatcagattagaagggaggacctaagcaagcatgttagtcaggaagtacaaccacagtcagtaccaactacccccaaccaagttaaatcatccactccacttgatctggtcctagggacaagagaaaaatgcccatacgtaccttgggaaaaattttgtcaatgacttgaagggcgcgccttgagttccaaccaatataccctctgagaaggatatcagcctgaatgagttgagcattagtgaaatgtatagtatagtatagtaggagaccgattaatacacacattatgctgaaaatggcacaagcaaaacagagggtatttgtgggtgggtcgacctgggaacaggacactgattcaagccaaaatgaacatgatagatgcaactactcatagatgctcggaaaatcctggcctacaataagtcaacggacaaggaagcatttttatcttgaaagacgtatgagttgtttaagaccgccaatggccatagaaaggaagtttcgctgagccctatgttttgaggcacttgtaaccctaggtttagcagtttgtttaaagaacatctccctcccactcccaagcaagggcagactgaaatcagttgccccggagtatatacctttagatatagcatacttcctcgttcctatcaaa

SEQ ID NO: 54644 - DNA, 2775 bp, Oryza sativa
cctaagactctctttttgtgggttcctacctatttagaagccatgtacctatcttttgcccctgctctatcagtatacacacgaggcaaaacttttgccttcttttcaaaaaaaaaatcttaatccgtataatatactctatatacaagaggaatcagaatgtcatctgcaatatgcagtgccccaactttgaacgatgcatggatgcgcgcttttaattaggatcggaagtgcacgcaaaagacaaagaacagatatgatcacttcgtcagttcgtcgtcctcactagctagctaactagctatacgtactgtcgatcagcttctagctagtctttgttaagctatactaatatgtaagattaataaagatgcacacagttggacataactgattgtcctataacctttatatatatatataattattttaaggatctaatttagaatttcaactttcacggtgtaggaatagggctggatatgatcaatcatattgcttgaatctaggtaattgatactcctaattaatcatgtaaaatttctagtctagcctgaactgatagtaatcgacacattgagctaaggttcagaactgcagatcagcttttaagtatatatggagggaacgggaacagtataaataatactaggaagaaattaaaatgcatggtaaaaagagatcgatcaaatttgaccatagaagttgtatacaaacacatacaatacaatacaaaatcctaataccgatatgatcgaatcgactggatacaattcttcagaagagaatgtaatcaatacactaatatcaagcttaattcttctacaacactggcatacatatatttatatgcactgcacgcatttggaaggagggagagagagatgtaagcatgctgggccttgcaaactaattaagaaacgaattgatccaagagaagtcacaaggggaagaaaaactgagaaattaaatgaagaagccagctaacaagacctatatatatatatacggagagactagagtgatccacactggggtacttgtcaatcaatttcatgcagattaattaagcgtgcacaacagctttaggaggagtactagtcccaagcctaagctctagatctagtactgatcctgcttgttgatgctgctgatccccaaccacaagggcagaagcagaagcaattatagagctagggcttgcggcggctgttgttggtgtgatgatcagtacctgatgatgatgatctcctccttcacatgacgacggcagctgatccaccaaaccaagcctcctcctcttgtaccttctcccggccggttcgtcctcgtcctgatctgcaactacttgtacttgctgtctcggtaccctcttcttgatggtttcttgatctcttgctagcagtagtatgtcgttactgcaagtagtattatcggtggaggtggtgctaggtttagagaaagaggtatagtaagggccagcttgctgatcttggggtgcttcagcttcttcttcttggtggctgggggaggaggaggaggaggtctgcctctgtcggagacgagcccggtcgcggcggtgcacgttcatgtggccgccgagcgcctgcgccgaccggaactcgcgctggcagaagctgcacgtgtagaagcgcggcggccacacgcagccgccgaggttggcgttggccgccgcatcgcgcgcgaacgcctgctcctcccacgacgccgattgcctgatgattcgtcttctccctgccgatccccacatcacccactcctcctcgcctttttgctcctccattactgctgctctgctatgctacctagctgtggatcgatcgagttcattaaagcagccaaggtactacgtactagctaattaacctcctttttttgatgttttactggtgcagcagcagccaacttgtaaccgagttagtagcagagattgagtactccactagccggcttattaagtagcactagctagtaccgatcgacaataatcaagcggctatagctcgtctcaaaataaataaatctagtacatattgaatgtgacgattctaatactacaaatctaaacaggctaaaccaactaattagagcgagttgcggtgtgtaagaagcaatcagtcgaccgagcaatcaatcaagaggtgcatgcatctccgtgtgcagcgagagacacacttgacggtcgacgatgacagaagactacgcatatttgcaggaggaagaaattaggagaagactagtggaacgaagtctcgcaagctaagctaagctataggagaggccggccagccggagaagaattaagcaaggattggatcagatcagatcggtgtatatatgtctcatgtgtgtgtgcgcgtacagtgtatgattggatgacatgtcttctcctcgatcaggttttgttctttaggtatatattggttactgcactgtgcacatgtggcctgctagctcctctttaatttattcattcgtttccttcttgggtttattaatttcagaggaaaaaatatgtagcttaattcattatttaatttgctattatatatgtatagagggaagcaaattaatttctctcacaccagtggtgtaattaagatgtttttttattggacaaaatgtaaaatccaggagcatatatataattggagaatgcgttgtccggcaaaatcatgtttttaaattatatatttgttggtcgatcttaactaactggtcattgatgtgtctctgcaattcattcaaggcaat

SEQ ID NO: 54645 - DNA, 2270 bp, Oryza sativa
tgacaacaaaacaggcaccgctactttgcactacgccaacacagtctcgtcaagcatggcatccctcactctcgtcaagccaccaccacaaaatgccacccatatcgtatcaaaatttactgattcactccatagtctcaattccaaggagtacccagccaatgtgccacagacagtagaccactcccttctccttaccgttggcgtaggtgtcaatccatgtccaagctgcatcaatgggacaagggtggtgggcacaatcaacaacgtgacgttcatcatgccatcaaccccaattcttcaagcccactattacaacattccaggagtgttcacagaagacttcccagcaaccccactgcacaagttcaactatacaggaagtggtcccaaaaaccttcaaaccatgaatggaaccagggtttacaggctgccatacaatgcttcagtgcaggttgtactccaggatacgggaatcatatcaccagaaagccacccaatccatttacatggctttaatttttttgtggttgggaaaggggtcgggaactacaaccccaggacctccccttctacattcaacctcatcgaccccatcgagaggaacaccattggagttcctactggtggttggacggcaatcagatttaggtcagacaacccaggtattgattttaaaacctatgtttttttaagataaataaccccttctgtttccagacacattgattgagctgttatattgcaggtgtttggtttatgcattgtcatttcgaggtgcacacatcatggggactcaagatggcctttgtggtggataatggaaagagacctagtgagactctgattccaccacccaaagatcttccgcagtgttaacaacatgggattcaaaactgcccccacggagaggagcctattacaagaagggtaattggctttggtccgatgtacggaaagaatcaacggtgatttctaccatgtgctactacttgactcttgccacacatttttttctcctttttgatttttttgggcttgtttaccaaagatagtgcatacagggcattcaggttgtaattagctcttgccatgaccaacttgttccccctttttcaattaatgaaaatgtatatgttggcatgcctcatgaattgaatgtttgttgagaattagagaaagatgaatccgccttaaagtatctcagtcaccaaattttagaaatatgtcgccgctatctcctcctttctaacacctatccagtactccctatcttctctggctggacccacccctgtatagtctatttagtactagatccagcttagtactttaagttactgtaaacctgttcaccgacagctcaatccaaaaaataccaggccagcctcgccatgcctctcgggccaggcttgacccagcttgagcctccacacgacccctatattaagcagccctagtttctagattttcttagaaaaaccttccaagaaacaagtgatggatatctattatcttctaacttgtagtattatgtccaacacaaatagtaatcacgtactagccataataccaaagtagtcactaatgaattggtaaatgttaggaacaggcattgaatataccttacaatgtgccaacacggcatctgatgcatgtggtactccccagcaactgaattattgagatatgctgtcagtatccaagaaataattgtttagcatttgacaagaaaaatcacgctgaaacaagctggtacatgaacacttgcaacagaaaaatactgtaatatgatgtcataccaaaatatgttcaaattttctccttttctttttgaggaaaactgttcagattttcatactgcacaaagcaggaaaagaacatttaacctgggaagaagagcacagaggagagaccatccatttgcgcccctgcgtcgctctaggattgggcgacatgggcgatgtctccctcccctgctgccacccaccacctcctcccttctccacctcaccgccgcctgagcaagccgccggaaaaccatgtaactgcaaggacagcggcagcggggccttccctctccccccggaggtctgaggcctgatcccatggcctcggggacagccgccgcagcaccgggaggcaaagagggagagccggtggcactttgggagtgggctctagcgaccggtggcgcgtggccggatctggtgtctcctgccagatctggtcagagccggcgacaacaacggctcgtcggcaggtgttgg

SEQ ID NO: 54646 - DNA, 3857 bp, Oryza sativa
tggtcggccgcccgtggtgacctcagcggcttatggcagcaagcaaggaagcggttagaaggtggagagtttgttctctattgccggccaagcatcctcttctccacagggctcatccccttctatggcccaagtgcttcagttttggtcgtggggatggcggtgcgagccaggttgagctgcggggtggtggattgggcttggacgttgaagggttggcgcggtggtccagtgacggtcgtttcattgtgcatgatggttgtttggggctttgattgggaatcgttggcgaaagccttgctaggccatgggccatcttgacgacaacgacaccattaggtaccgttccgcttcttggaggcgttattatggcgttgagccctcctagcaccaagaaccttccgcgtgcaacggtgaccattggtggactcctgcaacggctccgaagctctataggcctagagagtttgacgaggccttcgtcgttggttttgtgtcttgctctgcggcaggtgaccatcatttttggttattgccgagtagaacaatggcgcactgcaatctctatatagggttgttggtgctagctgtgtgtgtagaagtggctccttggtagcttgggctgatgtccttcgttggtgtcgaatcggtttgttcattttggcgttcgggtaacatcgcagtgaagtcggagctgttgcgtcgcttgggtggcaagcttggcaacgataacacgtgtgggctactgtgtcgtctctatggcaagctcggtgctgatgcctcatgttgggctccatcgtggtagcttaggttaggttagttattgatgtgttgttttaggtttgattttcactcagttttccctaattaactgggcacggtaaggtttggtaccttttactccttaaaatgggacaccttctttatataaaacgtcggcaacggccagtatgagcctccagaagtgacctggctggcgtttatggatgcagagaaacaacattttctggacgatcttatcaaacctcgtaccagaaaggcagtaatgtgcaagtatttgagcttgacactctactgtattttgactaccattttctgaatcaacaacctccattctgggaggtatgaattctgtacctcactaaagcagtgctaaagttacttgtcaattccgggcttctgcaaatcaggacagtctcatgcaaatcacagcagcctactttcagatttccccaacattaccaagcagcatctgtcaagtgatacaaaagcggaaaccgtagagcttattgctgtatatcatgaaacactctagagcggtgttggtggtgtaagatgcgtagactactagatactcaagttcagggaaacccatagctagagaagaaaggtattttatttgtccccaataatagaagacagttaaatcgtattaccaaccattgttcacaaaggtggccggctagtcgactagttggtctagggatggcaagttgccacatcaatatcttagtattttgcatgaagattccatgcattcagcaagattttcacaacattgcagacaaatcaattaaaatatttacagatcgaggaaactatcccgaattatgaacgaaaatactaaatcaatctaatctaagaggatgacaggagtggaaggcacaagtcatgtcacaatctaatctaatcttaggaggaaataatcgcacaccaaattaaggcgaaatttcaatacttagctaaggacgaatcttgatctgagaggatgaccagtaaaggcagaaacaagacggacctggaggaggaaggtggagaagaagtgcaaaggcgccgtcgttgaggacgaagcgccctggagcagtcgaggtgttgggcgtctgggggcaagacgacaccgacgccgccgccgccgccgtcgccgccggctcggtcgcctgggaatgctccgagattggatcgtaggcctcccaaacaggcccgtcgcacgttgggcttgggcttcacctacaaaatgattaggcctcattaggttgaaggaaaaacttttagaatgattttacatgttgggaaaagttatacacaaaaccttttcctataaatgtttctacaaaggttgatgtagcacctgtcattcggtctttattttatataaatccctactaattaaattaaatggttgaaaactttatttgtatgaactttttaaagtacatatagcactgttcataaattatgtacacaaatttttttaaggccttaggagtaaagccattgtaatataacgttttctataaaaaatttctatgagatgaactatactaccaaggaaattttctataaagttgtacatcatagctttattccttggtctcttgtaattgtacatttcttcgaagttatttcatccaacctcctttgaaatacatgaattttacaaaatatttcatacaacctccgtcccaaattcatgaaatgcatgaattttcatactatctctttgagatacatgaatttctgctaagttatttttcacacatcctatacataccaacaaaaaaaatactatctcttttatcaaatcgcaatgcaactgttctctactttatctagttccaatatatttatcctctactttcatatactctaatataataattacttaaagataaattaaacttgctctagcactatacaaacactagagaacaactgccacctgcttgctctgcatgggggcatttattcggatggatgtagtagtaaggctgagtttagttccaaactttttcttcaaacttccaacttttccatcacatcaaactttcgtatacacataaactttcaacgttttcgtcacatgtttcaattttaaccaaacttctaattttggtgtgaactaaatacaccctaaatgtgattgccaagctgcaagcctgcaaatcttcttcttcttcttcttcttttttgagaactcaagcctgcaaatctgcagctgcaactactcatatgtttggaattgaatggcaatggcctcgtagtagtgatgccgtgatggtcgactggcgtggttgaagaaacggaggctgactggtggtccttagccaaactcgagtagatgaggcagcatgcctacatccaactgaatgatgatgggtcatagtcatgcactcatggatcatggttccatgacttctaatctccatcaaaactatcacagaagctgtaataaaattcattccatcctttacttcaattcccatgtattatattttttaataataaaatccattccgtaaagtagctataacaattattgctgtgagattacatgacgaatgatcgcgaattacaaatcacagcttgattaaggacaataaaactacttgaaaaaagacaatttccatcaatgatttgtgagaatcttcacaaaaattgtttcttcctaacggcttactcttgctgaaaaggaaataaatccatggttgatcattgtgctgaccaaatttctcacataccttcattgacgactgacgccaaaccaatttggatgataatatcggagagtaagtgagctataaacaatcattcatccagatattgccaccctatccattgaagccaatccaatgaggacataaccatcatggatccgcacccccatgggacctccaagatgttggtggtgttgatggtctcgacaccaaatatgcaggcaatccgatcttatctttagctggtagcagcaatcttcatgagcacaacggtgacatcggtggctagggctgcattagtggaaggtggttggcaacagagtgcccgaacctccacggtcagatccagatggtgtcgacagg

SEQ ID NO: 54647 - DNA, 2277 bp, Oryza sativa
ttagatgcacggttagagctacattagattttctttttttggtatatgtttgtgtggatgcactcaaaaagttgtgaaatctgttcttccaaaaagttcagtttcaattctgattgttgggatttcaaatcagataacagttagcagtgcatattaacaaaaataaatagtgcgtggggtattcaaagtatatgtctgctgtccgcaaaataaaacatgtcatacattcccccctgtttcccacaggattcacttccgcaggcagttcttgctggatatccttgtatttcagtcagacaagtacatcaaaagggaggagggggggttgttcaccagattcaacgagtgttatttttctgccatttttgtggagagttgatgacagctgggacttgatctgtgacatactccctccatacttataaaggaagtcgtttaggacaatgtttaagtcaaaccttaggaatataaatcataaaagttgttgagtttgaaaatataaaaaactatatgaatagatttatcttgaaaaataccttcataaatatacatatatcacttttcaatcaatatttttatagaaaaagaagtcaaagttgtgttttggagaccgtgtcgctgtcctaaacgacttcctttacgagtacggagggagtaggagtattatgtgaaattgacattgatgattccaaataaaaaaaatggctccttaccttgcaacaataaattatatggaaggtgaacttcgacgaagttcaggatgttatataaatcttgatcatacctgagaaaggtccactagttagaaatcttcaaatctgttgtatgatagatagtcaactgttggtccatggcttcatctgttaggagtgcttagtattttaagatgaacattgagttttcaacgcacaccggcacacggcacactgaacattaggcttcaaagtttaccagctttccttacaaattcttgtagtactacatatttctcggtagtgttcctttgtttactggaatagcaggtctgaaatactgctagtttggttcatcattccatgtgctgatatggtttgataattacagactgatggagtttgatctgtcctttttcgttaggtgactaggagtatgtcttttgctatgtccttgaagcatctgcttgtatattttagccatgacttctggaggtttaggtagtaggaccgtaggagtaattcagtaataactagatagtagcagttaatatactagtcctaaataggagcaggatataatttgttgagttgcttatggagaagaagttgttttcaataagagggaacaagttgattaagtttcccgattgcttgggacggtcaatagcagcaaacgatttggcatactagtaccagtagtataatatatagaagtatattgggttggtgcaacttcgtccattttgtcattggcttcaataaaactagttgtagtacagtggttgcataaataagtatttcagtaaattagtcctaggtgcaccatgatagtggtgaatttaaaataaagcttcagattcatactggtattgtagttgcttttaatttggtcttgaaaagaaaaccaaaccaaacctgcgacacaggcaggcagctagagggtagctgctctgctcgatccattccattccatgccgccgccctccttcccatcatccttaatccttcaatttaattgcacttgattaatagctagtgatagtggaaggaactggtaggcaatggctaccacgccggaggcggcggagtccctccgattccgatggccggcagcggaggaggagttcgacaacgacatggtcctcccctacatctcccgcctcctcatggaggacgacgtccacgaccacttcttctaccagtaccccgaccaccccgccctcctccgcgcccagcagccattcgcccagatcctcgcctcctccccctcctccgccgccggcgcctcgtcgtcgtcctcctcctccgatgccccgcccagccgccccttcttcgatgacgaggcggccaccgccaagactttccccactgctgcggtccacagcgttgaccaccagtactccggcggcctcgacatggtcaacatggcgttcctcaagggcatggaggaagccaacaagttcctgcccaccaacaccctcctcctctcgaccgactcttctactaccttgcagttgcaggttcagggtgaggtagtcgtcgacggacatggaatgctcggggggtcgggggagcagctgca

SEQ ID NO: 54648 - DNA, 2708 bp, Oryza sativa
cactgcgcgcaggcggtggccacggacgaccgccggagcgcgcacgagctgctgaggcagatcaagcagcactcgtcggcgtggggagacgccggacagaggctggcgcactgcttcgcgcaagggctggaggcccggctcgccggcacggggagccaggtgtaccagtcgctcatgtcgcagcgcacctccgtggtcgacttcctcaaggcgtaccggctgtacatggaagcctgctgctgcaagaaggtggccttcgtcttctccaacaagaccatctacgacgccgtcgccgggaggcgcaagctgcatatcgtcgactacggcctcagctacgggttccagtggcctgggttgctgcgcgagctcgcggcacggagaggcggcccaccggaggtgaggatcaccggcattgacctacctcagccgggattccgccctgaccaacacatcgaggagaccgggcggcggctgagcaggtacgccgacgagctcggcgtgccgttcaagttccacggcatcgcggcgacgaagaaggagagcgtgaggcgggaggagctgggcgaggcggaggaagacgaggtggtggtggtgatcagcctgtgccatttcaggaacgtgatggacgagagcctgcaggaggacagcagcaggagccccagggacgaggtgctggggaacatccgcaggatgcgccccgacgtgttcatccatggcatcatgaacggagcctacggcgcgacctacttcctgacacgcttccgggaggctctctactactacgcggcgcagttcgacctgctggacgcgacggtggggcgggagagccacgagcggatgctggtggagcgggacatcttcgggcgggcggctctgaacgtgatcgcctgcgagggcgcggagcgggtggagcggccggagatgtacaagcagtggcaggcgaggaaccagcgcgcggggctgaggcagctgccgctgaatccgcaggttgtgaggctggtgctggacaaggtgagggacaagtaccacaaggacttcgtggtggacgaggatcaacgctggttgctgcacaggtggaagggccgcgtgctctacgccttgtccacttgggttgcccaacactagctcttagcctcttaccaattatttataccaattttcagatatgcacatcataagtacaaccatgtctatgatcgatgtggaccatggttgagtaaaccctattgtatgtttcttgtatcacatttttgctcctccttggtcatggtgaccactgaccactacctgatttactactccagttaatcctataaataaataaaatggccatagaggaggaggacctcaacatggagacagccttccctgatgaggtactcacggtcaatgaccttttcaatttcaggatcttaatggacgagagtgtacgttgtcacagacagcaggagtgccctgggaaatcgtcctcgacacaatactaacataggccatgtttagatcacaccaaacttcccccaaagtcccaactttccatcacatccaaaactttcctactcacataaacttctaactttttttccaaactaccaactttccccaaacttctctccaatttcagaaactaaacacagccatatggaagatatgcagctggacgtgtttgtccaaggcattgtaaatggctcccaaggcatcacctttcttgtcacgcacccgagagccaactgcggttggtgctggagcaggacatctttggatgggatgcccatgaacgcaattgcctgtgaaggagggaaggaccgggtgggcatacaagcagtggcaagtcaggaaccaacaggcaggctttaggcgaattaattttgaaaaatatattgtctattcttttttctcagaaatactcaggatacaatttttttggcacaaatataaagtcgatatcgctgaaccgttgtgcgaaaatgataaaaatgtgacaacacggatggtcttgaacagcgacggcgcaagactgctcgggctcacatggcgcgggtgtgagaccgagcggtctcgcacggcaaaacagcaacaacgttttggaaatagattaattatccgattagcgattaattaacaataataagtgattaataattaattaatcgctaatcaactaattaatcaattagaatgtcggtctcgctgtttggccatccatccgcgtgatacagagcagtcttgctccgtcgccacatgacaccatgcgagactgtccacgtcatcatgccctcgtcatttttgcgcgacgattcagtgatatcgacggtatatttgtgccaaaaaattattgcatctcagatatttttggggaaaaattaaatggaacagtatattttcaaatttaatttggcttgaggcagctgccctagaacagggaggaaattatgatggttaagaaacactaccacaaggattttgtcattgaggaggatcaatagtggcttcttcagggctggaagagccgcatcctctttgcccactcaacatgggttgcacatgactagtccagttctcgctgtcagcattccctctacaatggcggatatatccccttcaaaaaaaatacatataataactttgtattcccatgcaaaaaaaaaacatatatatttaactgtgtgttgatacggggtaacaagtatttttttttcatgttctaaaat

SEQ ID NO: 54649 - DNA, 1939 bp, Oryza sativa
gcagggaagacgggccgccagaggtgaggatcaccatcgttgacatcccccagcctgggtttcgtccatttcagcgtattgaggcggcagggcattgcctgagcagctgtgccaatgagttccgcgtgccattcagattccaagctgttgtagcagcaaagtgggagacggttggtgccgaggacctgcacatcgagcctgatgaggtgcttgtggtgaatgacctctggagtttcagtgctctgatggacgagagtatcttctgcgatgggccaaaccccagggatgttgccctccgtaacatcagcaagatgcagccagacgtgttcatccaaggcatcatcaatggtggctatggtgcctccttcctgtcacgctttcgtggagcgctcttgtattactcggctctgtttgacatgctggacgccaccaccccaagggagagtgggctgcggctggcgctggagcagaacgttctggggccttatgccctcaacgccatcgcctgtgagggtgcagacctggtggagcgccctgagaagtacagacagtggcaggccaggaaccaccgtgcaggcatgcagcagctgaaactgagaccagatatcgttgatacaatcagggaagaggtgaacaagtaccaccataaggactttctgctgggagaggacgggcagtggctgctgcagggatggatggggcgagtcctctttgctcactccgcatgggtgccacaacaacaagacaattcctccggatgactgtttggttttttttttcttttcttctttttctgcataaaaaatgcaagttagtagacttatctttggacatgaaaagtgcatcgtgtgcacagaatgttacagcgatttgcattttagcagcctggcaagtttctttaattatgaacgtgctagtattgtcaacatgtagagcaaggacacctagagtaatacttaccagtactagaagtactttgattgctccagttgcaacatgacctgtttattttccttgtaacagccatcagccgtataatatgccaacaaggaggagaaggtgggtaatgaatccaagccaagcatggaaaacatcaaaccctgttctcagcaaaactaaaacaccaccatgctatcaatcaccaggaaaattgttgggtatgaatgggttgaaggaattgatgcctccatccttttccgtcctcttcggccttaccaagagcatcacaagaaaatgcaaattagaaaaatgaataatactggaatagtgttgctgcatattatggttctattctgcacttgcctggattttgcctctacaaactgcagtctacagacattatgtgttgagtcctttcaacttgaagaattgactgagtacagtaacatagttcagggtgaagttgttaagttgccttgcacctgccctttttacaaagatttgacatctgcacatatttatctgtcaaacagcatggattgaatttgcaaattgcctttgcattatgagcatatacaatacccaggtcacaggctgcatcattcactatgttacatggtcctcagctacatcattcaatcagataagactggtgtagttttggctgctgccttgtatcaatgcaatagagtcctctgttctcccatcaaattatatctaatgatcattgcttcttttgataggacgagggaagaagtggctccaaaaccaagatttgcagattgttaaggatcaaagaaacattgaggaatggaagagccaaggcatcagtaccacaaggcatcactgctcctagcctatcagatgaaaattctatactattcttgtgctaatacaacaggattcctgggaatacaattcctcagcggtactgataaaccagcacaattgttactaaggacgtggtttccaagttcatagtagaaagtcaattaccagt

SEQ ID NO: 54650 - DNA, 1231 bp, Oryza sativa
tcagtgatatcgacggtatatttgggccaaaaaaatattgcatctcggatatttttggggaaaaaataaatgaaacaatatattttcaaatttaattcgggttgaggcagctgcccttgaacagggagaaagttatgatggttaagaaccactaccacaaagattttgtcattgaggaggatcaatagtggcttcttcagggctggaagggccgcatcctctttgcccactcaacatgggtagcacatgactagtccagttctccctgtcagcattccctctacaatggcggatatatccccttcaaaaaaatatacatataataactttgtattcccatgcaaaaaaaacatatatatttaacagtgtgttgatacggagtaacaagtattttttttcatgttctaaaattaatgttttccaaggatagtcatgttgaacaggtaaagaaaaataaaaacaaaggacgtatattattaccttgtctgcattctcaaagcaatcttggagtcatcttcatttccatgtcctgtttgtactaggttattggaatcatcacacactaggttggagttatagacagggtatttgctgctgtctcatgatatggcgagcaagagcaaaggctaccaccattgaatgattatcagcatggccaacccagaggatttcttttgggaggccctcctcaaggagaacgaagcaccatccccaccacctgtcttctttgacctccccgcaacacccctctccaacagtgatggcacagatccctcatcattggacaaccaacttctctcctacgtctctcgtatgctcatggaggatgagatgggttcttctgctgctatcaccaacttgcagtgtgtcaacaggggcagcacagaggaggccaacaatatgttgccgggcagtgaagtggttagggtgttctcgaagggcatgggagaggccagcaagttgttgcccagaaacaacagcttcagaacgctggagacggtggatcaagtatcaagtgatggtcattgtaggggacgaaagaagaaaaaccatgacagggacgagcagcagctggaggaggaactggggaggaccagtaaattagctgccttgacgattgcagggacacaggaggctggtgctcgcgagttgctggacgaactgatgctgcacgcacacgagacatgcatcaaagacatggagaagctgcgtatcgacatggacaatgagg

SEQ ID NO: 54651 - DNA, 2340 bp, Oryza sativa
aagatcaagcagcacgctttggcaacaggcgacgccatgcagcgagtggctcactacttcgccaaggggctttaggcacggctagctggcagcgggaagcatctgtatcagaatcatgtgcgcatgtcgttggtggagtacctcaaggtgtacaagctctacatggcagcctgctgcttcaagaaggtggcgctcatgtttgctgccatgacaatcatgcaagctgtgcaagggaagaagaggctgcacatagttgattatggcatacgctgtgggctgcactggccagacctgttccgccggctggggagcagggaagacgggccgccagaggtgaggatcaccatcgttgacatcccccagccggcgtttcgtccatttcagcgtattgaggaggctgggcattgcctgagcagctgtgccaatgagtttcgtgtgccattcagattccaagctgttgcagcagcaaagtgggagacagttggtgccgaggacctgcacatcgagcctgatgaggtgcttgtggtgaatgacctctggagtttcagtgctctgatggacgagagcgtcttctgcgacgggccaaaccccagggatgttgccctccgtaacatcagcaagatgcagccagacgtgttcatccaaggcatcaccaatgatagctatggtgcctccttcctgtcacgcttccgtgcagtgctcttgtattactcggctctgtttgacatactggacgcgaccaccccaagggatagtgggctgcggctggcgctggagcagaacgttctggggccttacgccctcaacgccatcgcctgtgagggtgcagacctggtggagcgccctgagaagtacaaacagtggcaggccaggaaccaccgtgcaggcatgcagcagctgaaactgagaccagatatcgttgatacaatcagggacgaggtgaacaagtaccatcacaaggactttctgctgggagaggacgggcagtggctgctgcagggatggatgggacgaatcctctttgctcactccgcatgggtgcgccaatcacaagacacttcctccggatgactgtttggtttctttcttttcttctttttctgcataaaaaatgcaagttagtagacttatctttggacatgaaaagtgcatcactcttcttgtgtgcacagaatgctacagtgatttgcattttaacagccaggcaagtttctttaattataaacgtgttagtattgtcaacatgtagagcatggacacctagagtaatacttacgcgtacttctagtactttgattgctccagttgcaacatggcctgtttatttttccttgtaagagccatcagctgtataatatgccaaaaaggaggagaaggtgggtgatgtatccaagccaagcatggaaaacatcaaaccctgtactcagcaaaattaaaacaccaccatgctatcaatcaccaggaaaattgttgggtatgaatgggttgaaggaattgatgcctccatccttttccgtcttcttcggccttaccaagagcaccacaagaaaatgcaaattagaaaaatgaataatactggaatagtgttgctgcatattatggttctattctgcacttgcctggattttgcctctacaaactgcagtctacagacattatgtgttgagtcctttcaacttgaagaattgactgagtacagtaacatagttcagggtgaagttgttaagttgccttgcacctgccctttttacaaagatttgacatctgcacatatttatctgtcaaacagcttggattgaatttgcaaattgcctttgcattatgagaatatacaatacccaggtcacaggctacatcattcactatgttacatggtcctcagctacatcattcaatcagataagactggtgtagttttggctgcttccttgtatcaatgcaatagagtcctctgttctccatcaaattatatttaatgatcattgcttctttagataggacaagggaagaagtggctccaaaaccaagatttgcagattgttaaggatcaaagaaacattgaggaatggaagggccaagccatcagtaccacaaggtaccagtgctcctagcctatcagattaaaattctatactattattgtgctaatacaacaggattccagggtatacaattcctcagcggtactgataaaccagcacaattgttagtaaagacatggtttccaagttcatagtagaaagtcaattaccagttatcacaacaatcctcctggtagaaattctgaacatctgatcaccttctcaacatggcatgagtcgatactattgtaaacaaatt

SEQ ID NO: 54652 - DNA, 6863 bp, Oryza sativa
  unsure (1)..(6863): unsure at all n locations
aactagtgcatcccccttacagggtttagaaagcaacatgccagttgggtgttgagtctagtgagagtttatgctaatgtgcagaaaataggtagatttcaaacaaatataaagccgctgacacgcaagttgaatagggatggaatttgatgattataaaaaaattctcttagaaaacatagtgtagatataacactgtggcagcatttttgtcatcttttctatgtggcatttgcttaaaagatcctggaactacactgtctcatatcacacagaattgtatgcaaaatgaccatagggcatgcatgcacgttctctagtaattaccaggccatcattgctttggtaactcttcctcaccaaaccaccttgggggatcataaccatgaccacctgtttgttggaaaagaaatttaatagatatgatatgatgcaggtgcagactgcgactgtcaaagaaatcaaaagaactatgaaccaacgaaaaacctacataccaagaggattacaatggcatagacgccaagctgtcaagattgtaccctttgcaacgccgtattttttgtatgcttgcatagagtactggctgcaagttggcacataacggcagcttgagggtagtaagggcgatatttctcctgttcacataaaggagagcaagctatagagatatagttgatatcaaaaggcaagggcgcaaggccaatgattgctgcacataaatacaagatgaaaacagtaagaatgaacttacttttgtaaaattntagcatggatagtgccacattgactcccaagtcattgacttcctcttcttaaaatcaaataaagcacaaaatgcactcatatcgatcagttctatagttntactcagaaaaaaaaaccaagtttgtctttcattaaaataaagcccaatctgcaatctcctaatcccacaatgaattgcttagacttagtcctttacttaagtacgagatacatggattgggaaatttgcgccataatattccatgtagcctatgtacattttgctaaactgagttctgtgatgactcattatgaacttctgcagcacattttgcaggcattatgcacagccattcgcagtgtgtgaaagctcaaaacttagacacactattgtaccttgaaagtaaatgtggtgtgcaatgtacagcctagaaaggacataaatacttctacttattaaaaaaaagaattgaaatagtagtccctcatgtaagatacatcaaaagtttataaccacctcaagatctgagcctgggtataagaaatttcactcaagaataaaaaaactgtaaaataaaacatttgaccgctcctacaatttgccaatctccagttaccattagactaaccttcatcagcagccagtagacccgcatcgttgggatccttctcttgttttggtagggaacaccgaaggaaactataaatgaaaaaccaagaaaaataaagaggtgggagaactccagtctgttgatgcaaggaatgcaggattacacaaacagagagggtagcggaggagaacaaaaaagatgaggcataatgatgaaagaacacacaaagttgtttaaacacagtgaaattatatggcactagatagatcatcaactacaatttcctacatatatataagcaggtcagcaacgtcccaattaatgtttacaggcatctattgcaactgacggattgtcagtgttgcttcacaaagtaataaaccaaattaatcagcaacgtgcatgtgtgtgcatactgctagacacaattggccaataaggtagcaaagacgagtatataggggtagtccggtagatataacaattagctcgctcactgaattcttctgttcttcccatgcatcatcttgtactacaagctaattccattgtcagttggttaaatatggagtagtggatagctaattagacaacatggatattactagatcaaagaccaagttatcatacatatgcatgcgttggctggctcgccggatggatggatctagtttgatctctagctacttgttcagaaatcagaagaaggcagctgctcccgcctatgccgcccgccaactccagtacccccgcgcctccctacagacccgccgcctccccgtgctgccccatatctccccggaccctacgcaacctcgactaccacaagccccagcccacgccggcgccacacccagtgatcgatgcattcctccccgagtcggctaggagcgagagggggagggagactcacgtgtggttccggcgagaggccgcacaggcgagagaagggcggaggcggccatgcccccgatgtccggtggtcggagatttttcacagatttcttcttctctctgatttttttttttcaaaagaggagtgactgaactggataagatcgaacgtccctagctatttgctactccctccgtttctaaatattcgacatatatttaaccgttcgtcttatttaaaaacttgtgaaatatataaaaccatatgtatagataaaagtatatttaacaataaattaaataatagaaaaagaattaataattacttaaattttttaataagacaaatggtcaaacatatttaaaaaagtgaacggcgtcgaatatttaaaaatagaaggagtaatatactatataatatattttccaactacccatatatttctatcaattttttgaagatctatatatttgcagtgattttaagcagatgtttgttcgatttaagtgtagctacccatatattcctctgcatagaaagaatcacatgagacatactccctccatttcaggttataagacgttttaacttcttttaagtttgactaagtttatagaaaaatatagtaatatttataatactaaattagtttcatcaaatcaataattgaatatattttcataataaatttgtcttgagttgaaaatgttagtacttttttctacaaatttggtcaaacttaaagcagtaccaaagtcaaaacgtcttataacctaaaacggatagagtatatagctaaaagaaagccaattgaccttatcttctcaccaaatagaaaaggaaagaaagatagaacccgccacactcgttgtttcaggtgtcgcggcagtggcggaggtgtggctgatgggcggcgcagggcaaaggagcgatgtggcgtgggtggatgggcgatgcggctcgggtggcctggcctgacgcgggcgaccatagctgcatacacaacgactacgacaatggtcgacaacttccggatgggcgttttggcgttcctctctcctggatggctattttcaccaggattgtttaggctcagtgtagcatttgttcgaaaaagtctcttaatataggccagatctgattcgtctccctcaatcgtaaaaccagctttattgactcctctaactattgatatcgtttaaaatgactcccttggctatttctagagcggttttcactgatgtgacatccacgtggcagccaggtcatcacatcaagtaaaaatatagagtggggcccacatgtcatcccctctctcttcccttcttcctctacccctctctccccgtatcaatcttctttggtcttcgcaacagcgggcggcatcaggggatgggggtgggggaggaactcgagggagctggatgacatcgaacgagccaaggtgtccctctctccggtagcatcgatattatattctcatattccccacactcacgagcggtcggccacttccctacacctagagacaagttctccattggattctccactactacggaaacgattttctatacgaggaccctaataggttgcagtcggattgtaattggtcgcgtctgcaataattgaccttcattttagcgtgcggttccttaagacgcccgcatgtaaaaatctatttttgcatgtgagcctcttaaggaaccgattgcaatgagcctattttcgtatgcgggcctcttaagtggtccgcatgcgaaaatatcccctctcctccaaagatttttttctcccctcctctttcttttccttcttagcaacttgaaatttttttccacctcctatcctctctctcttcctctcctctcctctcttgatactattttcacctcctccttccttctttctttctcttctctcctctcctctcctctcctctcctccgagcggccgggagcaggcggtggccagctcgacgacctcgggtggttgtcgacgacaacaaggaggcagccgggagcgctacggccaggagttgctgcagtgggcaaggggctcctcctccaccaccgggcaggaggcgtggcactgacgtatctggcaccccctctccctcccgcgtggatccggctgctgctccgcccctacacacgtggatccggcggtggcggggcggatctggcgcaggcgataacgagagtggcggcggtggcggtggctgacggcgggagtagcggcagtggctgcggcgacctcggcggcggcaggcaagggcaatggctacgaggattttggtggtggcggctgcgatgacctcggtggtggtggcctcagccttagacggttggcaagcgtggggccgccgctggcgaaggagtggggagtggcggggctaggttttttctttttgaaatatttttcacgattttttgttgtcgcatgaggtcggcttaagcacctgcatgtgcaaaatcgtatttttgcatgtggttgtgctggccgtatgcaaaagtccgattttcgcaaaatctttgggtgtaggtgggctgcccgtcaacatgcaaagttcgattttggctgcaaaccgaattctgtagtagtgcgcgattcagcggttcggtgatgccgccagtatggcggatgctctctgctcggctagaactagtgagcgtacgtactcctctcttcatgcgtcttcgaggattatgggtccgtgtccagtggcatctgcagcaagcagtccttgcctgtcatgtcggtcttcctcgtgctcataagcatcagtgatcatctctagcttgatgcatgcggatattggatcgcgtagatatatatgtacaggacggatggagtatgtcaatgtcaggagctcgatcgttcggcatagccaaagctcgccggagtatggccggtgatccatcgatcctggccttgtacaagcaagggtcaagggggctgatgctgaaccttgtcttcgccggcatgcattcgaactcgagcggccggcggcgatggaacatgcaagcagctagtcgcaggtcatggaccccgaggcatcttcctgatgctggtggccaacgtaaatactgaaaaagatcgatacgggagctagggagatggcagagaaagaatgagagaagaaaggggaaggaagaagaaaaatgtggcactgatatgtgggtctcacatgatgagtcagctagttagactgaatcaaagcgccgtcaacaaaacagctttctaaaactgcatagagagtcacgttatactgtttcaatagttgagagtttaagatatccggtactacgatttagggatatgaattagattgaaggtgagagtcaaagtggacttattccaaaaagatattcgaatttacaatgtgcttgataactatcttttttgtcgagtttctaagtgttaaggttttttccttgttattatttggtctgtcactaccatcaaaagtacctcaagtttgttaacattaataccgtattgttcatatcaaaaggttgttcattttattgctaaaattaacccaaccaagttttaactttaccgacgtttgggaacgtaacaatctaacattaccaattaccaaaacttgtttccactaccaaagtttggtaattttagaatctctctctcccaaaaacttaacaaaagtaacaaactaaacacaacttacacttctcaaccttatcaaatatgggaaatgccaaaatttggtaggctaggttaatttatttatgcatcaaagtcaataacccccaattttggtaagacagatttattgatgttaccgaaaatttntntttataattcagagaaccgctgagcagcgccatgctgaactattgataatatctttgcatttttataaacataaagtattcaattgttttcaccgantctacatgaagaaggnnncngaattttaaaatataaaatatgttaatactccttccgtccttaaatatttgacgccgttgactttttttaaacatgtatgaccgttcgtcttattaaaaaattaagtaattattaattcttttcctatcatttgattcattgttaaatatacttttatatatacatatagctttatatattttacaaaagtttttgaataagacaaacaatctaacatgtttaaaaaagtcaacggcgtcaaatatttagggacggaggaagtaatattctatatgtgtaatggtggttatgcatatgatgcaagcgttttggtgttgggaagtggacaagaaaacggttgatcacttttgtcacctcccttgcatgatcaaataaaatcacttctctgccagaacgtactgtcactactagagaaaccatctttcatcggttgccaaaaacaacaatagtcccggttgcttaaaaaaccggaactaaaaagcatttttagtcccggtttaaaagtgcaatgatctttagtcccggttagtgttaccaaccgggactaaagatcatcttttgtcccggtttttttattggcacgacgtggcaggtctcctaatatttttaatcccggttggtataaacaaccgggactaaagatcagatttttagtcccggttgtttatacc

SEQ ID NO: 54653 - DNA, 970 bp, Oryza sativa
gcggccgggctgtgccgggcaggggcgtccgcggccgagcccgtgccaaggaggggcggcggccgcggctaggccgtgccagggaggggcagcggcggccgggcccgtgccggagcgacggcggccgggcccgtgccggaatgacggcggccagctcgtgccggaacgacggcggcccagcgcggaaggccgcgcagcgacagctccatggattttttttcttttttccttttcgttgtgtgaataatttgaataattgtttgttgatttgatccgtgatttgagaatgatgtgtgaatgatctgtgatttgttgttgtggatgatttgggatgtttgagatattgggttgttgctgtggatgatttgggatgttgagatgtgtggatgattttgggatgtttgagaatattgggttattgctgtggatgatttgggatgttgagatgtgtgaacaatatgtgatgagtgacgtgtgaacacaaatatgtgatatttggcgctagaaaagaaaaaagaaaaaaataacttttgtaccggttggtaataccaaccgggactaaagatactatatctttagtcccggttggtattacgaaccgggactaaagatctatttttagtcccggttattttaaccgggactaaagatagacatttttagtcctggatttgtagtcctggttggaaaaccgggactctagggggttcccaaccagaactaaaaaatgattctccagcagtgtgtacctaacatgattaaataaacgttgaactttgtatcatcaatgttctatcagcagaagtagtttaagcaagttttttttcctcgtaaacattcatggtgtcagaaccctgatttttgctatatatgctttagtttgcagtatctaagcgcctttttctgcatttgtccttatactattaacagatagtcacatggtcgtcacatcacccccaacaaaacccac

SEQ ID NO: 54654 - DNA, 4052 bp, Oryza sativa
aattaatgtgggtagccacattttcctataggggaaatgtgggtcacatttttcctataggagaatgtgggtcacattttctctcctatagggaaaatgtgggtaacatatttcatggtaaatatgatttatttattttagaaaaatattttaatattttttttcattttatccgtagcaaacacaaacatttaactagtcaataatattcatgtattaatcgtattccttctttcagggttataattcaagtaatcagaaggtgattgcaaatgctaacacaaatagagataccaacaacttggcaatgcaaacacaagttcctactcatactagagagggaccaactttcacacaactactacttggagaggaagattttgaccttcctccgtatgttccggatgatgctaaagagagcaatcagttctatcaacaaacaacgaatgagttccttaacatgaaccaattggataacaatggtataggaactgctcagttggaatctcgggagcatatgatgacatatggcttaagttctggtataagttcacagcttttaggttctcaagcaatagacgtagttgatgttgtaggatgcctaacttcaccacggggtacccagctgcatgagggtcatcttgcacatctaatgtcatatatccgtgcatgtcgtgatctagagcaacatacccctcccaactttgtcatgcatcaatctattgggccagtgttgaaccactatgccctagtgcagagatgtcatattccatgagatatccagaaaatgcagctactcgtggacctcaaaatattcttgggtttcctataaaaaatgcagacacacgcacagagagagacacacacaaacacatgtacacacacccaaacacagacacatgcatgtacacacacacataaacgcacgtatatatgtagatggtgaaccgcaacttcttcatgctcatccactacgtccatcgcaggcatgtcctagcccgcctccaaatcctactcgccgctcgcggtccttatatagtcttattaatttttacctagcttgcattgttcaatacatcatctactgatcgatcagctagcttgttttggacaaacatatatctgtataatttctcataagcaagtattgagttgattcattcaattcattgatcgattcaggtgtccaatcgctgctgcatgcacagaggaggcgcctgctggctcttctcaccccgtcgctctactacttgggttaattacaatcgacaaactactacctaagctagctagccgctggctttccttcattttactccctccgttccataatataaggcacaaccacttttattagatattccataatataagacatgcatgcaagcatgcaattaactatggcatcttctctattaaattattacttttttaaatcctccactctcatgttatctaatcctattggatgcatgtattatatttattaggatgattctaaaaaaaactacaagatgataataattatttattgatctttgggttaagggtggttgtgccttatattttggaatggagggagtaccatgcatgctgtaactgcgattcgtcagtccggtgatgttatacaatcacaataagtttatcacaactatagcacacaagcgttttaattttaggaacaattccaatttacccccttaaaactattgcgacagtataaattaccccctcaattaaaaaccagatattcttcaccttcaacttttcataccggatgaattacccaccgacggactcaggagcggtttttgttgtacgtgacgcacacgtggtagtccaatcagcataaaaaatataaaagggtagggcccacatatggtgactgagagaagaggtggaactgacaagtgggtcccataattttttatttttcttatattgattggattgccacatggacgccacgtaggatcaaaccgctccgaagtcaactagggggtaattcgtccggtatgaaaagttgagggtgaataatgtctggtttttttgaattgaggagggtaattcaaacctaagaagatgtcatagggaaaatatatacatattatatgtgctgatttttctaaaaaaccggcacttaagcagcaatgccataggtaccagttttactaaagaaccggtacatatatatacttacaattttgctatatatttatcgacaaatttttctcaaaaaaaatgacactgtaacttgcatgtaactacaatgtaacttatacgtaactaattttgaaccattagatttctttcaagattcgtgcaagtcatgaagaaggaaaaacgtcacggcgcgcgcacatgtgagaggatttgttcccacaacctccgtttcaccgaaatagcatgttatgtaatttttgaaagtcacatacaagttgttacatgcaacttacagtgtaattaaatcacgattgtcaaattgtctagtaggtgttggttctagaatttcgggcacttttagtgccatccttttttttgctgtgatactacgtacctggtactagcttggagtatatatctgctggtataccggccgggcagttgagagtaataaagatggagtaggtaggatttgcattgatatatagataggcataggtagtatgattaattgatggaagaagaagatacatccagaatacgagtacattagtgaatgagtagttaggatggttggggtgggcagaaggtgatgaggtagcgcttggcgtgacaacggttgaggctggtggcgtcgtcgtaggcgtagctgtacgcacgagggcagatggccttgaaaaggtgggagaagatggtggggcggcacgccgacggcgaggcgtagtcccccgtgcagcagtagcggtcgccgcccatggccctgcaggcgctccggcaacccgccaccctcccttccctgtcccgcacctccagcgccgacgggcagcacacgttcacgtccgccccgcacgccgccgtcccgcaccccacgcctccccccaccgccgccatcgacaccggcgcgttgaacccgtccaccaggctcacgtcgtagaagtgcatcgccgacgccgacgtccccagcgtcatctccaccaccgtcgcgggagtcgcccccgccgcgccgttgcaccgcagcacgccgccgcagtcgcccgtcgcgcagctgccgcgcccgcgggagtcgaagctgcagccccgccgcggccacacgcgccccgaccaccccgccggcaccttcaacgccgcctcctcgccggcgcccaggtggaagccgcccgactgcggcgtcgggtgccccgcggtgcccagcagccccggccacaccgactcgccgcagttgttcaccatgatcagctggatgccgccattccctcctcctcctccacctgcaacttcatccctcataattaattagctaccaattcaaacggatcatgcatttctgcttgtttaactgccatgtacgtacaagctgtgattgccatgatgaggatggcattgacgacgagcagcagaggagtggccatcaactcaattaactgccaatatatagctagcttagtcgcttgatgcaactgatgatcactagtctgtggggggaggccagccaacatatatataacctgtcaacactgactataaaaattatgcagagggagctagcctccctagctactgaagctaactgacttgttagcttacttcctttcctgtaactaacacctgggacatccatctgaagcgaataaacatactactccctccgtttctaaatgtttgacaccgttgactttttagcacatgtttgaccattcgtcttattcaaaaacttttgtgagatatgtaaaattatatgcctacataaaaatatatttaacaatgaatcaaatgataggaaaagaattaataattacttaaattttttgaataagacgaacggtcaaacatatgataaaaagtcaacggcgttaaacatttcgaaacggagggagtactatctatttcag

SEQ ID NO: 54655 - DNA, 729 bp, Oryza sativa
cacctatgtgcagtgcaatcagctaatcggatgcctggcgaccaaatcagtgcgagcagagtagcgcagcaaactccaaaggctgcaaattactactaagtaccaactttaatttcactttcttccttttcctttggggattgcgatccatctctcagcaggtactacgtcaggatctattccttgctttgcgctgaggtttctcgctttgtacttgtgctgcgcaaatgcatcatcaaccgcatgctactagagtatttatatatctcctcgtcctcgatcgtcatttggataaggaaaagaatttgacaagtcgtagccgtagccccagttgcaatctccttctcttttgcttttgttctctgcttttttttcacgatctctatcctgtgaatgccgctggggtctatgatctttcatatgcatatgtaattcatcagaaagcaaagcatgcatgtatgctctgttcagttgctttccaaatcagaaaaggagtcctagtcgtctagctcgatcactgagtcactgatatgatttttctctacatattcacaccaaagcctgaagatacattttaaccagaccagtcacatatatcgcttcttcttgttgatatacattatgctcaacagtattacaattttatatttgaaatatgctgcacacagactgtttaaacttgaaataattgagcagcacgcacaacacaaatacatgggcgtgcttttt

SEQ ID NO: 54656 - DNA, 6596 bp, Oryza sativa
cagtcggccacgcgcgggcagcctcaaagccgacgcgcggcgacacgacgcacgacaaagtcggctgctagagagcgtgcgcaaaggggaggagaaggccaactaaaccacggtttttgagtgggatgtggtcccctaggagcaaatctaaactttgtgcaagattggaagggatcgggctgctctagttgggctaggcattctaccgaacaccttttgtgcaatgaacagtgaatttcataatttttgaatattttgctagaaaagatttgaattcaaactaggagtttgggagggtttcactagggtttagagtatagcaaaactccactaataatagagtaagctaaagaaataatctatggtttgaatttgagagaatttgctcaaattcactagggtttagaataaagggaataattagggtaaattagtaggactctaatacttgaacaagttttaaatcaaatagatttttaaaccaaacaaatttaatcaaaagctagcatgatgcagtcaaatttttagttttaaaatttgaggatgttacagctatccatttgatttagcgagtcaaagtcgttgctcgcttcaacagcctctctatctaccctctccattacaattctatgacaaatgggacccatatgttatatctattaaccttcttcctccatttcctccctattttccccgctcatactactgcctcctcccccacaccctctcctttgatgcggcgacggcgggcgtgcgaggcgacgggctgcagcgagcggcggggcgatggactacaacaagcggcgaggcgggcggaggtggggcgacgggtggaggtgaggcggcagggcgatgggcggcatctcaatgggcggcgtgacgacggctacgacgagcggaggccggcaggctgcagcgagcggcggggtaggcggtggccgactgttgacaggaaacacgaggcctgggagatctgcttaactccagtgcacgttcaaaactcgccttcggatgtatgagcgtgccagttgatttgatcctgcaatcaacaagaaacaaagacaaagaaaccgtgatcaaatccataaatgatagccgatcagctaaataccgatgacacatcatttatctttgagccgatgtcatatgtaaatcgatcggcaagtgttaagtaaacaaatcaaaactaaatctattcgatcggctgtagatatcaataatatataatccttatatcgatatatacttgagtcaagtgattgggatagatcggtcaccttgccgagacagtataaatcacttagatcgaaatacatattaataatgagattatatatatattcatagcatagccgatcaagtagatctagcatgtatcggctaatactccgataccgcttcgtgttaagatattaaagcaaatagaatataccaaacataagcctaatatacttaaatgcaataagatcttaatataaagggcagatctaacatgtcaatcgatcatataggataaaagcagttagatcagataagatcggctgtaactccgatactaccctaatcggcaactagtaggcaggctagagattgaaattctaagcacgacttaatagatcaaactcaactgatacagcattaagtatgaaaagaagaacaatatctagacaatcaagccgctggatgtttcataaagtggtggatatctcatataatctaagccaacgtcgttatttaacctaatcggctgccttctagtaacagatgttagccgattgtaggttagatgacgatattgtcaagaattatgcaagatatatgataacttgacagattacataaacaagattagagtatcataaggatggaagcactaatcttgagaacacaaaccgccataacaagttttacctcttgttgaagatcgaaaccgatgcagctcaacccgaaagcaagaactcgtcgaaataaagcaaaaagggtggcgatgcgccgaaattgtattgaacatgtgtgtccttttttttacatagggctcggggtctatttatacccgagaattataagatatgtccatattggacacgactcttatccctaacaaactctaagataccataagtctttgcggcagacttttgcccacatttatctctaaggaatttacataaatatcctaattaatagatacaactgcctttccaggactctatccatgcatggcaatcatcttgaagcacatcaattcaaacccgatgtcgtacacaagtcatattatcggaatcggctgtatcacttaactcaacccgactcaaacctagccgatcccaatcgtagccgatccggactccagccgattcttactctgtttccgcaacaacccttatcttcgattccacttcgaccccatcttcatctccgatgctgatattaccaaatttggtcgttaacaccaacggctacagcgggctacggcgagcggcggggcgggcgccgtcttcacctcctgtagcaatgctcctccccatgtctcatcgcctagttgccatgctcgagctcgccgcctctcgtagcagtgtgccggcgtcgagattgggtgggaaagagacagatgcaagagagagagggggtggaggagattggtagtgtggggcccaccattggccagccaaatagactggccaaatttagctagcaaggaggaggatttggccagctaaatagcttgaccagtgagttggagaggctgttggaatatggtttttttagaataggtaaaatttaacttgaagagtcaattggagaggcagatggatatgctcttaatatactactactaaataggagcgagatgtagcggccatattgttttgctgccattgaccgtcaagttgaatgggtttacttttccctgcgacggttaattctcttctagtaacaaagaacaagttgatcgggttttcttttcgttgggatggtcagtggcagcaaaacaatttggcatatcttgggttggtgtacctggcctgatccatttggtctttggcttcaataaactaataggagcatttggcctagtgcttgcatacgacgcgtacatgccaacataaatcttctgaaatatttcaattaactagtcctaggtgcatgatggtggtccctggtcggtggtcaagctttagcttcatattgttgttttgatattgaaaaggaaagggactgtctactcctcatttgacagaaaactcctcctagtatcttgcaaatttcagaccattggattgatttaagatttgtgcgaagtccacaaaaccctaaccagtttttcttttttctctctgccgccgcacaacggcacaagtcactcgagcctcgagagctcccctcctctcagcaccgtacacctcctgcaccgccgccgtcgtcccacctggcctcgccggctggtcaaaaggtgttaacggcgctgacaagccccccaggctaaccccctccctctccctttccccctccctctcctctccagtggcggcgagctgtcccgtgccgccgtcttccccgttgccggtggtggggcgccaccaccggccgcctccacctaacactctttccgcttgcccccgccacttacaccggccccccgcccgctcccgaccccgcggtttcagcggcggcgagctgtgccgccgtcctccccgttgccggcggcggggcgccaccaccggccgcctcctcctaccactctttccgcttgcccccaccacttacaccggcccaccgcccgctcccgaccccacggtttcggcggcggcgccgccgcccaccgccggtctgccgcctcccacggccatccctctaaagcctgtgaactcccccctcttcctcccacccccaccccgggaccctaattcgtcgaccctctgccggattttgggttgtcgccggcgccgtaaaagaagaggtcgccggagttggagaagatgcaactggagcacgaatcgcgaagcatatccagtggtccaaaatatgcaagatttggggtcgtattttctatcgacagaagtatagccgattccgtttttacaagagtggagcacttattatggtcagcttgagtagcgagacataagcgagagagaaacagacatggattttctacacctaggtataatcacacctattatttgcatgtcgtctaaacatttataggaaaaaaaaaatatctggttagattgagtgtcgtgtaataatcgtacccacttgctgcttgatttgccccagaaccttcatatccttgatccttcccattaaagtgcagtgaagtacactgatagtgggcgtaagggcctatagcctaatggttataagagtctcaatagtaatttaggccctagattcgacttctcatggaaacgaatttttcagaaattaacgactttgtgctttcagtagtaggcgacgtacccatcgatagcgaaccactccaggatggatgtgtaattctcaaaaagtagactgatagtggaacggaaggaatttgtgggtgcgacgccgaaggccggagtccctccctccctcctatggccggcctgaccatgctggcgttccatgcatgatgacatggccctccccaacatctcccgccttctcattgaggatgacatccaaaatccacaccctgtaaccattcgacgatgaaccgcctagtgaagtcaggcattgtcaaacaccaccagagacatgggcaattctctaaaaatctatcgattgtgaaacttaaaatcttgaaataaacttaaaaagtgtacaagttggatgaatttcacgagacaagagctttagagatcgattatatattgtgtaaattaaagcaagagttgaggagctgcgtcttgatgctgtcgtcttcctggaacctgcctgcctgcctttcatgatccatccatccatccatgtctcatgtgattggtgtctccctcgtcccctccacgcaacacacagacacccatcatcgcctccactctcttcccctccatccaaagtacctggagagagtggaggcatcgggaggccatggctgccgcgccgaagccggaggaactcgtcgtcgccatcgagcagccattctccccgtcgctcttcctggacctgcccccgacgccgcaccacgatgacgaccccaacaatgtcaatgacgacctcctcctccccttcatctcacgcatcctcatggaggacgacatcgacgacaagttcttctaccagttccccgaccaccccgccctcctccaagcccagcagtcttacgcccaaatcctccatgcccctgccacatcttcttcctccgacgacaccaccatcaacaacaatacgaccaactccacctccgtccccgacacgctcgccatgcccgaccacgacgccgacacccagagcgcgccggacgacatggagatgctctacatggcgttcctcaagggcagggaggaggccaccaagttcctgcccacaaacaacaccctcttctctggcttcaaggcagagccggtgctggatattcaacccaccttcacgttcggaccaagcggcggcggcaggggccggaagaacaggcacgccgaggaggacgacctggagacggagaccagcaggagcagcaagctgatggcgccagaacatgacgacgccgccgccgccgacgagatattcgacgaaataattctcaatgggtaccagatgatcattaaggggatagatgagctgcgcgtcgccatgggcagccagagccaggccgacaagaacggccgaagagcgtcacgcgcgaagacggcggtggtcgacctacacaccctgctcatccactgcgcgcaggctgtggcgacgggagactggcggagcgccaccgagctgctgaagcagatcaagcagaactcgtcggcgagaggggacgcgacgcagaggatggcgtgctgcttcgctgaggggctagaggcgcgtctcgccggaacggggagccagatgtaccagtcgctcgtcgcgaagcgcacgtcgacggtggacttcctcaaggcgtacaagctgttcacggcggcctgctgcatcaagaaagtgagcgtcatcttctcgaacaagaccatctacaacgccgtcgccgggaggcgcaagctgcacatcgtcgactacggcctcagctacggattccagtggccagctttgttctttttgctgggagccagggaaggcggaccgccggaggtgaggatgaccggcatcgacgtcccgcagcctgggttccggccagccgaccagatcgaggagacaggccgccggctgagcatctgcgcgcgccagttcggcgtgccattcaagttccgcgccattgccgcaaagtgggagacggtccgccgcgaggacctccatctcgacccagaagaagaagaagaggaggtgctcgtcgtgaactgcctccatggattgaacaccctgcaagacgagagcgtggtcgtggacagcccgagccccagagacgtggtgctcgacaacatccgcgacatgaggcctcacgtgttcgtccagtgcgtcgtcaacggcgcgta

SEQ ID NO: 54657 - DNA, 1672 bp, Oryza sativa
agctagtgtcctgttcacaatattgtaacagagcattacggtcggatgtgaatatgtaaacagagtagtccagcatttgcagatggcgacttgggcagtgaatgatgaatcacgaacgcaaaaataatagtaacaaatgggtagaatattgttgaagtatatatagggtaagaaattaattaaggtacgtaccgtctgggagaaaggatgaatgaggcggttgaggaggagatgattggggtgttgtggtgtagtagaggataaagtaagagcagaggcagcaagcagcgaggcatcaaagcggagaaaggagggatccaagagggagcggaggaggagggccctagtagttgtagtagtagtagtaacggggaggaaggagaaaggggtgacgcaggcgaggcgccagcggagagccttgagcagcgtgagctccatgtcccggatggtggacgcccggaacgagtgccccatcgcctcctccatctgtcctccacacaacacatgcatccatccttcagttcacttcgtatcgatcgatgtatatgaatatatgatatgaatgcatagatatgatatgaatatgaatgcaccgaaaattaaatgaaatgaaaatatacgtatagtacctgaaggtcgtggagcgaggggatggtgacttcgtcgagcttgcaggcgagggacaggcaccccacgctcaccacttccaccatccactcctcccacttctgccaatattaattggcaatgcatactcagttactagctagaggagacgtaccactactactaactgagtactccgatttgatcgatagatttaccaaccaaatggcaattgatggagaggaagcgatccagatagttggctgcgttgaacgccgtcgcggcctccagtcccagccttcccattgcctgatcattcatcatcatatatcaatctttcgattacaaattaaaaatttacacaacacaagagctaacaacaataattatttattttgcacatcaataatctatctcttagtgtctagatatcactatctatcagaatgtacagatcatggaagaatatatagctagttaattaatagagagaatgatcggtcgatacaagtcgagaatctgtacatacatagatgatgtaacgtacggctttgagcctggcggccgccacaccatgctgctgctgctgaagaagaagatgatggcattgcaggtagcagcagtaatctctgatctgaagagcgtaacacctctgcttcgccttgtagtactccatcacctcatcatcaatatcatctggcgtcgtcgtcccagcttgttgctgctgctccggcggtggcggcggcggggggggcgtagagtcgaaagggtcctcatcgcagtagagatcaagagaattattgaaactagtatcgtcgtcatcatccatgcttgatcgatctaccgcccgccgttcaccgtctcttcttcatgaattaattctacctagctagcagctgcatatgcgatcgagatgctccctccctcccatggattatatacctacctagctatatctaattaattaatgatcaacaagctagaatgtatatagccaccatgcaatataatggttgtgaaggagacgcagcaagcaaggcgaaggcaaaggcgggcggcatgatcg

SEQ ID NO: 54658 - DNA, 11542 bp, Oryza sativa
cattgtaacgtacgagtattttttcaagtctattgaaaaggaagtaggagaactgacttgctcagttagttacgctaaattattttttcatcatcgtgcggattattggagattaattgaagaacgcgcggcattaattcgtagagtagtattcatagggtacgtacaacgccattgaataatctgacagtagcagagacaagttcagtctgtacagtgaagtgcaaagcttctcttagaccctgaattccaacctttttctttaaatttttaactttttcattacatcgaacttttttacgtacacaaacttctaatttttctattacatcgtttcaatctcttcaaacatttaattttagtgtggaactaaacacatccccttatagtagtagccgtatgttgattagagagacagcccaggccggctcctcatgattgaggaataagtctactttgtctctctcaaatttacgccatccaatctaatttgtatctctcaatcataataccatatatcttaagcactcaattattaaaaccgatgcaaaataactccctcgataattttgaggatggttttcgctgacgtagccggttgacctaggccaaccattgaggaagtaagtagggacccacatatcatactatttctccttcccttcctcatccctcctctctccccttctgttcctcctctccacaacgatggtggctggcggcaagttcccattgggacgaagcggaaaccgggggcagttgttggcagctagcacaacagagccaaggaggacggcggcttgacctcacggaggcttacagaaaggttgaggggaaggtggaggggcgatagcaaggtgatggcggcggaggagtgtagcgcccgttccgtcgtggcgcctagcgggaaaattatctcttaaaaaccctatctgcgaaatttgtttctttgattgttgtctagtgtccgtgccatctcaagatctcaatccccgatctatcgtcgagttcaaatccgaatccaaatccttccaaatcgattccctccgcaaagtttagtttgcctcccccggggttcgatgggccgaattccgctcggcccatctctctctctctctcccgggctctctttttctctctctcttcccccccccggcgcgctccttcccccctgctcagcctcgcccgcgcgctgctcgcgcgtgcgagagccgccccgagcgtctctctccctcgctgccgctccccgcgtgccgttgctcacgcgcgcccgcgctgccgcccggtcccgccagcccgcgcctgtcgcccgagccgcgccggtcaaaccaccgcgcctcccgctgttttcccacgcgcgcggccgaccgctcggtcgccgccgtcgtcagcgcctgcccgcgcctgtcgccaatgtcgccgctccgctccaaaccgccgtcgtcatcgccgtcgtcatcgcccggcccccgccactccgcgcgcaagccgccaagggacggaggcagcgccccccctccctctgccgcgtcgcccccgctcccctcctcctctttcccaaatcgacaaaggggcaagccccttttccccttttcctccccgccggcgtcatcctccctgtcgccaatttggccgctagccggagcgccagctcgcgccttgaccgcgcaagtcggttctcaaaccgacattgccgtcccctttaaacccccggcctccccttacccctcctcttccattcgtctccgcgccatagccgccgccccgtgctctgtctcacctccgccgtccttcgccgagcgccgggagagccggtgcattcgaggacgcggaaggggacttcggccgcgccctctccttccccttccccggcccgaggccggagagattactcacgcgtcgtcggcctctcgtcacagcgcccctcctcttctcggtgatgtctctctccgttccccctcctcgctccgtctcctccccctagctttcggtagtagctcgagtagaccccccgtagctagccggcgccgccccaaccgttgccttcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcgacccctcgtggcctcgtcgccgtttccctcttcttccgccgccggttgccgcctccgcaatccgccgccgtcgagcgacctccggcgaatccgagccgttggctcgcctccccctgtcacgaacaactgcccggtgtgctcgcttttgcccgtatctccgtggttcgctccgccgctcgccgccgccgcccgccgtccattcgcggccgggtcgtcgtctacctcccgccgtcctgcgtggcagccacgtaggtgccacgtcggcgccagctcagcttagaccgggtcgagccgaccccggtcggtccctccccgtgcgcgcgttccaccgcaagccgtgaggctgcgcgtgggcccgtcgcatctgcgtccgccgcggaccgcgcgcatgcaccgcgttcctccccgcccgcgtctaaatttcctccctccttccttttctttctcttttccaaaaaggatttaattaaataatcttagaaattcaataatcttagaaattctatatcttcccaaccgtaaatccgtttgactccgttcaacttccaaaattcatcaaatctcgagatctatctagtggcacgctcagaggtcattaatagggctttattttcgctgtttgttgagttgccccgtttcgcgtgtagtttcggagcccgaagacccgcagtgcgaggatttcgaggatcaagctccagatctcgagcaaggcaagccacctttgaacaccttgagcctatatttgaaatttaattatgttgcttgcaaaatattatgcattgataggatcacacttaatctgttgtcccgtctgcgaagcagattggcggacttacctaatttgtcgcatttgatccttccattgttaattgctataccatgtccccttgtaaccacccagttgcgcctcgatactcgcgcactctgtgcgagtaccgacggtcgccttcaaacttaaaatctgagtaacaacttgggtaaaactggagttttacaaaagacttggaaaacccgacacttgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctggggcctaacctgttgttggtctaggacccctctcgtcggcatatggtaaacctgcatcggctttcgaaatgccttgtcatgaaagcttggaggtctcccgacgtggctgatccccacgggctgggtgacccgggttagtaatgtcgtgtgggtaaagtgtaccccctctgcagaggtcattaaactgttcgaacagccgtgcccacggtcatgggcggatgtgaggtgattcctagcgtagttttgtttgacttctgcttgtgaaattgctgttgtgaaactgggttcgatgtttggaaaacctgcagctgatgggatcagctaggcccgggtggcagtttaaaagttgttggcccaggtggctgtttgaaaagagttggcccgggtggccgttcaaaaagcttttggccgggtgccaaccttgtttcaagatctaaagactgacacattgcacatactccgaccggacgagacgcactgtctcatccgtgtcgtttgagaagcactcacttagttgcttttagaaaagagttcaaataaaatcaattgcaaaaacaacagcctttccttgaagcctgcattaaatacttatttcccctggcttgctgagtactcccgtactcacccttgctctatataaatatttccccccctcagttgctgaagaagatgaagcagatcctgctgatgaggagttcttccaggagccagccggctacgatgagttttagggtttcggcctagttcccaagtcgcgcctgtgattgattggtccaagtcctggcttccgccttccttttgtaatgcagttgtgagctcgggatctgtccgcagcccaacatgactgtacttctactctataataaagagacttctgttgctgtgatattctgtctccctgtgataccagcactgtttcctgggactggtatcgattaacaggttaatttggagcgtcacgggttagttccggtcgggactaattcggggcgtgacaaggagctcgtgggggttgggacatgatggccctcacctagtccgcatatacacgggtagagagtggcatcgtgaaggaggacgcggttatattactccaagccgcagaccactgtcagtgggtcgagatggatgggccaataggctccttcatgacggccgcaaagtagaggccgacggctttgtcgaggctaccgtggcagaagttaaagtgattagcggcgacgtctcgaccgtccaagtcgtgggtcgctgcccccggttcagcttcgctttgctgggagctagccaccagccgatgctgctactatgcagaaggggggtattttacttattgccacttttaagatgtggcgatgaagaatttgtcacttacaatctatgacgtgtggcccttgtatatttatgacatgtggatctagtggcaaatccttaattgccacttataagagtgacaaatagttaaatatcttggagagggggaatgtaatgggaaagagagagataatggagaaagagagaggaggaagaaggaaggggagagagccagagagggagggggatgttatgtgggtctgcacatgttggctcaatgattggactaggctaacatgccacgtcagcgaaaatcaactcaaaactaccgagcgagttattttacacctgttttaatagttgagggtttaggatatctgatactgtaaccgagggatacgaattatattggacatatatatttaagggagtctaagtgtacatactctcacgtgattgaaacatgtggatgtgtgggccacgatcacagaaatatgggccacttaaatataggccaggggcctatgtgctttacgttggccggcccacaagcgtggagctgggatagtgggcttaatggacctggaccagaatctatcggataccactccactacggagtcccctcctcttctcccctcacctcacgatatgatgatatccatccatcgctgcgattcgccgccgactccatccgatcctcctcaactccgatggcgatggccctgctgctgctgctgcttccgctcgccacccaccctcagccagcgtccaccgatctctttcgtgctgctgcttgcttcaccgatggtgatgcatgcttgatctgtgttcgtccaaatgcctcaaagggcgatcccatcttcaaccgcgattgcgatggcgattaggcgatggcgctgagccacctcctcctcctcctcctcctcctcctcctcctcctcctcagcgtcacctcttccaccgattcccctttctttctttcatgctggtgctgctaatgcttgctattccccttgtgtgttcgtcacaatgcttcacaaggaaggtgcgtcatcactcatcaaccctcgcacccctgccttcttcctacctgtttgattacattcatcggtactctctctctatctctcaattttgttccatgaatgtcacatgtgaattagcattccactctcccaagttttttttttgaaacgaaaagcggcaaaagacttgccgaataaattagaaggagtgcaaaccgtattgttcccattgcttaatttagcattttggctgacagtaaaccgtcttacagtattgttctaagaaaacactggatggacacagaaattgacaaatgatacccaaatgaaatatactcatgtatagtatagcccatatctttatattatattattattaacaaaaacttgtcatgcccagctatggcttgggcgcgatctgatacacagaacaaagagaaaacataaaaaggagaaataattaatagcaagcgtcaagccggcctgcttaaaaggtgtaaaggcagctgccgtcgtcgctcctcgccgttgggtcgaagttcttggcaacagggtcggtgcaaccttccggcacaggcaggttacctgcttgctgtgctccttgccctgatccaaattatcccaagtactaactttaatcagcaacctatcgatctatatagtacataacataggagtatagtattatatgtttgagaaaatgcagacaagatatagtagaatataatatatatatatatatatatatatatatatatatatatatatataaatatatatatatatatataaatatatatatatatatatataagggaaatatcctttgaaaacgagcttagtgttggaaactagtgaaaattatatctaaaaattttataaattcatgaaaaaattactagagaggtgtagatatgaaatacattgttaccaaatttaagtccaaacttaacttcatttgagagaaacaaaaattctcacaaataaagttgagtttgaacttgaaatttggtaagaatatatttcatatctgcactatatatctctagtagtattttcatgaatttacaaaacttttttgtatgattttcattggttcctaacacatagattgttttcaccggatatgtcttcatacatgcatgtatgctgaaggactgtatacaggaattacaaaatggaatagtgaagagttaaggggttaaatcacctcctcctcctatgcaggccgcctacgatgcatcgatgggatgcgaatagctagagatcttttattcagctggatggcgcagaacctatagacaggggcggaggtagaattttgtcatgcatagggctcaatcatttagtataacaaattgtaactagaaatttatgcttttccggccctaataattttcttgccacgtgtggagctcaagcctaattaagctgctcgacacgtggctccgcccctgcgctatagatagaataacatgtataacaaatcttaatttgtgcgttttagctggtcataattaatttagaggaagctatttttgtttctttcataatatatatatatatatatatacagtgatagagagagatgtatcatatatgatgatggtgtagagtagtgggagggtgttggatctaaccgtagaaggaaccagtcttcatggcgtcggagttagcgtcaccaagagcagcctcgctcaagtactgctcagccagctgcacacgcttgacgttctcctgctccttcacaagcatgtatccgtactccatgagcttttcgatcgtcatcttgggctgctcgaactccggtgggccctccctcgagttcaccagcctcttgccaatgttctccacacccgtgtccgacacccacttgcgcacctcgtcgtcgtaaacacgggcacgaagagcgccgaagaaatctgcatgcagcaattcgaccattcagtttcagtttcctttaattttaattaatttggtcattgatagcatttttggttgcagatggatgtaccgatggattggcctgggaagctgtcgacgatcttgacgatgtcctcgtcggggacgttgtcggtgcggaagatacccttgcagacgccgacacggtcgtcgcgggtgggagcccagtagaacttctccatacgcccgtcacggatgagcggcgcgtacagcgtggagaagtcgttgccggtgacgatgatggggacacgggggttgtcctccttgttgtacatcccggggagctgcacgttggttgggttgtcggcgatgttcatcagggtggcgttcaccatctggttgttcaccgtgtactgggtggtgcctcccatgcgacctgcacccgcgtccagatcgttgatgaagaggcagcacatcttccccttcttgatgatgtctgccgcctcacggtaccgctgcctgatcagcttcgccggctctccggcgttgccgctctccagctctccggcgctcatcatgatggggctgtaagtacgtacgtacgttgtaagtcaattagcaacaagcaagtacatacatactactaattaattcgaaagttcatactaacttgatccccatcttggcgaagacgagctcacactggaaggattttccctgacccttgcctccccagatacccaggatgagtgggaccttgatgttggggagggtcatgaagttcttggagatgtggacgacgagcttgtccatgaaagcaggggcgatgtagaagcctcccatggtgttgtcgaagtcgtacctggaggtatgtatgcatatatccagtcagtcaattcgattcaattcagcatatatatgaatatgatgaataaaatcgattggtgtggtgtacaaattagatttagtacgtacgttctgagaccctggctgaggtactcgtaggagctgaggacggcctcgtgggtgccatcacccgtgggagcctggaaaagggagtcgacgaaacccttccccctggtgatgtcctgctggtcatcggagatgtcgtaggcgagacccttccacctgtcctggtcggtctgcttgccctcgtccagctccttggccatcaccttgaacctgttgatgttggagctcttgccatggtagttcaccgccgatgtcacctgcttcttcagcttcttccccaggaagttggtcggagtggacgcctgcacatccattaatctcgcaagtaagtatcctcatttaatttgcagcaaaaacatgtacttatcaagctagctagctagctgcgtatgtatgtgtaccggagctccaacggtggaggagaaggcagcagccatcttaatttgctgaaagtcgatgattgtagaggatcactgatgatggccggccgctgctgctcaaagtgtagaggccgagctgcggtaggccttaaataatacaatagaattggacgtcgccatggaagttggaggctgtgagaggcacacactcgtccctgtggatcagcttccagatcctccacaggccacacgctgaagattgggttctgcacacgtggcgcaatctcggccggccgatccacagcatagcatgacttggacctggatcggagtctgtgagcgagttaggagtatattgtattagtgtaggtaggaaggatctcttggcttcagttccttgacctttcctcaccacagaattcacccatttctgatcaactctttctctctgttttttcttttctttccttgcctcacattcgtctcccggccggcagctagcgaccagttgcttcatcagctcagctactacataacctcttcattttgcatcaccacagaaaagccttttgctgcctctcgttgcccggcttcttggatgaggcatggcatgcaaattgtattctagttggactaccacaaatattttgctctgctacctgcacatattctgctttctcgataaccatcaggctaggactgtcatttggcaccacacaaacttctcttaacatacaacataagcattgtacgttttttcccctttgatggtttccgttaccacaaaaatacaaaaattctaattttgcactgctgttgatattgttttttggtgaagcatcaatcggaggcagctaaatctgcagcagtgccttaagatgaatttatttgtggttcatagctttcgttcctcctaagcctctatattgcttttcgtaacttttgaaaattaattgtttgctcatgtcatgtcagtagtaatcttttatgcaagtcatgtgaaatttctcctagctagcttgtccctactaagacgtttgagatggaggcaagtgattggtaacgacacttgtaaggtcgagtctccagtacattggaaaataacagtcatctcactaggcaagtactagcgcacatattggaattggataacattccccaacttgtgcatcattacagatttacagtgatacgctaattgttatcgtgcaacatgatgaatagcacaggaactttgatatagcatgcatctgtagtaacaaatgcaacccgcaagttgagaatacatccatatatagggaagtggatttggatccctcaaggaaatattccctcgttgattgcatgtcactcaagtggttatgaaaaaaattgagaagatatattaacatgtgatatatcactctacaaacatgcaaataaaaattcaacttcgacatctcgtaacgaaaaaaacaaatttaactctgaatatacattaactagctgttgtttaatttgtatttttcattacaatttgtagaagttgaacttgaacttgtatatttgtggagtgttatatcacatgttaatagaccttctcaattttttttcaaatttttttataatcatttgaatgacatgcaaataactaggggatatccccgtatatagtcagcatgtgtatatatcaatcagcgatatgatggcacatccacagtatccagagatcgtacgtatcgttgcatatgcatacagtactgctagtacactagtggataattaatgaactatgtgacaaacgattggattatgtgcaaaaatactaataatgtattagtatatgacaagtgtaatttcaccacatatcacatacttcgaggtattaaaatttgtagtgtaaaattttagtatgtactatactttaaaaattctcatacgattaatttaaataatactagttaatttgggtgcagtagtgacaaattaaacgttcctctttgttaagggtacaggctatatagggtgcgaagtacaaggaagcatatcgatggtgttcatatatatatatatatatatattcattaatcaagtgcaaaattaagaagctggtggtgaattggtgatggattgagttcagttgtagacgcagctgccgtcgtcgctcctggcggtagggtcgtagttggcggcgcgttggtcggtgcatcccgccggcacggggacgggcgactgctgctcggccttgccgtagaactcgccggagtcgtggttggcgtctccgagcgccgcctcgctgaggtacttatcggcgagccgcaccctcttgacgttctcctgctccctcaccagcatgtgccggcccgtactccatcagcttgtcgatcgtcatcttgggctgctccaactcgatccggcggagttcaccagcctcctgccgatgttctccaccccgatctccgccacccaccgccgcacctcgtcgccgtacacccgcgccc

SEQ ID NO: 54659 - DNA, 3764 bp, Oryza sativa
ccgcgtccaggtcgttgatgaacagcacgcacatcttgcccttgttgatcatgtccgccgcctcgcggtaccgctgccggatcagcttcgcgggctctccggcgctcatcatgatgaggctgcatgcatgcagttgtactactattacaacacacgcagcatgcaatgcagttgtacttcctactctcacttgatccccatcttggcgaagacgagatcacactggaacgacttgccctggatgttgggcagcttcatcaagttcttggagatgtgtccatggtgttgtccaggttgtacctgcagcaattaattaattaattaatcaaaatgtgcatgcaacgcagcattatatttcaagcattattgaatgtgcttaattacgtacgttctgagaccctggctgaggtactcgtgcctcgtgggtgccatcacccatgggagcctggaacagggagtcgacgaggcccttccccctggtgatgtcctgctggtcgtcggagatgtcgtacgcgagtcccttccaccgatcctgctctgtctgcttctcctcgtcaacctccttgctgctgccgcccgccatcgccatgatcttcctgcacctgcacctggacctgcctccatggtggctgtaccccgccgtcctcagccaattcttcaccaccaacccgcttccctgccaagccacaacatgtcagcttctgcatgcttttaaactttcaacaggacactcctctgtttcttactacagatctctcattgcaacgttaacgggtctcctctagtttttcctttctatctttaaatttcttgttgcttgcttcaaatcatgatatgcttttctatctttctgacaatacctaaaactttattatatgaatttaacaaaattgttattttctcaacaaatacaaatttttaaattgtaaagttggcgcgacaaaataaatggtaaaattggcgggagaattatataacttgcttaattgcaaaatattcagactcctacagaattatatagcagcaacaggtatctctcatccatttgccagcctcgttttcatttgccagtctcctacgagtactaatttatatcggccgattttgacaaatactactgtgcatagtaggaaattaaccttgtcgtgtaggaatattattagaggctagctagctaacagcaggagacgagctagcgtacgtaccggggctccgacagtggaggagaaagcagaagccatcgtcgtcgatgtcgctgccatcgatcagctggtgggtatgtatgtatgtatgtatgcacaagatagtattttaattagcttcttgcagttgtactaactagctagctgcgttaccgatcttgcttgctagctaggtactaactgagtgagtgatcgacgaatgagctaggtgcaagaagaaattaaattgtgcaattaagctggctcagctcagctcagctcgatcagggacacccggttgatgagagctggcttgctgatggagcgagatttatagctactggcaatgcaaggcgaacgattgcagctttgctagtgtccaagcgatcgagtgtgtgcccgactcttccagaccgtgcctgcatattccctgcattgatttattacgagtactagttaaattgatcaccaattaggctgtgtttacttccaaccaaagtttagaatttggttgaaattggagacgatgtgactgaaaagtcgtgtgtaaatgaaaggtttgatgtgatggaaagttggaagtttgaaaaaaaactttggaactaaacacacccttagacacaaattctgtaagcccaagtagctatactatattcactaccagactttagagctatcctgtgggccgtgatattttctgtgcgttttgcagccaacccacagaacatcgctatagttctgtcggttgtgctaggactcatagaaaattaccactgacaggtgggcctaaatccatcgtatagaagtccagcagcccacacaagaaaacctagtttttcatccctcacgtcccaatccctcgagccgccgccgccacccctctcctccttctgcagtccccatcgccactcgcgagtagatccagcgccggcgccggtgctttgacgaatggagaccacgccgccgccttgtgccatcgatgagccatctcttccccggcggtgccagccaacccaagttcagggtcttcagatccatatgccccattctcaatggtcacggatccagccatcccgaggctgggtgttccagatccggtggctcccatctccggcggcgccaggtctagcctcgaggtgagtggatctgcggcagtttgtccccagcaagcctcctcgtctaacagctggtaggtttgctctccggattattttgcaaggatttgtagtatgtgattaccaagagtagatctggatatttgtcttgatttggagtaaatgatcaccgtatagttgatctggatatttgtcttgatctggatagtctagacaattagacttcaagaccgataattgacttgcaatatattattttgcttcgggtagcaaatcatctgtctactaatattgttgccaattactttacctttaggtgccaattacgaaatacagagatgttctgatgactttaggtgcccttttttgaattagttaatcaattaaaagtataagtagaatgatattttattcaccttactctttttttttcaaagccctgagacagccctgattcccggatattaagcaagaaaagttgattcccatattagtctacattatgtaacttagtccataatagaaacttaattttcttggattagtctagtgtataatgtccattttacatctaaataatttgtttcttgtttcaacttatatcaggaccatctaattttcctctctcaagccattttgtgaagacctaatacagtggcaccacaacaggtactcccacattagagtcccttgctactaaaaaaacttccctgttttatatttaaatgtcatgagacaaagcttcatcagttacagtaaagtgatctgcttgaatgtgttgctaaatataactaacaaatgtgcatgacctaaactgattctttgtatagctgatttgcatattcaatttgtccatcttgcagagtccattccaaaactacagaagaacgccaaatttcaacgaagtcttaggtacagattaagtgccacatcttagtgcatatcttgcaagttattatttttgttgcacatcattcaacacctgttgcctttttgcttgcagctgattgaaaggtgttgatcaatcagaattttcgtacaatgtttggtggataattttatcttgaaagataaaatatgaatctttataagtgtatctttataaattgtaacatagatggagacttgcagttcctttaccactgggtggctattttcttagtgtttgtaaacaggattgacacaaagttgaaactttgatatgtatatctcactgaagttgatgtatctgtgcacaattgtactatgaatatttgattgatgtaaataattatgtatggatctaatcatgagtgcaatatccaaatcaatttacttgtgtattaatctgaagtgcatgtgcatagcattctctcttctttttttttttccttggaaagccaatttttctgacggtgcactcgtcagaactatgttctctcaaacccggcgtctcagtttttttctgtgttccacccacaggaaaagg

SEQ ID NO: 54660 - DNA, 10987 bp, Oryza sativa
tagacatgttatatagtactccctctgtcccaaaatatagaactacctttggactttttttggagggactaaggttgcggtaaaatttaaataaaggatggttgtgattgtttgagatgaggaagtaggtggagaaaataaatgaagattgttgtgattggttgggatgaggaagtaggtggagaaattaaatgagagatggctgtgattggttgagatgagagaataggtcgagaggtagctatattttgggacaaaattgaatgctaaaggtagctatattttggaacggaaggagtaactaagatgtacaaactctcgatgtcttgtgattttgagctgtgactgagtgactgactggtggactggtgaataggatttgtgacttatggagtgatgaataagtatttaacccaaacaaaacaatatatataaaaatattgcatgtgacgtgtagcaggcagcgcacaagcagaacttactcatcacgaccaatgtcagcatactgccgatccttatatttgggagtataggatctgcgcttccgcttctcatcatgtcctttaggctgtcctggagagtttgttcggcactcttcctttctctgtggggaattatgcctgtagagcagccacgagggtcatctcaaatgaaaggattttcaaaacctttgggggtgtggtgttctgttgtacccttggagggcaggtgtcggagtcttcctctaataccgtacaccttttcttctctatcttaatgaaatgatacgcagatctcctgcgtgttctaaaaaaaacagtactgggtacagtatacctggctccaattattcttcgcatttcctcgggccttttccgtgtctgcacagcaaaagcaacactgatctcacgtccagaaagcatcttacggttcatgtgatatcgcgctttagaagcatcagaagagtgagcaaactccacaaatgcaaatcctcttggctccctacatatatggtgttataaaatgttggataagtaatactatatatatttacgttcaacagagaagagggtgcatattcatggtatgtgctcaactagttaccaccaaagttccatgattcagtgaacgttccatgattcctcatgaagcatagccaataactaacattttcatcaaaacatgtagcatgcttcaaaaaaaagcagctaggagaccaagttcttctagtagcatcttcataaaatggtcacttgaaattcctcaaatgtttcagaaaatcatgaaagtacttgaaatcaacttctcttcaataaatcttctcatggaagacaccagtaaaatccaatcctcttcgggaaataaatttgtgaacaaaccaaacctcctctccaaagaacaactttatttgcacaatactctacctcaccaagacaccaaacaagtgaacagttaggactgtgaaagagatcttcaacaagtctagtgcttgtagttacttcaacacaacacaacccgggtaatcatgccagaacaataattttgccagaagaagccacataactagtacgtacaatattaacaccaatgtatgctgtacagagtacagtagtacagactacagggtgctatattttttacaaaaaaagtagagtgaaaggaaagtggggtctttgtgggggtttgtccagacatgacagaagttagacatctcaaaagaagattacagttgtagattcttcgctattaaaggcacaccagcgagagaagatttaaagcttctcagagtctttgagccgtggctggctcaacatgtgttaacatctaaccatatactccatagtatcaaatgagaaggataaaccaatttcttacccagtgttgtagtcttttggcagataaacatcccgaacaggaccaaacttttgaaatggaacttggacatcctcaggtctggaagagaacccaagtgaacaaccaggagcaagtgaaatgatgcagaaattggtattgtattgtattgtatacctgcagcttcgcggaaggttgctgacgaagaggcttacagcagcaccttccttatccttggcacagccatgtcgtgagcttggagggcttcttcccctgctgccatgccttctcctcttgctggggctgcggctcctcatcgctcttctgtgcctgcacaatacagtacatagccactgaccacgattatcatttatcaaaggcacagatggcgaaatctttcgtccagattgagattgtgagatacgcagatgaatcagcgcaagatttctttactgaaaactgaaaagggattggcggcgctgggcaatgagaaattagggctcggagtttaggggaaacacgaaccgtatcttggtattctacttgctaggcagcgccgccgccgccgccgccgccggcggtgccggaggaggagcggagacaggtagggcaggcgagacacgcgacgtgggaagaggaggagacgacagatggtggcctgcctgttatgggccttatcaatcgaggcccaccaagcctacttgaaacaaatggactttgcttcacaaactagcaaattattaaagctacttcatctatcccaaattataaggcatatatttttttacacgcccttaatagcatgctttgatcagtattttattatattcaatgatcctaacaaatatgaaattagcatcacatgaaagtacttcaaaatatgaatctagtgatataacatgcataatacttaatatagatatagttaatataattattagttaaaaacttccgagtttaattttacttaaaaaggagcgccctataatttgggacgaagggagtacttctcatctatactcctctctgtgtttatgtcgctagcgtgtggttcttggatatgcagtttggtacctcgacagtttctatattttttatataaaaaaaatctctttcttataatatatttgatggtctccttcggtcttcccggcgaataaagcaacttctcctacagtctacagagaaggaacatcacttatactccaggacaattcagaacccacaaagaagaagattatataaatggcactctgcatagattcaatcggtgtagtattcttttcttcatatgtacagcaaattcttttctattctctgtctgtcaaacatgatgtattcatgtacacgaagaatgaaaaatgtatatactactagtagtagtatttttacaagcagatcaactcagggagggaaccaagattctgctaactgcaaagttggttgcagagttggttgatcttatcttgcgtggcatccgctataaggtagctccggtgtacgtttgtgccttcacatgtcaagtttaatgtattcgcttgttgcattacctgcaaaggggaacaatttggtcataccatgaactgtcaagagatatgtccttcatagccattttcagaatctagccaaagcaatttcgatgcaattaaatgcttcagatttcaacaattcagattccaacaatttagttgagcttcgattagataccaaaaactgtagtattatgcaggagcaatagtctattactcagcaagaacaacacatttcttgtctacattatacttcaaatttctttagcttgtttctattcattctttgctgatggcactatcacttaaaaaggtaaacaaataatgatatttgaactgtcttaccgtgcaatatgttggtgatgagttgcatttccatcttttcgtaggaacacagctgagatagtgacaccaagagcagtggtcgtttgcattatatcctcggagaagcagtactatagccactgtaaatctgtcaagttcaaaattgggagatttcatcaagggaggaaacatgggtaaaatacattgccactattcattagagcccaaagaggaaggtcagtggactaacccgacaattagcataatggcagcagctaaccacagtatatattggtatgtcttgtgcttgcgtttcacaggagcaggttgttgtccaggtgctactcttctctgattaatccatgcaaactgtggacgaataaacataacaaatccaagaaggaacccggatataaggcccccaatgtgcgcaaagttatctaccctgggaagtatcccaagagccaaattcaccacaattacaaacactagtgttagtagtgctgccacctgacaaatgagaaaaaaatcacacaatataattcaataggaatttagaatggaaagaaaagctaatgaattggtgatgtagcagtagttgtttctacaatcaaaaaacagaccttgtttgcatagagcgaccaattcgttatgagttcagaaagcatggacccaatcaatccaaacaaagcaccagaggcaccaacagagatacttgatcggatgaagagggcagacatcaagctcccaccaagaccagagatgagataaaccagaccaatcctcactgcataacatagagaaaatcagacttcagaaagttgtctacgctgtgaaactacatattccgtattcattttaccactacaccattacttcaatgaacattgattcatattcacagaagttattgcacataattaacatgtattgtacctacattcctattacagttcaaggcatcgactcctcttgtattctaccaatgcaagcaagacagtaaaaggtatgatattatactcccaatccttacttgaacaggaagtcgtcttactcattaaatgtctgaggatttatatacaatgtattagtgtgcatccatcaaatagaattacatttataacaaattgtacaaaagaagctaattagccattatccaagcaaggtcatggctgaatagttggcttgtctgggacgtaaagttcagatgaaatatgcaaagttaacttaccaaacccaaactcttgttcaagtcgaatgccgataaatagaaggcatagcatattgatgagcaaatgaacaactccagcatgaagccagatgcatgtaattagacgccatccttggtgaccatggacaaccttagttacatctagagctcccatcttcagtaacctggtagtaagatgaaagcatttttatcatcttgaattcaatatgcatagtaaaatagtactattgtcttagctccttttgcccccatctccctttttttccctcaagttttgtgttggaaaaataacactgactcagttcattgtacctctaagcaaacatctgcttcttaccaacaaaaataaaagtaccggctcgtcctacaatccttaatctttttttttgcggggactacaatccttaatctaaacaagacaaaactctaagtttgaagtggtaaccctttccagcttaataataataaaaatggagccacggatcatgttcaccgaacaaggtacttccaattccaatagttgactttgcaaatccaaaatattatcgtaaaatatccaccgtgcagtaagatgagcaatcagagatttgaaaagaagaagttttcaatctttcttcggggttcaacaactctccaactgccaccatgagtacaaagaatagactgaatcaatacagtagtaatcaaagaaaaaccaaaccaagtctaattaatggtttcgtttagacaatcctacatttgaattgggaaaccagttggcagcttgcatattttttatgttcttttaataaagcaaatttttatttttgagctgtcagtttcatattgtgatatcacccaaagtcaagttgcaaggagcttaactctctagttaaagaaataaaaacgtatgttacaaatctcacctagagtagttgctaacctttatggatgaagtaattacagaaatgtaatgaatgttttgtaaacaaaagacagtaggttgttcatggtgcaaataaaaaaaggaattgaaagaacagttgcagactcttcattgcattgcacagtagacacgaagtacgttgagaccaaccctattgaagtggagtacataaacagaaggctttcttaaatgcaatgcattgcattggtaactgacgagagaatggatgagcagagttgagaaatggctcattttttatccattgttcgttgtctatagccaattgaagcattggttgacccttacaaacaaattatttagataatgagatgcataacagaatactactaccatgtttggagtcaggttcctaattgcaaccagccaaccaaccaaatgaagtggatgtattgaaattagcaggcagatatgaaaagcagaagaaaaataaaatcttggttggagtagataagagtttgctctgcatctgtaattggtgattgtatctactctagaaagtaaagaatggatggtgtacgtagctaggtacattaacattaagcagctatacgtcgtttattgaacaagaaagatcattatctaaaaattaagcaagaaagaaagaaaggggggcggagggattgaaggcgatcgacgtacgtggcggaggaagggccgaggaggggattctccttgagcggctggaaggcgaagcggccgaggaagccggcggcgcagtccccggagttgcggcgggggcaatcgttgacatacatggagacgaggaagacgacgacgcaggagagggcgatggcggcgacgatccagggcgtccatcggcggtagtaggggcgcgccctgagacttcccggccggtgagggtgcaccggcggtggcctaggcctctccacgcggacgtccaggttggcggcgggagacggcttcatgggacttggagacagacagacggaatatggaaatggaatgaggattggagttgagaatggaagagacggcggttgatgaatgaattggagtttgcttgccagcgagagaggagaagaagaaagaatcagcagccaccgcgtttaatttctactactccagtactacaagttgtagtatattgtagtagtattggtttggtaagcaaggagaagaaacaagtaggtgtattactccatgtcagaggaaattcgcagaagaagaaaagaaaacctctgacggaaaggccggcgcgagggttcagattactcctttttacttgtgtgcggtgcacccaatcagaatcagccaacaacaacttgcttaccgcctactacgtgttgaggaaggaaggaaggaacgcgcaaaattaaccaaatgaagaaacgcgtttcgtttcttgttggtgttgttggccaacctcgatctcttctatacgcctccatcgcgccttgtataattctactaccgccaattaaattcgaagccacctaccgtgatgagaacgagagagcgactttattttttaacggaattgctagaaaacttgctactgtcaaattttcagcccttagatccgcttcaagattcgtgcgtgcaacaagataaaaaacagcatataatgtgtcgtggacaggaatcgatccttggccttgctcatacatatggcagcattcaaaccactaagccagcacaacttcatgtttcttaatctacttatatagcatttacactctagttacatagtgtcacgccccgaactagtaccgaccggaactagcccgtgacgctccaaattaacctgttaatcgataccagtatcaggaaacagtgctggtatcacaggaagacagaatatcacagcaacagaggtctctttattatagagtaggagtacagtcatgttgggctgcggacagatcccgagctcacaactgcattacaaaagggaagcggaagccaagacttgggccaaacaacacaggcgcgacttgggaactaggccgaaaccctaaatctcatcgtagccggcttgctcctggaaaaactcctcatcagcaggatccgcttcatcttcttcagcaactggggggggattatttatatagagcaagggtgagtacgggagtactcagcaagccatgggaaataagtgtttaatgcaggcttcaaggaaaggctgttgtttttgcaattgattttatttgaactcttttctgaaaacaactaagtgagtgcttttcaaacgacacggttgagatagtgcgtctcgtccggtcggagtatgtgcaatgtatcagtctttaaaattgatcaagattggcacccggccaacagctttcaaacggccacccgggccaacaactttcaaacggccacccgggccaacaactttcaaacggccacctgggcctagctgatcccatcagctgcagattttccaaacatcgatcccctttccacaacagcaatttcacaaacagtaggcaaacaaaactacgctaggaatcacctcacatccacccatgaccgtgggcacggctgttcgaacagtttgttaacctctgcagagggggtacactttacctacacgacattactaacccggatcacccagcccgtggggatcagccacgtcgggagacctccaagctttcatgtcaaggcatttcgaaagccgacacaggtttaccatatgccgacgagaggggtcccagaccaacaacaggttaggtcccagactatactgtgccaggaagcccaagggtcctccccgacaccaccccggcgaatccacatgtctctcggcatcaaggctcccctgataagctagttactcagccaggggtgtcccattccacccatgtggtcatacttgtcttatattcggatgaaattccaaggaaacggtccttaagtgcaagagcgggaaaccgtacacccggtacgttcctcggtccgcggttttggaaaattcatttagttcgtaagcaccgacccaggtgtcgggttttccaagtcttttgtaaaacccaagttttacccaagatgttttttagattttaagtttgaaggcgaccgtcgatactcgtgtagagtgcacgatttccgaggcgcaactgggtggttacaaggaaacatggtataacaattaacagaggaaggatcaaatgcaacaagctaggtaggtccgccaatctgccttgcagacgggacaaacagattaagtgcgatcctatcaatgcataatatttttcaagcaacataattaaattcaaatataggctcaagatgtttaaaggtggcttgccttgctcgagatttggagcttgatcctcgaaatcctcgcactgcgggtcttcgggctccgaaactacgcgcaaaacgggacaactcaacaaacggcgaaaataaggccctattaatgacctctaagcgtgccattagatagatctcgagatttgaggaattttggaagttgaacggagtcaaacggatttacggttgggaagatattgaatttctaagattattggatttttggtctaaaggaaaaaggatttatttaaatcctttttgaaaaagaaaagaaaagaaaagaaggagagggaaaattagacttccctcgggcggcgagggcgcggcccgagagaaaagaggcggctcggccgagctaaatgggccggccggcccaaaaggcggcccaaagcgcgcgcgctggcggggaggggagagagagccggtgggccgggtccatcctgcgtggtcccgggtgggacccgcttgtcggcgactcggctcaccgtgcggagcgaacacgcggcgcgcgctagggttcggggagggagacgcggtgcacgcgcgcggttcgcggaggatgcggtgcggcgggcccacgcgcagcctcacggctcaccgcggaccatgcgcacgggggggaaaagggagggagcggctggccgggtcagccgatccggtcgcggccgaggtggcgctgacgtggcgcctacgtggcagccacgcgggccggcgggaggtagacgacgacgccggccggaacggacggcggacgacagcagcgagcggcggagcgaaccacggcgatacaggcgaaagcgagcacaccgggtggttgcacgagacgaggggagatgagccaacggctcggattcgccggagggagtgcgtcggcggcggattgcggcggcggcaaccggcggggagggaagagggaaacggcgacgaggtcacgaggggccgattcctggcggcgagagcatctacgcggctacgggaatccgtcccttgtgccggattaggaggaaacgcatcgagggaggccggcgacgagaggcgcttccgagctcgggcggcgacggcggcgagcacacggcgagcgacggcagcagtcggggcggcgccggctagctacggggaggctactcgtgctactacccgagtctaaggggaggagatggaacgaggagggagaacggggagatgcgctaccgtgcgggacggggggcagtgacgatgggccgacggcacgggagtgatctcttcggcctcgggccggggaagaggaagaagagggcacgcccagagtccccttccgcgtccttgctcgtgccggctcctctgacacgcgcaacgatgaacggcgacggcaaacagagcacgggaggcggtggcaatggagtggaggcgagagacgaaaacgagggagattggaggagggaggagcttgggtttataggggcgacagtgtcggtttgggagaggggaaccgacattggacggtcaagccggcgagctggcgcccggctagcggccaacacgacgacaggaggtgacgccggcgagagggaaacgggaggaaaggaagggagaaagggagcttgtcccttgccactttgggaaaaggaggagggagcgggggtgacgtggcagagggaggaggggctctgcctccgtcccttggaagctagcgcgcggagtggcggggtcgggttgatgacgacggcgatgacggtggggcggtttggagcggggcgacgacacgggcggcaggcgcgggcaggcgtggcagaggctgacggcggcggcgaccaggcggtcggccaccacggcgcgcgcgcgcggaaagcaacggggctgcaggaa

SEQ ID NO: 54661 - DNA, 2905 bp, Oryza sativa
catcgaacccgagggaggcaaaatagacttttgcggaggaattgatttgggaaggatttggattcgggattgaactcggcgatagatcggggatttgagatctgagatggcacggacactagacaacaagcaaagaaacaaatttcgcaattagggtttttaagagataattttcccgctaggcgccacgacagaacgggcgctacacatagtagttacacgcttgttatatattagttatatagtacttataccctagttatatagtagttacatgatagttaaagggtagttacatttgtataaaattagtatttgtaatttttttcaagagcatgtgttttacttttgaattatttttccattatacatgttgaccaatttcttaccgttcaatcaacttggatgctaagattagtggtttgtacttgtgtgtacccatttcaaaactgttgatgacaaatcatatggttaaaaatttgaaagttttgagcctcaaaaactatcgacagattactagctagttccattttttaacaactccaagcattttaatttcctcgtttttcattatcatatttctcaaacaactaaggttgtgttctttcccatgggttcccaacccatctcctttgttttctgcgtgcacgctttttaaactgttaaaacagtacacattttacaaaaaagtttataataggagagttgctttaaaaaatcatattaatctattttttaagttttttatagctaatacttaattaatcacgtgttaatctatcgctccgttttccatgtggaggggaggggttcccaatccctccaaaacaaaagaacacagcctaaatatgtttcgtataaaaactttatatataaatatttcttcaaaaaaatcaaataattccatttttaaaatttatattggttaatacttaataattataagttgtaaaaatataataaatttatctgtaaatatacgtataccaattaaagtttgattttttttgttataacttgtagaactcgaatttgaagatacatgtttgttgagttacatattacacatgaatctatcttgttgctttttaaaaaaactttttataaccattcagttgatatgaaataaatggtttggtgtacatcaaagtgattaaaattgtttcccaaaacatatttgtagtctagtttcttccatgattccatgattgcgggtgtatgtgttgacatgtactactactctacttgcgatatactataaggttgagttatacccaaaccgattttaccgtatggtgagttctatgaatgataatttcacgcttttcattagcatatttttcgaactgctaaacgatgtatttctatatacaaattttacatattctttaaaaattaataatttttttaagcttgtaataattaatgctccacttattatatactaattgttggtctcgtgtcacgtgcctccaaaatccacactcaattgctgaatcgaacacacccctagtccgggagggttgttgggctatgatttttaagtgccatgcgaaactaacaaactatttatacatgattaattgagtattaattattacatacataaaaattatttattttatttattttaaaaaacttatatattgatttttatggaaaatattgtgtgccttgtatgatttctttgtgatgtttcactcattgggacttaatgttctatacagtggttgttggtactgcagttagtattttctgaatgttgtatttctctacaacattttataaaatgaaatgaaacgttttagtatgtaatgaaacattgtttttactcggaggtcgaccaggaggccgccacgcatgctaccatttcagggtacatcgcctactacacggccaaccccgagtccttgacaccttcatgcagaggtcctcagaggtgaaagactgatagtcaagctactagagagagatggaaaagagaggagagaggaagagagagaaggggaagagaggagagagggggttgggcatgtgtgtcccacctactaacttagcgagtcaagcgtgcttaacctgctacgttaatagaaaccgcttcccaaatcatggaaggagtcggttaacaccggcttttgaagaccagggagagttttgcagccaagagagacaatgtaatcatgagcaagagataaaggaagtaaaatagacttactccaaacaaaggcgggcttcatatccgggcctctccaccccatctaggattggaataagttcacttggtgaccctcaaaagtgatcgaaatctaatccgtgaccctaaaccacgaaatcagatatcttgaccctccaactcttaaaaccagtgcaatttaactccctcggtgattttggagagcggtttcgctgacgtggtgcctacgtagcagtattgactcggtcttctttccacgtggcgttgacgtggcgcttaggtgccattagaaataaaaaatatgtgtagaacccatttgtcattcaccaaaagtatgggtgggacccgctgacatgtggggcccacataaatcatcctcccctctctctcttcctcttcccttcggcgagccgcgagcatggggacgggggccggtggcggcggcagcggcaggatgtgctttcacagacccaaatctgccatggaagcccaaaatccctgcttccacgcaaccgctcgcgacactcgacggcagcgcagcagctggaggacaaggaggttgcgctagcgaacgatgtgctccaggcggcggtgactacgattatgttcccagcgcggcgacgcatctagagctcgggcaagctagctggcacccaatcaccgcggaacagatccaggggcgacaaggccggttacccggatgagcggatc

SEQ ID NO: 54662 - DNA, 9460 bp, Oryza sativa
  unsure (1)..(9460): unsure at all n locations
gtcccgtgagcccccgctcatgctgccgcaggcgccatccggctccggctccggcggcgtcgcgtccggtggcatgcgggagaacgcgcagctcgcacgggagctcagccagatgaggaagctctgcaacaacatactcctcctcatgcccaacagtgcaagtacggctccacgcagcagctcgacaccgccaacgcctcctccgcgccatcctcaacctcatgccttcctgccccggcacgaagctcttcggcgtctccgtcggccggaagcgaatgcggcacgacggcggcgacggtgacaatgaccacacggcggcggtgaaggtggagccgatggacgggcggccgcccgccgccactccggccctcgccgcccgccgcgggagagacagaggggggagcgaaaaggaccgagaaggnnctggagggggaaaaataattgggncccgtgggtcctacaatttctttcacgtgtcaatgacaaatgggtctcacacatattttttaattctaaatgccacctacatgccatgtttaaaagagtcctggtcaataccgccacgtaggcgccaggtcagtaaaaccgctctccaaaaccgtcaaggaagtcaaattgcaccggttttaaaagtttgagggttaagatatcggtttcgtggtttagagtcacggattagatttcgatcacttttgagggtcaccaagtgaacttattcctctaggattcccggaagttctggtctattaagaaagttcatgaaggcccaataacgccataccatatcacatgcagtttggagacccggcccaactcaatcccaacatggtggcaaagaaagtagtaaagaaagaaaaggcagccttctaagcactgaccgcccggacgtactggtggaccgtagctagtgactgcattttaatattttgccataaaggctgtgattagatctaaacttcagttcttttctatcacatcaacctatcgtacacacataacttttcagttacatcatctccaattttaaccaaaattcaaactttgatccaactaaacacagccaaagttagttactgcatgatcgaatacgaaggtttagcgtagtaacttaattagtcatcgttaacataacggacaagctgcctaggtagcttactctacttagaaaaagcatttttcagacgtgagggtttttattttcgtaggtggatatggctctcggacccaaatgaccgtctacaaaaatgtaaactgaggtgaaactcgctgtccgaccacttaagcggtccgcctgtaaaaataccatttatttttgaaggcggacctcttacgtccgcctacgaaaataggcgtggaatataaatggaccactcatcacttagattttttctaagtcctcacctatcctctccctcaaccggcctctcttctccctcacctctctccatcaaccagccctcacctctcctctcactcagtgacgggcgttcggcggcggggccagtaggatccgcgacggcgaggcgcggggtcggtggcagcaacggcgaggcgacgctcgggggcagcgcaccctcggcgcggctcgcctcccctccctcccagatccagccaaaggggggagggggaggccagtggccggtgacgcgaggcggaaaacagaggagggaggtcggcggcagcgctcctacctcccagatccggctgtcggccctcctatcccggatccagaagcgtcatgggggagggtggcgacggcggctgcatgcagtggccaaggtcagaggtcgtcggcgacgctcccccctccccccctcccctccacggcggcagcgggctggcgcggtgagctcgtggcggcgcaactcccctcccctccctctcccctcccaaaaccctcatgatggcatagctcgtggtggcggtggccggaggggagggcggccaaatattttttacgctgaaaatattttcacaggtgggtggattcagccgcccgcaaaaattattgattttcgtaggcgtttggttgcggacagaagttatggacgcctgaaaaatacgttttagccgcctataaaactgttttttttccagtagtgttacttacgtattcatcaattaatcaattcattccaatgcttgaataataatactactgcatgtccgtccaccacttatagctacttaaaaagtggtgacaacagtttacggatgaaactaattttacgggtgtcacctgcatagtaaaagaccatctagcaaggcaactactcccaccgttaaaaaaaaacctaatactaaataaatatgacataataaatatgatattacagtacaacaaattcggatatatctaaaatatgtcacatttagtaataggttagttttttatgggacggaaggagtactctctaaattatcaaattatctttataagctgtgtttagattcaggggtgaaaagttttagcgtgtcacatcgaatatacggacacacatttaaagtattaaacgtaggctaacaacgaaacaaattacagattccacttgtaaactacgaggcgaatttattaagcctgattaatccattattaacaaatgtttactgtagcaccacattgtcagatcatggagcaattaggcttaaaagattcgtttcacaatttacacgcaatctatgtaattattttctttttcatatatttaatactacatacatatgtctaaacattcgatataccaagattaaaaaattttgccagaggattaaacaggccatagattgtgaagcttagtaggggtataatagccttgagatgctaaaaagtcaaagtcaaacgcacgtgcgtgtgcttgccgatacaaaagtctactggtagcacatcatctgtatatgactgtcttgcgattcaaggaaaagaaaataaactttgtgtctcatttcaatgaacctgaattcgatgcgtgtacacctggcgatattcttctcaaaaaaacaagaccagtgtccaaacgatatgattccaaatctcacgatatataggaaaaagaccaaaatgaaaaaaaaaaataacaaagagagtgggtgtgggtcagtgataagtcatcatacaaaacatggtgtgaggagtccaattgaagtcattattttattttatcaaaaaagaatactacaaagcacctatagtagattttggcaaatcttataattacaacacagtattattttattgcatactagctcttgtgccattagtaactgataagaagacggataaaaaatatttctaaaatctattatattattaagacagctcaaaaagaaggcaccacgttcgctgtagaggctaaaaattcccacattaatcgaagaaaaagaaaaaaaatctacaccgctagatcatgacagacttatagtttaaccgttgagattgatcggaatagtataagtaagaaagagtacatgacaaatcctactcaaactatgtaaaaaaaaaaactatacagcaaaataaaaattttgttcggactgtgatggcccaaccggacagagggttgacaacgtttcttttgtccatggagaaacttaccaaaaaaaaaaaaggaaaatcaatctgtttccatggcacttaccgcatacaaccaaaaaagagacctgtcagctaacaatcaaactcactcagccaaccaatgcctcctttccttgcacagcagcgcgtgatttaatcagccacgcgcccacacgatgtcattgaaaggcaagtttaatatgatcaaaattttgttaagtaagaagttaaattgttttgttggttgtagattgaaagataaaaatatattcctaatttttcttgcatttggagataattttatggttaaataatactataaatatcaaatattacatatgaggtatagaaattatcaagacatcaagatcaaggtcagtatttggcagcctgtaatgttcgatcatcaattctcgaccatattctatctaagaattaattcacatttgcagggctaaaaaaataccacatttaatcaaaagaaaacaaacatattaccaagggacggcaaataaggcggcattcaacgacggcttgcaggaattttaaaaaaattataaaaaaatcctatcaatgatatggatattaccggtgtagtgagatgacaaagaagagaagcaatgggcaagtgagtgtgtgcaaacaaatgagataggaggcagttgccacaggaggacatgccaagggtggtaaagtaaataaaaaataattataagagttcaagtaggattacaatttataaatgaaagaaatatcacaatgagaaatatttatttttgaaaaaaatagtccatacagaacacaacaataacaaattataataaagatgagagaaacaatagacccataaaaaattagagtggtgtaggtagatgggacatgtaaaaactataaataaaaccttaaatagaatctgaatgataattaagaggagggacgacgagcaggtcgttaagcagcatgatctcgacgattggagggatttctagaaagtaaaaaaaacccctcaattattatcatgttcgattttcaaatctcaacgataataaaaatgggaggcagcaggcgggccatagagaagtatagtagcggcgtttggtgagacttctaaaaattataaaaatgaaacccaacaatacaatgaactctaaaaccacaaggtcaaatttgtagaggtttcagggaggatgaatgaaagcattggtagatcgagcaagtaaataaagcgatgacaaagaaataaggcgtagtgattagcatgactattaaaagcaccggggtgataaagtcggtttttcaatgttctaacataacgagatagttatttaacaaattttaagtaaaatcatatgtaaaacatagataattttatatgggtgttagccgcgcaattgcgcgggccacccagctagttattcttcatttaatatataatcgatcactctgtatttttaaattaaaaaatcactttgtttgggaaataatcagtatatatttatttatttgtatattccatcgtaatcaaaggcattggcgcgcaaacgactttgggtgggggcgacgaccaataaacaagacgaggtcgagttgagttgcgtcgcgtcttcctccccgccgccgccttccttgaacctgtctccattaactcctccatgtctccattgtctccctccacactaacatccactattatcggatcgcaagaatccacagcccggccatggccgccgccgcgccgcagctggaggaactcgtcgacctcgagcccttctctccgtcgctcttcctcgacctgcccccgacgccgcacagcgacgaccccaacgatgacgatctcatcctccccttcatctctcgcatgctcatggaggacgacatcgacgacaagttcttctaccagtttcccgaccaccctgctctcctccacgcccagcagccctacgcccaaatcctcgacgccccatccgacgacaccaccaccaactcctccgacgactccgcctccgccaccaccaacaacacaaccaactccgccgccgccgccaacgcctcctggccctacgaccccatcgagctctctcagctgctccaatccccgccccaccccgtctccgacaaccacgacgccgacgtcggcgacaccaggagcgcgccggaagacgacaaagacctgaaacttctgttctccgccgccgacaacatggagatgctcaacatggcgttcctcaagggcagggaggaggccaacaagttggtgcccaccaacaacaccctcttcgccggcttcgacggcgcctcgctgctcaagacggagccggcggtggatgagcccacgttaatgttcggacgaagcggcggcagcggcaggggccggaagaacaggcacggcgaggaggacgacctggaggcggagaccggcaggagcagcaagctgatggtgccaccgcaagaggccaccgcggccgccagcgagatgttcgacgaaataatgttcaactggtacgaggtgatcatgaaagggatggaggagctgcgcgtcgccatggacagcgaggccgagaagaaggcccggaacggcggcggggccggccggagggcggcgcgcgcaaaggcggcggtggtcgacctacacaccctgctcatccactgcgcgcaggcggtggcgacgagcgaccggcggagcgccaccgagctgctgaagcagatcaagcagaactcgtcggcgagaggggacgcgacgcagaggctggcgtgctgcttccccgaggggctggaggcgcggctcgccggcacggggagccaggtgtacaagtcgctcgttgcgaagtgcacgtcgacggtggacttcctcaaggcgtacaagctgttcgcggcggcctgctgcatcaagaaggtgagcttcatcttctccaacaagaccatcctggacgccgtggcggggaagcgcaagctgcacatcgtggactacggcctcagctacggattccagtggccaggtctgttcaagtgtctgtcggagagggaaggcgggccgccggaggtgaggattacgggcatcgacttcccgcagccggggttccggccagccgaccagatcgaggagacaggccggcggctgagcaactgcgcgcgccaattcggcgtgccattcaggttccaagccattgctgcaaagtgggagacggtccgccgcgaggacctccacctcgaccgagaagaagaagaagaagaagaagaagaggtgctcgtggtgaactgcctccacttcttgaacgccctgcaggacgagagcgtggttgtggacagcccgagccccagagacatggtgctcaacaacatccgcgacatgaggcctcacgtgttcgtccagtgcgtcgtcaatggcgcgtacggcgcgcccttcttcctgacgcgcttcagggagacgctcttcttctactcgtcgcagttcgacatgctggacgccaccatcccgcgcgacaacgacgagcggctgctcatcgagcgggacatattggggcgctgggccctcaacgtcatcgcctgcgagggcgcaaacagggtggatcgcccggagacgtacaagcagtggctggtgcgcaaccaccgggccggcctcacgcagctgccattgcagcctcaggtggttgagcttgtgagagacaaggtcaaaaaactctatcacaaagacttcgtcatcgacgtcgatcacaattggctgctgcagggatggaaggggcggatactgtacgccatgtccacatgggtagctgatcgtgatcacaaatccctcttttagttcaagatttaattatctgcttcaattacttacaaattgagaactagatatatactcctacatgatataatatcttcatttgcaatgtagagctagctacataagattttgatatatatatatatatatatatatatatatatatatatatatatatatatttccagcataaataaattgagaacttcatttttttttttgctactatagtttaggcctgtgtgctcttctgtttgctgacaatctactatagtgttttcactattgtcgtgtttgatgatatgttctctttgtcatgtttaattcacttccttttgtgtacgcaaattcttgatacttcccttctttcaaaaaaaatcttgatacttccatttccctggcaaaagtataacagttgcatgattgagcagtgcagtttgttcaccaattattcaaagtgtttgaggtgtgtatcgctgtcttactttctaatattaatggtttgtgggccagtacaactcttgtgtttgtatggattcactcataaagttgtgatatatgttccaaaaaaatcagtttcaaatctgacaacagttaaacagcgatactgattaacaaaaaaagggtgggcggtggggtattcaatgtatatatctgcatgctgtccgcaaaataaaagatgtcatacatttcccgatgtttcccacagtttcattttgacaggcagttcttgctggatatccttgtatttgagtcagacaagtacatcaaaaagaggttaccagattgaagacatgttaattttctgtaaatattgttgagagttgatcactgggacctgctctgtgatatactcctatttatgtgaaattgacattgatgattccaaaataaaaatggctgcttagtttgcaatataatagatagatcttttcttttgacaggatgttattaaatcttgatggttttttttttttgaactaggagagcatattaaatcttgatggtacctgagaaaaagtccactaaactagttacaaatattcaaatttgttgtatgatagtcaattgttggtcaatagcttcatctgttaggctgcgttcgttccttgggcacggttaattaagtattttaacataacctttgaggaacattgggccaaaggttccctgcaaatttctatacgtgtttccttacaaattctagtactttacatattcctgggttgtgttttctttgattactggcaggtttgaaatactgctagtttggtttatcatgcattccatgtgctgagatagtttgataattacagactgatgtagtaggtgcagttttatctgtcttttgcatttcagaagcatagaactgttttttttcttatatatactggggctaattttactaaacaggtatttggtctagtaatttcacgctgcaacactaaacaagcttgtatagctgtgtttcagatagaagtttgtgaaaagattagcaatttgttggagaagttaggtacaatatcaattttaagctagtagagttagggggtgtttagatcccacccaaaaattttacaccctgtcacatcgaatgtttgaacacctgcatgaagtattaaatatatataggctaaaaaaataactaattgcacagattgcgactaatttgcgagacgaatcttttaagcctaattactccatgatttgacaatgttgtgctacagtaaatatttgctaatgacggattaattgggcttaataaattcgtctcgcagtttactgacggattctgtaattagtttttttattagtgcccaaacaccccatgcgacatcctatataatatccgatgtgacacgccaaaactttacaccctggatctaaacaccccccctatattctgtaaaaagggatgtgcatttcattcatctttctgacatgttaggtaggagtaattcagtaacaagatagcagttagagaatctccaacaacctttctaaaatagactctccgaacatccatatagccagctagctatcctgtcgggtcccaaaactaacaacttggatccgactgagattaatgtatcaatccctggatcagtaaa

SEQ ID NO: 54663 - DNA, 2560 bp, Oryza sativa
ttatatagagcaagggtgagtacgggaatactcagcaagccatgagaaataagtgtttaatgcaggcttcaaggaaaggctgttgtttttgcaattgtttttatttgaactcctttttgtaaacaactaagtgagtgcttctcaaacgacacggatgagacagtgcgtctcgtccagtcggagtatgtgcaatgtatcagtctttagaaatgacataagatcggcacccggccaatagcttttcaaacagccacccgggccaacaactttcaaacggccacccgggcctagctgatcccatcagctgcaaattttccaaacatcgatcccctttccacaacagcaatttcacaagcagtagtcaaacaaaactacgctaggaatcacctcacatctgcccatgaccgtgggcacgactgttcgaacagtttgttaacctctgcagagggggtacactttacccacacgacattacaaacccgggtcacccagcccgtggggatcaaccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactccgccaggggtgtcccattccacccatgtggtcgtacttgacttatgtttggatgaaattccaaggaatcggtccttaagtgcgagagcgggaaaccgtactcccggtacgttccccggtccgcggttttggaaattcatttagttcgcaagcaccgacccaggtgtcgggttttccaagccttttgtaaacccaagttttacccaagttgtttttcagattttaagtttgaaggcgtccgtcgatactcgcacagggtgcacgaatatcgagacgcaactagatggttacaaggggacatgatataacaattaacaaagggaggatcaatgcaacaaattaggtaggtccgctgatctgcctagcagacgggacgacagattaagtgcgatcctatcaatgcataatatttttcaagcaacataattaaatttcaaatataggctcgagatgttcagaggtggcttgccttcctcgagatctggagcttgatcctcgaaatcctcgcactacgggtcttcgggctccgaaactacacgcgaaatgggacaactcaacaaacggcgaaaataaagctctattaatgacctctaagcgtgccattagatagatctcgagatttgaggaattttggaagttgaacgtagtcaaacggacttacggttgggaagatattgaatttctaagattattggatttttggtctaaaggaaaaggatttaattaaatcctttttggaaaagaaaaagaaaagaaaagaaaagagggagggattatagacttttcctcgggcggctagggcgtggcccaagggaaaaggagcggaccggccgagctaaatgggccggccggcccaaggcggcccaagtgcgcgcgcgcaggggggaggagaaagagggccggtggaccgggctcaccgtgcgcggtcccgggtgggacccgcttgtcagcggctcggctcaccgtgcggagggagcacgtggcgcacgcgcgcgggcgggggagggacgcggtgcacgcgcgcggtctgcggaggaacggatgcggcgggcccacgcgcagcctcacggctcgcggtggaacgcgcgcacgggaggggctgaccggggtcggcccgtcccgacctcggctgagctggcgccgacgtggcgcctacgtggctgccacgtgggccggcgggaggtagacgacgacgccggccggaacggacgggcggacaacagcggcgagcggcggagcgaaccacggcgatacaggcgaaagcgagcacaccgggtggttgcacgagacgaggggagacgagccaacggctcggattcgcctgaggaagcttgacggcggcaaatcgcggcggcggcaactggcggggagggaagagggaaacggcgacgaggtcacgaggggccgattcccggcggtgagagcatctacgcggctacgggaatccgatgctagcgtcggattgggcggagctacgccgagcgaggctggcgacgagcgggtgctacggagctcgagcggcgacggcggcgagcacacggcgagcgacggcaacggtcggggcggcgccggctagctacggggaggctactcgtgctaccaccgaaaactaaggggggggagatggagcggggaggaagaacggagagaggcactaccgtgcgggtcggggcgcagtgacgagaggccgacggcgcgggagtaaactctccggcctcgggccggggaagaggaaggagacgagcgcccggagtccccttccgcgtcctcgctcgtgccggctcctccgacgcgcgcaacgacgaacggcgacggcgaaacagaggggcgacaacaatggagtggag

SEQ ID NO: 54664 - DNA, 2674 bp, Oryza sativa
  unsure (1)..(2674): unsure at all n locations
gcctcccccggggtagatgggccgagagaaattcggcccatcgaccctgggggaggcaaaatagacttttgcggaggaatttgatttggaaggatttggattcggaaatgaactcgacgatagatcggggattgagatcttgagatggcacggacacaagacgacaagcgaagaaacaaatttcgcaattagggtttttaagagataattttcccgctaggcgccacgacggaacgggcgctacagtacagctattcgaatagtttcaaagatattctactgcagtagatgtacgctttacccgcagtccacgacttgctgataattatcggctttagtcatggcccagtattaagtcattgacaattatggcacctgttccatgaacttatatcctcatatgctctgaacgtaatgttaacagcagcaagaggagttctggcgttcccgaggtatttaaggggaactgatcatatgacaccacgtcatctcgatcagggtttagaaatataccatataatttatactcgagtatcataaaccatttacctgtacgtggtaatggttaaagttgcccttcgcggctatagttgcctcctgcgcgaggacttaaaaataagaaccactatacagaggcgccatattgccaattaacctaataactaggtctgtccccattctagaaactgcggtcgtactcgttcgttcgacataagtacctggtaaaacttatgtcgattgagacaatactagccacccggaaatcatccaaatcttacgtattgtcccaatctaagtatagggtgttttaaccagattgtaagcaaaataagcaatactaaattatctgggtttctatgattaatttatgcatagaaaatagaatattgaatagaatgctataaataaataatttataaaatataggcttaaatgatcaacaggtatatggtaacttgccttgctcgatgtcctgagattgattgatattatctaaagtgtcagaggaatccttaagacctagggttagacatataaaattcaaattcaaaaggaattcaaataaaatccaaaaatatgaaaaatagagaaaataaaataaaatgcaaaaatagcaaaaaggggcttaaaagatagagaatgattttagaagaatattggtccaagtttcactgggattggatctatattttaaaagatatgggcttctaaagtttgaaaatcaaataaatgtgaaatggcactgtgtgcgggtcccacctgtcagtctctctttctcttctcttcttctaccttcggccgttccccaaatcgggtcggcggtgctagggtttaggattgcggcggcgttagagggagaaagtggttgcggccgaggaggggagggagctagggatctccggcgacggcgagcggcggtggaggagttaatttgatgcgtggacggtctagcggctagggcggcgaaggcatggttaggccgagatggcgatcaaggtgataagagttagacatggctaggtgttgacagaaaacacgaggcctgggagatctgcttaactccagtgcaggtccaaagctcgccttcggatgtatgagcatgccagttgatttgatcttgcaattaacaagaaatagaacaaagaaaccacaattaatcctataaatgatagccgatcggctaggtgccgatgacatatcatttatttcaagccgatgtcgtgtgtacatcgatcggcaaatatcaataagcaaaccagaactaaatctactcgatcggctgtagatactaatgatatataatccttatatcgatatatacttaaataaaatgattgggatagatcggtcgccttgccgagacagtataaatcacttagatcgaaatatatattaatagtaggattatatacattcataacatagccgatcaggtagatctagcatgtatcggctaatactccgatactactnnnnntaagattttaaagcaagtagaatatactaaacataagcttaatatacttagatgcgacaagatcttaacataaagggtagatttaacatgtcaatcaaacatatagaataaaagtagttaaatcagataagatcggctgaaactccgatactaccctaatcagcaaccagaaagcaggctagagattgcaattctaagcgcgacttaatagatcaaactcaactgatgcagcattaagtatgaaaagaaaaacaatatctagacaatcaagccgctggaagtttcatagagtggtagatatatcacataatctaagttaacatcattgtctaacctaatcggctgccttccattaacagatgttagccgattataggttagatgaagatattatcaaagattatgtgagatatatgataactcgacgaattatatagacaagattagagtgtcataaagatggaagcactaatcttgagaacataagtcgtcatgacaaattttacctcttgttgaagatcgaaaccgatgcagctcaacccgagaacacgaactcgtcgaaataaaagtaaagcataaagggtggcgatgcgccgagattgtattggatgtgttcctttttttacatagggctcgggtctatttatacccgagaattacaagatacgcccataacggacactactattatctcta

SEQ ID NO: 54665 - DNA, 863 bp, Oryza sativa
tatcaaattattattggaaaattatagattcaagatttaacactaagtttattaagaaatgaggtttaaaacttaagtatcacaaaattatagatttaataataaagttatcactgattacatattatggggttataattatttaggctttgtgattaaattggtattaaacatgtaattttgtgataaatttatggctaatatatttgtagttttacaataatctgtattaaattttattaaaatatagcgaaatttactctaataaaagatgcgagcacccatcatttggttctagttaggcatacccatttggtactacttacttgttgctactagttaggcatttgatattaatagtagttaggtatcgcatcgtattcctaattgatattcctattgtacatcaagactagagcatcgtatcccttacgaaatgaaaatcaggctaacatgttatatatacactagtagagggaaggtatatgagtcgaatccgagtcatttgcattaccactagtctagtgatgtgcatccgagtcatggaacaaagcaaaaaaagatgtccaaactagcagaagataattaacctgctcatttttgtatgtgcagaaaaatcaaaacaccgaccaaaagcaaaaaaaccaataaataagggtgtagggagttgttgagttgggtccgcgaatcgtggtttcccactagcaagcgcaagcgcaggcgcaaacgcaaacgccgccgccggtatgccggagcacgggtcgaagcccgacatctccttcgccggccgcttcaccgcaagcgccatcgctgcatgcttcgctgaggtatccaatcaatccccttcgatttctccgatttct

SEQ ID NO: 54666 - DNA, 1250 bp, Oryza sativa
ttagcgggcctttgcatgacccctgacagaattggtgtagtgccttttttttgtggagaacctctcaatttgtggaaaatgatgaaagatgagctgcagaattgagctcggttgagactttttttttcttttccgattggaatatggcctggttggttctctgttgtctacatcgtaaaatgttggtttactggcattcactgcttattttgctttgcggtgaatgaacaccgttcacttgcactgaactgaggtctgagggatcaagcaaattttccggaaaaccataaaataatttgaaaagcgtgagcaatagcttttataccgtgaaatatagagagtatttatatttcctggaagccatgaattatgtttcttctgttgcctcttcagtcttcactgcacaaatcatgaaaaatggcactaaaccatgagcttcattgcatagttgtatatcagtatatgaaagaaaaggagccttacaaactgatgaagggaaaagcgtttttcttttcaatccaacacatggctgatttgaagcatatgagattatgagacaggcttgagtctgggactgaatggatgaaagaagaaacatgcatatgtcgtggttggaggagattaataaacaaaagggtgtactagtgtaaattaagtaaggtataatgcacccgtacgtggtggaggcaatcaccagttgagttgtaaaactgcaacaagtatatataagctgctatgctatgcacactaataatttttgattgatgagatttagggcggctaagggtaataataataaaattgagttcagtagtagtagagtccaagtgaggtcctcggcaaggtggaggaacgaggaggcctgcttccagctccagctccagaattgttggcaatggagttggagtaatcatccttgtgaaactgatacctgcaggaggaagacgaagagtacctggcgctgaaattcctctcaagcaaaacttcatctgccctcctcatccccaacctgccgccattgaatgagcttccaattccactgaatgagcttcttgcgctgacgctgctgttgcaccggagcatctggccgtcgtaaccccttgcccggagctccggtggcgccgcccgtgcctcgccggcgaacgcactggcagtggcacccacactgttggtggtgctgctcttcttgtgcaggaggccccagatgctccaccccttgatccccttgttcttaggcttgctctttgcct

SEQ ID NO: 54667 - DNA, 1934 bp, Oryza sativa
ggtggtggtgcttgagcttggacttgcgacgccattcctgccagcgcttgcccagggagcccaaggcgagcttggtgttggttggagcatcagcagcatcgggcaggactagagcatcctgctgcgggtgcggctccaagtaggatgaggagcgggcgtagtaggagaaggacttgcagcggcggaggtcggatggcgggtggaggccggcgaggcggtcgcggaggcaggccgggcagaaccccgtcaccgccacgcccgggtggagcccgcacaccgacaccgtctccattatccaaccacaatatgcctctgcaactgcaactggactagtagtagatttcttcttcttcttcttcttcttgcaattaaactcttgactgaatatgcatgctgctaggtctgcgttcgttgcagaggaggcaaacaaggcaaaagaaaacaagaggagcagagcaggcaaaagagacagatcgatcgatggtctctctctctccctattcttcttcttctacttgagttgagtcttgagctgctgctgcttcttcttttccctttttccctttctcttttgcttttttcccttctctgaatccttctcttctttccccaccctctgcctccttggacttcactggaccccatgcttgtttagctagcttagctccgcattcctataactgtaccaccatttttttttctttcttctttgttttggattgcagtgttagctttgcttttactttttacaacttttgatttccaacgtatactcgctcgctcacttacgtatattactactagttagtacaacccatcttacccctttgatctcatctatcgatcgagctgtgtgtggttttagcactagtaggtgaaattgatgcatcatatcatgtcatatgtgtgggtgtagcatgcagattattagctggatcatgtcgaattatcaatggaccggccccttccatgccatgcacttgccatcataattaattattactaacaaactacgggggtgcactgcatcatggatctccacgcacgcatgcccaacttcgattcctctccttcatcaccctatccatccatatcacttctacttatacactggacagagaataacccaataaatactgtaggtaggattttggatgaatatactagctagtactttctctgtcctaaaatatactaaaatatagctatctaatatagaatatgacattatctatgtctatatttatagtactagataatatcacattatatactagatagctatatttttagaatggatgtagtagtacattaacctaattaatgtgcgttgctgtctaccgtacgtaccgttgagcttcatcatttagccactcgtcgtactcgtatcgtatagtgtacatatgcttgcattaccagtaaattggtaattgcccatagccaggcaatggtgcctccaattatcaattgaacaaaatctgaaagcaagcatctacaaggaaaagaaaagtactagtattaattacctccgtcctaacctaaaatattgctagtgttactatgattctgacatgctcatatctagattcataaactaggtaatgtcacattatatactaggtatctcccgcttgtatacacacacttgtgcacgaaattaagggcgtgtttggatgccaccctgggaatcacgcctgactcaggcgtcgatctcaggcgttcgatttcggtcacctgcggctagatcgacctgcctgagtgatagcgctcaggcgagggcagcaaccaaacacgccctaaatgcctctcacatgatacctgatatatgcttctcacatttttcccccatgactcaacaatgttaacaagtcattgttaaacaaacagtgggttgcacaaagtgacggtgatgaaccgacaattggagtatgtca

SEQ ID NO: 54668 - DNA, 4013 bp, Oryza sativa
tcagcgaccccgaagacaaagtgaaagtgtgcggctaacaacctggacaaggcgcctcgcaatagacgcgaagacctcggtggtagcgagcaagccctaggtgaacggagcggcggagacctcacacgacaaactcggctatagtgcaaatcggtttggatctgcggcgactccaacaacggtgctcccaaatctggtcgtcggtagactcctcttctaccccgcctccttcttgtcgctgccgctttctcctcttctccttttctccttgttcccctttccatatatatgaaagttgctttaaaaaatcatattaatccattttcaagtttgaaataattaatactcaattaatcgtacactaatggttcagctcgttttaagtttcttctccaatcctctcctctaaaacactccctttggaagtgtggaaaatttatgttgcatcaccttggctagcagttggtgtttcatggaccatccacaaaactgtatgttcttctaggattgagatcgtttgcaggtacaaacttacaattgtaattgcaacttaaggactgcatataatttcagccatccatttccatgattaacggttcatatctagcgctacagtaacagtatgatcaatgttccatgctacagtgtttttgctatggaacaaagaacaatgcaactcgtttgtctggacaatccgatttgcatcccttgatgagaactgctactgcctaagttgcaagtcacaatagcgcctgcaacttattcagattcgttcctctattgtgtgtttgagtcttagttgctaccaaacaattagacctagcgggccctatttggggccgttctaaaaaaattgaagccaaaaaagaaatcttttataagtatgcaaaatcctttacacatgtatgtatgtatgtatgcatgaacaatgtcgcctacacatgtcccaaacaagtcgtaccaagcggtactgccactatagtttacctaacaaggtcatctatctatgttatgcactatgaaaacaatgtaagatgttgacagttaaatttggtattggacccaatttaggctaaatttagatagggataagagccttcacgcaaaaagctgattggaggtgttagaatagtcggtctgatcaaatattgacctatatgtcaatagtcttatcaacagactatgagtccaactgtctatgtataatttgttctttttcatattccttttcttaaggtctaggattttctcgagttctaatacatctctaaacctaatataatatgaaaaggttttgtttacacaagattaacccctttataaagatcatgggtaattcaattgagccaaaatgaatatatcaagaatcattctagttttaccttttcttttatcctatattgtattttacctttccaacccactattctttgtcatcactagtccctgcaatattggatgatgtcctaactagcctgtcgagcctaggataaatcggcatgcgtgcatcctgatggggtctctccgaagtgtgcatgctacgaattagttgcgtgcaaacccacatgccaatgctgaagaagcacacaatgtgatgtccatgtgttagcgcggaccgccgccatctgaagtagtacattttctaaggagtatattggatgtcatttcggcctctacattatagtggttatagattttgttgaagcaaattaaggacaggtttaatatctattattaagaaaacacattgaacactgattagcgaatgtgtaataaaaggcaaatggatatagagatgggtggtgttggcttaatttcttggtgcatattgtagaagccattttagccaagctaggtggacatgggttagcttagctagcttggctttgaatcaatccgaattgtcttgcaaatatatgcttgtgcgaagctggctgcatcaacatcgatcttattctcctccttagctaccttagacaggcacccctcaactacatgcaaagggaaaggttgcaatggcaatataccatctaatctaatctaatccaatgcatgatgaatctgacggactttgatcagcgcatctaactaatgcttatggtgatatggtccaattgttactctaaatggttcaagaaaaatgaaaaaggtcccatcaatattcaggtggctgaagcgcacgcaccacttacaccatcgtgattgaactccctccagacacccaagtacccaactcattacatcgtccaatagattgaattaactaaagtattgcccatttctacgaggagaaaaactgaaaaggatgagatgattaataatgctgaggaggtcaaagtttagatcgtcgtggatatacaactgaggccctaaatgctgggagcacccacaccatatacaactgaggccctaaatgctgggagcacccacaccggtgatgcctgtgagcaccacacattccttgaggcgatgtcactgacgctcccttcctctcatcgtgtttaggggtagactctttgggtgaaagactctaggtgaaaacctagttcaaattgtacggaatagcaatgatgatatcatagatggcatgaccattttagaggcgtcgcattggaggttctattgctggtgggtgtcctttgtgttggattagcttcaatggctatgacggtggtaagatcttggcgaatgattgattcactgctcaattacccttcgacgttatcttctattttggtttgacgttagtcaccggtgatgatgtgtgagaaattcaatggacaaaatgatctacagttgatttcagtgattccgttttcgatttgcggaagacaatataacttgcaaggtattgggaaaaaacaatggttatgcatattctcaccactctatatggaaataatctttattttaagatggtactctaagtagttttttatttttacttaagttgtaattttataattcgcaatcgtttgccatgcaacttctataataattagttacaacttttttcttaagcaaaggtcaaaattaattatattatctaaagtcccattccaattaagtccccactattaatcgtgtgcacaagctcttccaaacgccaacatctaataacaaaactgtacaggtgagcactctaagaaatagctagatctatgtttactatattaattagaatgatctgaccgttaattagatagatcacactatgtagatcctattgaggatttgtgttaaataaaagggtaaataaaacatgcaactgaaaataccatcgagtctttaattttactctctcaagtcataaatatctagcatttgggataagattcgaccaaactttttaattttttgagcatcaattttatagtagtagaataagtttataaaatctaatattcagctgaatgttgagctaccactgtttcttatatttcaaaactaagcatttgagaaattattaggttgaaattttaaatgtttgagcgaatgttgtcataaaatccaaatatttatgataaaccgacggatatttatactgtgggctatgagcaagcaattttaaatgtttgagcgaatgttgtcataaaagccaaatatttatgataaaccgacgcatatttatactgtgggctatgagcaagccaacgcatagacatgcactggtataagattttgcaattgccactaaccatttaggatcggttagctcatttgtcatattcgttatatgtaaatatttgactaggatactatctttaagggaaaatgtaatttagatgctattttgtggacccttgtacagttgtactaggaacttgtcatcattatagttcctattgtgtaggccaagcgttttataggtgtggttgctgcaattgtacatatgactgacagacagggacacgatggagaatgtctacatgactagtagacggaacatggagtactcttcagtctgatgggaggaacatgccggattattgatagataaactgatataaggc

SEQ ID NO: 54669 - DNA, 1725 bp, Oryza sativa
tgaaggtttcaccaagtatgaacagccagaaactgggtgcggcagcatagtggagtaatcgggtaggtagctttatgtggtactgaaggaatgcactatcaggcatgtacagaagcagcagcagctgggattgggctggtaaaatttaggcgaatggtcgtgaaagtaaatgaatcagaaggttcctagccttgttaagcaaggcttccccacctaaattttaaaacgacatggcagctaaaaacccaacaccgcccattccctcctatctagccagtgcgccattataagcattcgttacctccgtatttccatgcactgcactgcactctcaccagctcttagttctccttcccctgccgctggtcacgcagcaaacatggccgtcctgccggagtcacgccggctctccctgctcctcatggccgcctgcttcctgcttcaggctctcagcgcccacgccatcacccggcattacaagttcaatgtgaggatatatcgtcatcaaactttgccgcatgataactgcaagcatgcatcgcaattgtcacatacatatacaggttgcagcagaaatggcaagatggtttattaccacggttttgtctgtcttttctgtgtcttgtgcaggtggtcatgcggaacatgacacggctttgctcaaccaagcctatcctcactgtcaatggcaagttcccggggccaaccctgtatgcaagagaaggcgataatgtcctagtcaaggtcgtcaatcatgtagctcacaatgttaccatccactggtaagcagcttagctagctagcccatggctactccatgcatatgcttcaactccacgtgtaatttgcaccacaatttgaatcaccacctcaaggctcctttgctctctgtaagtacccaaaaagaaaaggagaatatcatgctgtgttagttaaaaggtaaaaagtatgtatagcttgcattagatcctctctgttgaacagaaaacagaaatgtgctagttattgttcccatttatgcaacaaaaatacacttggtgaataacttgataaacaagcatgtcatactaatcaggcacggggtaaggcagatccggacagggtggtacgatgggccagcttacataacacagtgcccaatacagccaggaagcagctttctctataatttcactataacagggcaacgaggcacactcctctggcatgctcacatcaattggctaagggctaccgtccatggtgctatcgtcatccttccaaagcttggcgtgccctaccccttccctgcacctcacaaggaggctgttatcgtgttaggtatatatatacacacacatatatatagctgcttctctacatcttgatgcatccagcacttaatttatcaagtgctgcatgcaggagaatggtggaaagaggacacagaaactgtaattaaccaggccatgcagctaggagtgggacccaatatttctgattcacacaccatcaatggtcatcctggtccgctgtctgagtgtgcttcttcacaaggtaatactcttactctacatgaacacgagacagacagtgcatgttatggctaactatgtgctagtcctacaactgagccaaagacctaacgatttcctgatgtatgcttgcaatacaatgcacagatgggttcaagctcagcgtcgaaaatggcaaaacatacatgctccggatcatccccgctgcact

SEQ ID NO: 54670 - DNA, 2996 bp, Oryza sativa
  unsure (1)..(2996): unsure at all n locations
cgcacttgttcactctatggctgtggatggtgttgagggtattggagacagttgaagctcacagtggataccatttcccatggagcccatcaaatttcttgccactgtatggagggtaagtaatctagatattgtaagtgtgatataaaatggtatggggactctattggtgtcctgaatgccgtcttttcctatgaccagctccgactttcatgactatcatcaccgtgtgctctacaccaaatcaggaaactacgcctctacttttgtttacatggactggtgagaaatcattgactttgctatgtgtaatcatgcatgtttacctgactctttacatgaggagccttcctgtttgtgataggctgtttggcacggacaaggattaccgcaatgccaaggctatcgaggagaaagacgggaagcatttgtaaattgtgggggctactctctttctctttgtccaaatcatcgaaacaagggtttgacatctcgcagtggtgatagcattgtgttcatgggaggaaataggtgtcctagccacaggtatctatctcctgagatgatcctacagtttagattttctttccccaaattcactatactatcatcatgagacctttgtgtttctggaggccaccatgatgtaatttgtcataagcttaatttgatgcgtgctattttgtggtttgcttggacaggggtacatgccatgacaaaaataaactattcgaatcaaaaaattgtcagattagtaaattaacattaacataaagtttactggttaaaatactacgtattactttaatacttttagtaattgtatcatctttttctcattcttatcaatctccaagtcgaagttgatttatttagttgtgtatgccgttatattttataactactaactttatatatactacctaacctaataaacaattaattaataacagtcaactttacggttcaattanacgatgtttagcattaccctggcgcgtcgatcagaccaaggaattgggcgctgtgaccggcttacggccatgccatgcctctatccgaaccgaacaactcccgcctcggccagcaatgggtgtgtttggttgggctgtggcttttaaaaaagcagctgtcgactgtgatttttttgaaaagtagctttgaaaaagtagctgtgaggatttttttgaaaattagctttgaaaatgagcatgctggcggctgacgacgacgacttcgcacgcgcgacctgctagctcggctggaggaggagtggcggtggcggctcggcgaggaggtagaggcagacgcgggcggcggcggaggcagtcgcgggcggcggtggaggcagtcgcgggcggcaaggctgaggccactgcgcacgcgtgctcgccattgctggagctccaccatggccacctcccatgcccgccgatgacgaccgaacaacgacgacttcgcacgtgtgggcagctcggctggagaagcggcggcggcgggggacggtgtccgtgcagcacgtggcgaaggcgtcgtcagacaagctcatgcggaagttcaccgacccggacgcgcacgccaagcagatcacgccgccgcgccgtagccttgcgctgcggcggaagcagtcgtccagcagggtggcattggggctccgcgagggatttggagctgggagcggagctcgtggcgcctaagcggaggcggagcatcggcgggtccacctagtggaaggccgggctgctgctgccgatgaccacggcctctgcccgcaagggagatccgccgcgagcacctcccatgcccgccaacgacgaccgaacgacgacgactttgcacgcgcgggtagcttggctggagaagcagcggcggcggcgacggggcgaggaggagaggcggcggcggcgaggaggggcggcggcgacggcaacggggaggaggagcgccggcggtggcgtggtctgtttggtgacggcgaagtgaggaggacgaggagcgacgcgattggagaaaaagaacgaaccgttttttggtaatggcagagctgggtaattttttttttcccaaaagcaggtgaaagcgggggtagaggtgcttttgatttgtagtagaccaaaaactggctttgggcaaaagtagctgtagcatttgggctctttggttagcttttgcaaaagtaaaagctgattgaaaagcccaaccaaacacaccctcaattgctctgagccaagcccggctgccgccacccttcacgctcactctgagccttgccaccactaggaataggtaggggtgcaaacgggctagcgcctccctccatattaaaatatacttcttttgtcgtataatatagcaacttagtaccatattaaaatatacttctttcgtcgtataatatagcaacttagtaccagatggagtatttttaaagcacaataaatctgtccagattcattgtactatgaaatgcccctatgaaatgccccctttagttataggttgctttattaagtagttacttctacttacagcagggtataaaaaatatgcggctatcacggttatcacgtatagtaaccttctccatttttttcgtgttaatcgcaaggttgttatggtaaccgtacggttactacgttaacagttgaaaccgtgggatgaaggtaatctcacccaaaacggtttgagaaccctgcatactagtagtggagtagtgcagtggtggtgcaagatgaaatgtccacccgtctgcccgatgcgtgagatgctgtatgtggaggcaggcagctgctttgatccagagcaaagcacatgagaacaatcttaattttagtgtgcagcagctttcagtcagagtactgagaacatgagacaagagcacaagaatctttgcctgcctgcctgtgcctgcccagccagcactaatacccaaccaacagtgacccctccttccctgtgctgtgcacattgcacagagaaaattaaagatcctacta

SEQ ID NO: 54671 - DNA, 1942 bp, Oryza sativa
cagtaagaaactgaaaagccccagttcgtttcatttatcgaaaaaatataagggattctaaagatgtcaagaaaaaagtacaacaaacttcacctttgtttttcattcaatacctcaacctaacacttattttatttacttcatttctggtaaatatgccaaaagtacaacatacaacttgtagttaacctgcgcgaacacacgaaaattactgacttgtagcaataattctggaacaattctttgccaaaaaaaaaatctggaacatctgaaacaaaaaaaaaacaattaagagaaacacccttcacttatatttctatttgcatttttgttacattgcatcaactttctttatttaatgaaacaaacctttcctcaaaacactacaaattgaatctgtttttttacaggcacaaaatgcacttgtgaagcttatggcatgatttatatgtacaagatataacaaagacgaagaccattgccggttctgttgtccaaataatctccaaaactaaaatattgaagaaagcttcagagaggctcacacgcttttcaaataagtcgcaatgatgcatctgtatgaaacaaagaaagaacaatgtcagagaaaaacagtctagagtgtcctatatttttaactttgttaaaatattcaaaagcagagagatctcatgtgcaaattaaaaaagcagagagatctcatgtgcaaattaaaaggagaagttgtatacctgtacatggtaagtaccatctgttttctattatgcattatccacaatccaaaaggcaaccttcaaatttcacagctgtccttggtactttttacagcatcagaatcatcagcctttccctcgtccaatttcctcaaatccatggcttcttcatgttcgctgcactgcaccccacagtcaccatctgcatgcgaatcacccaaatgcgccttgtaatttgggttctgttctttgttctccttgccagcatcatcagccaccttgctcctatgcgcccacagatggcttctcacaggacgttctcctctgccaccagcagcaacgctctttgctgatctcgggctgtcaaaccgtttagcagcagcatgcctgttcttctctgcagcttcggtttcagagccaggttgcttattcagaactttccctgacaccgatgcccttggctgagacgccggccttctcttgtcggcgccgtcagctgagatgattggtcgtcttggctgagacgatgacctctttggagtggcttgcttgctagtagcgttgtccttattgctagcagacgtgttggatgattcatttctcatgtcatcttccaacgccttgagcttcctcctgagcttgtcctggaaaaggagccaaagtttcagacaacgacatggagaaattaattgggtgaaaaattgattgaagtatctttgccacgtttctcacattcagctgggcttctgccttggcagacttctcggccatggcaatcttgtcgcgcagccgttgaatctctccctagacggtcattgtgaaaatgacaaataatcagatgataaattgagaaaaatctagtacaaaggccagtaaaatttggaggcgccaccgtgtggtgtacttacctgcaggagcctccgttcctcgagccatctcttgacaggcatcagcttgtcagcatcgtccttccactcgttcgcggtcgtcgacgcgacacggttgacgtagaccttggcgcgagctagctccctctcgagcgtcctcttctcttcctgcaggttgaaaaagctcgtcagaaactaacgtaatcaatccgtcttctgaatacgctaccccctccgtccccaaaaaaaactcctatgggacctctcctaggacaacgaatctgaactaccctttgtttagattcgttattttaggaggagttgagttttttttgggacgga

SEQ ID NO: 54672 - DNA, 4132 bp, Oryza sativa
cctttaatttcgctatatgcatgtcctagctctctgtccttctctgcaggtttaagcacgagctaggcgtgagcatgaagctagattctaacattaatttagttcaactgctagttaaagacttaaaagtttgaatttctgagaccatgtcgatgtacaaaacgtattatttgagtaacttttcaaatttcatagttataaatgatggactagaagattatactgatagcttatttctcttgggtctttgacccaaaacgaacaaaaaaggataaattattaatcctttttatgtttgtaaacaaaaagatattttactgctccttgtttggacttcagagtgaaattgaagtaactagagtcatcaatgaactgattgaatgagacagatgacaataacagctttgaacaaggaccttttgtgctaaaaagtgtagagttcaatctaaacatagtattaatgactgatgcagtgtgagaaaatctttaggtaattctgctaccgggaaaagggtatatcagtaaaacgtttaggtcacaactaaattgaatggcagtttggcgccatttagatcatgaagaaatatttttagttcctagaatgatgcatgatgaatatcatgattcaacagtagtactcctatatgtctgacaaaattgactagctagcctgaaatattttctgcaaactagagttctagaaacaagtgcattctgccatccaaccagggcttaaaattttggttcttttttttttgagaatttcgggcccctataagaaccttttttttcaaaaattttaccgttttgtgaatttaataaaatttattgaaattcagtcaaaaattttcacaaaattcaaattatttttgttctgaaatattacaaaatttcgaaaattttggtcctcctggtagattgtgctcaccgaaattataaagcctgcatccaacaccacgttaattcttcttgccctttattgacgtcctaccaaccgtccaaccagccatactaaaattttcagggttttgtcacacctatatcgtagaatctgagcaaatatctcttgtaacctacaagattgggttacttagaccactttttggtgtctattttttgtcatagttggaaaagcttgcatcatggataagaaaaggcggacaaaagagagattttttctttctttctgaaaaaaaatatggaactgtagcatgccctgattccatctcaacaaattggtgcttgtcaagttaatgtatctgttcttctaaagaatacttaaaaaaatgacttaggtacgaatagtttatctaaaactacatagtacatattcacgctcaatttttctatttcctacttcaccaagacgatcacagcgatcgtactacgttattgtaatgaactgatgtactcaaattttcagcctacttgtgaactacaagtgtctgactatgtctcagtaactgatacagggaaggggatatgtgtccatttcgcttacagtatcactactggtacagtagtacttgatatgaccaaagcgtgaattgaatgacttatgttgcaaggtcataattaactagggcttcagtttgatcaatcagtatgtcatatgattaaccatttcaagctggcgagatgcattgagatgcattgcaccacgaggcttaaacacaacgatcaaaaactgacggtggtttattaattagctatatagccaaacgagcaaattaattacctctgaggagattctccagcctgttgagctcgtcgacgacgggatcaggatggccatcgaacggaagcatatccttgctgacgccatgctcgacgacctctcccaagctgcccatcgtcgctcgatcgacctcctcctgtatgtcctcctgccctgccttttgtacacctttcttgcagttttgctagctgctagcacctagcacacaagataaacccaatcagctacactctatctgtctatctatctatctatctatctatctatctacctagctagttttgtttagctagctatatatgaaagcccagttgatgttcttcttcccacctaagtggaagaaagaatgctcgcaaagatcacggctgcccccgggagctgaatacttgcagtggttgcagtgctgcacgactaagcgagagtgggtttggttggattttatggaggcgcaatgcgtggggtttcttgaggagcaccccattgctggggctcgcgagcgcgcgagaaaggaagccgacggtgcaagcagcggatggatggatggattggatggaggcgggaggagtgcggttgaagcagagacaaatggagccgcggcctcacgccggctttgctgctgctgctgctgttgcatagtccagagctggcacgagagcgacgccaaaagttaacttctgcgatatgccgatgtattttcccttggagaaaatccagtactcctgcaaaataaatatgattgtggttaaatatatgtgaaatctgagtagctaatactccctccgtagttttagattataagacgttttaactttggtcaaaatcaaactgctttaaatttaattaaatttaaagaaaaaaattagtaacattttttacccaagataaatttattataaaaatatattcaattattgatttgatgaaactaatttagaattataaatattatactataattgtttataaacttagtcaaacttgaaacagtttgactttgaccaaacagtttgaccaaagtcaaaacgtcttataacctaaaacggagggaatagctagttaattaactactgctgtatataacttaattaatggtgtggcactgtaattctcttgctaatgatcggggtcaatataatatggtcctaactctcgtcggtgtgatacaggggtaacaaaaatcttagtagtaacttactacactagtggtgatatttgtgtcctttttgtatctgtccttctcagaagttcatcgttttgttgaaaaaaaaaatatgctagcatcatgcatctagttaatgaattaattaattggttgtttggtaagacctggcagtacaggaggatatggttaattgaatgataatctcctattatgaacacgccggttttgacgaaaagaaagaaaccgtgttaaatgcaattagctgtagctggctaagctaagatgaagtgatatgaacaaggccttctcacatacactgcactgtgctgaaactgaaagcatatccattatccgtgtttcgtaaccgtcaccggtcgagggacaaactataatggtgcgtgcacactggaagggtgcaacgggccaacggcccatgctgatgttgaccatggaaggagccttcccttcgccgtctgcatcgccacaaaattactcattggatgaagtggtggcaaactagcttagcttgattagctcctatgtgtgttccaaatggcagctagctagagatggaggaagcattgcaagcattagtctttaagggtaagaagataataagaggctttgcttgattgcttctgctgtcataacacattttgaagctttcaagctactaaaaacgaatcaacctaccctctatatgacagtcttcttcagataaccaagtaactgggtactgattggtgtgtagttttttttttcctacttaaaatattgaatatcagcaatcaaaatgcttcaaatattataaatcaagtccagggtgttcaactagtttaggtggtcaaactaaaacgtgtgaatatgtgtgaggttattgtggcctgccttctctaggtagaagcttgtgttagttagaagatgacaggaggaagaggataagaagttagaaaacaagcttcctgaatggcctgatcgacaattcgacaaatatgatgttatgatgttggaagcatcgaacagttttgtgctggacggactgagactacacagttcgtttcttctcttttttttgccttttctaaaggagatgcttctggcaacttgaatgaagtattcttcttgtggaagttttaacttctcattaacatctatttttgccaaagaaaaacataaagagaagtgaaaagaggaagagcttaattattcgattattacatgtctatattttt

SEQ ID NO: 54673 - DNA, 899 bp, Oryza sativa
aaaatgtgcggctgagattgcgtagaagtaggacagtggagtcgaggcagttttttcgcggaggtccttcgcttattcggtattggcggttgacttcatgggcctcaaagctaatcgcgttgagagattcttgggcctcatgccagccaagttagtggacctccgtatgagcgcgtgccgtttgggcttgactgatgccattcgctacaggtgctttaagattggagtaaattcacttttaatccctcaacttgatgtggagtgttgaatcatgttcttaaccgcaatataatatatatataacacgttcccccaacttgcaatactggattacccgaggttatgggtggaaaaaaagctcgggctcgtgagctcagctcgggcttggctcgagcttggttagcttggctcggctcgtaagccaaacaagccaagcccaagcctcctttttagctcgttgctgaaatgagccgagccgagctagctcgcgagccgcttgttttggctcgcgagcctaggccatcgtgtgtttatattgattattttactttatatagtgttattatttgtcaacttgaaatttatcattaagattttgaagaattgaatataaaaacttatttaaattttacatgttgatgatttgtttttactttttttaataattataaaatatatatgaagaggtgtttcaacaggaaggcttgcatagctcgagctggctcgagccaagccgagcttaagttttagcttgtttccctaaccaagccgagccaagccaagcctagttttttgcgagccactgcaagccgagccgagccaggcggctcgtttccacccctacccgaggttccagcatagtttgtgtccagtttcaaccgacgtgagggctgcaggaa

SEQ ID NO: 54674 - DNA, 914 bp, Oryza sativa
agtggagtccatagcaatgtaaggcctgcatccttccaaaaacccatcgatacagggtttaagagcaacaaagaacctcctaaagcagacatcaccattgcactcttcagtgtccagctcaactacactgcctggcactgatctcaatagctcttcacgataggtaggcagcagatcgtagctgtcatcccactttccatttataatgtcaagtgctctctctctacctctgaagaccttgaaatatgggatatcaatctgatgcttcctattcaactcctcctgcaaatcctttgctccccttgaggggttatcccgcaacaagtccaccactcgatcagctacccacttagtggtgaccattgtttcaccacacttattgaaagatccacaagtgtgctttggtccacttgtcttaacctacaagcaaagaataaatagctcatgtttcatcttgaacaaaaattccaaacagaataaccattcataaatacgcatgtaaaagtaccttgcatccaatgtacttagggcttgtagatgcaaaaaaacaccacttgcaaccctcttctgctcttttgcaaatggctctaaaccttttcttgtcattcttgacagtttcaaaagcatgatcattcaagatagcatgatgggtaactgctaacttgcattgatccacatctgggaacactacaccaacatcaatacaaggatcctgaacatcatatgcaaagacaggtacatcatcatccttatcaacaatttcttgatcaggatcaaactcagggtcagaacaatcagagtcggaagattcggccaaatcagaatcatagctgctatcactatgtgccacaagtgattcattggcagagtatatgccctcatcatcaatgcctactgcatcctcatcatttgac

SEQ ID NO: 54675 - DNA, 4491 bp, Oryza sativa
cccaatgcgcacaacccccttatctatattgagctgaaaccactcccgcaaatgttcatcggattttatctcaacaaaaccatcatccaaagaacgccacaaactcacatattgtttagatccccacgtgtagtgttcagcaatgaaattaacaacttgcagcagatcatacttatgcatgtcaatattttgggttggcaaggttttaccctggaggtattgctttggacctccatccggcaaactgaaaaaagactcaactctaacaactaattgcaaatcgctgtgagtaggcctacaaatcacaacacaagtggcacatttaggtaaatcgtcctaaatagcaaagttatatagagagacgaaaaagcaaccgtactgaatgcagccctaagattaaaatgcatactagctggtagttcaagtatatctaagtatatgtaagtatctaactctaagtttcatctaggtttagctagctctaagttttcatgtccattttcataagatagcatgacaagaatcaaattacctgttgaactcttccatcaaaattagctccattgatatgatttcctccattgccaacaacttccccttttctgccttatcttgccctcggctgtgagaggccgcctccacgtggaagagaactggccgccggctgtgaacctcctgcgagcgggcgccggcgcacgccctcggccgcggcctcgcgcacccgcggcagcggcggcggccaccgcctcctcgcacggccgccgccgcctcctcgcgcggccaccaccgacgccgcctccccgccgcgcgagctccctcccgcgcgtgccggccgccgcctcaccgccacaagagctccctcgccgccgcctcccttgccgccacctccccgccgccgcctcgcgcgcctctcgcgcgcgcctcggccgccacctccgcgccgcgcgggctccctcgccgccgcctcaccgccgcatgcgctcgccgccgccgtcgtcgcgctagcttgctagggttttgagttgactcgacccagggagtcccgacgcacgggaagagaagaaccctatccattcactttccctcaggggtagaagtgtcattacataattcctaaaaccttttttttaatttctttttgtatttctttaacacataatgtgggacccaccaaacggctgtcacaaatgggagtagacggctgcttcaaattcaaaaagtgggggtaaaaatgcaaaccctaaaaaataggggcaaaacaacaattggctttcaaagtgggggcatggatgcaattgccccttattattattaatatagccaatttatcttttgcacatacttaagcattaattgccaaaattttaaaaatattggtttcatggattctgggacagcgtatacttaactctgtatggagtagctgttaaatttttaaaaaaatcacaccaagtaattaattaatatctatgtcatggatatgtggctgcagcacattaatttcttgtgaaatagatattttccttagaaatattttagataaattgccatactaaatttattcgaacaagtatatgctgatgtatcaattgagagaaattttacagtctttaatagatattttaggtacttgagaaagtcattataaattatgctactatacctccgaatactaaagacgatggtaaacttacccattaattaaaccatttaatgtgatagataaaaacaaaattacccttaaatgttactctccgtcccagtgcctataacctatgaccggattgatacataatacaaatacacatactataaaaattaattcggacagaaggaccatatagattcatatatagtctaaagatatgtctaattcggtgttagattgctatattttgggatagagagagtatagtacatttttccgtgccacccggtgtggcaacatatttcgcacatcgccacagtattttccaaatctttttagatatgggttttccttaatatcattataatgttaaaattccgaaaatcatgttcttcctaacgaacaattctacattggatgagaaggaaacaagatatatactgtacattccaatataggagtatatggtggttctctatggcacgacgccatgattggtggatagctgcgttgccagcaaatgtcattttttgcgtgtacccctgcgaacagtgctgtccttgcacacagtggcacttgctgtccttccatagttccattcattctaagaaaaactcactgtcctttcaattcgctctatacttcaattcatgcgtggatttatttacatcattcgtaaatatagatgcatccttaagaggcacagtcgcatgacacctgcacatatgtagctgtgttatgtagtggtgtgtgtgccctcttgtgcatctcttttgtaattgtaattgaaaaaaaacgtgcaatgtaaatactccttccgtttcaaaatatttgataccgttgactttttagcacatgtttgaccgtttgtctaattcaaaaacttttgtgaaatatgtaaaattatatgcctatataaaaatatatttaacaatgaatcaaatgataggaaaagaattaataattacttaaattttttgaataagacgaacggtcaaacatgtttaaaaaagtcaacggcgtcaaacattttaaaacgttaaaacggaggtagtaagtgataatggcttcatttctagttagcattgctgtaagcgcggtgcaatggatttggtcattaacgcaatactccgtctgtttaagaaactccaaatcttaaggatgaatctggacaagttcattgctagatttttttttatttttaacagagggagtaggtcacaaacagtttttgccaaattggtccaattagggtcatgaacagtttccgctcgagataggttaatttagtttgtttcttgtgccatttatacttgtattttatagcaagccaaaagcaaaattacaaacttcaaatatttcaagttatagctaataaaaaattagttttttaaatggatcctggtatagatgaatagcatctgatgtcgtgggcaaatgtggtgcaaccacataaaacagatcgatttgttcatgtgcaaatatgtgtggtgcacctacaaattaaaacatatggatatttgatttatcacttcaatcagctctttacgatggcatttaacattatacctcccctagctactaactgaaaaaagggaaccttgcattgctcacacaggtacagtgttgccaaagggcaatataccacagtttgtgctcaaatgtgtatatctgtagcatgaatgttctgtgttcatatgggtccacgtggtcaaggaacaggagagaatattgtttcaattaatatatctgaaactacaaatttgttgtaccacctacctaggggtgacaacactgcacatttggctatttagggccacgcatatatgcatgaaaaattgacacacgacgttacttgagaacctattcatgcaggtctatgagaaaaccccaccaaaaaaaacagatgtgcaaaataatgctggattttcatatgctataaattaagtactactttaatcaaacaccacattgacacacaatgacacaaattaaatactcttacgaattcaagtcatatatactctaatacgcacgtgcagcttgttactcaaataaagaaacagggcaatacggatcagtatatccaaccaggctgcatgtaggccaagaacctgacaattcgttttccttggagaaagcaaagaacgtttggaacgtgtgatgtacatgcagatcgaggaaaatagctaatcctgctctttccctttccagcacaaaaaaagattccttcgtagttcgcactgcatttatactcaaacctgcaaggctcccaaacagtttgaaccaaggcgagggaaaaaaaaaacatctccatagccaagagaaaacatactgtacatgtcaagagattccctcttcatattcttacaatcctatttactcaaattaaatcttcatatttcacttcgtaaattccaacggctaatttggtcagcacaaattcagcatctcaatcaacacaatttcaatgcatgaaggcgatcaagctcaccactctcctgccatacaagatggaccgccaccgcttggaatttccgcagtgacggcaacacgaggaagaggcaacactagcggatgtatgaaggagtctgccaagctcggctatttccggcgagcttgagagtataatcgagatagaggccggtggaaagacgaaaggcggcgtactcttgggcttagtgtggaggcaacggtggcggcctcgcggagaggtgacaacaccttggcttggcatggcagagttccacttctcaacagggatgcatgacactcctaggtaagaaggcggcggtgctggtgggtgtgggtggaggcacatggacttctctcaacaataaagt

SEQ ID NO: 54676 - DNA, 10493 bp, Oryza sativa
cgctgcgcaggagagagaatcgatcgatggaagaacgcgacaggagcaagctagccagcctagctgtagcgacgtgacagcagtttgatctttctttttttcttatgatggctaagcttatacgtaagccgatcgatcgatggcgagatagatcagagattaatatacaggggtaattaatgtactaattacaattaagtgtgtggacgagcgagccgtgtggagttacagctagctagcgcttatgctactcctacttaaggcgagaccccaaactccaagcatacgatcaggtagccaaaccacaccaccataaagctagcttgcaaaggggatagagtagtagagagagagagagaggagaggaggaggaagaagatggggagggggaaggtggagctgaagcggatcgagaacaagatcagccggcaggtgacgttcgccaagcgcaggaacggcctgctcaagaaggcctacgagctctccctcctctgcgacgccgaggtcgccctcatcatcttctccggccgcggccgcctcttcgagttctccagctcatcatggtacgtatagcaccaaaccaacgccgccgccgccgccggcgtgcttgttccggcgcagcagcgcatcatcatcgatcgatctaagtctaataagataatcaattaaccctaactaaataaaatgataagaacagtatatatggttatgatcagtgaaacactcgtcgatctgagggaaaatccggtcgagatcgagggagtggggagacaaattgaactgcaggctagctaatttaatcgtgtcgatcgatttctagcttttgttgatctttatatatacgaacgcatgcactttcccctttgtttttttttcccttcgatctgcttggagctcatatgctatagatcttggggcatatgtatctgtcagctttcgagagcggctatgtccatcgatccctcttttttttctctttctttttgtagtatcagctgccatgcatatatcagatttcgttttcgcgtgcttttagtgcttcacttatctgttcgccatatctgatttcttctcatcctttgccgacgtcgtctgagcagtctgacctccaagatctggcgaaataaacctcaatcgttgctatttcttgccttgaatctgcataaacatgacaatagatccttctattttttttcttcaagacaagatcttgctgtttcttcccttgctatttttcattcaaagattcttcttttttttctaaaagaactatatatatatgaatcgagtttcatcttcatcgatctgtctctctccttttgttttctgtaaacacacacacgagcgtacgtatatatactctcatctctacttttatcaaaaagaaacacacatgttctagcttcagatcccaaaataatcaaacaggaaaatatatataatatgcaattagttcagatcccgaggtagatttcttgattatttccattttccaaagtgaggcgcgcgacaactcgacgcggttcctctttgcacacacacacagtataactgtacgcaaggggtaagaacaaaggagcaatcccttctgggttgctgcttgcttctcccatttttagctatttcagaatttcactttctgagactcatctctctctctctaccagctgcattatttcacttcccttttttcccatttctgcctattacacggatggcctctttgtggactcgtccaaattgaggcacggtagctggtgtcaaaatgaacctgcaggcccagcccggttatgtatatgtatagctatatagcttttcttgcaagaggtatatacactttgtagttttagccagtggtccagctagccatggatggatatattatacacacgtatatatagtacatgtatgtacgagtgttaattaaactcgtttagttaatttccaaagtccttttttattactacagctagcctgatctgtgttttagtgtgttactgttccattagttactgttctattgaagagagcgcgtacacgttgttgttttatttctctttttccgatccggtgttccttttttttttcttttggtcatcttcctcgagtcccgagcagtagaaatactactactgccctgcaaagcacacacatcaagtgatgtgtttttcttcagagcttcagacgtgtcatatcaagcaggtcagcacgcattacatgcaatataatactcctatatggacacgcagaactcactttgatcatgtgtgaccaagctggatgagccgttaatttgttgttgggacagggtattgaatcattaattgcggtttttcctctttttcctgtcttgttctactcagagaattgaacggtgaactgtataggcagagctagtcctgcatgcatcggttttctgaaattattaactatacacacacatgcacaattgctaaatctggtatacatgtcttgctgactcacatattcgttcctcctaattaaagcactcatttatttattttacacggttttcaatgatatactttaaatattaatttgtttgatgttatatttctatgaatatgaaattagcatcatatgaaaatactttaaaacaaatatagtgatataacatgcataatacttagcatatacttgtatgattagcatggtcattaatcaaaagttgccgagcttgaattttctaaaggacagggtgccttgtaatttgggacaaagaaccattggaaaacgaacacaaagaaactttcattacattaattatctgaaaaagaaagaaactttcattaacctcgtacagtaaatagaaaagaggaactatgcatgtataacgaaatagctaggatcacagcaattaattagttgttctctggctttacttttcttttggagtaactttaatttttctttggaggatgaagtagttaattatacaggtttccaattcttgtttggtagatccttttttatgttcctggaagagctactatatttttgtacttgagatggagctgaggtaccgttatctagctatgtcgcatctcaaggagttacgaattaacatatatcaccaatatcacaaaaatgctccatacaaaaagatcataaaaattcttgaatttgcttgctgtgtttttttactatatatgcttggaattaaaaaaatgactgaattaatcgtttgcaatctttaacggtgcgtgcagtaccaaattggaaaggtatccacttgttcaaacttaaaaatattttttttactgatattactctctaaaaaggtgcatgggaaatgctattggaactactagttttcgggacattataagaaaatgtatgcatatatatatatatatatggacttatgatatgggccagatacctatatatatagaagatatatgtgtgctactacctccattcaacaatacaagcatttgagccagttctggtcaaggatataaacatcctgcactattagcttgtacttgtcaaattaatgatctctaattcaaactttcttgctactttacccccaatcacccttcccaaccatcttaatctttgctaaacattctagaaatgcttattgttggatggaggaagtagctattaactactcctatagtttttttaactacctcatattaattttgtaatcctaataaatgcactatatatgcccacttttaccgtgtttccaaactggcatcaagctaaaatgaatgttaatttagtttccccataattttatgagaatcgcaaaattgtacctattttaaacaaatcaaagtcactgaacaaatgaacggaggttaattattatattcacctgatataggcagactaggttgggctaagagggacattaatttgggcatctaggttttgaaatgggagatatggagagtgaaccaaaaaaaaactgttagtgaattagtacatgatatatactagtattattagtgggaacctagagaaatgcaaagaatgttgcgcaaatcatcattttgtgtaaattaaaatgggatatacactatggggaactatagctgagtgtcaatccccaccttttgtttgtaattaaacatgtgtttatgctacaaattactccctccgtactcataaaggaagtcgtttaggacaatgtttaagtcaaaccttgggaatataaattatgaataactctcaagttgttgagtttgaaaatgtaaaaaatatatgaatagatttgtcttgaaaaatactttcataaaagtatacatatatcacttttcaataaatattttatagaaacaagaagtcaaaattgtgttttggagaccgtgtcactgtccaaaacgacttctttacgagtacggagggagtatgttctacatattggctaatattgttgaacccttcggatcaatcttagacacagtagccattttacccactgatgcagcaacccaattaggtatctactaattagcatcatagtgcaaatttgtacttttcaagtggaaaatagaaattatttgtcctcctttactttaatttcttgataatatgatatatgtaacataatttctctttgctcccaagcatataaaaaacttcaatttgatatgtccaaaaaatgtcatatatatagcatgtaatcctctgtggcaaacacgtttttttggctcaaattaagaagaggaaaaaatggtatatatgtataaacctaacaaaaatgccccaacaagaatagctttattttgtgaacaaggtcatatagaccagggaacaaaaaccctgtactgtgcttctattttgctatgcattttggataagtgattctacagaaatatgactatataggagatattctcaaatctgatcttttctattaattagcccatacgatatgaagacatatcttcctctgttctgattctatttgttgtgctaagatagtctacaggatttgctaggttgccacctgccgtcaacaaaattcagctcatcagattttgttatagttgctagcacagttatattatacgtatatctcttttgagaatatattattacagtccattgatttttcttgtagagtggaaaatattattgtgttttctaaccgtaggagttcatgtggtgttatttattttggataatgtggtgtatttttatgagaaatcaggatcgcgtcaacatgaaagtttcatctaatacattattaagtgcatcgtagcaacaattcatatattaactcaaaggtagctttgaaattaagatgcatgtcattaatgcataatagagaaatcaggttaccaaattatattaagcccatatattaactcaaaggtcatagctttgacaaatgctccttacagatttctccttgaaccaatttgtaaaatatcctctcctttttttttgcgcgaacgctaaatatcctttgtttaacaacctcgtcaatttgtccatttcatatgtgtgaacatccttgtacattcttttttgtgccgtttgaaataaaactttgaataaatatgcacaacttaaatgcttaaatgtcaattggatttggatgaaacaaaaccaaagttttagaatttacgatctatcattatgaatttatgtatgatatatcacactctttctgaataaacttcagaataatataaattgcttaattatggtatacatgagcatatatagcttgcgcaaatcaaaactgtacagtaggtgtgtgttcaattcagaatagtattctatttcgaatttaaattaataataccttctgtagtaatttctatattagaaaatttatacatacaaggagcactgttaattagctagctagctttatgggttccactaatcaatttatatataataatgtgctaaactatacagcgtccatgcatttttattcttcatgcctaattaatttgattcaccattaattaattctacgtacaatgttcgaatgtgtgactatatatgctgcatctgcagttctgcacctcattcagtactaaattcaagttcaggttcattaattaattcacttattccttcatttttcacttccagcatgtacaaaaccttggagaggtaccgcagctgcaactacaactcacaggatgcagcagctccagaaaacgaagtaagcatcctcttagtttcttaattaacaatctttgacaaatcaattacttcttactagcagaacatatattatgatttatgagtcagttattcgcttatagtattctctactcactaaaaaggattatgttacccttttttttcttatgagatgaagggtcgtgttatctttgttaattttttgggacattgatgttatccttaatgtcgaatgcatatatagggttttctctagcttcatgttttgctctgatatgtgcagtgatgctcatgcaagtgaaaatgagctgggctcttaccgtgcgtaggttaacaggccggcccattaatagctaacagtttagatgggccgcaatgctagatgccgcgggggacgaaggccttacattcaatgggccgtagggcgagatacggcccacgtcggaggttgtgggccgtagggcgcattgtgactttgggccgaatatgcttacttaaattgggcttagaattgtgagaggtttctgttcggatccgaagagattgatgccatgttgtctatgttaacattcctcatgcataagtaggtttagctgatagtctaaaacaggagtgaatttagtagacttggtttgcaattagaatgctacatggtttcctgaatactttgttgtgcctacagtttgttaaccatcttttttttccccttcggccaatatggtctgatatcttgtagcttcaggagtcatgagctaatccgtgtgtctgcaattttgttgtttaaaccagattaattaccaagaatacctgaagctgaaaacaagagttgaatttcttcaaaccacacagaggtagtcttcagagatgaatgtggccaatcatttcagcttcttatctactacagagttgctatgttcttcctgagggacagagtttctatgacttactagcaagcacttcacaccatgcagaaatattcttggtgaggatttgggcccactaagcatgaaggagctggagcagcttgagaaccagatagaagtatccctcaaacaaatcaggtcaagaaaggtaaaaatgtttgttcgccatgttacctatgcaagcaaatggcactttttgatatgctcttcttaaacactgaacctagattagattaataatgagcttattataattttttactgcaactatcatgtaattcggtacttattacccctcaactgtatggatttgtttatgtgcatggcttttaacacaggctcaatatttctgcagaaccaagcactgcttgatcagctgtttgatctgaagagcaaggtactgaataaattctggttcttttcttttttcctctgcacctaaattaaatctgtgcacatatgacaaacactaaaattgattctgcaggagcaacagctgcaagatctcaacaaagacttgaggaaaaaggtaacacagccatcgatcaccctgaaagtcattgcgtgcatcagtattcggacaacatacatctttttccttgctaaagtcccaaccatgatcttttcatggctgctaaaatgtttcacgaaagttacagtatttgcacggaataaacctttttccccggtacggcttaaaagttaatcagcttctcataccgctgaagcgtttgtttgttcgtgcagttacaggaaaccagtgcagagaatgtgctccatatgtcctggcaagatggtggtgggcacagcggttctagcactgttcttgctgatcagcctcatcaccatcagggtcttctccaccctcacccagatcagggtgaccattccctgcagattgggtattcttcttttcttccagttacagttaatttcttgcctgaaaaaattcccaaaatgcagaggtcatgttctttttaaactattcactaaattattaaacagagtatttgctcaagttcgaacaatacactttcttaaaagatggtttgctatgtattacttagaccacttatctcgatttacttgtatattttattttttttcaaatatttaatttataactatataatcgagtatatcgataatcctgacaataattcgcccaataatctagatcaaattgggcctaattttgtctttgttattcagtaatttaaaatttatgtatatatactccatcgttttcatagctttaatttaatttttccttggtgaaggtatcatcaccctcatgctcaccatcaccaggcctacatggaccatctgagcaatgaagcagcagacatggttgctcatcaccccaatgaacacatcccatccggctggatatgatgtgtgtgttcagttcaggcttcaggcttcagagaagccaatgcaaacagtgtcctgtaatccagtaattacagggcatatgtaatgtaatgtaatgtaatccctgatctatattttgctaagtacgtgcgtgctctcttacgaccttctcccccaaacagttaatcaggggaataataatttcgtttgatgcacgtactgtatgtctgtatctgtcactgtatcgtaggaccgtccatgtataacaatttccgttttggatgtggtaacaagttaattggcacttaaatttatatttgtgatgatctgggagagtacctaatctcaaaaacttgtggagattatgttagggagtagtgcaagaaatgttttaagacggcagctgttatctcatgagatattgataatgatgttgtctctgctgctgtcgcgatcgccaaattatgctgtttttttagattataccgaaatatgctgatggatacgtggttttgatctgtggccgttgcgaagtaagcgcgatttatttctgcaggcgttcgaatcacgttttactgttggcggtagttactgcacggtgactgttcgacgaaatgccaaaacaacccgcaggctgcagccagtcgacatgtgcggcggccgtcgcccgatcgcgcggctagctagtagctgtcggcaccgccggttggttacccgcaccaccgggccctcgccgtcgccgtcggccgtccttgcgctgcacggacgcgtcacgcgcactgccgcctgcctgcctttgcgctgtcgggcgggcgcgcgggcagaaagcgaccgcgcgcgcggaggggggcgccctcttccacacgcagcgatgcggaggcggcactggcacggaactcccaccgagccgacgggcccgcccgcccggcggccggccgcgccgcgccagcagctggacgaacatgcgtgcacagcgcgcgcgcaggcgaggcgcggcgcgacgtggtgcttcggctcgcgtcctcgcgtacgtacgccgccacggccaccaccgccatcagtgtcgcgttatgcacttactcatactgaacactggacagagcacgatatgcagcggtgtttgtaccgcccggcccaagggacggcagactcgccggcagaaaatcaaattaaaattgcaatgttgcaagtatatgcagaagatcatgcatgatctactgaagcaatggattgcctgcagttagcctgatttctacctgaaaatcctactccctccatccgttctaaaataagttcattttttatccatctcacacgtatcaatacaaaatcaaaaagattaaattaattttatttatcaatcacaatgtacttgttttctatatattttaccctactctcaatacatttatcttctactttaaattttgatgtaaggattacttaaaaataaatttattgtcggataaacgaaaagaacttcaaaacaaacttatttttcctattttgtaacggaaggagtacttaatttcaattcgatcgccactgaaaatcttactgcacagaccaacagtgcatgcacactgaactgaattttgacgacgctacctgaaaattacttctctaccgtctcgatctctcaggttctctgcgcatccttctggagttctggtaacggactgattattcaagtaatcaactgaataatactgccattaaattaacagcgcaatatgatctcgtggaaccaaattaaagcgaaaaaaggccatgcaaattgacactccaacatacatcatggaacgaattcgcaccaagaaaacatatggtactgtaatatagtactatctgtcttaatcaggctaacttttgtgactttaatttctagacaaaaacgtatgggatagagacggagatacaaaggaaagagactacaccatcgaatggtacatcagaatatctaagctgatgtatatctgtgtccaatacggatcactctataaactgggtcaaaagatggtcctcacactctaaccagtagccagaaat

SEQ ID NO: 54677 - DNA, 11448 bp, Oryza sativa
cggagctagattgatttttagtcttcaattcacaaatttcaatataattattatttactaaagaaattaattccgtcatcaatttattcatctctaactctactattataaaaattgaagttgtttttcgctgatactttggtacatcgtttgcatttgagcaggtttttaagttcgttcacttttgacaaaaatataaggtttttaagaaatcattttaaaatactacatgctaacctacgatgagaatgagacttctaattgcttaagaattcttgccagacaataagaaaacaacgtacaggatatggccatcatcccaataagagttccaaatagatatcattactatcaaataaaaatcccatttactttttagacaaaaaaaatctaataacaatatgattaaaatagcattcacctgttgcaatgcacgggtattttttctagtcaatattaaaatttaatggagttttcactggcaagcctgggcaactgcctaggctagccgggcggtggctccgccactacatgcagttaattcagagaaagcatatatcctactaatagttgtttttagatgtataagggcttacgtgtttggttacctgcttagagggtggctcgcacgcacatataggtgctcggtaggggaggtttcatggcatgcacgaccatcggggctaggccgcacttgtgcaaaaagcgctcctaagccaggcctgcgagttgcgagcttcatttgttccatctccacatgcatgttgttgtcgtctctccattggtcgttcagatctagcttggatccgatcgacttgggttttcttcatcgactggatttggccggccgcaaccgtcatcgctttcgcctccacctcttcgccgacggccacccccaactagatctgccatcctcgtccttctttgctagatgccacgcccctagccatctccaccatcatcgctggctacacctacaaatccgacgatggagaacccccaaccagcggattggttctatgatggtggtgagcaattgggcagtgagtgggtctggctcagcggcggcgagcccacgaagttgccccttgtttttcctcccccaccccctccccctagcccttttcctcttccttaatttttcttttcaccaatcaagtagtcatgtacatatgtgatgatggttttgctgttcatggatatatggatatgaattcaatttttattttaaaaaaacaatgaatttatttgacttagctgcatttatatctgaaatgtgtgtattttataataatttagagtatcttgcacttggtaatatttctatttatgggtagtagggataatcttaccatccacatagaaagatgagtatactcaaggttcatttatccaaccaaacgaataccatgcatacaagttttcacatatcgatccaaccaatgaaacaacacctcatataaaaccaggttaaactaatacatgcaaccaaacaaccactattacaccttgctaaccacaccaaggtcagcctgaatgatgcacatatgtaaggcaagctgagagtatttgagcaaccggccccggccctatgaaacgcaagatagaaaaaacacaagaaaaggaaaaaaaatgcagaaattgtgtagttgcatgtttctttaatcgtacaaaaaaagcgcaggaaagatgaaaaggagctcttcgctagcattgtaggaactaacaaaggaaagcaaagtttccaagagatttgacctcttgcttatttttcccctataaaattgaaccatagcagtgcaatcctttatgaaaaatttcctatccttcctatgaatcaaagggctctataggaaaatttttccttaattaggaaattgaatcctccaaattacttatggcaaacattcatttcaaagtggtatggtgctatcttcagtaaaatatctcctttatctgaaaaataaatttacagataattgtatttcacatatatagagatagatctgcactgactactgattgcgtgtttatatatgtgaaaacctgcaaacatgcgtattttacatatgataattaattatatcagttgtcaactatagtatgaaacttgaacacatgacatatactttgcacacgatttataagatgacaaatatatatatatatatatatagcatacgtacgtatatcgtacggtagcagcagctgggtcttatagggggtacatactccatgcaacaacaaattaacaagatcaaacataattaactaataaacacaaaacgagcacagatatatgctaaaggggaacgatgagcatgcatgcatgagctgagctgacgacggtgataataagggggatctgaaatttggtactctccccagtggccggcctgcaggctagctagcttcatacgagcttcaccgccgatatagatcgccgccggctccggccgccgccgccgccctagccgctgcgctccatctgcttgaagatgtcgaagctctcgaccacctgctcgttggccctctcctgatataacatcaataatatagcacataattaaagaacaattccacggtgagatcatatcacacaagaactatctaaaatcataatcgttttgtggtggccatgcatcaaataaatcaaatcatatagagaaactgccttaattatactctcattttgtgtgtatgtatatatgatcggtgtctctgttgctatggcaagttaattatcgtcaatatgatcatcacctgatgaggaatgggagcagctactactctgggctcggggttgctgttggaggtggaaaccgtcgatgagcagcgggggtcgcacttcgcccactgcataaatgcagagctgatcatcagacacttgcatctccatcggtgcaagtaattaatattattgtactagtaattgatgtgtaagcaaggtgcgagagatctagagaccgatggatcggttgattatagctaataactgtcacaattatcacatgcaaattgggggccgggagatattggggatgagtagagcttacgttcttggcagccatgctgaaggcctccctgtgagggatatctggcttggcagctttgatacgctgtatttcctccctgcatcatcatatattaattataattaattgatccgctaaaatatccatgtgcagatttatttctgagaagagagtgtagtacgtacgtaggtacatgcaatgcatatatgcatatggttgtgtcgattagatataaactggcattgtctacatatatatcccagtttagttgtcccatgcatattttattccctttggttaattacttcatcgatgatatatcgaagtacgggtctgtaaaaagattaattgatactctctccatctcaaaatataataattttcagctcttagaatttatcctaaaatataacaacttctccaccaacattctctttccaatcaatcacaaacttccaccattcacttttcccacctatctccactactcatccaatcacaaccctccaccactaacttctacctactttcttaataaccgtgttcaactctaaaacttcttatattctaggacggagggagtactaaatgtgatttatattacagtagcattagcatatgtacaataattagctcgcacacattggataataatgcatgtgtggtgttttgctaatatatcatatgttctaccttttgatactacttatttgtgttcaagctagtatattgtcccattttaattttccacgaatctgtgaaatttcccctgcatccaactttcaccataaaaatatatagattggtcctaggcttattcagttttagtgaaataattggtttactaactcaattagtatttaattaaagaaatggtcaatctagtagcaatgcagtatcaaattaacttaaatttatagcacccactattttatggaagggtcggttaatttaattaaaactatcccatggatgggcatctaagagcatgctgaaacttccataagttgtacacgttaagatggcacatataaattaatgtcttttattcaaaatgatctagtttttttaataaactgttatactacaagggcgcacaaattaacagccccatcttttacagttacgttagtaatttctaacaacaaaacaatgaacacttaaaaggcaagatggcttgcattatcaggaatttaacatcaacaagtgtgtgttacttatagcaggtaggttggtaggtgaaactacttttaaattaagtgtgtttaatttagttaaaaaatttcagaaaaggatactccctctgggctgataatacttgtcgttttggacaagggtgaggtcaaactttaaaatctttgattatgaatcattttcaaaatatttgtttttcaaatatggtgaccacatgtatagattagtctttaaaagtactttaataagatcatatatttgttaatatttttttacatattatgatagaaaataatggtcaaagttgtttttttgaagaccgtgcccttatccaaaacgacaagtattatcaacccgtactactagaaaaattatttgttgccacgaaaaaaatcgtggcatcaatactaaaattgtggcaatagatacatattgccacaattttaaaatcgttgctagccgtggtaataaatagtgtagtaataggttattgcaataatttttatttagtggtaataaatttagatgttgccacggaatggatgtggcaaaaaatcatattgcaacacttgatatcgttgtaataaaaattattgccaccactccatatgtggcattagttctacgtaccaaattaaaagtacaaatattaatctatcatcctatctattaatttctttatacagtgtcttggctaggattcgaacccatgtatattgttccatttgagcctacctaactaagatttgaatatctaaaagatttcatatgaacaagttatcaactataaaattatagatctcgtcgagagctataatttccatataaaatttgtctcaatccgtatccatatgaaaaaaattaagttaaattatgagacgacaatttttttattgcaacgaatttgctgattgtggcaacaaaaagtagtgaaaagtaccattattatgtaaattgccacaaaaattaaaattgtggcgatagaacatattttttttgcaacagtaagattttttgtggcgatatctcattttctattgcaacaaaagtactaaataaaacaacaattgtagatcattgcaataaaatatatttttttaccacagaaaaattatcattgcaatagtacaatatattgctacaaattattttttgttgtaataatttggtggcaatagctcaattatcttgtaatgccggagggagtagcatttatacttagtgtttatatcgaagaaattaaacataattgtatccaattgtttataaaatatatgtaacacgtacgtattgatgtaataatttgtcgtaaatattgaaaaataatctttgactagttatttataaaaaataatgatgattacgttctataacacaaacaaaaggtagttcaaatatcaggaataatgtatgaaaatattaggattgttggtgtgaacaggaaacaccaaaactctttttttttactttcattttgttgaaacaaattaaccatcataactgctttagatattgtaaataaatatctagcataggctgcaggcatcagatataagatgcacacaggcattaatagttatatatgggtaactatgatataagtgttttttttcttgtgtttataaaattatttgggaatcaagatgaacgtactgcccagctcattgaattaaataaagatgtattttgtcaaaaaaaataaagatgtgtattggtcatgtgttttcaaaggaaaatgtgtttactaatttattaattattactatcatggcctggaatctgttccaaaacctgagcaattaacagggaaaggaataaattaaacaaaaataaatgtacttttgttaaaaataagtgttaattaaataataaactaagttaaatgtgtatatcaacatatacatatatgtagagagagatagagatatgataaaatcaatgcaaattggcaataactaggaccacattataattatatgcagagatctcagctaaataaaacagctggacatggaagcctggaaacagagagacccttcactatatatcaacaagaacaaaatatattaaagaaaagaacatatatagtggcaactaaaaaaaatgtaaaatggggtatttattttagatatacaattcattcaccatatccatgtataaacccccaagctatcacaaggtttaaatcagaccatagatcgatgccctaaaaaaagtcagaccatagatgcactttatttctttttttttttgaaaatatccacaaaatgacaaacaagctagatatccataatatgcacaatggtctagctaggtaaattactggagtagagtgtttttgtttgattaacagaaacaaattaattaatattcttcaattcacaaaattacactagctatagtagcctttatttagtgtactgagatttacaatataaaaatgtcctgaccttggatgataaattattttatgtatattcttccttcttttagaaggggataaatccccttcaataaaatcgaaactttctcccaaaacaggtgcagatctcatagagtttatagtacaggacaaataaaaaaaatattgaaccactactagctccctcaaaaaaaaactcagaacaaatagaaaaaatatatataagatcacatgagtgcaaaccatattagggatcacaagcatatatataagataaatgcatggacaaataggtaaatagtttctcacctcatgaagcggttgtaagcagatgggaggcggtgtttcttctctggggctacaatggaagacataaaaacatttgtcagaggaaacacaagatatgctagctagctgtttgttcatatttatatattccatgtgaacacaagacacagagagctagtgaaggactcgtcagaagaagacagttaacaattagcaagaaactaaggagagactgaatgactgatataaatgagcagtaagcaagcaagaaatttaattagaaagatattgatatctactctagctggtatatatgcacgtgtatgatatagcaagtgaagtgtgcatatagttgctttgctacttacgcttcacaacgaagggtgctcttgggctaccctcatttgatgtcggcgagaccagcggcagcggctggttcctcctgcagtcagtgcaaggtccctaacaccaagaaatatccaacacaagaagcaaccaaggttaattactagcttccagctctagcacatttcaagatctctcaaacgcttgccatgcatggatcagtgtagtagtagtagtagtagtagtagtagtagtagtagtagttggatgatgataaaatcatcatttcctaactattttctcagatctctctctctctctctctctctctctctctctctctctctctctctctccctctctctctctctctctctctctctctccctctctctctctctctctccctgcttgggtagaagtagctatactagtcaactcggaaaacaggcaatgaatgcatctttccacaccaaaataaaaaaaaagaagtaaataaataaaaatgcaggtttaatttggagaggcatgaatgccacagtagagcagctgctagcagcatatgctgcctgagaaaaaaaaaagatgaactggccggccgcttttgcagcatgaggctttcccaggccacagatgggcaagagagaaatcttttgcaatccagctttgtttaatcttgccttgcaaacagtattctgagtggctccataaagccgagacaggacacagagagctagagagagaagggaaaagaggagagagaaaccgaacaaaagaacaccccaaagctctgctaaaccatatttcatgagaaaaaaaagtcccactctccatgtgcaattaataatttctttaattatatgtcttccctttcttgtataaggagaaagatttatcgccagcctttctcctcgcaagaagctacccatatgcagaaaagagaaagtagctagaaacagcaacacgagaactgaagaagatcaagacgacgaagaagaagaagaagaaagaggaggaaaaatatcaagaactgcaaggagattcagagaaagagagagagaaaagaatgaaacgctagcttaattagctagaggagaggactgacctgaaacgggcccaaggggtgatcagttggggagagcggctgcaccatcggcggccgcgggctgaggaaggagaggttgttgcagtggccacatttcacggtcacggtgtccatcagcctcttgcatgggactccaacctgcagctacccaaaagacgaaaaattaattaatcacatcatgcaattaagccaatactttcttcgttaatttcatctctttgttgcatggcactgtccttaaggagaaaaagtagaggagaacagcatatctgtgtggaaggaatctagatggagcaagcaaataaagtgggatatgcaaaacagagagggaaaaagaaaaggaagaagagaagattcagtagtacttgttttttaatggaagaacagaagatgcaggtactactaaattggattcttgtccagtttaaaaatgcagcctgcagctggtaacaatgaaagaaggggatataatggaagcgaaagatggaacatgacactgcgagagaaccagctgagtagaacattctaccacaaagcatcatatcaagagctatggccaatgaattttatctaagaaagaaaaagagagctagccaataaaacaccatgcaggaagacagcaagggcacatcaatcacgtgtcatgaacaatccccagtggaagtttccactagcttagcagctagctcctcaggacacagagagagcaagcaagaagctggatttggtcccagctatctagctagctctctctcactgtgtcctgtgtgagagtaagcatatgccatgatgcacattaagcaagccaaaggattggaccaaaccaaagtgagagccctctctgcaatctgcagcagcaggagatcacgagacagaaccaacactttgttctttgctctcttgtccaattcaaaagataaccaaagaacgaaggccatggtgcagctgcagctagcagcagcatatatcgatcgttctctgcatgcgaagctaagccgctgctccggtttctcgaggagtttaccgcgagcacggtgttgcagtaggtgcagcgcacgtagcacaggtgctcggacggcgacacgagatccattgcggcggcgacgacggcggcgacggcgacaagcaagctagccctagcactgaggcggaggaggaggaggaggaggagcaagtgtgagcggtggtgcgggggaatcaagggcaataagaggagaagaggccggaggaagaagacgggaaggaggagagagagagaggggggggggggggagagttgggcacagcgggaggaaggatggggtagggtttctattgttgcaataatggcgagggggtcccacgcacacatggaccccgtacgcacgagaccaaccacagtgatcgggagagcgagcaccagaaaagtttttatttttccttttctttctttctttctttcgaggcaaatgttgcaagcaaagctaagatagatagcgagatgagatccatggttggatggatggatatatcaacatacaccgctctatcttgtcgaaacgaaaaagagaaacatcttttttaaaatggtaattttaccatcattaaaaagatacctagagaaccatatttactaacgtttagtatctcgatattttctcaagaacggtaaaatttctctttttgaaaaaatatagagatggtgtgtaagaagcacgggatattctcttataacgtgtagaaagactttttcatgtacgtatatatgtgtaactcagcatagtgatctgacaggtctcttctatctctctctctctctctccatatgtgtacatgtacactacacatcgtaatatcatatgcatctcgaggctatgggaacagtatatgtttgctcctatagctagctatagcatatgcttacagtaactagctagagtggtgtccatccgatccggtggcgaagccacagtagtactacatcccatccagttgtgccttgtactgtgccctcaaattgtgaatggtccaattgctccctctctctctgactcggaagatagtaccggtactgcttgacatatacccctagctagccaggttcctaattaaatatctaggtgttagttctcagagcacctaaaataatctctgcagtttatagatttttgaaatgttttttgaaaattgaaatatctaggagtttcttttttctatggaggatcggaaatgaaactttggagcttgtgtggtgtgaaatctttagagaatatcttccttaactggcatttgagttgttgaggaatgtagtaggtttctcagttttattttgtaattactccctccatttcatattataagtcgtttgacttttttcttagtcaaaatttttcaagtttgattaaatttatagaaaaatatagtagtattttcaacataaaacaaacatattattaaaatatatttaatgttcgatttaatgaaactaatttgatattttatatgttgctaattttttctataaaattggtcaaatttgataaagtttgacaagaaaaaaagagtaaaacgactacaatataaaatggagggagtagttgacagcaccttgtgtatacatattttctcttcttaatataacaccagttgggctggctcgatttcaataataataattttcttatagataattctttaaatataaatatatgaaaaataagtatatgatttttcaaataaaaatcgcattagtaaaattaataataaaaatatttctattgattatgcgtgactagtgtacttccaatcttttttaggagtgttttagaagaagtaaattcagataaattatagtagttaagagtatttggaaaagctgatcgtggacatttactacataaactaattgatacgcatacccatacatggtaactaattaacagaattatcgtctgtgttaagtaattaccctgttggaaactgcaaggaagtcgatggcggatcgatcgagacatttcactagatcgatcattggttgctgccagcttgtttggtcttgactagatcgagcatgatcagcg

SEQ ID NO: 54678 - DNA, 8970 bp, Oryza sativa
ttgtaggtccagataacatactttgatgatacggccgatcgacactagctatatgtgttcattatgcactcgtgactaatcgattatgttagtaggtgagtttttcacatgagagttgcaggtacgtttaggcatgctcctagcttcagtgaaaaagtacacgtaccgctaattaatgaaagcttatgatgggctgccttttactgatgtttcttcggtgaaagaaattgaaaaatataacggaaaaagcaacagttggggatcatttggtttaactgttcatgacaaaaacaagacgagcagggaagattttctatctgagcagcagctagctagcgggaaaaaggcgacgggctcgcatgcatatgcggtcgtacgctcccaaaatataattctgtgattggtaattatttctccctgagcaggtcgccagcatgtcgcagttcattttctctattacacatgtggagacaaaacagtgcacaccatgaatgatatatggagtatatagcggtacatgcatgcgtatatatattcccaccctgatgttgttgattaaattcagtgaaaatgtactgtctaattaattactaccagcagtaattttattctcgagctgaacaattaattactctcccatccaaaaatatactactacctattttagcatctaaattttatccccaaaacatatcaacttcttcacttactccctcgttacaaccttcttttatttaacttttgatctttttatgaacacgcaaaagaattgcacgtcaatatatattaaaagaaagcagagtttcagttacacaacgcaacctgcaaccattgccgggggacaagggaaaattaaaaagaaagaaaaaaaggcaatcgcaactaattataaccattcttatttaactcttgtcttaatctagcttcatgaaaaattctagaaatatttatattttggaacgcgagagagtacgtgtagagctttacaagaattaaactcatgatttgccaatgatgtgtcccactatggatgatagagctagtagctagcaaggctgcattattattgtgcaccatgggtgagtcaaagcgaaagtcaacaggggaatatatatagtatatagtaatgttgatccccttgatagggccgggcatgcacaatagagcagagagaaagagagagagagagagagagagagagagagagagagagagataactagcatatatatgcggcggcagctagctgatcttgctgttatatgagttgtgacaacacaaaactgcatgcactaagctcggacacacttgggggtatatatcatgcatggtgtatctctgccgacatatgatatggaagcaaagtttgattcctgcgaccgatcgatcgatatggccaattggccatatgatatggaaaagtagtttgttatctctcgctcgatcgtcggtcggtcggtcgatcgatcgatcgatcgatcgagagtagtagtttctgtacatgtgccgccggcattgtgttcgcatgcatatgatagagagatcgataagcctaaggagagcatgcatgtagccgccgcttgcacacacggatctgtttgcatgagagcaacactagtggctctcgctagcgatgggttgtgttacacgcagcatagcatgcagctggggccatccacggatgcaagcatgcatgccaacatattgatcacaattagatctctgtagtagctgatctctccctcatcatcaaaggctctctcgctgctcgagccgcatgcatgcagctagcgacatttccaacctagatctatctcaggctcaccagcgagagctcgatcgattgagagagatctcaatatctcatcagccatgtgtgcactttggccagcagtttgatcgaaatcaagagagagagacagtcacacacagacatcacagaggattgattacgagtactgactgatcatcaccactgagatcagaacgcacacgggagcacacacgaatctgatcgatcggaacgccgcgctgcgcatcagctagcggcgccattcatgcgcggcaaaagcttgatcaaggcggatggcgacaccgggagcgcgacggacggacggacgcccaccaccaccaccgtgacctgctgctccggctgatcgatccccctctcgcttgctgcatatgctggcaatttgcaagctagctccagtgtttgcgtgtgtacgtacccctagctcgcgtgctgctagctgcaggccgtccaggccggtgaatgcgcatcgatcgcgtgcctgcacaccaatcagctcccgccgcgacccggccccacatgtttgacacagtcagacacacacacacagtgcgatatctgcgcatgcgaggagagaaaagattattacagtgtggagtagaagtgtagagacatactagctagccgacacttgtttggataccagccgatgcgtcgtacactgatcgatttacgcacacatttagtaagcgaggtcgctgtccggtggaggttggcgagaccaacaagcgcagctaaagctagtgacgacgacgacggcgacgactgcgaccgcgcggcctgtgtttgtgtgggtggtgatgtgacgaatcctcagtttcctttccaggaaaaagcgccccaccccaactctgcccttctagcttactcccccggcgcaacgcgcccctgcagcctcgctctccccgtccatggcttttctcacagcgcggcgcctctaccacagaacccattaaactccctccatttcataatgtaagattttctaacattactcatattcattagattcgttaacatttatatgaatgttagcgatacgctagaaagtcttatattatgaaacggaggaagtatgcgacgttctattagtgtcggttagacaaaaaccggctccccgaaccaccagctgaaacaaaactagtacgtgcgggacatattctcgtactagttttgtttattttgaaatgacggagagagtactgatctgcgccggaggcgccaagaaaattaacataataactaagcaactgttatattggatgtgtggtgaaaagagatagtatatgtgcatgcaattgcagtagtagtgcgtgtggtggtggtggtggtaggaagattctaggatatcttgtcacctcaagcgccacctttggttggttgggcgctaggtctagcccagctacgtcgtacctagctacacctcgcgctcgatcgatccatcgctgctgtagctaagctatcgatcgagcaaagcaagcatatgcagcagcttattatcaggggcatgttttttttcagcgggatgcgtgtatgtaacccatctcgagcacactgtacatgtggcgtctgtgcccctcttctccattgccatgacatgccctagctagctattactagtagagatcgcagctagtagtagtatagtatagtactagtagctactatgctgcttgcattgctgatcgatgctgtgtgatggtagtacaggggaaatttaatagcagtagttcaactgtggcgcatattgcttgtcagctgcatgtgtcaagcgcatgtagtccatcgatttggatgctgctgctgctgtggctctcggtgggctgtgggctgtggctaagctagctgacaaccaagcggggacaaaacgagctcatcgatcgatcgctacggatgaacacggcgggcgccctagctatagctagcagcagctggacgttttggctgcttcaaattcgcagagatcatatcacggccggtgctaacacacaaccatcgatctcactggtgctaacacccatcccactggtcttagcaatgatcgcaacgcttcaccgtacgtgtcagctgcaaaaaaaaacaaaaaaaacactatttgatcatatcatatcactggaatgtatatatcgataatacatcaagagggatatatatagctttatattgggctggctgcttggattcttggcatatcagaggaggcatgcatatatgatactccatatatatacggttcaggcgcaaacagggatgcttgctgttactgcaagttgctaggcacgcagcagccgattgctgtttgtttgcttacaacacgtagctaggttagaagagagaccctgtttaaccagactggttgatcgagcacaatattgtgtgcgtgcgtggtacccacacaaagttaatgccgaacaaccatcctgtttcaatccaaacgaaatagtgttttgcatcttttgaaatatgagcacggctcgtcgttgactccctctccaaaccttccaggtttgttgaccaaacatttctgcagtggcaataagaggaagaaatcaaattgaagcaatgattaatttgagtgggcagctatttaatcaccaaagaataatgggacaacattcatggtaagctagctataggacttcattaaactctctccacaagcttatcaattccattctgctattggatagaatgacagggaaaatagggggttccggcgagccaaatactgtaccttttaattcaagttgttccagtcgaattctggctagtatattgaccggaattgatataaattgttccaagcatgaattataaattcttaagccatgttgtattataaactcatttatctatatcatattttctctcattatagtaccattttaaatataattacatctgaaatttcgatgaaatagcatatttatattgttttattaatcccaaaatggtggatcattatcgcctagctggtatatatctgaacattgagtcaaaccaaaatatcctctgtgattgaatggcaagcctccactacacaagctactccctccggtcataactatttgatgcacggttgactttgtccaaaaagcttaatcatttatgttattaaaaaaactatgtaaatattatttattcttttgaattattttatgattaaaggcactttgaccgtggtatatactctcccgtctcattttaggtgtagttgtgggttttcgtgtacaacatgatcgttcgtcttatttgaaaattttatgaaaaaattaaaaaaatcacacataaagtactattcatattttatcatccaataataataaaaatactaatcacaaaagaatttttaataagacggacaatcaaacgttggacacagaaattcacaactgcacttaaaatgggacggagggagtatattttttcgtatgtgttctatttttttaataagataaataatcaaagtcatgactaatatactggctagctagacacgtattggcatgttatttgtctacgagtgcatagtttcagtaaatatatgaggttttaattgacagaagaatcaaaaggctaataaggttgggaaaatattaattgtgatcgcaatgctctctttgtaaagcagtactgtttgatttgaacaataaaactagtaatttaaaaaataattttcttgttgattttcaattcgtatacatagacagacatatatacatccatgcacttccctgtcaccatgttggttgtctccagtgccaggacaggtgcactgtcatacctttttaacgaaatactggtggtagtgcatgcatggacgcatcaatacggggtcgttcacatgcgtgttttctgttcaacattgcatgcataattctatgttcataatgtaagaggaagaaaaatatgaagacacattttcctaatagttcgttactctctatccatccacaaagataagcattttaagatatcaatgcaatctttgaccaataataatacctatgaggaaataaaatactttaaatgaaaagagttgtatataacgatggattgtttcacaacaaatttagtaacatatcattcttaagtcactaatctttataattgttttttttctattgacgatcaaagttaaaagagaaatgcttgacttgttaacactattataaacgtgctcatattatatatttgtgaacataggaagtaaaacacacaattaaacggatattaaatccagccatttaaagccgaattgatgggaaatcataagaaaaatgatgatggatgagtggggaatcaattttttgcaatcaattggagaaggaaatgcatggagagacagatcgacgtggcgacggaggtaggattagcctgggaagaaaaaaaacagtgacgaaaagaaaaccgaaaaatcggaagcctgcaagaaaaaaactgcaaaaaaaaaacagcggtggaaaaaagtatgtaaaaaaccatgacggaagaaaacagcgacaaaaaaataataaaatcgcgatggaagaaaatgacgacgaaaaaaaatcagacggagcttggagcataaaaaaccaaaagccttacaatttttttattaggtatatagattaaaaccgtttgaaacatggacgacgtgccaaaattctggcagaaacatcttcaatttttataataatagagatatactcacaaggaacaatattaagtggttttcgattacctaggttatattaaatctgattagaaagaatgacccattagttcctatatatatgcgatgtttttttaacataatattcactttttccttttggacaggagggcgcagcccctttatgtgctctcatgcatgcaatcactgtgtatagcatgccatgttaaggtggtatgcatgatgcatgatagttaatgatcgaagtgggatatgatatggtagcagtgtatctctacaaaacaaacaaattgagacataaaagagaacttgtgagaagtaaaggtgtattgtgtttgaaaccacactagcttgtataaacaataggttggaattatgtttttagacatcaatacgttgctacttttccactaattaatttagaaaagaaatatggccactgtctattgacttgcttataattatgaatgtaagatcattttttgttggatatatgtacatatgctttcttgtgctctccacgcggtgtggcgcaaattaattttgttcaccacaaagtatagcaaattttgtaagagtttgcgattaattaggttgtgcgggggacaggataaataagctagaaaagtatagcttgccacaagtattgtcgcaatatataaaataaacatgttggtaatataatatatagtcaaacttccctagctacaacaaatgtggcaagttcatatccaaccaaatgccccttaattaaatcgttgaaaacagtttccttttttattcttgagttgaactgtcaaatgtaagagaggtctccccttatacaaatttaacattttcttttgttttaatgtcattcatgttggcatacactgtagcaaattaaatatgttgttttgaggtttttccatgtggtcatgttcatcaataggaccttatttgtatgcttctatttgatgcttgtcgagccagagtagtgaacatggaaaatacgcattaaatatataggtgtgttattttccaacaaggaatatatggtggatgaatgcgcatgcttcccaagctcttaaacgatatgatttgcttttctttaaaaaaaattatacgaatttcttatataactattttaatttcatttttaactttataatattttattaacttgtcaatagaataattatcacaaatcacttcactatttcaaccatttaagctatgccatgccgccattcagatattcagtctcatacaaagacgccattgtgatgatataccacacctattaaggtcggatcaagctataatggtttaatttgctccaatatctcacatatttctccgagatgcattcaagaaggaagtttagattggcatcgtcattgaatcacaagctaagacactacgaaaagaaccaaaaattaatattacttccgtcccaaaatataacaaaacttataactatgaatctagataaacatttatccatatttatagttagaaatgcttatattctgggacggaggtaactaatactcgaatgaagccaccacacaggatgaccaccgcaaaatatatattcccattccccaacggccacctaataatcgtaccaccttgaagccacacgattgggcatttatatttctaagatgtacatcccatgcctagtatgtcctcctatcaaaataaattcattttttgactcattccttgcataccaatacaaaacaaaaaactaaaatatacatattttatcaaataacagttcaattatttctttctttatatactcccaatatatttatcctctaccttcacaaattttgataaaataattacgtaaataaatttattttagaataaacagggggctaaaactaaacttattatgaattactaccataataaaaaaaacaagatttggagggagatacatcacatcaaatattttttaagaagaaactataagcatgttagagattgaacacttattgtatatactccagtaaccctatagtaacgatcgggtacttacaatcatatccttgactttgacactttacttgcctcggagacacgcacacatgcatgtaggtgcgcgcacacgcgcaatgatggtgcaatgagacacgtcggtacgaacgacccgcgctggcctaatcggccaaagaaaaagccaaattttaaattttcaaacttaattttgagattgattttaagatattttcaacgttgtttctttttcaacattgcttttaagttaccaagaacacatttataaaagttttacttacaaatttatttttattttctaataagctgttttggcttattaggccaaacgatggagaccgaagtataaagtatagccgtagtaacagcaattgcactttattagttgtacatgtcgatccgttagagacatgcgcccacacaacaagcacgtatatatgtacacatactgatcgatcgatcggcctcc

SEQ ID NO: 54679 - DNA, 4911 bp, Oryza sativa
caccaccacccacagccaccgggctagctagcttccggccgcgggcgcggacgtacgggcggcgggcgcgcggcgtggggagtcgggccggtttgaccaccggggagacgtacgcctcgtgcctgatgggcctctcgtcgctcgctcgatcgatcgcagttgatcgggagctacggttgatttgcttggtgctcgatcggagatcgagaggcaggcgggcattattgtgcttgatcattgggtgcatgccctagataactactgtatccgtcctaaaagaaaactcaatctaataatagaatatggtacatcctaatacgataaatctaaatatactaaattgtttatattctaatattagattgtttcgtcccagggagtatagtgaagctgaaagttgttgtaccggctgactagtactgtacttgttcagagcgccaacgctgcaggacgtacggttttgattaagggattaattagctatatactacgtaactttcgacaggtgattaattaatctacacgcttgatgggatttgaggaaccaaataatactactactactactaatcatgcataaaatatggatatctcgtataaataaaaaagagaagttaaatatttgtatacacgcacgtacgcatgcattcaagtgatcaggaccttgatcacgggacacagccagccggggtccctaccaacaacactccccctaatcgatggttatcgcagtagtgggcacgccacacatgactaggtttcgcgctatttccacgacatgccatcgctgcccgactgccggccagccggccggccggcatgcagctgggtctgttctggctggtcctagcggccggccggccaaactcgcgacctcccctcctcgctgatccgatccgatctctttctttaatcagcgcaaagcctgcgtctgcaacgtactacgtgtcgctcgagatcgagctggatcgatcgcgatcgatgcgcacgcgtacagggcgcttacgcgacgaatcacacgccctgcgccgcctgacgagagctagctgagctatcatgtcgatcgtccggccgcggtcggctctccgctccgcgccgcgccgcggcgtgcagtgagtgccgcgacgacgggcgcctgggccgtgcgcatgcatgcgcaacacgagcaagcgaacgtactcccccgcacggtcgtcggtgatcgagctagctacgcgcgggccattgatgatgaggttgatcacaatctggttggccggccggcgtcacatctctcctgaggtttcgcttgctgcctgcctgtgctgcgggtccatcatgaactcaatttgatcatcagagattcacttgcacagtagttagtggaaccccacctcgctgcacgaaaatgaaaataagttacgtaaataccccttgcattatatattctaccgaaagaacagtttttattgattccgatttcatgcatgtgcatgggttggttgcaatggagtggtttcattatctaaaatgaataacatttccaaccaaaagataagtcgaatcaattttgctatatatttgtcgacaaattttctcccaaaaatttaacagatgtaatatgcagtacaatcgtagtgtaattacacagtaactgtatgtaattacactttaactataatgtaacttatatgtaactttcaaaaatctctccgtaacatgttatttcggtaaaatagaggtcgtgggaacaaatcctttcacatatgtgtgtgctgtgattttttttctttctcaccagaacaaatattgtaatggatctaacgattcaaaattacgtgaaacttgcatacaagttacactatagttacatgcaagttacagtataattacactacgattgtactataattacataatttttagaagaaattttgtcgacaaatgcataggtggtcccaagtcggataatgccatccactagtaaatagcacgacgcttcttcgtgaagctcattatttgaatatattgaacatcataccattgcgaaagatactccctcgtttcagggtataagatgttttaactttggtcaaagtcaaactgtttcaagtttgactaagtttatagacaaatatagtaatacttataatactaagttagtttcatcaaatcaataattgaatatattttcctaataaatttttcttgggttgaaaatgttactacttttttttctgcaaacttggtcaaacttaaaatagttttgacattgactaaagtcaaaatgtcttatagcctgaaatggagagagtaacaacaatgtttgaacgagctccttaggataagggctccttcaagcaagaaaaggaattgtgaatgcgtctaattaagaagggtaagcaattaattccgagttagagctagggacagatttaaggtgtgttcgctaatggggtttaggaacccatctcctccgcacggaaaatggaacagtccattagcgcgtgattaattaagtattagctaattttttttcttcaaaaatggatttatttgattttttaagcaactttcgtatagaaactttttacaaaaaacacattgtttagcggtttgaaaagtgtgcgcgcggaaaacgaggaagggaggttgggaacctagggcaaagaacacagccttagagtataccgaatcactggtggagaaactgtctttactctcggtttgtaacaccctgtagtcctggttttctaaccggccgagtgaaataaccggtagttaagttgtatctttagtcccggttggtgttatcaaacgggactaaagagagggatctttagttccgattggtaacaccaactgggactaaagagagggtaggggcagtcccggtaggtccattttctttttattttctcccaaatcgagtgccatgtatatatccaaatcaaacaccaaatctccaaatcgagtgccctgcatatacccaaatcaaaccccaaattctcaaatcaaaacaacatcccaaatcattcacatcacaaatccaaagttacttacacacaaatcaaatactcccccgtcccaaaaaaaagacaaaccctaggtttccgtgtccaacgtttaaccgtccgccttatttgaaaaaattatgaaaaaaaaataaaaagataagtcacgcataaagtattaatcatgttttatcatctaacaacaatgaaaatactaattataaaaaaattcatataagacagacagtcaaacgttggacatggaaacccagggtttgtcttttttttgggacggagggagtacatcacaaatcttaaaaaaatacacacaaatcaaatacatcacagatcgattatacatctcagatcgatgcaatgaatcacaaactgtacaaaaagaaattatacatctctcaatcacaaattatcaaaaaaaaagccggagagaaccggcgcgctgccgctcgccatggctgctgcttgccacggccggcgcctgccgccccgtgcacggcccccgctgcccaccgccgcgcgcgctgcctcgtcgcctgttggccgccgccgccggccgcctgcccgctgccggatgtgaggaggagaggggaggggagaaggaggaaggagattcgaggggttgaaggatatctgattttatctaaatatctcggtgaggaggaagtctcatctgggacttaaccgatcatatatgggagagaaatatttactcacggttggagactccaaccgggactaaagatagatgtttagtcccggttggtaattaaactttagtcccggttggtagtatcaaccgaaactaaagatcctcgtctcctggcatgcctctgacaggccatgaaccgggactaaaaatgatctttagtcccgattggtaacaccaaccgggactaaagatcaaaattttttatgaccgattgtttttagtcccggttcttattagaatcgagactattgtagaaaacagctgacccagcaaatatcacttttccagcagtgaatgagggcttggtctctagcaattttacaccgatcgatctagtgggggcaaatgcgtccttatccatttttaatttctcattctatgacactcgcccccacgtactcactcattttaattcctgcggatgcccttgctctgagttcaatccaacacggaattaccgtacctctcctactttaaattgctagggcaataaaaatctattaggtgtgtgatatgtatgatggttatccaactctataccttacggctaggttgattatattgccgtgggagctgcccgtgcatggtgggaattctgttgtaggcataattattttggagtatcatttagagtcgacaagggtcatatacggtgtttggtaataatcacaaactaaaggttaggaaaactcttttgataggaggttgggactcgtgtcattcatacatatatctctctctatatatatatatatctataattactctctctattctaaattaagttaatataatacgtgatgtgacgaatcattgtaacacgaatctaacgagacgtacatgtcctgattcatcgacaaatggatataaagctagataaactctttgaatcgaaacaagaaggcatggtgacgagtcaattgatccaccccacatgtttttgtgacccagtagttctattgtatagatatttacgccaaatatgtaatctatatatgcaagattagctggtgcgcacagggatttaattagttctatctctacaaacggtgcattaaacagtcacttgcaaaatagaatatatgcatctagaatttcctaatattcaagaaatgttacaatcattttaaggggcaatgcaattttactttggatcacttcatttgattgcggacttgcagtgccaagtgg

SEQ ID NO: 54680 - DNA, 5586 bp, Oryza sativa
ctgcaccccaaaatatttattgaaaagtgatatatgtatacttttatgaaaatatttttcaagacaaatctattcatataatttttacatttttaaactcaacaactcgagagttattcataatttatatttccaatgtttgacttaaacattgtcataaataattttttttacgagtacgaagggagtaagtgattatattttgaggcggagagtataactttagcatatatatatacacatatatccagctggggaaaaaatgaagtatatatatatgatgggacagatgaagacgaagatcgtgatccttaatttaatttcgtcctcgcaaaaacaaataaatgaaggaaggacttaatcagatcccatatgagacttcgacgatggcaaataaattactggtttccctcagatttggcaagtctaaaatgggattaataacaagatggagatctcagtggagatgcggacgcacggaaagagtcacaagtaggacatgactgtggggaaagtttcatactcctatatatctggtccctgctgggacaacctgatcaggtgatgttatcttttttgttattggatttgacagcattaatacgtgtaccagaaagatgcagttgtactacttgaagggagcactaggatcttatctcacccccaaaaaaatagggggcaaaaaacggagccacctgtgaatgatgggattagagacatactacgtacgtatgacccggccagccctgctccctccgttccttaaaaaaaataaatcctggtttccgtgcctaacgtttgaccgtctatcttatttaaaaaaattataaaaaaattaaaaagacaagtcacgcataaagtattaatcatgttttatcatctaacaacaatgaaaatacaaattataaaaaaattcatataagacggacagtcaaaattggacacagaaacccagagtttgccttttttttttggacagagagagtatgatttttagtttgaaccaactgcattttttcgttctacacatgtttttttcttgtctttgttgcagccctagaaattttgtttcccctaattaactattatacatcctcaaagatagagtacttgttgtatatatgtcctcccgaatgtatacgaatataattaagttgcatatatatgtggctattgtatgtaggcatgtcattaattcccgtagtctttttttaaaaaacaaaatggatatgctaattgccacttgctcgcatgggatgtcgaccaaaagcttaccattattccgcagatatataggttctctgtccccaaactttacacctggaactgtagtgatgccgtttgtggggttaaaatgtatttactactttagtaattgatcagtccttcagttccagtgaaattaatgtctttcaacaccgcacgcccagtgtattttacatacagctaataaaatctgttatgtaaaaccaacatttcatttatttacaactgcctccatcgtcctgcatgttttattgtttctttaatcaaagtagagaacatgaactgcattgtttctttaataaaataacttttcatagtttatgggcttgttctgtttgttcccaaaatttggcattaatatcccccaaaaaattggcacactttggcattaccatttttttttggcaatgttggatgtgcttggtttgccacctttctagaatttggttatgagatgttggttgaaaagaaatgctctcatttttgacaatgtccaaccatctttcaatacttggaaagctgatttcaaggaggatttcgctcttcttatgcatagagtgaaggaggaggataaacctagatatcaatcatggattgacaacattttttaaaattttcctcttttgtatatatatattttgtaattttcctgtaactcctgttcatatattaatatatttaccacacagtaggagcctctcctactgtttaaggtaaaaaaaagaaggaacttctgaaaatactaaattttggtagagtgataatggcaaaaaatgtttgatttgttaacttatcaaattttggtaaaacaaaaaatcgtagggtcgaaagtggtagcaaactggacaagccctgtgactatatatatatatatatatatatatatatatatatatatatatatatatatatatatatatatatatatatatatatgatcataccagagacaaacttaagaacttaggactcttttaatattaattacatatagatcaaagatgcacacgctcctaacaatgttcttgttggactccaataagattaggaacaaaattagcttatatgcgcataaaaatgatagggaaatttcgtacattaattatggtgttttgttggatctttatgcccataaaatagctatttttttgtttactagtaaaatatattggacacaataagtacatatttgaacccctgtgttatataacatgtttaaaatttgcaaatagtattcctgaacattgaaagaactgtggcatgcaggaaatatataatactaatatacgtgtgtgtacgcgcacgtgcgaggggggtcagtcatataatattccctcccatatacatatatatgcatgtgagcccgattgagattacaaagataataaactaaagcctatcaccgataggtcttatcggtgacgggcttaaaatacatgcacgggtacggtatatcttttttacgagtatatttttgtcggtgtttattttaacctgttagagatgacgacactgtgacggtctgtaagccccatgcacgggaaaggccgttacagataagtagttctgtactagagtgtgatttttttaaaagaagaatttcttcacttgctctcattacatgcactaacacgaggaccccatgccctgtatgtcagtgagcaagtaattaagagatttaactaaagctggtatatataatttacgaggaaaaaccaaaggatcacagaaaatcacagaaaataactaaagctggtatatataatttacgtggtagtactgattgatcgatcagttctctgctggccgatcaaacgagttgatgagcagatgtgtgcgcgcgcatcgagcaaagctagcggcatcatcgatcgatcaggaccacaataattattcgatctctgcaaatacgaactaaggacagtccaatcctcgtagggtcgcacaggggcagtgcttgtcccagattagcattggcacctgatcaatgtgtatgtccatgtcagttagacgcttacatctcccagaaatttccctctcttttcattgcgagatctatgagtgccctcttctttttttatcaggcccactgatcacattcacactagctcggccagccagcagctgcttccacatggaaaactaaggcatcagcagggttaattctggagttatgcatttgctagattggcttagcatgcaaccgttcaactgagaaatcatcaggtgcgtgcgtatatgtgtgcgtgggacaaagccaacggcaaagcgtcacatctcacgacaatctgggcgcagaagggcaccacgtactgctcgaattttggaaccacacgtacattttatcgactgacgaacaacgtcgaccgaatagccaggaatcatgtgatcgatgagtttggggtcatgagagccccatgtacattggatgttctgaataagctcatcattatgctggagctaatgtacgtacggagtatcaaacaaaattgctgaatggagatgagatgtgatcgagtgctggcacaaaacgagtatgtgtcgtcgatttccttttccttgcacggatcggagcagaaatcaagctagctagcatcctgacagttctctgacttctctcctataaataaactagtcaaactaaatagacccaatagatgtttgccgttggagtttggagataatttctccattcactactagaaaaatgatccttgctgggtcgggtgatttccacaatagtcccggttttaataagaatcgggactaaagattgttgctagtcccggttgatactaccaaccgggactataaagatcataattagtcacagttcatcccctatcagaggcctgttagggggccaagcatctttagtcccgttgatactaccaaccgggactaaagatgaccagtaccggttggtaataagtaaataccatttaccaatcaatcttcacgggagtaaatatttctctcccatctctgatcggttaagtcctagacgaaactttcctcctcactgagatatttagataagattggatcgatcacatcccctctcctcctaacccctcagatcccctttcttctcctcccccctcctcccctctcctccccctcctcccctcccgtccagcagtcggcggtggccagcggggccacgcccggcgggggcgcgcacgggtgtggcgagcgacggcaggcggggccgcgcacgggcgtggcgagcggcagtaggcggggccgcgcgcggtgacagtagcagtggcaggtggcagcgtccgttcttttttttatatataatttgtgatttcctgagatgtataatttgtttttttagaacttatgattcattgcatggatctgagatgtatttgatttgtgtataatttttttaggatttgtgatgtatttgatttgtgtgtataagtaacttaggatttgtaatgtgaatgatttgggatgatactttgatttggggatttagggtttgatttgaggatatgcatggcacttgatttaggagaaaatacagggattaacatattataagactttctagcattgcctatatttatattgttgttaatgaatttagacacatatatatatatatgtatagattcattaacatatatatgaatgtgggcaatgctagaaagtcttataatatgaaacggagggagtagcaaagaaacaatgaaaaaaaaaagaaaagaggagattcaactttactccggttatttcacccgggattaaagatgggaatctttactcctagttcccaaccgggagtaaaaacggttaccccagtagtgatttgtccttaacccttgccacatacaaagaagaagaagaagaagaagaagaagaaaattcatgtgtatccctgagattgcatgtgtttgtgatatatatacatgcaagtattcttaaactgagctgaataaaactttttttttgcgtggtgaataaaactaatttgatccatcagttgacctgtgtgtgtctatatcctcatctcccaacttccccagccctaattgagcacatgcaagctactagcacacactatccacgtactccagtacagaagtactacgctctaattaaatactactattagttaaactccctgatgaggccagttagcacggagagcagtgctagctagcccagagagagttaagaaggcccatctttggagggggttggcatcctacactctagctagcccacagtccgctgccggctgccggccagcgcgcgcgtgcaagtctgcaagcaaagagttttcagatgcagatcgaagcaccg

SEQ ID NO: 54681 - DNA, 13567 bp, Oryza sativa
ccggtcgtcgtcgtcgtccgcccgcgcgtgctggctctgcagcccccgccgcagtagtgggaccgcgcgtgctgggtcggggaagcccgcgcaggcctgtcacgccgccacgatcccacgagccacccacaacgtaacacgagccgatcgagtcccgcgttttcactcggcctacatgggctgacgctgcggcctgcttcggctttgggcatcccgcggcccatcttctgcgagccccccgggaacgtgcggcccgcgtgataatcccgtggatatgggtccacgggttttcctctcctcttcccatcgcatccgcatctcggcatctcgcgtcgcgacccgcgacccgcggcggcgcgtcccgaatggcggccgatcgcccgctcgcgagggttgatgagatagcaaggcgccatttccaaatatttcgatccgcagcgtaatctctctcgcgtgcgccggtgcgcgatcccctccctccctcctcctcaatcccccagatcgcgtgcgccgcgggctctccccgcgttgactctccagcatctagatccgcgcctgcgctcccgacgaggtcggccggtctacggtcaccctcgtggtttccattgacttgtttttctcttctttttctttttttcccctcttctccccaacctcgcaacaaaatcggcggctatcctcgtgtttcttcttcgctccgtggccgcagaatccccccaccgctgttcttgcggcgccggtgttcgtttgaaaggtgaggactcgatctgcttgccgtttctccttctgggcaggggcaggtaggcatggaatgcgatcttgggtggtccatggagggattgatggattgatagttacatggagtttattggtgtacttagattggtgggggatcaattatttcttgagttctggttgtgcacgaaacctctatttaaatcgaagttttcctattcatggtgatggggttgctcctacctaacaaatcgatactccttgctctgcttattctcgctttttatttaatgggcagcatgtatttcatgacgcatccgtcggcggcgacgaactaattttcagttctttatgttattcagcagttggctgcgctgtcctgggaggcctcagcagcagcagcagcgagctttgctcttgtgagcgcttcgtgtgcttgcagctgcgttttattattgcgtcttggagctgtcacgacgtggttgttgagaggaatctatcatcccttcacagttgcgaggaaagcttcctgtggtatgtgttgtgctttgttttcttgtgggcaactggcagattgcaatggcattattaggaccttgtccaccttgacttagacaaactgcgaattaggtggtgtgacatgtgttgatattttcttttccaatcctctgatgcttacaacccggttgtgcttgtgacgtgcccctacctttgtttgacttcaatgtgtagtataacatggttgtcctgggcaagctcattacgtattccccatgagctatttagttgattgggcgatgtggtagttgcatactagtcgtcctttcttcccttgtcacctttggcggcctcggcttgcttaaaaggatacatatgcttttgtaactagaacatttgttgttgaatttggattatttgatcccatggcgaattctcgggctagccgtttcaaggtatttctttatcttgccttggattcctcagttgtgatctttctttggttgtcatcagtttgatgtgttcttactcctttcttgaagtatttctgttcttgctgttcagttctgtgattttgtctgaaaactttatctttgtgcttatcatctgcctgctgtttaatttaatccttgaccttcttgagtcctttcaatgcttgtactgagttttttgttaatataccgtagaaaaacatatggaagcttagagatcaatgttgagcgagttatttttatgaatcatgcttttcttgtgtgtctgtaaagttgaaacagggacatcttttttgctaaatatagcttaaagagggatggtatgacatgtgactagagttccatgatttctttttctgtatcttctcagtgttgtaaactcatattagaatgaacatcatttgacgagcacactttgttctgtgtggtaaattagcatcttacatctcacatattgtggatcaggccatataacttatttattttttgcaatatgtatgaattgaaagtgcttttttttttcttcttgcatacttgattctagctaatctagagagtttgatcactcagtattggatatgtctacagctatatttagctggtgttcagagcactattatgttgatgtacattttagctttctgctaacaatttttgtactatttctagtccaaagtagagatctttttaataagccaagtctatataactgtgtgagtggagctaaaatgatgagtatggtgtagtatgaagctttgattgggatgtgaaaatccatgggtggaatcaggtgcatggggtctatcaagaaattagataattattgttagtaaacattttttaagtgttcctctgctttgtccagtaccatggtatattgtcacattgctattaactctaagagcaagataagggctaaagatcaaataggttccagcaatgccaaatatttcaccatgttacaaacaccaagatcgattaaagtttctaagtattttggtttgttccatttgttttttggcagcttcagtatggtttttgtgaggtaactttttattgaatttttttctttacattgccagatgtctaatctatcagagccctcaaaagaagctgcatcagctgatgattcaagtgctgtccagaaaactggagcatggagtaacacgttgaacattcttctgcaacaagcttcagtctatggtgtggctgctggttattgcctgtcagcatccctgctctccattatcaacaaatgggcagtcatgaaatttccataccctggagcattgacagctttacagtacttcactagtgttgttggagttctcttatgtggacaactaaagcttattgagcatgatggccttaatttgaggaccatgtggaagttcttgcctgctgcggtgatgttctacatctccatcttcacaaacagtgaacttctactccatgccaatgtggacactttcatcgtgtttcgctcagctgtgccaatttttgtggccattggagagaccctttatcttcaccaaccatggccatcactcaagacatggctttcactttcaactatacttggtggaagtgtgatctatgttttcacagacaaccagttcactgtgactgcttacacctgggcagtggcatatcttgcaagcatgtccattgactttgtctacatcaagcacgttgtcatgaccattggcctgaacacatggggccttgtgctttacaacaatctggaggctttgatgctcttccctcttgagatgcttctaatgggggagcttaatcagatgaagggcgacagcgctaaagtgacaaactggctttcatctgatgtcattcttcctgttgctctgtcttgcttgttcgggctatctatatccttcttcgggttctcctgcagacgggctatctcggcaactggatttaccgtgctcggtatagtgaacaagctcctgactgttgtgattaatctccttatctgggacaagcatgcctcctttgtgggaacaattgggctcttgatctgcatgtccggtggtgttctctaccagcaatccaccacaaaaccaaaggcccccaaggctgagccaaaagaggagaatgatgaggagcagcagaaattgctggagatgcagcaagggctcgaaagtagctcaactcagaagcaagcgtcatcttaagcctggtaggaaatttggcgtcgatatcttactctcaacctcaagacggcttccctgtatcatattatgggatgctaaagaagaatcatttggccaaaggatgtttgttcgtcatgctagaatcctgtaatgctgttggcatgaaaaatctcagagaaaacttaatgtcactttaaaattctttgtttagtggtataccgtaattcatttgttagacctgtggtagggtatcaattatcaaagaatcctgaaacatactcgaacagaatactccgtatacaatatgctgtttcattgataatacagggtggttacccttttccatgcagtatatttgtttttgcttttcgttttgtgatgaaggaaaattatcttttgtactcaaattgcctgtatattatgtattctgtattgtgttgaaggcttgaagcaggttttgtcctgagttactccttatctgtgcacttccaggtcctggctggcgatctaattttagcccttcgacactgaaaatgatctcctgtttattttttttggattcagggattcagattcaagtgaactcggacttagcgtcgcgttcactgcctttgatgggccgtaatacgcatcgcgtaggacgggcctattcattgggcctgcaacttgctctgttgtcacttcgccacggtgttcttctccacatcatcctctataaaatccacgtcgattatggatttgcagtagggatgaaaacggctagagaaaaatgattatgaacattgttcggagcggataattctcagataatccagatacaaatacgatatacggtgaaacataccttatttctctttaattctagactttcaacctacctctttatattttctgttttaatagtagcccatctcatgacactatcctgcaccaataatattatttaaactttcaaatgtttttataaattatactatagtttatatattataatattagttagacatgtgtttataccaacgctgttgtacatgttaaacttaattagcattgtttagtttatgatcagacttaggcgggagttcccaattccctaccctcgttttccgcacgcacgcttttcaaactactaaacggtgcgtcttttgtaaaagtttctatacgaaagttacttaaaaaaatcatattaatccatttttgaaaaaaaacagttaatacttaattaatcacgcgttaatgcgaacatcattttgtgtgctgggaaggaggaacccatcctcccaaatacagccttaatataaaacaagctaattatatgtgatgatacttatttctattaaaagttaagacggttttcgtgctctgaaaaatatttgtttatgtatttgtgccttagcatattcggttcttatttgtatttgaggtaattaatatttattttttgtattcgagctattcaaatttatttttttgtccgaccaaaaaaaacgaaaacaaatacattaggagtatcatctgtttgtatcagctttgttttcatcctagtatgttgtatgctgtttttttttcgatggtgagaacgatatgtgaatgtgattaccatcgattcataaattaatcgaggtagagaagaacacattttctcgcaactaaggataagactatcatatttttctcctgaaagaaaatattatctttttgaacttcgaaagaaaaaaaaaacgcagtacagtaccagtagtactgtatttttatctctctacctttattcctcccttcgtactttcgtagccagccagagaaaaatctggaccgtgcattcccttctccaacggcccagatctctcctcccacgcagattccacctccccgtttgttcgctccagtgcttcgcacaagcaagcgcacgcacgcacgcgcggctttctctctcctccccctctctctccccttcacctccgcacccaacaatggcgcagccagagaaggtctcgtaatccaaagcggcccgcctcgaatcccctcgcgcagccgccgccgccgctcgatccccgcggcgtcgcgcggggtcaccggaggagagccgcctaacaagcccctcgcgagccccctgggggtattctgctccagccggaaggaatccgcggtggaaggccgccttcgaactcgcggagaggtatatctatatctcggagcctcgatcctcctgttgagtggtggctcccatttatgtagcgcggtttctacgggtgtttcgatccttgttcgatttgatctagggttttggttaggggggtggggggtattggttggttaatcgcgttgttggtggtgtgagtttttattcatatattattcggttagtgtgatttttgtgcagcatatagtagcggactagcgggtgcttatgattggcagcgattttgcaggagattttacccgagggtttcgattccgagcttgggatgtacggtcagggagggaacttcaatccgcagtatcggcatgctgcgccaccgccgccgccgcagcaagctggggtaacgggtggcttccctcagcaaccactaccaccgccgccgccgcgaatggcacagtatccgcagccgccagcaatggcggcgccgccgcctggaccgtaccagcacaggatgccactggttcagaaccaggcctacccttttgcccagatgcatcagatgccaatgctacctcagcagaggggttacgcccagatgccaatgccagggccgccatcgcagccgccgcctccacaagctatgtatcaggcccatcctcagtatcccatgccagggtctctccctccaccgccgccacggccaccaagctttgctccagagaatgcgctgccaccatctagccccccgcctccatctcccccaccaccaccaccgtcttctccacctcctgtgcccccttcaccaaccgctgcccccacaactgggcagtcatggaattcagagccagaaagaaaagaaggtgccactgccacagatgttggtcatgatgtcaaaactgagaaggtgactaatcagctaattgtctctgatgactcggatatggatatggatggtaagcgaacctacccgtcttctgcctctcaactgtacactgttaatttgtcacaattctaaaaattagtcctgcatgctgctccactctgtatttgtagtcaaactttgtcttactttgtgcatttattggacatgcttcccatcttattcctacctgatataatgatcaccactgtttcttgcaaaaagactggtataatcctcctgtcatcagaaatattgttgaatctccatctgcaggacagtttatatgatgataaactattaatatttattttcccttttgtagctaaagcaccaaacactttacttctcaattgatatgataccttaactcctgtgttaatccactgctagatatttactttatcaagttaaatttcagctgacgaggactctccatcaagggaacatgtcagtccaatcaattcttcacttgcaactgctgaatgtactggaaatgttaacacgcgaaagcctgcgtgtgatgtttctaaccttgtcaaggacagtggtggtaaggctaaaactacaaatgtaactgatgaaggtaggagcacattccaactaattcaaggctatgcctcagatgacagtgaagatgaggatggtgcttgtgctgtcagcaaccttgtgccattgactgaaaataatgagcctgttcattcaattggtacaaatcctgatattggccatcaactccttactgaagctgctccttgcactgagagaagtttggaggatcgagagcatcaactcatgagtaagagcaatccagtgaaacatgattcagatgaacttggacatccagtcaaagaagatttaagtggcaatgattctgatagagggcaacagactagaagacatggcaggagccagtggaaacgaagccgtggccagtcacctcagggcaggaggagctgtagccctctgtcccaaaggtaccaaaccttgtaccttgccttcaacttaaattggtgcatcaatttatctccacaaattggaactctatttgttttagatttttatatgtcatccagtttgcacaagtgaccccctatgggagtctaagaatcttaaatttctttcagtttatcatctggaaggcaaagcaattctccacttgctaagcgggctaatctactcgagagcaaatcaccagatggagtgggtcagactttcagggcacaacctggcgtcaagcttggtataagcaaggatggattctacaacgacaaacatgattcccctgtaaaagttgccactccttttgatattcatcctgctggagggcacatttcaggagatagaatatctgagcaagatggcctgatgggaacaaagaagtttaatggttctccagatgatatagattgtaacgagaaaacgaatgatgcatctgttggttcctttggaccacatggtcatggtgcagttttaacttgtggaccttctcaatcagttgcttcttctgcaaatggttctgatcctcataagatgcaaaggtcaggccgtgcatcaatacctcaatcagacatggataaatcatctctgggtgctcatcaaagtctttcgagtcaacctccaggaatctcatttgcaacagtacatgctactgagaagaatatgatgtgtgatgtgctccaacctcattctcagaatttatgtcctcctggacagatgccatctggtttgagaccagctcatataccatcctcaaatataaccccactcccagggcaacagttactttcgactccagaatttcctcagatgcacttccagcctaatgttatggcaccagctaatgagtttctgcagagtcagatgcaaacctatcctgcaccagatctgcctcatcctaggccattggatttccatcctcatactctccagccagttgtccctcctcatcagcagcctgctgccatggttcactcctctttccaaagattcacaccaaatctaccaggaagtactgaatttggtgctatatctgatactgatctgcctaaatcatctatcaagccccactacaacccttttgcgtctacctttgaacaaacagatccgactctaaatattggctgtgatgttatcccaaatccagttgagtctgcttcaacaaaagcagcagaacacgcgaatgcactgtcaccttttggtctgtcggttcctggatctggaactcatgtgcgtgagaattctgcggaagttgtttccagtcggcaaaagcagcctcatcgtgaattcacttctagtgctccctatgatccactgctcgacagtattgaaccctcaagcagttcaatcaacaaaatggatcttggtcgagaggcaaatctgagtgctagcaatcataatgcatctaaaattgtgaacatagaagtggagagtaaaaatatgcatggcctggggcttgttgctgaatcggaagttgaagaatttggagaggtggcagcagatactgaagcaggtgttgtggataatttaagtcctgagcccttgggtgcaaaagactggagctcagatatgcccggtgatattgacaatgatgaatcggtggataaaaataagaggactaaggattccagatcaatgaagctatttaaggttgctattgcagattttgttaaagaagttcttaagccatcatggaggcagggaaacataagtagagaggctttcaaaaccattgtcaagaaaacagttgataaggtttctagttctgtccctaacaatcatattccaaaaacgccagccaagatcaagcagtatgtccagtcctctcaaaagaaagtgaccaaacttgtaatggtatgtccacgattcttctgtagcaatattgattacttagtttgatattctgcaaatactcttctgaccatatgttgtagttctctataatggattgtgtttagtaactgatttttttatgcgtgatatgttaagtatctaaacagtaaacacaaattttggagaaaaaacaattgcgtgatagtagggaacaaaagttgtgtgttctagtcaactttgtgctattcagttctttgatgttgtgttttgattggagatgtcctggtatctttgtgcaaggagtcttccagccacttggtaattggtttgtgagtttcagtgtcatgttgtaatatacactattaattgaataaaccaggtttatttagctattgaataaatttgaaagcacaagtactttcaagattgaaacattctgattctggtgtatgattttttttagtatatgcatataactctacagttgaaggatcccctgagccaatcctctgagccaatctgtttcttttattcagggctatgttgacaaatatgtgaagctatagttggatcagtaaatgggactatgaactggagcaatcaggacagtgtccttttcctgttgcagaaatcgtgatgggactatggactatgaacagctcacacgaatctgagctatgctatggtattttggatcatcaatttgcagtctttcagcagtaagggattccgggtaatagttctgcagaaatggatgtatttatcagaaaatcacgagtttacattggaacaattgctgcctagtcttcatagccttgtaagatgtatctttgctccactgtttctttttttcttttcttttgagtagtttgctctactatttcaccatcattaggcaagtgatagtagaacgttctttaatactgactgcatgaacgcattgctgaaaagaattatatttcttcaaggtaaatgtaaatgatttaatcttattgctacttcaatagttcaatgaacgtgttcatgtctgatttagccaaagatctccctaagaccctaccgcctttgctggatgctagtttgaccatttgaacaatataaagcgacttaaactgcagttggctcaatctttctaatgtattgttatatttacatgttacaagtaatgaacacacaccaatttgacaaatatttctcatgttgagctacgtatgttaccatcgtgaaggggatcgcattgcaagattctagagcgtggtgttgggcagaggcagagaggaggaataagttcacttaacgactgagtttagatcacgtactaaaccgcaatataagggcagtagcaatcatggtttcccaaaccgccgggttaccgtgcctcggtggtaagcacggtaaccgttgcaaaccgtacgaaaccgtgtaaaatttatcaaaattattttttaaaaaaaatatttatggaggttaccgcggttgtctttttaccgtacccccgcggtaagcgcggttaccacggttaccggcggttctgcaaaccctggtagtacccatttgaggaacctaaaaatgccataggttctgcaaaccctggtagtacccatttgaggaacctaaaaatgccatataggctataggtaccgtgtccaaattttggttccccacagtgcaaatggtctcatgggtgacttcaattttttgtttcagcccctactacttttgatttcaaccctcatgtttttttctcaatttacaaagaagtaaaaattttacagtgaacatcttacagtggagaaaataatacaaatcacaaccccacccaggtacccaccaccactaggtccacaaccctctccactttccctacccactcggcgagttcaccggcgacaccgccgcctcccgcctcttcccacctcggcgacgaactctgctgctgccagcctttccccactccccataccttggcaacgaactccgccatcggcggcctcttccactggagcagcgtgggagctcggcctccaccggagctcgagcggatcccacctggagctcgatggtgctacccgaatctcgcccggcgcggggtggcgttgccggacatggagctcggcctccaccagagctcgagcatatccgacctagagctcgacggcgccgcctagatctagcccggtgcggggtggcaccgccggacatgaagctcggtggcggatcgggcgacggattggtctctcttatcctctgttgccggctcctgtcctcctcaacgtcacaccaccatcctctcccctctcacctctccgggcgccggatgctcaagctcactgcccctccccaactctgcagatcggggggtgtggagctgtggaggggctcaacggtgataactgcggggtggggaacatggagcgttgatccagtctactatctctccccctctcctacgcgttctctgacgaggccgagtgttcttcagtaggacgcaatgggtgagctagagaaacggggccccaccatctctttcctccaagtaagctattcaccgacgtggcgcgatgaggtaactcgccacgtccctgcactgtgaagggcctaagatgtttaacttgcaaaatcggagtgcacgaggtcttcagatagtattgaggtcggttttagatgatatggcacttacattcaggaaaaaggaataaaatacgatggtggaacttacatgtcagacaaaaaaaaaactacccttctcttccccctctcccactaacacgtcctgacagtgtgctcctgtccctctatctccttccgctgccccaccacttagccacctgtggcgacaaacagagagagctcgcgcatgcaaggaagtatcatcgtcttcgcccatcatgttggtatccgcaacattcgttggagcaggggggaccagcctcgttccttgtcatgctcgctgtcgtgttggctgtagtgtgtgtgtgggcggcgtcggggataggcaggaggacgacaggcagtgcttcgtcacaatcaacacgctcaccatggccatcgtgttgtacctcctcgttggcgacctcatcggtgtcggcgttgtcaataatggcagggttgtctcgaacaccttcgtgggcatgctcctagtactagtgctctctctctctctctctctctctctctctctctctctctcttcgtcgatgttgtaggaggctcaccgaggggcaggacaagctgtcctccccggcgtccctccccctccctgcgctcaaagcctccgttgaaatccaccgccgccgcagaaccccttttaccccaaactggtcatgtggcggctgccgcgtgtttggacgaaggtgccatccacatcattgtggtggaaacaaaggaaaattcgatccaagaggttggggagtgggggggtggggagagagagagagagagagcatgggtttggggatggaattttcgagcttagctctcctcccgtcaatcgctgtccttctccctgctagccaccatcctaccttggagtccatagaaatgggaatagaggggaggaagtgagagataagggcccctaacatgtagggcccatgctgattcagcgttgttgatttcgatcaattagccacgtcggacaaaaccagccgctatattatcatgggacctcctttacattggttggttttgtaagttaaggaagatgttatatctggtattgcagtttaagaacaaaatttgaactaggtgtcaagataaggacctaaagtgaactaagggg

SEQ ID NO: 54682 - DNA, 9256 bp, Oryza sativa
attccgcttgctcaaatgccagcccaatttaaattctaaatgtggctcccaagaatggtggattatgcgattttccaccgaacatgcctaaagcacaatgaattgctcacggtttgcttgtgttcaggggaacataaccttttcaacataacgaaaatcagtaagattttcctccatccatgtccagcatatatgaggaaaagaatatgaaaatacccgctgagtaacaatctaaatcacactgggaaaagaactacaatgacaccctactggtatgaaacttttgatccgcttgtgctttttccgtgatcaatgcatcaagctccaggcctcaacgtccagaggatttaaagagaaatgaaattacaggtcctgatcaatagggtgccagggaaacgttcaaggcaacatgttttcatcacccagaaaactacagccaccacagccagatcatctctcttttcgcaccgcacccttggtgaccaaggccatatagcaaaaggaaggttggataagttatgcagctacaagatcaggcgtctctgcctcaacggacaacagggtggtatgcacttttccaacccaggcgtccaaccgctcgcgcaacgccttcacctgtggaattccaagtactctaggctggacccatgacacgtgaactgtgctgtccacctcatcaattatcccctctataagatgaacctgcaaaatgggggaatcattaataattctctcatattccaatttacttttaaattgtatggcaattgatggcctcatggaaatacagcacccaggctccattagcaactaaatagaaaacatcagcatggagcttttgtaagaagctgatagcagtggcattctatcttggctacctatatattctgcctttcaggggcagcattattatatactataatgtactaactgatgtagaaaagaactgtaatggaagaaaaagatgagaacatcaactaggaatactagttgatacattgtgcaaacactgaagccgtataaggtaaaagcaatagtagcatgtaacaaggagagacacaggtttgctgtgatcaacaaacacaaatatatgaatcacatgtctagtttaactgacaacgcacacccataactcacaactaaagattcacaaaacaaaccatcagcaattaaaaaaaaagacaagttcacaaaggggaggaattgaaggcagtaattatcaaataatcactatccatatacagctgccacattaaaatgacagaagcattagaagcattctaatgtctaatcttaaaaaacaatttatgcacaacaaaactagatgtttatgaatggcattcatgcattgtctatcccaacaatgaattaacatgatattggcatattgcaaataatatcttatgaaagatcgaatgtaagaaatgcaattaccgagaggctcttcataagaagatattccacatcactgatagaaagcttagtgcgctcggctataacacttaatgggatagttctgtcttctgacgcccggctacaacatgaaaaagaacacagggcttagaaggaataaaggaaaaggggcaagacatttgtggtggcatagaaaagcaagtagcaaagttgtacctaaagattatctccatcagacatagaatgttgatcttctctagcagtttccgttcattctgcaccaaagctggctgagcactgagagcagcattgtggaccctacatagttcttggtagagagctaggttgccggtgttgaatgcttgtaacatatgatagacccactccaccttggttccaataagactgttgatctaaggatataaaaatataaacaacttcagacagagatgtaccaaatgacaaccatatatgccgatatatagatttaggggccattcaatatttcaatcccataaaggctaccttgtgtctggaatttttttgtttggtatccacaagtcaatattgatttttccatgcacaaaaaagatggtttgccattaattcatgcaaacttaagtttatgctatttcaattcaagaaaatacgaagtttacataattataatatagtggttcacaattacatcattcaacattcagcaaaaaaggatcaggcataggatatttcatcattttgatatgctttacacaatcggtagcattttattgtgtcaatgttaactgcatacattcaactcatgaaatttctgctaccgatttggcaatagatgtaagttactgtgtacaaaactccgaaacttaactaccataacatacacaggtaccttggacgccttgcagttctagcaagcatcagataaaaacaactaataaataattatcagaactggcagttgtgagtaccaagaaaagccacatgtaatgtttatataggcaagcagagttaattttaatcaagcaatcaagaaacacaaaaaagtatggataaaacaaaggtggtactactaactagtggcaacaaaagaaatcatgcgtaagcaaagtccaacttacaatcgggtgagctaacaattccccaaagttgtagatgttatcaccaagcaaggctgcaagggagagatcaaatgccaaatcctgacacaagacagcatcaaagggtaaacatagatgcaagatacattattaaaataatgcgaggaggaaatgattttttgtcatgtaattgcattgttaacaatagaacataccagtttgaaagactcagagagtgactctacagtagtgtaagccagatacagaagggcattcttgtagaactcagcaaattcttggcgagccttatggtactgagatgatatccagtagaggctagcatgaactgtgggatcaacatcagtcatgctatctagagtagattttccttcgtccaaaagtttcttgcactccttctgatttcccttctccaggttaatcgcagcgatttgcatcttgacgtagagaatgggttcattgatgcgcaggtcctttgtctcgcgcaattttgtgattaccccctcgaggaaacttatagcagcatccttgtcggggtactggcgcgaagcgatgaccgcgaaatgcgcaagtttgagaagattgatcttcgtctcgaaatcagtgatgaaattgttgtagagctgtatgagggtgtcacccgtctgtaggagaatggatgccgctgttagaattgcaaaaacgcagaaggcacaacacagcagttacaaacctaagcaaggttcaaacaacaagagtaaatttcactttgggcatctttatcaaccaatatttcacaacagagtaatggactagggttaaggcttatcctttcacataacatcacatataattaaaatcttttgcgctttggaccacagcttattccctggtacctcaatttccaggtagtgaaatctgatctttaaatatttcatatgcaagtaatgaaacccaaatatttatcttcgaatgttcatatgtacttttcaaggttgaaacatgaggtttaaatctccacaaagtggcggcctgtttgcggccggatcggtatcgaatttagggcccatccagtccaactagggttcaaatcgaactaggcacggtgggtagggtttgcggcgagatccgtacgggggggacagcagctaacctaaccaagaacaagaaggcgcttgcaagagagggtgaggggaggaggtggtgggaaacctgcgcggcagggagctggaggaagtggtcgagcttgagggtgagctggtgccagagcttccgctggtagaggtcggcgaggtcggcgtacgggtcggcgagctccggccgcgcctcgcgctgcgactcgacgaactgcagcgccatggagaaaaatccccccacccaggagttggtcgctcgctagggtttggggaggagaggagaggaggcgagagggggatctgcaggcgcggcgagcggaggcgaacaacaaagagcaatctcttctctttccttctttcttgtaagaggaggaaagagtaggagacggagacggagacggagagagagagatactttgcgtgggctgggctgattggtgctgctgctgccggcccgcacgaggtcgggcctagtgggcctagtgggccttataggccgaatagtttgttaagtctgtttttattgagtgatcttttttaagatcatgtttattaggttcgcaacttgtatttaaaggttgttttgggaatttctacttggtaatttcaacttatatttgaaaattttcaattcaaattttttaaaaaaaatcaaatccacccaaaatttgaaaacttcgtatattaccatcgtgacaaagtgaatctcaatgctccctgccatgttgtttgaagtgatcttacgctgaatttctttttcattttcccaacctatctcacttgtttttcacgccaagtttttcaaactactaaacaatatgtttttttaaaaaaaatctatacgaaagttactttaaaaatcatattaatttatttttcaagttttttagattaatacttaattaatcatgcactaatgtgtaatatcgtttttcatgtagagaggcaggggcggagctagaacgaaatggaggagggttcctcttgcttaatttactctaatttagatcaagttttaagctgatatgtgtatgcctaagtttgtattaaggagggtgcacacatggtgaaaatcggtgagttataactaaaaatttttttttgaccggattcttgggcaccccttccatactctacctccgccccatcagggaggtggagttaacacagtcttaaggtggagcccaagtggcgtgcagaagtttctctagatttgcaagtgtttgggaaatgcacatatgtgggctctacattttcctaaaagtaaagaaaaatagaattccaaaacaacctgtgagtgctgctcacatagggtgtaggagaaacgagaaagggatcgtattcttttaaatggagtattgcttgaagcttggcataaaactcgagtttggcttaaagctaaggccaatctaatggggtcagggttgcagttgtggttacgtacctcgctatgggtttttgactttatgccattctcccggatacgtattctcaaataccatcattataatatacttaaattatttgtcatctgtactcactagattctttctattttgtcacttttaactaccaactcagcaacttgagatgagaatgactttattgcaccatctcttccttctttcgttcatctctactttgtgtatgaacttgtcttctctctccattcgtccctctccagcatgccgaagagtctatcaacattagcgttggcgccatccatgacacctcgatgaggaagttaagtaggccccaggtggcagagctacttgagagcatagtattcatcgtctagattgacatgctggcggaagttgttgcggcgacagtcccttttccttggcatcgtcggcagtcgatgaagaaggggaaggggtagagctgcgacgaggtccttgtcaaccctgcagtcaccatccccaacaaggtgtggctcaggttgattccttgatcgacgatcactgctcggggatccaacctagatctaagcgaccgtccctcacaactccacatagggaaaaagtgacgacgtcgatagcgcaggggaagagcagagagaaagggacaactggtgcttgtaggcggaaagcttgtccgcgtgcatgaccttgtcgaagctggagcaactcgttgaccaaagggagtggagtttgaaagggtgggagagagcagataagggataattagatcttttgttacacggttggctgagctagcaagaaaaatggcaaaatagcaacaatctagtgggtccgatggcaaataaataaagttgtttggtaagatggtattggagaatatgtcgctgagaaatatggcaaatagtccaagatccccctagctacttccttctccttcgtgcgtgttttagcgtgtaactgcttcgtgctggctttttctttctataaacgtttgatgaattctgaaacagctggaagagcaagtttgctggcaaggtagtatagggatattccacccgggctagagcatcgcattcgcatatatcggcgctagacgccttcaccatcgtagcgtgacaccagcaaattccgcagccagcagccagcagccagcagatccgcagaagtccccaatccgtccaagctccaacaacgctggggagtgtggccccgcctggcccccaccagctccaccaaccgaggcacacgctgcggctgcgcgagcagggcccaggtgacggccgcccgcacgcacacgacacgacaccaacgacgcgacgcttcccctttccccccctcatccgccgtttgcctccaccccccacccactccaccgtccccgctctccccccattgccgccgccgcctgcgacggccgcgagctcatcccgagacgacgtctctagctagcatcgagcgttctttctctcctcgggctctcgttggtaagccctcgattccggtttcctcctgcttctcctccaacctgcccctcggattagtcgccagtttgttcctcgttagttcttgcagtaattatagtgctaagctccggttgtccgtcggcaatacgccggtagtccatgcaccagtctcgttttcatgggttttgttgtttgcagcaggcatacccctgtttcgctagctcaatcaatcatttcattgctactattttttttgttttactttgtatttaacgagtacttgcatctatgaaacaaacttcacacaaatttgatgctcatcaggttcttagttccaccttcttttgtgttttttttgttcagttgagataaggcaaatcaagagagcaaaattttggtggtacatgtggtgattctatgtcgacaaggcgtcatcttgcagtatttaccactgcaagcctcccatggatgacaggaacggccatcaacccgttgttccgggcggcctatcttgcaaaggatggggatagggaggtcaccttggtaatcccctggctttctctgagggaccaagaattggtttacccgaataagattgtgttcggttcgcctttggagcatgaggcctatgttcgtcgctggattgaggagaggatcagtttcagaccttccttcagcatcaaattctaccctgcgaaggtacattgatatattaacgcaaagagttcattaaccatttaaccctggaattctctattctttgtgagattttcttttaggtggttctgtacttgatatatcaagttctctatactttgtgggattttcttttaggtacattgatttatcaagttctctacaatactattgtcttctattttacttggaaaataaaatcgagtcaaattggttaaatatttaccgttgattgaacctgattaccttaccatggagttatggttaacctgggtcagttttgtcagaaactcaaccccctttcaggtttcagctaactttaaaaaaatgcagctcaatacagatgatgtggtgcatataccatttttatttgcactgttagcttccatctagtaatactcatatttatatcttttttttgctttagggattttcaagacaattaatacccttttttctttatgatgcagttctctaaagaactgagaagtattctacctgttggagatatcacagaatgtattccagatgaagtggctgatgttgctgttctggaagaacctgaacatctcaattggtaccaccatgggcgcaaatggaaaaataagttcaggcgagtgataggtgtggttcacacaaattatatagcatatgtgaaaagagaaaagaatggacaagcgattgcctgtttcatgaagtacatgaacacctgggttacccggatttattgccacaaggtaacatcaacgccatatataacaacagtgaagatcccaagaattatggtgattaatctgaggatgcattttgcccatttaatttatgttccaattttacatggcgtcttgatggaaatgaaaaatacaagagacatgtcttttcagatttttctgtctgaatgcatctggttgttttggcttatgctctattacatatttattgaatttgaagaaccccaaactcccataatcatcatgtccttattaaagcatgcaatactgacttttgttgattttagaacagattatcagattgtcaggtgccacccaagatcttcccagatctgttgtgtgcaatgtccatggcgtgaatccaaaatttcttgaggtaggtaaactaaagttgaagcagctgcggaatggggaaatagccttcacaaaaggggcatactatattgggaagatggtgtggagtaaaggatacagggaacttcttgacctgctgtccaaatatcagagcaagttggtgggtttggaagtagatttatatggtagcggagaagattccgacgaagttcgaaaatctgcagaacttctgagtttggccgtgaaggttcacccaggacgtgatcatgcagatcccctgttccatgagtgagttctcttattgttcaaaaacttccttccgtcttcttaattatttgaatgaacatgagcgtacaactagacaagtttaaccagctacttttttcattgttgttcaaaaatgagtttgagggttacatatcattataattcattgcaacaatgcaaggttactgaactaaacaaaacgttgaacacaggctacataatgaggtaagacaagaaactgagagtgctaaatcacctaggaatgcaatataactcataatatattttgtcatctatattacattcagcatatggcaatggtttgtgtggatactgaaacacttcaatttcccaacagctataaagtattcatcaaccctagcacaacagatgtggtctgtacaacaactgccgaggcccttgcaatgggaaagattgtcatatgtgccaatcacccttcaaacgagttcttcaagcagttccctaattgccgcacctatgacagtggcgaggaatttgtacaactaacgctggatgctctagcagagcagcctgctccactgactgacatgcagagtcatgacctatcttgggaggccgcgaccgagagattcatggaagccgcggagctgaaccttcctatctcagcagagccaagaatccatcaaacatccaagg

SEQ ID NO: 54683 - DNA, 3302 bp, Oryza sativa
attctgcccatcagtgtcttcttaatgtaacagtacttctgtacttatcatcctacattgtgcgctggcaaatgcttctgaagttgaatttccacggaacagtattataaactagtgctagatctttcaccaatctttattaattttctactacaaggttgcaatttgcttaagaatagtaacgtgcaagttagtagtactccatactatagtatgcaatcattaattgccttgcaagttgcagcatggttcccacacactcgtttgcacttgcagaaaagtttgcaagttgactcagccagcacaaacttgttagctgctgcttaaggctttctctggattgaaggaattttacagaaattttgatcaattcatgtaaaatttctgcgtgtggtacaaaggagtagggaaagatgcaaccgtcgcatggtacgaagcagctgctaacaaggcaactgcaccgcagatcgtacagcggtcagttagcctttattagcacctactccatcagtccaaaaaagacaaatcataagtttccgtatctaacgtttgactgtccgtcttatatgaaattttttataattagtatttttattgttgttagatgataaaacattattaatattttatacgtgacttgtctttttatttttttttatattttttttaaataagatggacggtcaaacgttggatacagaaatccaaggcttgtcttttttttaacggagtgtgtagctattgatttcgtccaaaacaacatcattagctggtgctagtgtggagattatggcgagctgtcaccaccagaatgactctgtagcgaaacaggatgcatgccatgccagggcaagttctgcatggtgcacaactatgcatgtacgtgcacggcactatcagtggatcgactagtaaatgatagtactatgcccgtaatataagcaaagtttatatatacgcagaagaatgctattggaacaagacaacacagcacattcaacttgagaacaatataggtgatgtttgaaaagcagggactaaactcacaaaaacataaattcctatgagagggactaatccctccttcccaaacaccaccgtaacatcattatttgcttgtactatgctactgattagtttggctctgatttgaacctgatgtttgtcgatttaaatgtgtggacgtgtcaatctaaattttcgaactctcaatttatcttaggtgtcatgcagatccaaatagactccaatctactcgtgctaatattcatatcacgataacacctatgtatcaatgggactcatatgttagtcacatagaagaaaataaagatatctcatctctctatcgctaatctattgtaggcgtctctctagcgaaaatatgtttttaattttattttttatatgactaacatatgggtctcactgacacgtatacgtcaccatggcatgtcacgtcagcctacgaagcgggttggtgcctgtttagacttatatgacacccatcacaagtttaaggacttgaaaatgcattttgatagtttggggatgaggatgaccgtacctgcacaaatttagaaaccacccgtacactgcgctctttggattttaagttgtttggatttcccttctaaacacataattgttgtatggattcccatgcattagagttagtatctcacaactgattattttatgtacaaaaattgaatatgactataattatatccaacaaggctaattcgcgaacgcattatgaccacattatgacaagcagctggattagggtttggggttaggtagagggggaagcagggatattccctaagcttagaggagtggccggggaggcggtgtgtggtaggcaaggatgggcatcaaggcggtgggggcaaagcaaacatgagtgaggggaagggggaaggagagcgggaggcagacaggcagtcatccaagtgtgcctcgccgacatgttgacgcgcctttcaacggtggcaaggccgagtggcgccaacggaaggtggtggaggtagggcactgcattgcgagtaggtcgagcttgatggcatcgttgggagatcgtcaaagtaaagtagtagcagcactacgttatcaaagaggtcgttgtctactccttccctctcaccgtctcttcgtacagatgtattagatgaggatgagaggatgaggtggagggaaagataggccttgagctgacatcacacgatgatggctgcacgtggacctcgtcgtcgtttttcattcacgtattgctagacactcgaacgtgtgcgcattagacccatccaattatatttgcaactggaaaagcacatttgagtactagaataaatggttttgggccttcttttaaacacaataactttatggtattttcatgcatcagaatatcaataaaattcctcggttaaaaagtctcgcttaacacaccccaaaattcaacaattaaggctatgttttttttatgtaagttgagaactacacatgtaaaacagagtagcggataaacgcatgattcattaagcattaaaaacttaaaatatattaatataaatttgtagagcaactttcttataatatttttttaaaaaaacacatcgtctcatagtttggggagtgtgagaagtgatacaaattggaaaaggagagaaaataacaccgagtaccagtaggctgtagtggtttattttttaaaataacgagtagtcgagtatcaatactacttcctccgtcctattataagtgcagccataattttccgtgcgtaattttaaccgtccgttttatttaaaaaaatttgaaaaaaaaatgagaacataagtcacgtataaaatattattcatgttttaacatcttataacaataaaaatactcattataaaaaataaataaaacagacgatcaaaattagacacggggaaattatagttgcatctataatgagatggagggagtggttcacttccttttcacggagcaatgagatcacctgatcggccttagccagtgtcgcgatcagaccgacgtggagacggcgaccgcggcgcccagtaaaaccgtttccggccgcccatttcttctccccccacgatcctgaccgtcggtccaatcacgccggagcccgcgcgggcagagagagcagagccaccgctttttttcccgcgccgagacagcgacgcgtcggccccgccgtatccgcctctcccgatcctcctgtccccctacccccaggtaggccccaccccgatttttcacattttggtctttttgaaaaactt

SEQ ID NO: 54684 - DNA, 1080 bp, Oryza sativa
cgccagagtggctggcgccgtcgttcaacaggacggcgccaacctctttggcgccgtccccctgccgacgtggcggggcgatgctgagatggttagggggagtgcgccagagtggctggcgccctccccccgaaattttttatttttgttttatttgtttgatattttttttcacgctttgggacacacaagaaccaaccatagaaaaattgaactcaaatggacgtaatatgtgacatgtagaatttttcctctcctctcctctctctccgaactagtgcagaggagagatgtgcaacttttttatttttattttatttttttgatatttttttcacacttaggaacccacaggaacaaaccatgtaaaaaataaactcaaacggacgaaatatgtggcatgtggaattttccaaagctctaccgaaaaacttctctcctcgaaaacacaatcttgcaagcggaatttggaggttttaatatcgccgaacccggcaaagctgaggagaattggatgtaactttttctgtagatgtccgtgcatatattatttgcctgattccgagtccgtatgagaaagttacgcctattttaatagatgacatattttgtccgtttgggtagagatttggaaaattctacgagtcacatattttgtccatttgagtttattttttatatggttggttactatattcttctaagtgtgaaaaaaatatcaaaaaaaatgaaataaaaataaaaaaattgcatctctatgtactgtttaacttatatatgttatttcatgtggttatattttgaattagattaagtaatttcatatagtggtagagtgcattatgtttaacatgctgatcaaagggttttactaaaggaattatggtctaattttagtgaaggtgcaaagtagactaaatggtatgctatctattttttcagacttagctaagtggttgttcgagtttaaattttttctgtggttggttgtatcgtgatcctgagtgtgaaaaaacattcgagaaaataaaataaaaatgacaccgttgcaactccatacagagaaacaggaatggaggc

SEQ ID NO: 54685 - DNA, 16575 bp, Oryza sativa
  unsure (1)..(16575): unsure at all n locations
cgccctccgccttgtacggtacggcccggcccgtggggcccacctcgtcgcagcggccggtgcgcggcggccctgtggcgagtcgacacgcggcggcgaggctccgcccctcctccatgtgggcaagttgggccgaccggccacttgccggtggggtgtgggcccccacgcgtgcgtggcgcgaacgtgtcgcggtcggcgcgccggcgcacacgtggcgggcgggagggggtagacggtgtacggtgtaccctcgggggaggcgcggagtggggcccacgtgtcggtgtggaggggtgggtgtggatcgggtgagaagaggtggaggggtagtacgtactacctgaaaaagggtgggggccactgtgcaagttgggtgacgcggggtgcacctgacgacgtagtagtagcaaggactgcaggaggtgggaggtggtggtcttttttctgatctcggctcggctcggctcccctctatttcaattttcaaggcacgtgtcggctacggcgatggtcggcttgagccgtgagcccgagctgcggtgtttgtcccgccgcggcctggtcggcttcggctctcggctcctcgcgaggtggcgcgcgagccgcgccacgcgtcgtcgatgggtcgacacgtgtcgcgcgccgcgtccgggggtgtttgccgttccgacgaaaccccacgccccaaaagcgaaagcgagccgaccccgaaaaggaggattttttttttccttcctctctctcttctcctcctcctcccttcccatctccgccgcggagaggcgcaggcgagggcgcgcgttccccgcaatggcggccacctagtccctcaaggaatcctcgtaagtcgcatcttcctctctctctctctctctctctctctctctctctctctctctctcgccgcggcgggcggcagcaatggcggattactcgctcggtcagttcttggctcaccaccgttggtgttcccctgtttcttggttcacgccaggcgcttcttcttcttcttctcggatgcgagagcttgctgtgattgctggctagctagcttgccggaatggagggcttctcgagggacttgctgtgcggcatcggcaagggaggagacgggccccgcggcgaggtgaggccgcgcgtggacatggaggctgaggaggtggagctcaacctcgggctgtcgctcggcggccggttcgggctggacaggagaggggagaagctcgccaggtcgtcgtcggtcgcggccatcttggcggcgccgacggagccgtcggcgccgccgtccgggctcttcaggacgagctcgctgccgaccgtggccgccgcggaggcggcgaaaaagcagggtgtggatgaattgaactgtcgccgcccgagcggcggcgcggaggcggagcccgcggcggcgaggctgccggcgagcgggagcccgtcatcgggctcgtcggacggcgaagggcgcaggcttgaaggtgcgtcatcgcttctctccatgggggcgtgtgctatctatctatctttagcttttatgatttcatacctaaccgatgttaattgcgattctttggtaatatatgctgctaattatgcaaattagacacgaattgtttgggtgaattcaaggtgaaatgcacattgggaaatgtgaaattgccctgccatatgtcatttacctgacgtcctggtggtaaataaagtttggattaagatgcttgggcgttggtctttggcaaagctaatgagatcttccatcactggtgcttcctcgttaacaccgaggactgtaatttcgatttacagcttaaattatccaacagtgaaattcgtctgttttacccctcttgaaaaaaaaaatttctgtttacaactgttgcttccatcatctaaaaatgtggttgctatcagtatatagtttttaggatcgtgctgctggcttggcaagtcagtttcaggatatctgttcttgtcaagtagccctttaagtcacatgacacgcgcaaaaagaatcttaatgggtattcttccttgttctgtaactttctaatttcacctgcagtagactttcttcagtactccttttataggaacgcctacaatctttttaacccaaagggtgaggatgggaattaagtaaatatggataactgctagaatggataactttgtagtgaactgaattcatagatcttattcaactaagcaatcagattcagcaagctttttttttttatccgtgaagattattaccacagttcagtgactagtggcaggacacgtggacgtggtgcagtgtttacagtgatgaacaaatgacgataagcactcgagattaaggaaaaatcatcttttatgtttctagattaaggaagactaattatgctttgcctttgctcaattcatagatactcttcctcacatgaaagaaacttannnnnnnnnnnnnnnnnnnnagcagaattagtttgagcctgggtagcatgcatggtagaaattgaagaagtctttcatacaactaagatctgaaatagtaattagatacagagtggttactggttaccaagtttcttctaatacatagtttctcttattacttaataatcgcactacttcaacagcagaaagaaacgtgtcctatgtgtggattcaagtgttaattggttgcatagcattttatttccaagggaggtgtgaacaccattttgttaacgtcaagaacatatttttgataatttgaaaattttaaaaatggtagttaaagtaaaatatatgaatttcaactctcaaatagaaactagctttttgggggaggcataatttttttatggtgaactaatcacacctcacttcttagtcaataatgattttgatccttgtaatgcaatctatgtatgtattcctctcattaatgacagcaagcaagagctttacatagacattgagttacgtctttggatggatgttggtaccctttgttagtggtagcctaacctaatgcggtgtttattttgaagcttccagaaataatacaagatgttctattagcatattagcaacaaaggacatcagcagatttgtttttgtgttactccgaataacaggtagcaaattcatggtggaaatgtacatggagctcgcaaacattggctaattatggagcaattcaagttgggttcagcgacggttgatgttaattacattttgtttcattatctaatatttaacaacaataatagcaggtgcaacagcacaatgtacatatgtaggtgttgaatcaaggttgatgctacctgggtagctaactaggctttagacgccaagcctcacaggcagctaatagcccgttagttgtgttgtatttttcaaattaccatataggtgtgatgatgtaagaatggagctttactcgcacattgtgcacactacattttaatgctgccatatatgatgagatgaaacaaaaataacattagaagacattcctaaattttccaattctagtgcgatttggtactagagtttgcatgttgcatgccctccccttccaacttgtcgctaacttctggttctgacattgcattagggctgtggacagtaagtaatctgaacctgcccagcatgagctcctagatgcatgtgaaattggtgagctgcaggataggcaactatctcctgcggtctgggaggattcagatattactttactactggtctggtttaagggaaaacataccatttttcctaagaaaagtgaattaggaaggattggtcgacaatagtaaagtccatagttggcgtcaatggatgtaatttcattgtcgcgcaaaagatgaagaccccttgactgtaacaacctagtggacttgcgttcaaaacagacgagttcgaaaggtcggtagagacagctcctatcaacggacaactgtgaaaaacaaaagatggtggaatgcagctattcatggaattggaccttactcttgcttatacaccaagtgaagtagtgctaggaatgtttctagaatctagaatcgtattagtaaagccttatgctcacattgcttttgaagtgtcttgttcttcccgttctaacctatcgtttagccagacatgccgatatattgttctgggcctattttgtcattgatgttgggccaattgtggtccgaactccaaacgccaaataaatttgatcggagggagtacattgcgtagctacgatattacatatttccaaaagaaaacaaaacatgcaaagggagtacgataagaatgttaccgaacaaatttagtttaacccatttctttcgggcagtttatctcatattctgaaacttacagttttctgtttaatttagaatatggcagattccggaacagtttaactaaccatgttttctctttcgtagtgaatatgacagacactctcatgagaacaagttcactccctgccggcatcgaggatgaatggaggaagcgaaaggaggctcagagtctgaagcgactcgaagtgaagaggaagagaattgagaggaggaactctctcacttccaacatttccaaagaggctgttgggcagatattagaggagatgaatgcaggagctgagaaagtagaaagttgcgatgatgttgctacaggcaataagaagacgggaggaaatgtgaaccatagcagtgatagaaaccgctgcactggacttcctccagtccaccgtgccacgtatactcaacaacgtggcagtctgtccggaataccaacaaagcatattccagctatgaaaggtaaaccgcttacgttttgtcgttttgcatttgttttgtcgttttgcattatagatacgtgaaaatattttcttgtcaatctagcttcaagcatgattgtttgatatgatattgcactattttgtagtttcatgttttgttctttatgcttgtcacaacttttgcccctccattatgttcatgtagatctctcatgtctgagggcttttagatgctcaatttatttatattgctctcatttgtgcgagtttcaagtcaaatgtcttgaatgtgaactgggcatggatggttggtgccagatactgttatgttgttagccgctgtgcgcaatgttttttttcctaaatggcagatcgactaaaataaattatgttgtaacaaatgcctaatttagtggcctggattgcatggccctgcctccggtcaaaggatggaaactacttccagacttgaaagtatggagggtccacacaaaacatgtatgacaaggatcaataggttatgttattagatgaaaatatcagcaattggtcatccttccttacttccttacttcctttcatgaggtttgcttatgtttctcattaaggcctgtttgtctgtccttccaggatctgctgatgccgaagagcacaacgttccatcggccgctactgagcaccgaaatggagcagccatagcaacaccgccattttcggcactggcggtgagggcagtagctcttgcttccaggggagagcagctgcgtgctacaggaagagttgcggcaagagccaagagcatgggagatgtggagaggatcatgatgcaggagatgccatgcgtgtgcaccaaggggctccccaatggcaagagggttgaaggcttcctgtacaagtacaggaaaggcgaggaggtgaggattgtctgtgtttgccatggcagcttcctgacccctgctgagtttgtgaagcacgccggaggtggagatgtcgcgaacccgcttcggcatatcgtcgtcaaccctatcccgccatccttatactgaacctctctgtcagctcactgctgctcttgcaagtgttactatagcttcagtcagcccttcaccttagcttcagaattcagttcagagtagaatctgattgtgagacttgtcttaatgttacaagtgtttattatgctaaggagacagcgggagatttgctcctgctgacataaaaagtggttaacatggctccattgatcattgttaaatggttcctgcagctgcttttgttcatgcaggttgtgacaaattcatcctagtgcaagttactctggcaacaaagatctcctggactcgtagtatgttcaagctactacttgcaaatttcccagccagtcagcagcatgacccatggagatgtcaaaatcctgataccgaataaccacggaaaccaccgacaaaaaccaatgaatttcagacagatctttaaaaaaaattgaaagtatgatcaacccaaatgctacaaagaatgattgtaaaacactagatacggctagtgcagacaaatgctacaaagtatgatcaacccaaaggagtgcacaacagagactaatctgtaagtgcaactgtgcaagcatctgtggaagtctggcatacatgggaacaatgtatataggaaattaacatcaaccagttactgattccaattatcaatttcacaatctgtccaggcaaccatcacatttgaagataaaacggctgtataacagcatcacattctggttgcctcaaaaacaagttaagcatgcatctacctataatacaaaaggctaatactagctagcacctaattgcagtggagaaaccataatttataaagctattacacctcaaaagctttcatggacaggcacttcaaaagcttcaccgaaacactgcatctaagctttcatggactcttcaagcttcaccgataattttgcatctagcaacctgtcagcttggctatctcctcgagcatgtacttggcttcagctgcgtggtctaccggagcttcactcctcacagtgatcctctgcctcttctcattcatgtactcattctgagttacgctgacgcggaacaggtgaggaacccaagtagcttccttcagcttgagaaggtaactgtcatcaccctcctgaaacaattgagaccaacaatcttaggcacagcttaaatagcaatcttaggcatgtagaaaactaaagcctagaatctgcacaaagttgaactgaagcctagaattcgcacaagcttgaactacagcctggaattcgcacaaagttaaactaaagcctagaatttacacgaaggtgaatcaaagttactgtgggattggcaaaattacctccttcctaatccgatcaagctcatctgcactgcagccaacaatcctctctgcctgatcattgaacagagaaagccaggcctcaccagtagggtcggagaccttgatgaccatgatgtacctgaagaaaggaaccagtgtagcattagctttggctttgtatcatctcaaattcaagcatgcacggtgtaattcagcccaaagttttacctcagtgagcactcagcatcattcttctggcacccttcacaccagtatcctgatccaattgcctcagtcaccttcttgttgcaggtcttgcaagctcggtaccacatggtttggtcaggcttgataaggctaatataggcattcagactgaagaacacaggctgcaaaacataacaagtaaatttaggacaatcacaactagaaagtgctaataaactaaacatcaagaacaattccattttctttcaaagattccaagattttaccttatcctgacccaagttggggtcacttgtgatgtgagacagaaaaactctatcactgtacatggatctcgcgccaccaacccttgatgcgcccatatctgaaccaattgatgccattgaagtacccttgccttcagagtcatacctgtttgccaaaataacgtcaaggaccaaagtagatagtttgaaagataataaaaggagtgtttgagattaggacaataccaagctctgagctgttctgcctcaggcaagtcaggattcactacaattgtacttctccccacagttgacagagacaaacctgtcgacattatagtagtaatgctgttagcacataatcgccaattcagatcctaccacatgcaggaaggtaacacaaacataccttggaagtcagatacttttaggctctttatcgcaatgataggcgcagagtctaccatgtccaagagctcctgaccagtagttgtggcaagatcattccaaagagatatggttacagttttgctcctgccatcagattaaatgtaagttatcagcacataaaacataaagagcattcacatcatcaaaagaaaggagttaacaagccaaatgatgcttacgagtcatccgctacaacgatgtcacgctttggaatcgtctcgttgtcaatcttcctcctaacactaagagtaggagatacgctctgaacaaccccaataacatctgcaagtagggtaaaactagtcagaacactacattcacaaagtaggaacaagaacacatcactgaactgaaagcactattgccttacctactagctccctgccaccaacatatggccctagctgatcaatcttgacaaagttgtactgaatctgtgggataaaagtttcgccctcagcttcctcaacaacagcattctcattcagggtcatctcgtagtcattatggacagtcttgaactgcttgttggcgactctgagagatcctttggagatgtagtacaccttccccagctcaaacatcggatagaacttcttggcagcctcgttgaacatggttgcctggatctgggtgccctgtacacagatccaacaaaattaactcatcaatcaacatacaagaattcagaattgctcatgaactgcaattacatcctacggaataaacatttcacggtaggttgcacttacatccacatcagtgagctccacattgaagacgcagccttcaccacgagcattcttgtacgtcctcaggttgcccttgcttgtgacacgcaccttgatgatccagttgccctggtaggggttcagggagatcaaaggatgaactcttctcgtcatggccaaccgcgccgcaggagcagcactgcaaacaggaaggcatcaagaatcggcaggttagtctcaccaacaattctgcatcagaaacaactgaacaagagagatggggatctcgcaagaatcgcttacttgccgcgctgctcgttcacgatctgggacgcggacttcacctcctgcttgggcttcagcacaaccggaggaagtggcggcgcgttcgtgggcttggagagaaccacggattcctccttgggactcaacagaatcgccggcttctcctcttgcttttcggcctcgcacttgatctcggaatccagcgccttgaacacgacctcgagcttcgtgataatcaagaccctgtgacgcatatgaacaaaaccagagattcagatttcagaagacaaagaaacgcgagtggtctgaagaatcagacaggtggagcgcgcggatctgtacttttcctgcttttcgccgatggtgttgcaggtgtagtcgaggacgcggatgacgccgagattctggatgttgccggagcgcacctccggagcgagctgggtgagaagcatcgtctttatcttgtccttgccatcgctcgccaagaaactgcaacgcaacagagagatcgtgaggaactcgtcgctgaggaagaacaagaacccacccagatctgggcgagtttttccgtggcgcggaatcgcaagaacgctcatcaaagaggaatcgcacacaagaaacactcacgtgaagcgggtgccgatgggcttgaggtcgacgacctggaggacgatctccggcaccggcacgccggtggccgcgtccggcgacgcgttctccaggacgaacgccaccgcccccggcgtcactgacggtgccgcgtcggaatccatccccgagccgagttgaaggcttcacgcgggaagattcagctgcggcggcggcggcgatggggaggaaatggtttggagttgaggagaatgggagtgggagaggattggatccgcgcgcctttataacgccgtggtttggcgaggcgaggcgagcgcgcgggcgggaagggggaggagatggcgtttcggtgggatttttgccgcggggtttcgcgttctcctcttcttccccgcgcgcgaacggccgcgtctggtttttctttttttggctcggtttttgagctgtggcgggagaaattttggagggttttcgcgccggtggcggaggcggagtgcgagccagagagatgggccgggccgctttatcatcacgttcgcctgaacgaggtagtgggccgagactaatacggcccaattagtgagatgggggagctgcctcctcggccaggttgggttttgaggcccataagcgtgctttccatgggggcccactattcagcgtgaaggaacgacactacggcggaatcccccctaccgccggtccgccgccgctcgccgtagcctgcctccggccggcgtcgtagttgcgtttcacggccgttatttcagtctcagatcaaattggattgataagccaagcatcccaaattctcaatgtcacaatgtacaaattggcttacggcacagcagcagtaagcaacctgagcttcggcgagatcctcacgaggccagggtggtggtggggcagttgtcgacgccgcaggcgaggatgtcgcggtagtcgcgggagacggtgaagctgtcgtgcacgctgccgtcgcggctccggacgtactcgaacagcagcgccgtgtggttgaaggccgtcagcttggcgaacccgtagtcccggtcctggacgtggctccaccgcgcccgtacgccggcgtagtccgccaggctcgccccgccgccgcccaccaccacgtgcgtcgtcgccgtgaacgcgccgctgtagtggctcgccgccttcgccacgcacacattctgaatgcacacatttcacacacagtaaaacacaagcagaaaatgagagccacagccataaattcacaagaaatacacatactttacactttagctgttctcacgttctatacttctaaaatagttgtccctgtgtgattcaaattttatctcaaaatagtaggattcaattttatttcaaaatagttatcacttcatattactccctccgtcccaaatataacaacttttagcactcagaatttgctccaaaatataataatttcttaactataattctcttcctaaccaatcacaactatccactatctacttttcccacctacctctttctgaaccaatcacaatatctttctatttaattttacctactttcttatattctgggacggagggagtaccctatcaattaccttccattcaaatatctcgttattataccctcaacaagggcggatccaggaacaaaaaaaattagggggggctcaattatgcagtttctttaacctctagccatttaaggacctttagtttatcatttatggtgaaaaaatcgaaggagtgctccgggaggtatccatgggtatagagttccccctgcacccacgttggatccgcccctccctcaactacctaaccatacaccattcaattcaaatttctctttattctatctccaatctccaactactctctcacacctaaacatacaccattcaatgacgggcactataatcttctctttaaatcataatctacactaaacaacctagaatagtaactgtatgggaacggaagagtaacagtgctcatatacctcgtagactgggcaggttctctcgtagccatggacatggccgtacatggcgatgtcgaccttgtacttctgccagagcggctggaggctctccctgcccatgggctcctcggttgtgccctcctcgacgtagaagctagctgatgagtagccgagaacacggtgggcgaggaagatgagccacggctgtttctgccggtcgacggaggagaagcagtgctcgatgaacttgtactgctcggtgcctggcctccagtcgagctcggtgttggctatgcagaaacggaacatgccgtagtctatcgagtacctgcaaggatgatctcagggtttaacaggtgcaggactgcaggttattggggccataatcttttgtagtagctttttgttcagaattttgatggaccgtactaagaaagatgagattatgcagagttggttgtgttcagtaagagagatcaatgaattttagctattagtacagcctaaaaaaacatgatagcttgttatttgttaatgttgatctgtgtatataagaaaagcatgtttacgcatgatcgtctagtgaaccagaatgtctcgataagtggtcacatgtatgagtggtacgccttaaaatatccaggtttcgtatagtatttcacaaaattcaggggaaaaaatgtcctaccagaattgctcacggttctctgctggcacgtagaacatattctgagctggtacaccgcattcaccacctgaatccaaattcccatagaaggaacctgatccaggccaatctctttcatggttgccgctgcaagcacaaaacaatatcatcagaaacattgtttgaaatttccaccttgtctttggtttgtttctgtcgtcaagtcggagtaccttccaaccatgtaaggcacactggatgcaatgggttcaacttgtgcggtaaattgatcccattgtgacagataaccattggcatagcagatgtccccaatatgtattaccatatcaatattcttcaaatctttaattagctggtaggtcgtgttcagtgaaccaggctcgaagtcattgaactcatttgaaccatcggcctcagcctgtgcaaggagttcaaatgccaattaaggccagaggagaaaagcgaatttgtagcaaataatctctcttgttttagcatgagtagcaggtacttaagtatcttattctttgttagtttgactcgagatgatagaactcataaagagtacaaccttttctaacttgcataattgtcattaccaatttactactactaactaaagataaagacacactttggtggccttctgctaattgttccctatctaatcttttttatataattgagagattttatttaaagcacaagttgtactacatctcccatattaactttgaatagctatggagttccatatcgattcagtgatcagttacctaataatttattgcacttttgggagataaacgtggaaaaacaggcacattgtaagtggtatcatattcacaccttccccatatctccaaaaatgactacacgctgcaaagagtcttcccctggataaggaggtgcttggaagctatactcatgtccccaaataatagagccatctgatagccgatgcccaattctgtatgtatacctgaaatacaaactcacttgtaagacttgttggcacttgcatttgtacaaatgaatagttacaggaccacagagggcacagatgcagacaaagcaaggttgtgtaacactcatttacttgaaattaggccacagatccttgaggaaacttgtatgtatgaaaccaggatcgcgccatccaactgtcctagcaggaggacctgtggtaaaatcatcataaagcatgacaatgttatcatcttattaggttcgtcaaaagttacatgtcaatggttatttgatctacaactgctctgccattataccattattctaagatgtgtttcttttttagttgtcacttgtcagcactaatgggggattattactctgagcaagtaaaaacataatgaaaatttactcaccgcacatagtgctgcgactgaacgtaagggtgcctgcaggagaaaggctttggatttgcccttgtaggccccatttgacaaatggtgtagcctcattggtgccatatccacttgtccaagtcactgtcatctagaatcacttaacatcagtcattattctgtaaacatggtatgatctgatttgcagaagcactttggtgcccatttgtttcataagcaacgcagacaagcaaacactatttcggaagaaaaaaatatcacttaaatggaacaatctgagatgtcttacattcctgtttttgttgctttgacattcgagctcataaacatattccattaaaaaaataggttacttgcattgaaaagtgctaaaggaccataaacgaaattttatttctgtccgcaatgatattttcctttgcagatcacaggctaggatgctcaattgagactcacttcattacttatggaatacttaacaagatgatacttacttcattccaggattttccttgcgctaggcgtgggtacacaggggcctttgggttcgtgaaggttactctctttgagtgtgcaatgagctttggctgtgaggttatataagacatggcataggcaagttagaccatataatagttcagtcacattgtattttaactagaaaagacaaaatattcaagaaataccaccatggtaactgaatcgttcaacaataagttttcacactaaataaatgaggagaattttggcacatacatttgagaggcctccagaaaacaatgcaaatgaaaaatcctccctctgattgattagctgaagcttcatggatccctttcctgtcttctcatagtcaagattcttgtagtttgcaaatataaactgccaaaaaattgtgcctccttcagcatatgttattggcaagttttctgaagtctcatctacagttcacatggaataaggctaactggatgtaacactaacctttatgggagctgtacatagaagtggtggttcaacccattggctctctgatggacaagtagaatcactggtaaattgccaaaaaggcaaaatataaataagatctcaacttctttcttgctgtcttaattaagcattcaattcaggcatccagcatcaggatgattggattgcaagtacctgaaattagcaggagagaacaccccaatccaatcatccttcgatggcttggggttgttataggtaagagtcacccattctctgtcctgtccctgcaacagataaggtagccaataatttgaatacagtgggtctatggaagttcaaaaaaaaaatcatgattgattctcctataaatcctaatgctgcaaaatgcaaatatatgcctcgaccgactaaattaaggcactattaactgggatcagaactctcgagctctggtaagtggtaatggctgactacatcgaactatataggtccgtacaagagcaaaaaacagcagcgagtgctgaattgacgagctagtagatacagtaggttgctgagaaagctgtagtacctcgaggccgaggaggagcggcgaggcgtcgacggaggcacccggctggatcgcgaaggtggtccggtggatgccgatcctcgacagcggctgctccccgcctcttcctgccgccgcgaccgcgccggcgaggctgagcgccaccagcgcgtgcagcaccgccgccgccgccgccgccatcacggcctctcgctcgctttgctccccccaaacgcagcaagagattggtacagcgaggaggaagatgattaacgcagagctggcacggaggaaagagtggcgtctaagccaaaacacaagtggctcgaagaaagaaagagaacgcaggagaaaatggcgttaatctctgcaagatttatcagattagtgatgggacgtgttgggcatgtgtaatctaatcgactaatcgttgtgttcggagctggatccgcagatgctttggtttaaccgtggaatatccttgtggcaattctggtggttatgactagggacttcagatgcaacacttgcaggctgcaagagattaattaatgcacataattgcgaagtcaaaatgggatcttatttatgtatcaacacatggttttgttgcattgatcttacaagtcaaggtcaccaaactaacaaaaccagcaacatacagcatccaagagaagctagcaaaaattggcttaagcatcatcagcactctgaatgtcgtgcagacaagtgcccttgccctgcctgatcacactagcttctacaggattatatgtcaaaagaaaaatgaccatcacgtcgacatttgaaccaccccaaaagaaaaggaactggatattgtacatagctcacactgagaacattgagcgatgaactgttagcgtaatggcattgagctgatgcatcaggtcaggcaacattctctacctgcactcaacttgcattggagtacagaacaaactaatttttcacacagcccaaaacggtttctgcccagaaatggaagttgggttccctccaagcacgctattcgtctcatcgatgttgtcctcttcatcgtcatctccataatccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54686 - DNA, 4323 bp, Oryza sativa
ttcctgcagccctgcaatgaactggacacagagctgctgttgtattttttttttgaacaattcacaaccctgttgtattatccatgtagcgttgacctgtagtttaggggttcataatgaatgcacgtgcttaggccgttcaaagcctcacatcataacactcacaagctgaaaaaaatagggggcaaaatcacacaaagctgaacaaaatgggggcaaaattgcaataaccaccaagggtatatatgtccttttctctacaactaacaccgttagttgtggctgttaggaatgggggtacatggctgcttcagattcaaaaagtgggggtaaaagtgcaaatcctaaaaagtgggggtaaaacagcaattggctttgaaagtgggggcacggatgcaattgcccctaataataatggtattacaattgtattgcaatggtgcccttttccagtgtactacagctgctcccttcgggctgataatatttgtcgttttagacaagggtggagtcaaactttagaatctttaattatggatcatttttaaaatattcatctttcaaatatggtaattgtatgcatagagtagtcttaaaaaatactttaataaaatcatatatttttttaacagttttatacatatcataatgaaaaataatggtcaaagtgttatcaacccagagagagtaattaacaatagtaagttctgcactagagatggtaaaaattacaaaaacaaaatactaatatttattgatgggggtatatatgcgcgtatgaacatgtgtgtatacatatttgataaaacgcaaggggaagcacgggaacatactatatatagtactccctccgtttcaggttgtaagatgttttgactttggttaaagtcaaactgtttcaagtttgactaagtttatagacaaatatagtaatatttatataataaatttgtgtcatcaaatcaataattgaatatattttcataataaatttgtcttgtgttgaaaatgttactatttttctataatttttgttaaatttaaagcaatttgactttgaccaaattcaaaacgtcttataacctaaaacgaatggagtatcatgataaagtggagaactttggggatttggaaagagtttttttctattatcttgaaaaatgttattacacacaattttataattcatagtatctcatataattagaaaaaggatgggtatacgcatgtgttttttagggccattgaaatatggagcaatgaatgcctagtgagatatgatatgcgatgacaaacagacaagaaagtagcgtggaactttgttgctcccttccacaaaccactaggcaggcatcgctagctgcacagtactactgtggttctatatatttcaattttcaaccagtatcactataattgtactatccagtgcaccaagttcagctacagtacaaaatgcatcaggaaatgcgcaaaacaaaattatatctagaattgaaaaaaaatacgagttaaatctatcgatatacggatcctaaaattaacataggacttgtttagttccaaactttttcttcaaacttccaacttttccatcacatcaaaactttactacacacaaacttttaatttttccatcacatcgttccaatttcaacctaactttcaattttagtgtgaactaaacacaccatagtggagtactttgcaaaacagacctaaggatgcaacctagtagaaaatagcaccatcggtctcttttatttcaggtacatttgggcctcgaggagtatttgggtgcagctggaaatgggctagatggggcacaacaattgctccgtggatcaattggaaattaattaaatttcaaatggtggaataaaaatttcaaaataataatattattaattaaagtaaaaccaaactagagatgcaattgataatgcagtggtaagttggcatgtggtttcaaccctgagctctcgtgttcaattctcaacacgttcgcaatttcttctttaaaatgtttggagccttggagggatagatctccctccaaatctctctttttttttaagaaacaaaaacaaatcaacagtgatctgggtaacctttcagttttgttctcaatcatgttgttgtcgatctcaaacttccatactccagtacgtagaatcgtagaatatatatcttttttggctcaccataacgttttgttctttgcactacgagaggcatcaggatattcccccaaccaattcaaacagtgtattgtgcagaagatactacgtatcagattgcgtacctttgtatggtcctccttgatgtgtccaaaaccatatgctacgtatcagatttctgtgagaactttccagttcagctaattgggagaagaatattaaatcagagtcaatcaagacaaccagaccatcagcaaatgatgcaaataaaagataaaaagatcaacctgcatctcttcataaaaggggtgttttttttgttttgttttttttttgtgtgcaaaggctactgttctcgatgcctcctctccacgttgaccctcctcaatataaagtgaataagcatctggacgcttttctgaagccccaccttaatatccaacttaattttaaccgaggcatccacctctatgatctttaattttgaaccaccagattgttacttttgttctttgtctggacctcccactggataaggtattgaaaaggaaagtagtcatagaattgaccaaattttaaaatgctttcaataggttcgacagaaataactgacaaaacataaaataagaaatgtggccttattctgccatgacagagaccaacatatgcttatttttcaaagaaatatgaaaaacagtttgcctgtctccagaatccacatttccattattcattagtgtccgaccattaactccataaacatggagtatttccaagttattgaacgtgaaacaaaaggaacgaagaatatactcccttctgattcaagtgaaagttttaataagaactcaggaatgtccagaaaattaccagacaatttgtatcctttttcgtcgttcaaaaaatttgtatccttgagctggctggcacctttcatgtcttcagcatcagctaattgtgcatttgagctccttctcatcttggctgcctgcacaaatttgtgtaactggtacaatatatgtgagaatgaatatacaggtagaaccatagatgtagcatagttgttgcagtgacctaagtcgtagcactccaaaaacctgagttcaaatctctataggagcaattttcagattatattatttgagaggtaagttccatattaataggctaagttactaatttaaaaatatgccatatatccaacagtaaaaaatactcttctctaaggaaaaaagttagaaccgtagaaaaccaagaattagttgtacctgctgtacaataatttctctgcgccaacatgtctaaatcaacttttggaaattgctcggtaaattcagtctgttgaggaaaggaaaatgatttcaattttcatgtaatttgtgcagattttgcacagtatactatgttgacatatagcacactgcagattagtaactcacacgttcgtgtgcaaactacaactcaatgatctactacccacttgattttgtaaatgccaaaatttcgtaattatggaagatataattgtcaaacacttgcaaaactgaagaaatagattcacttcatgcacacagattgactaaccaaacaccccaatgcaacgaaatgcaaacacaaatcaccacggacgaggaaaaaaattttgagagcatcacacgaatttatatatagtataacaataatgcaatctggatatgctacctcaggtcatcagttcgtattgaaccactccatcccaacccatccgaattgaatggatattgggatgggttcatcgctagatttgaatgaattcggacgatgaaatgatgctccccagttgctggacattattcacgcagggcagcacgccggtttgagtatggcgtcggcccgggaccagcagcgtaggcgccagtggcggcgacgccgtggagacgcctaggtttcgtactacgcctcgagatccattgaacgctctgggctctggggcgccgcggttggaatctcgaaggaatatgttcagtttttgtcccttatctcgacgtcgagtttaaatcacgtcattgaactataacgtgtttaaacttataataccggagtatttgaaatctcaaaacaatattttgtccgatttcaattgacgtggtatgtttactatggt

SEQ ID NO: 54687 - DNA, 907 bp, Oryza sativa
tggagagaatggactcctcgagctcggcgatggtgtgcgtgagcctctcgatgtccagcacctgctgcctgttgctcttctccagcagcttgttctcctcctgcagtcacaaagaccaaaaaatcaaaaatcagttcaggctgacgaaaattaatctagctgatgtgtcagtgatggatttgcatgtgtgctagctcacatggtagatctccatctgtttcttgagctcgatgttctggttctggacgtcctcgacgatcagcgccctctcgagcgcgctacgcaggatgttccctgcctccaccagcgccgcctccttcagcttcaggtgccgctccaacgccttcttgtcatcctggagcaatgcaatctgacagccgagacgagcagccacaatgtcatcatacagaactgaagttaaactgaattgtcctggtaactgatcgtcaggcagctgctttagtgcagtttcaggtgttacctcgtgcctgtatgctttgatgtcagactccaggggcgcgatgatggcgtcgaacgggacgacctcctcgtccttctgcgacgagtggatccgcctgagcgtcgcctcggcggcgaattgcgcagacagcgcttctttcctctcgttgcttagcctcttcacgtccaggttctgttgcaccgagagaaaagctcgttagtatcgtagaaccgtagaattggtcacctccctccgtataatattatgaattgttcctaatcaaacctatttaaatttgatcgagtttacagaaaaacttagcaatatctacaacagtaaattagtttttattaaaactaacatctaatatattttaataataagcttgttttgtgccggaaatgttgctatatttttctataaatttgattaaaacttaaaaagttt

SEQ ID NO: 54688 - DNA, 1129 bp, Oryza sativa
atagcgaatttgctagggacaatgggtccaataactttgaataccctagaacagactgacttcggtatctctttaaccaccttgtgtttgatgactgcttctatcatcattatgaagtacacctctttgaatcaatatgcggaaaaatagctgataagttccatgggctgccgttggcagccaagacagttgcaccactattaagggccaatagaaatatggaatattgggaaaatgtcctgggaagtgattggtggaatatttctgatcatggtttgggaataaacgttctgccagccctaggaattggctgcctatatccagcgctaaggcagtgtcttctgttctgctcaatatttccaaggaattatgtctttgaaaaggaaagagtggtccagatgtgggtggcacatgggttcattcagtctagtgatagaagggatatcgttccagagaatgttgctaaaaattggtttgatgaactagttgataggtccttcttgcaaccaacagtctggcaaggccgttacgtcatgcatgatttgataagagagttctcagttgctgtttcttccaatgaatattatgtctttcacaggaattccaaggttcttccacaatttgctaatcatatttctgttgataatgataatttcgatcttcaatggggtcattatgatcataaaagattacaaactctgatgttttttggtcatcacagggttgacaaaaattatggcactcttggtagcatagtgagaaagtcaactagtctacgtgtactggatttgtcttacatttgcatgagtaatgtcagtcaggcttcagatgttctctgcaagttgtcacatcttcgatatcttgatctctcttttactggtatcaaagatctcccggaggcatttggtaatctataccatctccaggtacttgatctgcggggttgtataattgagaagctgccaaagaacatgaacaatttgatcaatctaaggcatttatatgctgattcacaaaccaccgcactgatctatgctgtaggccagctgacaaaacttcaggagttacaggaattcagagttaggttggaggatggttacaagataaatgagttaagggacatgaaaga

SEQ ID NO: 54689 - DNA, 1486 bp, Oryza sativa
ccctgtctaggaggttctgaagtactggagcaacaatgtcagaaaacagatggggatgaatggcagaaaatttctcatgtgccatacgttcggataaatggcagaactatccagatgatttcacatgatcttggaagttagcaacacatgtataacaagttactctaggttaagttatgtgtaggcattttgtgggatatcattgttggtacttcatcggtaggaattaggagtttctgaaaacttcaaaggtatggtttcaaaaaaccaaattcacattaactgctccggcttctgtcacatatctggatatacaagccactagattgtcagcgatctgctcaaagagggaaatgaaccaatcaaaaactgggaagtagccattttttaaaaaaaatggagagtgctctgattattttctgatgttttcacgtttcaacagaagccaatttttcatcgttttccagtgcagactaaggtgatctttctccatggctattacatttttattatgttctatgatatataaatccaatttttggtaaacagctgaattttgtctcgtgatgacagattggtattcggagcgatgcagaattgcagataccatcagacgcactatgactgtatactaatatactgtactactgaattcgcacatcacactgagcgttgtgtgttgtctggtagattgctagtctctggtatgagatgcacactacatatatagttacgagttatgacttcatattcattctcctatcgaatagtaaaagagcttttaaatgattatactctatactgttgcagcttgcacctgcgcagttctgcgttgcacctcttcagaaatgataaccaccgaggtttcaaaataaatgttcaaacgaatgatatgtttcattcgctgtacttgtgcttgcaaagggcaacgcaaaatttgtctaagagcaagtttaatagtcatacaatagttggctataaaaatatactataccattaatgctcgatctcacatcgcatacactcataatgtcttggagtccgtgttgcagccgactataaatctgtagcccgctttcttctctctcttctctttttttctcgatatgtggttatagctggcttatagcttgctattgtacctgctctaatgagttggtttggtttgtggtctaaataggccttaccaaattttgtcaatgccaatttttggtaagttttgacatgactaattttggtaaggcaaagttgtatttggattgaagccaaaatagcctaagttcactattgaaatggcatattttcttaggcatgccaaaatttggcttcaaaccaaataaacactaaacactattgaaattgtcaaatattggtaagcctaatttagacctcaaaccaaacagcccaataccacaatcgagcatatgtggatctatttgaacgaaactcttatgtcttgccacactcacatgtccacacgaagtaa

SEQ ID NO: 54690 - DNA, 11710 bp, Oryza sativa
cagacatcaaacatgaggctgaatttggtggcaagaggaatggatataatgacagctcccagggcagcaccaaaaatacggtgtgagattgagaacgtagcactcagctgcggcttcttcaaagggagatggggtgacagtgggcggtttgcaacaggagccgacaggggacgacttgtgtgcaggagtcggtttccagatgggaacatctttggtctcagagctcctaggggtgaagatgtgtagctcctagcttgtccagaacttgaggattgtctcagatgatctatgttgttgaaggatgagtttgagctaccaagggcacctgaaaacgatgaaaaaaggtgagggcatttatttagttgtttgaagcagttgcaaaacatgtacatcaaattatacaatatacactagcgtccagttcaataaaaaattagagactaacctaaaaacagtgaaaaccatgtctcgtgtaaaccaatgacgacttccattttcttaaaaaaaaacaataacttactctagtgtggttgcaagaaatttgtgtcctacgtcagctacaagtcaattactgcattgcataatgtacttggctaccgcattatgaacaatagggtggctgcccatattattgattgatatatcaaaggcaaaccagaaggcaaggcatatagacatattcatgcaagagtcatttaccgcggagagcaaatggagcatcactgaggggtgcaaaccgggccttgctctggtacttctccattcctgaacaaacaagcagtaatgaatcgtcttaatcaacacaaaatcacggtttagtaaaaggaatctatttatcctttctgttttgcaaaactgagtttgaggaagagcattaatgctggagacctgccaatcagttgaacctactgaacttcatacctagatcaaatgatgcattttcgcaacatttgtactacagtaaaactcggtgcttaacagaaggctttgaattgtgttacaaaaaaagaaaatagtataacaaattaaattgtgggagcagataaccagatcgatctcactgcaaccatgtgcaattggcacacccaacattaaaacctcccattcttccagggcatctgctaatccatgaagctcccacccgtccgagtaaggattcgggggtagggttggagggagggtttggtttctgacgagccagttggcgaggctagggtttgggaaaggtggtcgcctagtagtagtagcaaattagggtggagcacgaggaggaggaggagacggcggcgggacataagggcgctgccggccggccggctggccggccgtggtggaagcgggggtggccgtagcaccggtgatggcgcgggcgggaggcgggcttggggtggcgcatggaggcgtgcggatctgggggcgctgatgaagattcggggggcggggaagggatcggatagaacgatcggcgaggaggaagaagaagggggcggtagagcttaccgggcaggacggtggcggcggagatcgctggaggtgggggtggggggagtcgaggcgatgtgtttggtggccgcgcgaaccagctgggagagagagagagaggtgtcgtgagtttcggattgttcactttgttactgaaattttgatttttttttttactgcctctattccataatagttgtatttctaagggtgtgtttgatttaccgtcaaaactggatgggatatgacggtacatattttgttgaatgtagtgatccaattttttgtttagttgggtgaatatggtgatacattcttttttttttagagatgaaggtggatttggtgatccaattttttatttagttggaaagagtagggtggatgagcaggtgtggtcacctctcacttagagaaggtgagtatacccccatcaaattcatatatacaacaaatcacaaatttaaatatatatactactacaaatcacaaattcccaacaaatcacaaattcatatatatatatatatatatacactactacaaatccacatagagaaaaaaaagaaaaataacaaagaaaaaaaaggcgggaagaagggccctgagctcgccgccgccgccctcgcatcctgccgccgccaccgccgtctccgggctcaccgtcgcctctcttcccgctcgccgtcgccccctcttccacgtcggccgccaagctcgccttccgccgccgccgagctcacatcccgcgtctacgccgagctcgccgccactgccctcgcatcctgccaccgtcgcccctcttcccgctcgtcgttgccccatcttccacgtcgcccgccaagttcgccttccgccgccgccgagctcacatccctcgtctacgccgccctcgcatcctgccgccgtcacctctcttcccgctcgccgtcgccccctcttctgcgtcagccgccgagctcgcctcccgcgctggtcgccgccctcgccgctcgcaccagccgctgcctcgctcgcgtcaccatcattctcgctagcgaagaggggtgacgcgacccgcctcgcccagctcgcctagcgcttgggaggctgcatccgggcaaatcaccctgatcccttcatccggcatttgaggggaatattcccctctgggccgcccaatcccacattcgccctccaaccaaacagccataaaaaatgggccgccatgttctatccacccaaaaccctccatccaaccacccaaaaccctccatccaaacacaccctaagatttaaaattcgtcccaatatacttgtcactacaaagtactagttgttacatccatttctttatattcaaatttctttcatttctacccctaaactactagtccactcctaaccatataccatttaatgtggggggtattatagtctttttttttctcaaaccttagtccatgctaaactatctaggatgacaagtattttgggacggagggaatattatcaaattttaacatattttgatattatcaacttttgatagtgttagttttgtttgttttcatatctttatcaaattttggtagagttttaagagagagagcttctaaaactaccaaaatttgatgaggtggcaatggtaaaagtgtgtttagtttgttgccttaccaaaatttgataaggttgaaaccggtacttgtgttcgtgttcgactttttcatgggttcggtcacgactcatgagttgaaatttgggttgaatgtagaaatttgtattactgtacatatcttaaaatttactcaaatttaaatacacatataaagacatttttacatgttgtgagcatgacagaaccaaaacttttaagcactgattattttctttgaagtagaaaagtattggaagtttagaggtggacgttagtggtaagattaacactgaaatttgatttttattccatttccttgttgtttcttgacaagtaatctgtataagagatccatccctccttaaaaactccctccaaccgaatgcactctaaaagaaatatgccgagatctaatttatgccatgtttgacacagatgcagattctagattcacattggatttgaagtgaagcttgtatgtcaaattatagtggttcaaaattttatacttaaaatagaaataaaatgattcattctaatgttaccaacgaaatcagaaaatcaaatccataaatttgtggagctaggaataccaatcttcaagaaatcttatatctgtagcagtgccaaataagaccttagtatgcgttgctcttgctatattgatttcataaatctttatgacagctaaaatatcaaatcctttagtagtatttaaaagtttaataataaatatttgccatttaactaaatcttctaaaacgtcattgtttggcaataaaacaatatctacgatgtaaactttaccaatttagaacacaagctttacccattttcgatcaatgttattgaaaaaaatcacatcaaacactgtgacaaatatcagcggaaaaaaacattgtgtcaaataaaaaaaggaaataaaatactcgaataatcaaacttgggtacatatacatattaagcttattctaatgaccaagacatacattctaatgatgttttaaaatcaagaaataaagggattggataatcaaaatattaagcttactcgaactacgtagaattaatatttttatataaaccctttcaataccctttcgaccaaggaagaatatgaagatctcatatgaggtagtctctactttacatttgacaaatatgatttcatcctactaaagttaactagtgttggacttaatttttttttattagagtctaggtgaaactcactatgttgattttgtataaactaggtggttcatcatgggatcataactgcaaacgttcactagactctaaagtgacaaacaccttattcctttacctttttttcaccaggaaccacacattagatccacttatcgtttcacctcacgtcgcagactacaggcgagcgcgttctctagcatcgttgggtagcggaaagatcccctgcccctccagcaaaacgacgtgccgacgggcatctcttctgctctactccatgttcttcctctttggcaagaagatagtaaggctccgcgcacccccttcgttcgctccccattcttcatctccagcaataagacagtgatggcaccactctccttacttatctcttatctttacaagggcggtgacgaggtgccatcccaccttcctcagatctgacgcatagcaccctttcttcttcgcgcatgttgtatgaattgccaaagttcttaaattttttttatttcgaagatgacctttcgaaaatgagttgaatgtgtaaagtattaggtatgaaatatcgagttgaaacttctaaaatcgggtttctaagtttaagggtttgaataggaagctttcaagttttcacatgaatatttcaaaatctgaccagatgatttgtaatccgagttgaaagtttgaattatagagttggaagttctatatatccgagtttaaagctttaatcatccggttgagaattttagtgaaagttttaatcattgggtttgaaatgatatcaatctgaacaagctctaagaaaaagaatattgaccaatcagtagacgtatcttatttatgtctctatatatcatagctatcgtgaataagttttataggaacccaattattaaactttaatctcaaagtgttaagtacgatactaccactccaggaaaataagcccgagaaaactccaggaaaatagtacaacctcgtgcgctgacacagtgcaccccttctagaaaaccctcgccaaattttcgtgcagcagacgccgtagaccccacaccctcccggactgttggtagtggatctcggaaggcaaaaccccgaccaaaacacccaaaaaagaaaaaacaaaaaaaaaacacaaaatgaaattccaccgagaccagaccaaaccaaaccaaaccgaactccacaacacaacgcctctccccctccgccctcctcctccgcttccttcccttccttccttccttccttccgcctcgcgtctcctcgtcctcacctcacctcgcctcgtcttcctcctcgcatcgccctagccctaggccacctcgccatttgatgcgggggcgcccgccatggcgtcgtgggggctgggctggaagcggagctccgagatcttccacctcaccctcgactacggggacctcgcggatggacctcctcaccatcaccagcagcagccgccgccgccgcagcagccgggctcccctcccacgccatccagcgcgggctccacgccgacgtcgtcgtcgtcttcgccgacggcgaggaggagcggcggcagcggcgagttcgggttccggatcgagctcgactggtcggcgggcgacgacgaggaccaggtcgcgctgcggctccagtcccagctcatggtcgcgctccccccgccgcacgacgccgtctgcgtcgatctgtccccgagaggggagggcgacggcggcgaggagggtgcggtggcggtggagatgcgggtggtcaggaggcgggaggcgctgcggtcggtgcgcgtggcgcgggccgcggggtccgcggccgggagcggcgacggcgccggggtgctctcgcggctcatcagatccaacctcgcgcccgcgccggccgtcgacggtgccgctgccacgggcgtccccgtgctcgccgaccactggcgctccgtcgccgtgctcagcctctgcaactgcggcttgctggtgagtccatttctctatctcttccccctccccctgatccgtgcgaaaacattccatcccgtacggcctattgttttaacacatgcctgatcaatgtagaattatgttaccgccgtgattgctcgatgctgtagtgatctaggaggtggcattgtagtgttgtcgtcttttgtgggagaatttgattggatgtgtataaaggaggcttgggcatatgttttggttgcttcacatacctttacttttagctatagagattctgattatcaggtttgaccacacattgtgcatgctacgaccactgaagatttcttagaaatgcttgttctgtggctctgtccaaatgttgttctcttgtcagacagacctcctgggtggcctattttcatgaaattgtgtttggttttgtggagttcgtttgatttcttgatttgtactgatctgtataatacgtcctggtttagtcgtgcaaagatggatatgcttgaattatgcagcaatcacctaataattgtgttttttttttgtttgtttgtcccctaaatctgttgccatgaaaacttagggatggacatgtagatgctataatgatctaaccatgaaatgctatgcaaaacttggcagatgcttcctgttgaattaactcgccttgcacttcttgagaagctacatcttgacaacaacaaattgtcagttttgccacctgaagttggtgatttgaagaaattgatagtgctgacagtcgacaacaacatgctagtttctgtacctggttagtgatcatgcctgcatctaaattaaaaacttaaaaaaattatgtttcacagcgtatttaagacttgaagacttgtggtctttcaagtttatgttatatcaactgcccatcagcccatgcaccaatctaatatcttatttccctttgaccaagcagcagaactgcgacagtgtgttttgctggaggaattatcgttggagaataataagcttgtccgcccattactggatttcaggttattcaattgtcttacagaggcatttttttattgacggtttcttcctgttggtgctattaagctaattattcattctttgttccgaacaggtcaatgcctaagttgcgtgtattgcgcttgtttggaaatcctctagagtttctcccagaaattttgccactgcataaccttaggcatctcacacttgcaaatattagaattgaagcactggaaagtcttagatctgtcactgtacaaattgaggttggtaaactatcctgcattgttattctgttagctaggttgtttcactactagcaatccttttgataagtgtgtattttggttttaattccagactgaaaataattcctacttcgttgcggccaggcacaaacttagtgccttcttttcacttgtttttcggttctcttcctgtcaccaccctttgctagcctctgctttggccaaaataatggaagatcgtagcaaccaagttgcaattagcaaagaagaaaatgctgtcaggcagcttataagcatgataagcagtgataatcgtcatgtggtacatattcaatctccctaattcattgtgctcaaagttctgtggaaacaaaatgctcatttcaagcacaacacagttccttcttttaatttagaagttacttttgcaggttgagcaagcatgccttgctctttcatcactgggatcagatatttcatcagctatgctacttattaagtgtgatatcatgaagcctattgaagctgtactgaaatcatttaatgaagaagaattagaatcagtattgcaagttgtagtcaccttaacttttgtttctgatcatgttgctcaaaaaatgttgacgaaagacgttctgaagtcactgaaaacactttgtgcacacaagaactctgaggcaagatgatctggatttagactctggttgatgtgttgtttcgatacccaccggtgagctcacttgtatctgttcccattttctaggtgcaacgtctatctctatttgcagttggcaatttggctttctgcttggagactcgtcgcaccctcatgcactctgaaagtttgcgcgaccttttaattcgcttaactctttcacaagagaagcgtgtcagcaaggcagctgcacgtgctttggcaattctaggtatgcttgttttggtactgaatcttaatttatgtgatccattttcctgaatattcaataactatatgtgttgattagtttgtgaatatctcttcaatccttttaggtgagaacgagaacttgcgtcgagcaataagaggaagaccagttgcaaagaagggtctgcgcattctatcaatggatggtggtggcatgaaaggccttgcgactgtccaaattcttaaacagatagagcaagggactgggaaacgcatacatgaaatgtttgacctcatatgtggtacatcgacaggtggcatgcttgcgatggctcttggagtcaagcagatgactctggatcaatgtgaagaaatatacacaaaacttggtgagtgtcttttggctcttactttccacatttttcttattgtgttgccaagtgaactgttggtttctccaggcaaacttgtctttgctgaacctgcccccaaggatgaagctgcaacgtggaaggagaagattgatcagctttttaaaagttcatcacagagttttagggtggttgtacatggatcaaaggtaaataacataataacttgttattgatgtggtctttcatgtgacacaatgtagttagtgaccaaagtcttaattacagcacagtgcagatcaatttgagaggttactaaaggaaatgtgtgctgatgaagatggtgacctccttatagagtctgctgtaaaaggcattccgaaggtttttgctgtatctactttagtcagtgtcatgcctgcccaaccatatatattccgaaattaccaggtttgttttcttaccatatatacagtctgtgcatgaccatgtcaatgcttgtgcttattagtcaggaaactgaagaagagtgcagattcacaagtttttttttctcttcttgaatattgggccatctgttaacctcataacatgttccagtacccacctggcactgtggaagtatcatcagtcatgacagaaagcccatcaattggctcagctggaacgcccgtttctggtgccccggtcggtattaaaccaattaacacggttggaactgctgtttctggtgcaccggttggtattaaacgtggtgctttcatgggtagctgcaagcatcgcatatgggaagccataagagcatcttctgcagctccatattatctggatgatttctctgatggtagatattcctaaacttagttgtggatattgttttgtgcaagaacagtaggcctctatttgtttgagtcctcaagatttgttatccaccgcagttcttatagccctttttttttcttcctttctcttcagacgtaaatcgttggcaggatggagctattgtagccaacaatcccacaatctttgcgataagagaggcacaacttttgtggcctgatacgagaatagattgtctagtttcaatagggtgtggttcagttccaactaaggtaatatacatcatagttgtcgactcttttgttaacactattattcattacaactattaagtatcagtggcagagacagaaatgcaaaaaaaaaaatggttgaatcgggccaatagtgttagttttttttctcaaaatttgctaaatctacaataaatttagtgtaaaatttggagccatggggggagtccaggcctctgcttgcctcctcctgtctccgcccctgttaagtgttgggcagccttccaagcaatgggcaatccatgtgctggaaaaccaattatttactgaattcctcacattttaaagaaatattgttttcccaattttgtaatacgttgaacacatgtacaatatgtcggtatattggaactgaaactttcataggttcaatatcgttccaggatagtaaattttagaggctaaaattttagtcaatttcatatattaaagtttttttttgttttgcaagtgacataatatgggaatgggatctattaattcgatacactacatataatctgtagcttatattagcctcatctgttggaaaccacaagtcaaggcatacattactagaagaaacacctgactgatccaagatgaataatttttgtttttagtttgaaaagttaacttctatggtacattaagtttacacttccagtgatctcgttgtgagctatacatctatcacattgcttatatatataaatttattccatgtgttatgcatctagagtcggagaggtgggtggcgctacttggacacagggcaagttttaatagaaagttcatgctctgtagagagagttgaagaaactttggatacactgataccaatgctcccagaaatgcagtatttccgctttaatccaggtaatttgagttccaaggaaatccacagaacaggaactcgatcatagtgtactgtttaatgagttctagtacatatttaccaatgcactttgatattgaaagaatgggaatcttgttactgtggcagttgatgagcggtgtggtatggaactagatgagactgatcctgctgtctggcttaagttggaagctgcaactgatgagtacattcagaaaaactttcaagatttcaagaatgtttgtgagcttttagttccaagataccaagaggaagaaaagtcatctgaaactaccaaatcaatgttgttttcaagattcaagccatcaaattcaggtttgtcttctccaggtttgcactttgtgtaatgattcgaaggaacatttggttgattcatttttcaatcctctaattcaggttttagtgaaagtaatcctaccttaggatggaggcgtgtggttttacttgtagaggcttcatatagtcctgattttgggaagaaagtaaatcatgcccgctcgcttgaaacattctgctcccagaatggtatcaggcttactctaatgaacagtgcttctgggtttggaaaggcagctaccacacttccgactccaattacttctcccttatttactggcagttttccatctagtccacttctatatagtccagagggcacccaaagaattggccgaattgacctggttccgccgcttagcctggatggcaacccaactgcaaagtcctcgccgccaacgtcacctcttaagtcatggcagccatctgtacatgttcaatcactatatgataagttgcaaaatatgcctcaaggtggtgtgatacatatggcacttcaaaacgattcaactggctcaatattgaggtattttttatcacgatttcttttactg

SEQ ID NO: 54691 - DNA, 1766 bp, Oryza sativa
  unsure (1)..(1766): unsure at all n locations
ttgcagacaggtttctccagtgtgtgaaaactagcttgtcagccatgttgcatggatgtaagagaaagggtgcatattccttgtcaaagatttcatgtttgtctgagttgttgcagagtggccgtcgtttgaaattggtgggattcaccaccgctatatagggcgccaaacacaagtaggaactgttttccttctttatgtttccaagacaaatcattatgcatataataatctatcttgtcgcaggtaatggaagataatcaagaaattggtgcctatatgttcaggaggacagtgcctgctgctcatatgacacctgaagatgttcgatggatggtatatgccagcctggatagctagcacttccactgaaatgctcttcaaattctattcttatgtagtgtgttaattgtgcttagaaaggacatgtgacaaaatattcatgcaagtgacatctgatgaaattggatgctaatttccaactaaattctggtatagtacattactggtagttgattcctccagtcaactataaatttaagatcaaaccttcatatttttctcatggtgcagccatcaaaatgatatcatagaaaagagcatatttggtcaatgatcaatctggccagctattgaccaaaccaaaatctggccaatgatcaatgcctcacattactgaaaaaatttagtcaggaaccaaatgtcagacatactctaattgctgccaatgctgtagtaaagatgtgttatttacatctagtgatgctgaaatcgttagcatgcctttttctatttgcaatgtatctagagtttagggcactatctaatgttgattcattacatacatgtttcccaggttggagcatggagggagaggatcattgtatgcagtggtaagtatggccttgctcacggcctggtcaaagcattcatggattctggtgccaaagcagtcatctcgtcggccatggagcctccagattcccagtctatagtataccatgggatggaagtaaatggcagccttgagaacgggaagtttgtcattgccgatgatgaggcttccgagtctgaggcggaacctgttagccctacgagtgactgggaagacagcgacatggagaaaaatggcgatcgcagcaaagatttcgatgatgaggagtacatggctcagttcatctgcctcctgtatgacaagctgttccgcgagggcgtgacggtggacacggcgctccagcaagcgctccggtcacatccaaagttgaagtacaactgccatttacccaatgttttgtaggtaggagtacattcacagtccttatagaaatatataccaagatgaatatagaagaagaaaagaataatatgatctggcggattcatgagggggtttatagagtttatactcgtaatttcgttgttgaggctgtggtcgcagactgtttgtttcccccaagtgaatctttcggcgaaatgctgtttgtaattctaggctagtacatagaacatgtactgacggcaacatggacatagcagttaatctgagacaataaaggatgaagttttgcttgctgttgcagtaatgctttgcttgaagttcatgctattgcttgctgttaggatttggcatcttaacatgttattatgtgaacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54692 - DNA, 8647 bp, Oryza sativa
  unsure (1)..(8647): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtggggttttgaggcaaatgcacggatggacccggtggcgatatcgcacgaatgcacgaacgatatatgtgtgtgtaccacttggccctgctagtgggcagtggccgtcgtcatcgacgactttgaaacaaagttggaagtcgtactcgtacgtacgtaccccctttctctgcatattgctatcgtatttataagagagaatctattatatgccactaactttgtcacacgtctatgatttgccactgactttttcacgttctataatatgccatcgacttttgcttaacttataagatttaccatcaccgtccggttagcatctgttagcactgtacaattttgtccaaatgaccaaaatacccctaggacaaaaacttccaaaatttagataaaattatcaaaataacatattataaacataagattgtaaacatccaaaatttagccaaaaacttaaaatatgatattttcgaatttttatccaaattttgaaaggttttgtcccaggggtattttggtcatttcgacaaatttgtacagtactaacggagactaaccggacggcgatggtaaatcgtagaagttaaacaaaagtcgatagcatattgtagaacgtgacaaagtcagtggcaaatcgtagacatgtgacaaagccagtggcatgtaatagattctttctatttataagatgtgccatcgatgtttatattatatattcatcaatcgactaaagaagggacggcctttgtgatcttggtcttgaatgttaatttcatccattcattctagtcaagacttatgagcagaggcgggacctagcctattttgtgttgcgctggatttactatgataaagaggtacggtgtccaagctcatggacttattagagccctagtccttattcaaatgcaagtactccagtattgttcattctaaaaaaaaaatgcaagtaactacattcggaagcaacaaattgagaggaaatttgtcttgtttttcctcctacttttgttgaacggttaaacggtgttctttttcaaaatttgttataaaacagttgctttaacaaaatcatattaatatattttgaaatttaaaagaaataatgcttaattaattatcatgtgctaatgacttatctcgttttacatgtcttttcaatcttctcctaacccatagtgtcgaaacaatatttcagcaatataaaggggtagcgcacgagacttaaaagtggatggatgcggagacaaaggatttagacaggttcaggccctctcaatgagaggtgataccctactcctgtttggggatttaaatctgccgggtgtattatagatctgacgatctagttgtgtctcatgcctctagagggtctcctgcccaccttatataggatgggggggacatgattacaagatagaaatcttaaccaatacggtatcggttttctaaatctactctacaatattatcaaaccaggactttaggccattccataatatagaaggaaacgtaatacctaagtcattatccgttacatattctataaatataagttagagaaaattcgatccatagcacaggaaaaaaagcggtaccaaaaaatagcacaaaaaatttccactttcgatccatagcataggccaccgatttttcttcgccctatagtacttccgtcacattttgaagtaacggtgttagatcggagtggagaaaatttttgtcggacacatttgcccttcgttccccacgttccccaccaggtctcctcttccgccccctcgtggatggcggcgtggcggccatcggcgtgcctggcgaccgccgaccgcctcgtctccccgccaccgtcgagcgagctacacacgctcttcaacgacgtgggtgcgtggctcgccgtcgccgccgacggcgaggtggaccccgtctggcactcggcgttgctgatagagggcgagcctcccgcgccggcggcagcttgacgacgaggacaacgacgatgacgtgggcggccctagcttcggcgtggatggatgtggcccgtggtggccgtactcggtgccgcagaacagcatctcccttgccacgacgccacgccgcgctggcttgccgctgcttgcacgtgacaacgacaacaacaacggggacgccggcgatgacgacaacggcgacagggacgatgacctgccgcttatgcaggcgggctgcggcgcgcgctggcggatgttgggatgattcgcgagcgggcgggcggcgggctttgtcagctccatgacctcgggcggtgccgccgccgccgagtaggcggccatgagctggcgggccagaagcgcggcgtctccacctcctcctccaccgccttcctccccatgcggatctggccggtgctccaccccacgcgcacaaatccagtggtggtgcgacggatctggcgcgggcaacggtgggaagcgtggtgacgagcgccgatcggaagcggctgagcgagcgggcgggcgggaagcgcggctccgtcagctcaccgagcgtcggcgacacgggcgcggcaacgtcgccgagtgagaagagcgctagcggagggaagaggggcaaatgagtttttttttcatgtcaactcacatgtttggatggcaaatgtgacggaagtggtatgaatcgcaagaaaatttgtgccctatgcttttagtcgaagtagaaaatttgttctgctatattttggtaccgggttttttcctgtgctatagatcgaattttctctataagttataccatataaccagtcggataactatgccgtgtgggtatagggtacccataatctccacacatagtttcaaatacacccttagaaaaagagctaatatactagctacgaacgaacaaataaacaattaacccagatttcagattgtctaccacgggacagtagtaccgcctccctgcatgtcgttcctcccccttctcacggacacgggcaaggacggtttgtaataaaaacacccgtgtcgtcccagctaattccctttcctcctcgagagcgaaccggtaaacggaagcgtctccgctgggacgacgagacgacacacgcgaattctccatgccgtctcgaggccatgttgtttcgccttttccctaataaacccaaaacggtttattagagaataaaaattaaatttacaggtaaaacttttaaatacgtgctttttttacttaaaaaccaacgaaaaaagctaggttgaaaatatctcaaaatgaatcttataattaagtttgtaatttttaattttagttttttatttggctgccattcgacgggggcttcgtacgcgccggtgttttgtcacctaaacaatgatatgtacccatcgtcgatatggcctaggggacctattttcttaagctacgcccaatacagattaccgtgaaccgagtgccttgcgcattatgctacgtagaaccgcgttagtttttctggtacccaccaacttcccttagccgaagattccatccattttttttatcttcccccagaaaacaaaaaacaaaacgaaaaaaaaaagggaaaaagaaaaccgtgtgacctttttgagcgtccccctgaggctgagacagacaggcacagccaaaattaaggagaagaaattccgatcgaccatggcaaaatgcatcttggaacgcaacgtacgtactttcagtttcagggcgcgtcgtcgctgttacgtttaatttcgccttgggtctctctggcgatagatcggcgccacatttctcggttaagctattagagcacgtacaatagcaggctataagtcagctataaatatattagatttgtagccagctgcagcacgaacttcaagacgtaacgtgtgtatgacaggtgggaccagatattaatagtatagcaagcaactatggtatgaattgactattacattggttatagatgatttggagctagtagtggagctatactattaaacttgctcttactacaacgtacgtgtacacggattacgcggtggcatgacatggtaagcttgtgctgttttatcgctactagctcttggtggctttcgcaggcgaggcggcaattgttgttgcggtcatgtggtggtgtcactcttgggctattgtggcctgcagctgcagctgcagggagcaaaaggcaggcatctcgtgagctgtggagtctggagatggtcgcgcatgcatacggacggagaagtggtacacggggaaaaagatggacgggagaggcgtcagtggcaaattggcagctgctgcatgctaaagttgctaatcctgttctagtgtggttctggttaggccagagccggcgtacggcttattattgggagacgtgatcagtccagctaatcgcacagtgacattgccgcacagggcataacgcaaaccgtgtatgttgtggtcttgtggacctgtgatgtgtgcgtgggtaggagggatcgatcaaggctcttccaaatggaaactcttgcaactatttcttcagggattttgttgtatttcaggtgcttgaaaggtttgtagattttcattcaccaaaaactacacaatgtcaagcctaaaaccatggtgcttaatttgtaatttaagtttatttaactacagttctaatggtatatttggtttggttttattttacccaagtttgaatattttcacatgtattttttttggaaaaaaatatgaactgtaaagtttattccatgtttgggttagaataacttatttttctaacaaaaattaactttctttaaataggtaacatgggagcaatgaggaccatgagcaattctacggtccttcaggaggtaccataaggtacaaaaaaaaattcagtgtaaaatttggtacctaatagtacatagatatcaagaggtaccaaatttacaatagaaaaaagtggtacctcatggtaccttcttaaggaccgtaaaattgctctattttgaaagagcctatttcggagaaataacaatgccgtacctaacttatttagtggaaatgtatgaaaccatatatatatatatataaatagaccccaaaactggcgcctatctcacgaaaatgtcctgaatatataatccattaaacctgaaaattgattgctcgatcctgctggacttttccatctctttggttgacatatctgcttcagttatgtacgcacattgacaaatgaagttaagcttcgctaatctcccaaatttaatatcccctcaagtcaaatttctgacgaccttttgcgttttcaattaatcttactaaattagctatgtatataaaaaagccatatgttgttctctttcagtcttctaaaccaaggatctagtttttctagttttaatatggttccatcctattgatcaataatatccttctaatgaagcctagaatattaacgcaaccgacctgtatgaatgattcgattaattctgttaaaatttaggtggaatgaccctgtcaatcaatcacaaagaataagatctttgatcaagactagggaaggattacatctttaattagttccctttactgattcataaaaaatatgcttctaaggacaaagcattgatgccctttgttttggactagtactgcagtactgctctgtgtgataaggtaaacaagaaggattaaacagttttaggacaggtgcaattaaggtgtacactcaatcaagatctgaatgtccacacctaccaccctgtctgaaagaatttgtttcttgattggcttgaaaaatcttttgttttcttgcaggactcatgttaaaaatcttgtagggtttggttttatgtgatgagtagtaattgatgttgcaaccaccagatatcaaaaaaaagaaagatggagaaaaaggatgcagacaagtgtggacgacttgttctattcttgcctacttagacagttaggcagttagtgtctgtaggcttcatgagatggatactattgatcaataggatggcaccacattaaactgaaaaaaaatcagttcattaaattatgaagactgcaagaaaccaatagctataccaacaagtttctttatgcatggctgaatgattcagttgagctgatatttaatttctatatcctccctacaaatattgaaacaagaaatgaccagctatatatcacgatgcatatttgatatggtcagaagtcaagttttaaggattaaaaacaaataaatttcctgatcctctcttttttcttcaagtctctttcaggagcagcatgcatgcataactataatgcactaaccatgggctgcagtattttaatctattaagtataaactgatgataaccaacaagaacaaattaacaaacttgaatggtatcttccacttttcagaaatacttaattaacttgcttgacagccctaccactacctaaagaggagcaaaagtatacacaagtgggatcacaaaccacaaacacaaaaaaagattacctttttctcctttgccttcccttgaagcacatcgctatttatgtcctgacaattggataaagaaactagtcatgccccctatcaagatcatgcacaacacatatatagattgctgtgcaaaccaatgattcatcctatctatcagcattaagaattaaccaccataaaaatacacaatgttttgatagcccatcatgtttagcaccgctatctatgaaaattatgcttatgtaaactaatcatggctacaaccgtgtggcttgccacttaatttgtataccatcttttttttttgtaattacaagatttaatgggaaaatatatgtcaagttggcccattgttaatctcacatgcgtatataacatggcaaaaaggtggcatgatacgtccacactttgctttattcaataaacaaaaaattaactctcctaattaatttatattgtagtaaggcaggaaccgaactgaccctaaatagttcgatttgctcgggagatatgtacaaacatgtcaatatataagtatatcaacaggtgaaataaacgcttaaacactgcctacgggaatatctggatatctgttttttttggccaaaatttgattttatcaaacagattttacagcttacaaatctaaaatccttgttacaccatataataataaaattgtggatcacaaagaacatattcgtaaggattttaagtcattgttcttattgcccctgattattgttcacatcagaaaccacatcatgcaccctatcagcaacaataatccaaacaagaagaaacagcatgagcattacgtgatagcaagtgatgatcatgcatggccaccacaaaagggggtttgctaatgcaatttggtttcacctattcattgcttaatcggcaatgggccacactacttggagcaaagcaaattaaccaaatcaagccaagagaaaaaaattaaagctaattaaagctggtgtcccattgcaactttcacaaggtcggccgctagtataaatcttttgccacttagttgtctcctaataatttattgttcagaggtttggaccagtgtgtgctgcgcaccttgcacaagaaaaagatttctttggatcgccttaagcacacctcatcacgattcacgaattggtttttgtgaccaactagaccatatatacttttgtcgcctgcatgccgtgtaggagtaacgaaccttcacgtgtaatttttgatgatgttatcgtgcaagataagtcaaaaaacaagaggaaagtgggatgatatatagacacattgttgtgtgtgtataactagttggtaaaaaggtagttttatgttagagaatatattatttcctttggtcaaaaatattttactcctagagaaagattcatgcaaacctttaaaattcctaaccatcaataatttctcaaacacttagtttgaaaacgaaagaaatgatatatgtagttctgcgtcaaaaagaaattatatttctcataataatatgaacttatattgattattgggattttaaaatttgactgaaccttatcataaactttttttttactagagggagtaccccggtaactaccaagggcaataaaatttctctaagataaaaatctagcaaccggtgctacaatttgatttcttaactggacggatgcagttgatttttttaataaccgaattcaatcagttcccaacacttgtaggtagtggttgccaagataatcacaatgtatactctacattggactacatcttgcagtgtatacattttgatctctagtgtatagacacgttgggacctaaccttagttggtgatgaaacttgtatagaaaaatctatttttctatgaaatacaagcaatcaaatcaatcaagggttggtgccgactccttttctgaa

SEQ ID NO: 54693 - DNA, 777 bp, Oryza sativa
tcatcttcccaaaacctcgaactaaggcaaggatattgtttccaaagttttttgagacaaaaaatatttacaatcgttgtttctccatcaggtgtgcttctgcatttctgcaagctagaaaacctacattcctacaatgctacacttgcaacatttattttgttttttctttgaactttgtttatattctgtaaattaaggaggatgctcgatacccatttaatccattgtgttgtcatacgctggtacttctatgagaagtctaaacttctcaaccacaactaacttttttcatttcattttctcagcatgtccttgtaaacgcatggtaacacttaatttgatggagctgtttcctccatgaagaagctgttattttcctatgaatatctcatcaggttaacaggtttcttgcaagttcagaacaagaaagttgcctgagatgatgcaaactgactgcacaaacagaaaggcaaccagttggttacttcatcgatattacaggctagatcgatgtagcctggagactctgcaagtatgcatagaaacagagtggtctttactcttgttcattaatcaggatagccttgctgatgctgaagcagcaaaacggaagccggttagagattgcagcataaattggattcagtaatgctttgcacttctttcgtgggaccgcactttaatctgtactacttcctccgtttcacaatataagtcattctagcatttcccacatctatctatctattatattattaaaacagctttgaaagg

SEQ ID NO: 54694 - DNA, 1207 bp, Oryza sativa
aatttgtttcccacttatgttgtctgacacataaacccatgctgttagatcaaagcacatttttaccctcttattgttgaagacagcttgagccacagttgtttttcccactccattaatgccaactatgggaaggatgccaaggttttgagatgaaccactggtttcatgtacatcagaactattataatctaatctttcagtttgtcccttctgattaggttcgtattctccaatttctatgcaatctttgctaggatcttcttcttcaattttgttccccttctttcttgcttctaattcttcaagtttagccttatcactcgatttactagattcagcagttccagtaaggaaaatcttccgtaatttatcaaaaagtgttcccctttgaccaaattttggttgatcatcaggtcgtgcatgctcactagttcttggcaagtggtagcggtaacccaatatgatgtccaatatcaggttaatttcttcatcccgaccaattactttggtgtcaccaagtaaagagctggtctcactatgcaagctatggccaatccttcccactgtatcatcatcatttagcctgatcaattcaatgaaagaatcaactctcgctgatacattttcaagtcttcttacagcatgcttcagcttcttcaattcactatcagaaaagaccaaagcctttaaagccttgacggtagagtatgcctttgcactgaccttgctcttgctttcgacctgatctttaattgtcttggcttcaaaatcatcaacaacatctcctgcatgggaaacagcatccttcaactgctgcaaccatgtggaaagggcactgctttcaattgatctccgctccgctgcttcaatcaccgcctcaatgcgaggaagcgcaacctccaagtcattcagcattttttcagtgtccttttgcagactgaaattatcgtggaggagggagcgtactctggacaagatattggcaatcactgcctttgcaatccatcctccaactaccagtcctactcctgccatcctaattttattgtagaagagcaaatacgtaagaatagagcagaataggcatgaccaaagcacaaatttagtggacatccacacatatggacatatggagtagaaacattgaactgaccttctgttttgccaagggaaaggtggtggagatccttctaggctatgctca

SEQ ID NO: 54695 - DNA, 10495 bp, Oryza sativa
gagggggcatggaattttgcaggcggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcagatctgtagcacacagcacatatgtgtagatccagagcatagaatataatagtatgaattgagacatagacagtagtgttaattgtaagatgtagtttagtttgatatggagaatgtaacatacttttagaattttggagaacaatattgtagagaatgtaacttagggcgtagtacagaaatgcgaggttaacgcagttattgttttcatcaggcacaatgtcaaataaggtcacatttcagatagttcatggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtgtcaccgaaacatcacttcagcttttgtggcaagtgagatgtacagcagtgttgttagtaacattggttttgaaccaaaatcaattattaggcacatcgagaacaaattcaagtacaccataagctatgcaaaggtctggagagccaaacaaaagattattgagatgaggtatggcacatttgaagcttcttatgataatttgcctcgtttgttagccaccattgcccagaggaataataatacttactatgacctacatcacttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttctagctaagtggcctgatgttcggagtcggtggtgcatgcgtcacatgggtgcaaatttctacaaacaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacacaagcgtactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtgtcttgaaggcggatggtggatgtacctgcagttgtatgaagccgaagcttcatcaccttccttgctcacacgttcttgctgctgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactcgacgcatcagaaatgatatggatgagtcagaagcaggtgggaggactttacgatgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgttatcgatttaggaaataaaatgctgttgtgatgtgatgagtgttcggactaaatacttctatcgtgtaatttcaattgaatgttgttgtaatgagtacctccgactattgttgtactagtagtattgcgaactattcggtgttgtatcataatgttatcgtgatgagtgttcggactaagtactcatatcgtgtaactgcagttattgttgtaatcagaaatattccgtctggtgacaattttgtttgtttgtactcttgtttaatatgtgttactaattcgcttatgaacatttattacttatgttgaactaattatttatatgtttctgatcaatctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcacttcttgccgctctggtagaccgctggagacctgagacgcacacgttccaccttccctgtggggagatggctccgacactacaggacgtgtcgtacctgctcgggctaccgctggcgggagcaccagttggtcccgtggacggtgtttttgggtggaaggaggatatcactgcgcgcttcgagaaggtgatgcgccttccacacctaggaccggccaacacccttcctccgtactctatagtcgggcctagcaaggcttggttgctctagttcactgtaagtaaataagttgttattatcatacatgcttatttgcgatcaacagagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactaacggtccatcgcggatgctcagccacaggacgtgccgcagtggagctggggttctgccgtgctagcagccacgtatcgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttctttttttttcttcacataacatgtctaattccgatcatgtttattgcagcgtcgttacgctcacgtccaagtgagacgaggctacccggacttcgtgttcaagtttgaccgtctccagccgagcgacatcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggagtgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccctagagccgcacgttgccgctgtcacggacgcgtatcccacgcaccgtgaccgagactacttcgtgggggtacgtcgaatttgtattagttctcacaattatttcatttatcttgcataatataggacaactactgaatttttttatttccatcttgcataggctgatgccgcatgggatatcagtgccgatatcaccgcagtccaagtgaggttgaacagaggtttgcacttgactgacgttgagcagagggtgaccttcaaccggatgcaggagaagatgcgtgcggtcatgcgcgtcttctcctgtagcagcgccgtggacgtcgtacctccagctggtccggtacaaccacggcctcgcgcgcctactgtcggagcaggacctcgacctacggcacctttttcgcacggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccggttccgcacggtacagttcagcccagagattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagaccttatgtgaccgtttcttttggcttacaaacttgtaaagcagtactacttttgctattactactgcagtactacttgtgtttgtctcgtctacatagttcttttcattcatatggtgctagaacagcttatattttggcactaacaaaatatttgtacggtaacattccaaataggccctaaaaataataaaattgtattttaccagtcttggagattttaatcttgtatagttttcaatataaaaagatttgataactattaatatttatacaaaaatataaagcacagtataaaatcgccctccccaagggcggcaagggggccgcctgcaaaattccaggccccccgccgcccatttgtaggcggcccccccccacagtacaaaatcgccgtagcggagggcggcaagggggccgcctgcaaaattccaggccccccgccgcccatttgcaggcggccccccccacagtacaaaatcgccctagcagagggcggcaagggggccgcctgcaaatttcgttgacggccgtcgcccgagagcgaacggccgtctgccacgtcactttcgccgccctctgggatggcgatttttaaaaatcgccctcccagagggcggtaggcgactacatccgtcaattttcaaaatgaaaaattatttttgtaaaacttttaataaaaaaattaaaaataaaaaaaattctctcactatctctcctttaaccaagacgcgggttctcgatagtttgatttctgcttgccaatagaaaacctgattatatatatttgattacactaataaaaaaaatatctataaaacaatgaccccacctattatgatccaaattttacaaaaccacagcgattttgacacgtgacacataatgttggggaataaccccatgccagcgtgtacggttggaaaggacccctcacatctagggtgttgtataaattaatgtaataatgggctcaaacgcccctaggacaatgcccctatgatgcaaccgatcaagggtaatactgcaattttccattacatatgaataaaaggagtcctccaagagcaagaaggcggaggcatcttcccattacattcatttagcagcactctcttcctcttatcttatcccccatggatctaaactaaggctccctgcaagagaagggggtgcgtttgccatacttgttggactttgttctaacacataaccacgggtattatatctaaagtttcacaaaatcacaatgttaaccattttgatatactcatatatcaaaatttaagaaaatggatgtaatatttatatgatgaataaaattcttataaatttgagatgtgatggtagaacccaaaagtgtgaaagattaaaatcaaaatgatcaataacgtggtttgtgaaacattatgaccataaaacctgagcttacgtatcacataccaaaatctgtatgattttgtataatttggatcataataagtgaggttttatagtatagaatttactcacaaacaattgaacaatactagttcacggcacagacctgctccagaccggattaacaataggctacaacaacatcacagtatttccttctatcccaaattagtaaagttattaggacatggctccaatctatctattatatactaaaagtccattacacttcatacaaacactctcaagctgtcacgtggcactctaataaattatagaaaatcttagaaataagaaaaaaagcaaaacatctacccttgattttcacttaaattagtgggtccattattacacaccattagatgaaattgatctttaaacaaaccaaatactatggaccccagctctccttctcccgtgcatgtgtacatgggtatatatacgtacgtaccatgtacgtacgcccttcttttcttttttttttctttttttcttccttttccatttatataatatggatatatacttttttaaataatcataaatttacaacacaaagaatctaccatcatgcaactctcgggtaattaaattagctctaccatttttaaaaataaaatttaaactattatatgtgaccattaaattaataatgtaatatagtttccacttaaacatgggtactcattattttgtactattattttcaaataattttacacaattatattgtgtacctatcaaataaacagtttaagatctatattaattgatttatacgtgcacttaaaccgaggacccattatttaaatcatcggaactattttttgttacattggactattattctcaaataatgcatggtttcaaaataaagtctacaccattatattatattatgtacccattaaattaacaatttaaaatctatattaacaaatgtacacttacactagaaccggtggacccattatttaaatcatctgatatattatttgctaataaataaagcgtccgaagttctcttttttgcccgctgcacaatgcacgtctgcagctttgccttttgcacgcttgacaaagcgtcgtgtctgaggcatctaaggtgatcacgactaccgcagcactaccactttgccacatatcaaatcatatatggagatgattaattttgttaataacatgaaaagaaaattaaaagtgtgatgcagcgagagatgaattaagcactatgggttgtgtatttttttccaatacttagctctgtttaaactgaaaccgagagttaattacagaataattataatgtattgtgttatatatgtcgtatttggattttgtactatttgttcgtataggtgaaagaaatcattatgttataaatgtgagcacaatattaacaaatatcaatagcactcttacaaagactagggtgttataagggagtttaagatccgcttttttcccgattccatagttggattttcgtttgcacgctttccaagttttaaaatggtgtcttttttaaacaacattttaactttttaaaagtcaattcattcgtttataccctcaaatagctatcagataaatcagataattcatcaatttcagctgccctagaccctaagtagtacatattattttatgcgagtcatggtgatcagtaaattgggaatcaacggataatcaaagtcgtaagatgaatatgtaagagctactatgaacaattgtaaataggtgtcaaaattaattgctactaattagacatctaatagcttgctaaccacataattaatttctctcaacatgtatataaacatgcacgaaactggaacaaatattattatatgccctatacatatatattaagcggttaatattctaattgcattgttaagtcctttaaaatttcttaaaatgctctcaaactgccacgtggtgctctaataaattagagcaaatattagaaattctaagggaaaaaagagcaaagtattcacttaatcagtatgtccaatattataaactgttagattaaattgatctttgaaaaaactaaatactataaggtctcacctctcgtcccgtggcataggtatgcacctacgtacatgggtacgtatgcttcccctcccttttttatttttccctttcttcttttttttccatgcatacacttccctccctttttactacatcatgcgccttcttagatgatttaatcataagaattttgagtatcttgctttcacatttttcatccgtggccatactacacggtatgttgtatgataattaactagcaatagtttcttatttactcgagaaaaaatgatttaaaagtcataccttaagaaaaatagaacccttaaaatattataaaataacattatccgaactttagtttgctcttaatctattatgacaaaatttttaaacaaacaataattcgcatgcgcgcgggccaccttcctagttaaataataaaagaaaggcagcgtgcccacaactgacgtgtaccttaacacttcgttgagccatgaggccatcaggacgggcaccagaggtccgggaggagaaggttcaacatggttagtccacggaggttcgtcctgcgccatgacgccatccattgccttgcgaaggacatacatatggttatcagcc

SEQ ID NO: 54696 - DNA, 2591 bp, Oryza sativa
cccccccccccctcacctcgtccggtcttcacggctacagattggaacggaggagaggggagtgttcgcccagcgcgtcatgggtttcgcctctgggtaatgggctgtacgatcaacagacaacagttacgacggaagatgttttgcatacttgcatcggccttgcgtttctctagctggtggttctgtcagatggtaagttactccctccgtttcaaaatgtttgacaccattgactttttaatacgtgtttgaccattcgtcttattaaaaaaattaagtaattatttattcttttcatatcatttgattcattgttaaataaactttcatgtacatatataatttttcatatttcacaaattttttttaaataagacgaacggtcaaacataggctaaaaagtcaacggtgtcaaacattttgaaacgaagggagtaactatcaatgctggcctggcttgagctaaaaaaaagatcgttgattttacttccaatcaagtcgctgaagattcaaatagcggcgctcacaattactgtatatcagtagatacagtccgtggaaactcatacagatcacattggacaaagatatgcggacagtgtatgtacatcgtaacaaaagatttggcaagattggaacaactgcaaacagcaaactacagtacctgagatagcatacagagctacagttttattactgtgtaaacacaatcaccagaccgcctcacaagataacatctactctctccgttttacaatataagtcattctaacatttcctacattcatattgatgttaatgaatctagacatatatatctatctagattcactaaaatcaatataaactagctgggtggcccgcgcaattgcgcggctagcacccaaacaaattcatatattttttaggatgattttacttaaaatttattaaatagctatcttattatcttaagactttaaaagaccaaactttatcatcctcgtgtttctacatatagtttttaaaagtcacaccagttgctaccccttctttatttgcttgcttgatctaccactatttctattcattcttcttggaacctttaaaaattggattttatagtttttagagtttattgtcacattgggttttgtttttataatttctagatgtcccgtcaaacgttgccattatactcctctatggcccgtccactgtttcttctctttattatcattgagatttcaaaaatcgaacataattatcgtttgggttcatttttactttctagaagtcccgccaaaccgtcagcggctttgccactgtactcttctacggctcgcgcactgcctccgttctttattgtcattgagatttttaaatcgaacatgattatcattgggtttttttaatttttggaagttccgaacctttaaaaattggacttgtattttcattttttataatttttagaagtcccatcgaacgatgccacaatgcccctctacagcccgtccgccgcctactctttattacactatgattttaaaaatcaaacataactatcgttggaattcattttttattttctagaagtcccgtcaaccgtcggcggctctgcaactatactcttatataccccgcccgctgcttctcccttttattgtcattgagattttaaaaatcgaatatgattattaatggggtttatttttttactgtctagaaatcccggcaaccgccttacttgtttgcttcacgacttgcctgacgtccctccttttaatcgtcattaggattcttttttgtgttttattaacaatttttatatgtcgtatcaaccgccaccactctactcctttataggcatgttacttaatttatctcgtcatgtgttttagatggtctttttttcaatagtctttatttttatcacaaattttagttatttataaattgtattactaattgaaatcttatttccttttctaatttcagaatttatttttaaaaaatttttagttaataccgtattgtgttcttttaatgtttttattttttattttcaatttcagttgtttcaaaatggtattcctacttgaaatctcttttaatttttataattttggatattattttattttttattcaaaattttaattaatctcgtattggattcttatatggattcttctttcaatattgcttaaatttaattctgaattctagctaattttaaattgtattcctacttgaactcttcttttattttcttttgctaatttcagatttatttttgtttttattccgaattttaattaatcttgtattggattcttatatggactcttcttttaatattccttatttttaattccaaatttcagctattttaaaattgtattcctacttggactcttctttacttttctaattttggattttattttatttttatttagaattttgattaatctcgtattgggttcttatatggaaacttctttcaatattgcttatttttaattccgaatttcagctatttttaaattgtatttctacctggactctcctttcctcttctaattttggattttattttattt

SEQ ID NO: 54697 - DNA, 1986 bp, Oryza sativa
tgcatatgtccagctctcccaattctccatatattcaaagcttagctcctccaaggaccaaaagaccacgtttgaggttccacaaatatcagagtttatatcctttattgacggcaaaccatccaacttgagtttttgcagatgctcaagctgtccaagtggagggagaacgttcaagtttttgcaccaacttatctctacaacccgtacatgcttgagctgccccacccaatctggaagttcaaatcctgagtaaccatacagttttagctcctgcagatatcttggaggagacaaacacccaagtatcgacttggacagatcaggcaaagtataagaccatcttaattctaaagctgttatatagtccttctcaactatgttagcttgaagtgcctctgcaggatcagtcaccatctcaaggtgtgaaatacaaagggaaccacccaaatcgttcatgtcacttagctcagttatcccgtgaccttcttctgctttaatatggaattcatgtagctcttgcaatttagttagcttcccaatgccattaatttgagcaattgtgcctgagctagcatgcaagtgacgtaggttgattaagaaattcatgtctccaggtaatttaccaaatgtacagcctctcaagccaagaacctgaaggtggcacaagctgcatactgaattaggcagtttcgcgatcccagtaaacgagaggtctaaatatctgaggtgtttcgttgagctaataacatttgaaagagcggacgtccgtcccagccatttgtaactccttgaagagaaggccagtaagcgtaggcttttggaattacacaaaaaattactaagagggagatgagtttcattattgctgggttgatgactgccgtcaagcaacataaaagtgcgcaattgttcagttttaaatttatctggtagtgtatctagggcatccatgtcaactgataaatagcggacatcctgtgaaacacctctcaccttattatcgttaccatggtattcatcagaagacagtgcacttgcaaaatcccagaccaaatcatgcataatgtattcagttttccttgctgatggctgaagaaaggccctattgacaagttcgtagaaccattccccacctacatcctccaaccttttgactccactagaactgtccagctgaataaaaccattagctatccacatctgaaccaatttatctttttcaaacacatagttcctaggaaatattgaacaatagacaaagcactgccgcaaatatccaggtaacgcactgtaacaacttccaagagaagatataattctgattgcaaagttatcatctgaaacattccaccaccaactatttaagatttccctccaatcagcttcttccaactgacttctcaatgttgccccagttacctttatggatagaggcaatccatgtaacctgtgtgatatttttctaccaatttctttgagaccttccgtggacaaacttctgcagggttcaacaaatgcatatctcctgagaagtgcccatgagtcatcggattgtaaaggatccagaattacagggcctgcagtccctacaaagttagctacactgtacaattgagttgtaactaaaactacacttccaggtgctcctttgcttagtacactccttaaatcattccatagcacacatatctcattccatacatcatcaagtaccaggaggaatcttttaccttctatgatatcctgaagttgagagtaggcactgtccaggcttgtcatataactgatgttatccttgggattaaaagaatagatgatctgttctattgtaaccaactggtcagttctgtcagtcatatagacccatgcagatatatcaccaaagtgctcccgaacatttgcgtcatcgaatatgaatttggcaagagctgatttgcccactccactgattccaacaatgggaataactgccggattccgaag

SEQ ID NO: 54698 - DNA, 8030 bp, Oryza sativa
tctcttatcatagccatttcctcatcgcgaccaataagaaagtcatcaccaaggaaagatttgtctgggcgagtcatggcaacagaagatgaagctatcttatcttccttttcatctcctaaggcactctcattcaggggtggtgtgtcaactatagatttgccttgagaacatgcactggcaagtttactaatgacgtataccattctaatcatgtttctgtcatcagaggagagccaattcataacatcagagattgaagagtcaggagctttcacctcagattccatgtcgtcaagaagtccctttgcatcttgtgcagccttgttcaggtcctgcagccatgcaggggcaggcttgacccgctgcaggctgtccagacggaggaagcgaagcttatcctccaccacatccagcttcttcgtagttctcttgaaggagtcgctacttttgcccagagagcggcggagcttctggaccacttcgctgatctccaccgagagaagcacagcaggatgctcatatccaagatccattgatgcggaaacgtgtttgtcgaacttttgaggcaagagttgggggtgcagggctaagctgccgtgttgaccttacctctagtatctgatggaaccaaactttttatttagagaattagagggggcgtggggcctgcttgtgttaggctgagctggaccagcacattgtccaagacatagcataatttatttttacataaacatatacccctctatccacccgtataagcatctatctattatatattattaaaaaaagccttgaaagaagacacaccattcgttatagagactagaaaattctcacattagttggagaaaaaaaagaaaaatatcttagtcgtcagatcatattgggtttggattataatggtatagattgattgatatagctataaaatacaattatatctacaaaaatataagttgagagttatatataaagtctactgcgttcgttgggtggagaaagagagagtttatttcgttttccgcgcacacatttcccaaactactaaacggtgcgttttttttcaaaaattttctatagaaaagttgctttaaaaaatcatattaatccattttttaaatttaaaataagtaatactcaattaattatatgctaatggctcacctcgttttgcgtatcttcccaatcttctcaatccccttctcctcaaactctctataaaaatagaatttaagagttaagagttatatatgaaatccatgaattatagaaatactccctccgtccaaaaaaacagtgaatggatgcgacatattctagtacaacgaatctggacagatgtatgtctagatttgttgtactagaatgtgtcacatccagtattaggttgtttttttatggaacggagggagtggaagctaaaagttgtatatgaaatttatggattataaaaatagaatctaagagttgtatatgaaatccaaatgctcatagaaatagaagctaagagttgtatatgaaatttaggggttacaaaaatagaatttaagagttgtatatgaaatccagatgctcataaaaatagaagctaagagctgtatatgaaatttaggggttacaaaaatataatctacgagttgtatatgaaatccaaaggctcatataaatagaagctaagagttgtatgtaaaatctacggattataaaaaatagaatctaagagttgtatataaaattcagatgctcatagaaatataagccaagggttgtatatgaaatccaaatagatttctacatgcaatgatatcttttggggcaatcctctagttttattataagagtgctaagttttgacttaactatcaatagcaaaaaaaaaaaatcataaaaattcatggcataaaaaggatgttgttagatttatcattaaacaaactatcctaacatgcaacttttttaaaaaaataaattatttttatatatattattggtcaaaatagtacattgaagatcgatcatgtgaaagtctaaaagtacttatatttgtggatagagagaagtgggcttatttgggaaagcttatagcagcttctctaaaatcaaaagctcctcaaatattacagcttttgtccacattctaaagctgatgtagttgcgtaattcaaagataaactagaagctagattcaccttagcttgctataacacaacttgccataacccaacatgtcataaaaaaccatccttatttaaacccatggataagatgttaatggttttgagatttaaagtaccaatagtagttggttttataattaagggatcaaaatcagacaagtttatagtgaaaggagctagatacatattttttttaattaattgacaactctgatgtcattgcggggaaaaaaaaagaaaagtcagattcatcttaattcattgtctgaatgtgtatttaatccctattgagaaaaaacaaatgtaccttatgccactaacaacgaaggtcgactactgtagcattaagaatgctcccactcagattccattagctggctatgacccattcgcacacatgcccacatttaggtcaatgactgaacacaccaattagctggccatgacccattcgcactcagattctattagcttatgagaacatctgccagtcctcttctactaggatgcaattctgaactctctttcctgttccgtgctactagttgaagccttggagttggaggggcgacctcgacatggttggaggcggattgaccatcggcggatggttcgcaggagctgtgatcgccaacttcgtgggcaaggcgcgttccatcctggaggagcgccatgagctgcatggtgacgttgcgggtgtttaacgtggaggcttcccttgttcatctgcaagcagtgcttgatgtcgcggagcgaaggcccgtcgtcgatgataatttcaccggctggctggagttgatcaagaaaattgcttctgaggcggaagagctgctggatgactttgagatcaagagaatacaaaagagccaacagaacaaggttagcggttttctggcatacatgatgaagaatctgggttttgttgatgatgacatatacagactgaagactctcctggcaaggctcgacaagattgccagtaagtctggaaatttttttgacttgttaaaattgaatgattctaaagaggatatggtagggtttcttccagaaatacaagtagtgttccatggtcgtgagaaagagaaggaccaattaatgagcatcatatttccaaatgaagcacaagctgaacattttccagcatccagaatgcaggaagagacacggggaactgcaactgtgaaagttgtatgtatcgtaggcgaggctggggtaggcaaaacagcacttgctcaagtaatctataaccaccctaatgtcaagaaggccttcaatcagagaggatgggtctctctctctcaaaggtctgactcagaggatttcatcaagaaaatattttgttcttttgcagcagaacagcatccttttgattctgaaatgggtctggaaacactccaagctagttcggaacatgatctctccaggaccatacagaacaagagattcttccttgtccttgacaatgcaaaggataacctgcaacgtgaatggaagactgtgagagcaaaattaactggagcagcagcagggagcatagtactggtgacaactagatcagaagtgactcatgccattccaggaggtatagttataactttggataaaattccaacatctgttctctcgatgattctgaagcaccacgcgtttggactcaccagaaaagattctctggaatcaattggtgacaaaatagctggtaagttgcatggcctgcccttatcggcagaggtaatcgggaggcttctcagaacgaagttagatgaagaccactggcgaaatgtttgtgaaagcaattggtggaatgactatgaagatctggtcatcactaatcctgctttaccttcagtaacgattgcactggaattcctcagaaatgacctaaagaaatgtttgggttactgttccatgttcccatccagttatttatttgacaaaagaaaaatgactcaaatgtgggtgtgtaattctatgcaacaacatcaagaatccgcatatgagatcacagacattcgatggcttgatgagctcttgaacaggtcacttatccagtcaactgtatggaagggtaaatatacagtgaatgaaatgatcaaaaaagttgtggcctccataaatcaaacaggatgttacacaatagacgatttacacagtcccagacaaaacctttccaatatcatccacatggcagttgacaaatatgatttcgaagtgtcattggacctaagaaaacaaagcaaggtacggagcattttattttttgatggccagagaacaaccatgctgaatacagcccttaatagcatattgcctgtttcaagttccctgagggtgttagacctgtcttgcattgaaactaagatggaaaggccccctgatgtcatcagtacatgctctcacctaaggtacttggacctatccttcactgggatcacaatgtttccagactcattctgtaagctactccttttacaagttctaggtatgcgaggatgtagattcacagagttacctagggatatgaataagctagtcaacctgcgatatttatatgcagaagcttgcacactctctttgatacatagtataggccagctatccaagcttcaatacttggaagaatttgctgtcagtgaaaaggaggggtataggataacagaactgaaggatttgaattaccttggtggccatctttgtattacgaatcttgagaaagtggcatgtgtgaatgaggtgtgtgacgcgcgtcatgctgagctgtctaaaaaaatgtacctccagaagttggctctaaagtggaattcacagccagcaacacttgatggttgcacggaaactgtttcacacctaaaaccaaatggacaacttaaggatctcgagatccactgctacatgggagtgaagtttccaggatggatagcagatgaccagcacttcaccacactgcgatacattaaattcagtggctgtaaaaaattggtagaacttccacctcttggaaatctttctcaccttgcggttctaattctacaaggcttggaacaaataaaagatatcggaaaggaattttatggcagttatgacagggtatttccatcccttgaagaactgacgttccgtgacatggaaaattggaggaggtggatggatatagcaccaacacaaattattccacggatcagaaagattgtgataaagaattgcagaaagctagttgatctccccaaatttgttcttgtaggatcccacgaactggtagaattgtaagaacagaagaagccgaggaggaaaacatgacatgtttaaaagttcatgattgtttggcaatcatgattgatctcccaaaccatttgttggcgtcaaccgaggtatggaatcttcaaatctgtgaagtgtgcttccaaggagagtaagaacataagcaactaagggaggttcttgaatcttgaccattattgattgtattgaagtgagacagaggaagaaaagaaaaaaaaagctagccttgtcttctttcttgaatcttgatcattattgattttattgattattgattgtattttttcttctttcctggctattgtctcctaggactctagccttgtaatttttctcctgctctattcaatgaatcttcgcgatgtctggtgcggatcgttcaacaaccagatttctggtgtgaatcctagtttttaagacaattagtggtctatgaggaatgcaaaaaaggtttcaaagctatcgactacccccttggcttcattttcaccccaactagttcgggcccacacctcacccaccccaaggaggcaaacaagtatgtttaccgatctccttaatagccgtaccaagggataaaacttgctatattttgggacatatgaagtattttagaaggattggtttaacaaaatatgtcttcacaaaaccatattttgcaggttagcatcttaatgcatactataaggtttcaccagtaatttttcaacaaaaaaaaaatcaaggccccttgcagtttacaatggtcaagatggatatgtcagtttcttctcaaaaacttagaaactacagtgctatattttggttggctttcccatttccaccacacctatcatccatttcaggagcaatgattttcttgaattttgcagttttcaggttactgtgtataatatattaagaagttggtggctaatcttgaagaacaaaacaattgagtgaagaggccacggtgtagcaggtaaacaagttccctgactaattgcaatctcggaccataggaagagcaagaggaaaggcaaaccttttaccatcagatagtccacttctgtttatgttctttttacattatgctgtaatctgatatctacaggtttcttattgctcctattaatatagcaaaagcactccactggattttcgaaaaaaaaatactatgtacttcctttgtttcacaatataagatgttttaggttttgaatagattcatgcatggatttatgtatgtactccgttcttcatttatgtgtccaaattaatatgtatatgtgcgactctagacgagagatggagaagccaaaatgtctaataatatggaagagagggagtattatattttctatcaaccttttagctctcagagttacccttttttcagaatcattgacagagtgaggtacaatgtacatgggaactgctagtctgtagattgttcgttatgtattcagaggctgcacaaatagacctgaatgtttgaactatctatgatttgaagaattcgcccacttgaaacatgggaccttctagcaacatgaacagggttcacgcggagattagccatgccacaagaaagataaacatagcccgtattaccacacagaatgctgcaatgctatattatacacaaagagccgaagaggacaatcatatttaatactgagaacggcaggcgcgcgatggggggcgtaccttaattccgagttactccatcagaaagataccactgcattgtcatcgaataggacggctgcatgccaccgcatgattgcggattcccggccacttcagatgatcaaatcgacgccttcatctgtccgcacctggtgcagagcgaagagcggagtcagggagaagtgcgcatttcgtcgagcaagtggcgagcaccactcacctgggcaaagagacggcccgcagaagcaaccagcggaggagaggagggggagctcgcctgcatcacctaggcaccgcctgcctcgtgaacgccgacacggttcaggagcccgtagaggtagaggtagagcggctagggccatcggcctccgccggcgtgtcctcactcgggactcgggagagggcgtgaggctcgccgcctcgcgcccttcggggaagatgcagaatttttattttatttttctgttctgacctttattgacacgtctcacgcagcaggggttaggccttgttcagataaaaaaaaattgtggcaaaaaatgtcacatcaaatgtgtgatattaaatagaaaaaaaaaccaatttcacagtttacatgtaaattgcgagacgaatcttcttttttttagaaacacaatacaaacgcagacgctcacaacgtgcgcacactcacccctataaacgcacacacgtacaccctacccctatgagcacctccgaaagactgagccgacatgtcttgaaattgacgaagtcaccacaggcgcctcgctgtcgacgggttcgtcgcctaccactgaaagaataattagccgtaaatgcgagcacccgtgtcaaatctaggatttgaacttggatgggctggttccaccacaaggaacctaaagaactttt

SEQ ID NO: 54699 - DNA, 1713 bp, Oryza sativa
agatttcggaaagctgcacgctggagtttcacagataaaagtgctgtataatatctccattcacacggatataaggaatatgagcaatctttggtccagtcttcgcccctactcttgagccacacatcttcattattttccagttcatctgaattattcttcagccagtcctcttcttcattctctaaccactctcccttatcgttcagatgatctgtagcactctccacccactcttcctcatactttaaccacccttcccagaactcacatgttttcttctgtcggtactcgtttatcgtctctttatgccattcccctctcttcttcttcacccatgtctctccatcttccttctggcatcgtgcctctagtataggtgagcatcctaatatttgtaactctcttaggttacctggtaggcctttcaatggtagcgagtgaatttggaaacatgactgcatatttaacttcttcagggatgacagagtgaccaagtttgatgggagctgccttagcaggtagcaacaagagaactcaagctcttgtagggatgtaatctgctcaagccacttctcttggtgaagagagatcacatcgatcttgtggagacacagagttcgaagtgctgaaagcttgcaaagaaaattatcaagatctgaagactgggaaaggttatccattgtaaggtcagtgagatattgtaaagtatgcataaattcttctttttgcggagaaccgggaagggggagttctctcctttttgtacccagctctttggctatattgaggagtccacttttgagaacaagtgactggtctttgcccaaccttatttcccagttagaaaacagtcggttaatctcttcctcaactgtcgatatgattttgcggcagccagaaatatgtagatttttaaggttgttaagacgaagaattccaccctcaaagtatagctccttacaatttgaaagatgcagattctccaatgatatcaggttttgacatggaaggattaacttctgggagcaatcatttatgctcaagtgtgtgaggctagttagtttttgcaaatacctgaagactgtttcagcatatgatccacaacccgtaagagagagttttctgatagctaagcccaaggacatcaaaggtagttccctcaagttatcacatctattaatctgcagattttgcaggtttgaaaagctttcttcgttctgtgaatctgcccaattttccaacttccccatagactcaaaacacaggatttccaaagatttaaaggccacatttgaggttccatagacatcagaactaacatccttcatggagggcagctcatgcaaaattagtttcctaagatgctcaagctgtccaaaaggaggaagcacctggagttctgtacaatggcttatctcaataacttttatataccggagttgtacgacccaatctggaaaagccaaacctgtgtagccaaaaaattttatcgtctgcagatttcttggtggggacaaacactctaatatctccatgtcttgatcaggtttaattacctctggtggattcatcagatatcctgatatatctgaagtataattcttctcaactaagctagcttgaagtggctgcttttgacctctgtcgaattgactcaactcctttccatatagattatatttacctctagaagactgatttctatcccac

SEQ ID NO: 54700 - DNA, 2176 bp, Oryza sativa
tgttatgacggaagccaccgaataatattaatgatcgcaactgtttaatgctatactcggtccatggtatattcatagcatccatatctacggacaagtgacgtacacttcgtgggagatttcccattgtacaatcaacaccctgatattcattagaagataaggcgattgcaaagtctctaacccaactatgcataatataccaagctttccaaactgtcggttgtaagaagcacttattgactagttcatcaaaccattcaccagctacatcctccagttttcttgcaacagtagtgttgtccagttcaacaaaaccattagctatccacatttggatcaactcatatttttcaaataaataatttctaggaaagattgaacaaaataccaggcattgcctcaaatatgcaggtaattcactgtgacaaattccgaaagatgatattatgtgaatgtcgaagctgcagcttgaaacattccaccaccaactttctaagactctcttccaatacgcttcatccaaacaatttcttaatgatgccccaatgaatttcgctgccaaaggagatccatgtactttatctacaatttttctaccaattggttctagagcttctgtactttgataactggcaaatgcatgatgcttaaaaagcttccacaggtcatcataatgtagataatccaaaaatactggagttgtagttcccacaaagctggccacactatacagattggttgttactaagacaacacttccaggtgctcccttcttcagtgcactccttaaatcgccccacattgcacgtatctcatcagatacatcatcaagcacaagcaagaacctcttgccttctatgacgctctgaagttggacacggaggctgtttagactgaaagcatggtccagcatattatgctcaggttgcatcgatacaaagatctgcgccatcggttcttctttcctgatgttgtcagtgaaatacacccatgcggaattaccgcggaagtgctcccgcaccctttcgtcgtcgaagatgaactgagcaagagctgttttccccactccacccactccaacaattggaatgacagttggattgcacattgaactgacagtgctgctctgcaccctggtgtatttcactctgctgcccatttctttctggtatgctgctgctgattctgcaggttggtttctctggtcagatagatctatgctccggagggcatcgatgatccatcctttccgagaaatctgtgatccatcagcacttgccctctcctcaaccgattcatccgccacgaaacgggcatcatccagtatcatctccaatatgacacctatttcctcatctcgcccaacaacaaagggttggtcagggccagggggcaaagcggcgacgtcatcccccggggtttccagtccatcctcgtccaggcccggcacgggaagaagcgattcgacctcggagcacgcgctgacgagcttgccgacggtgtacttcaccccgaggaggaggctgctactatcggaagctgcggccgccgcggaagcctccatggcgttgaccagctcctccgcctcgtcggcggcctccttcacctgccgcagccacgcggccgcctcttcctccctgtcggcgtcgacgccctgcaggctctcgccgcggaggatgctgagcttgtcctccagcagatcgagcatcttcatggtgcccctgtacttgtgggcgtcgctgctgcctcccaggtggagacgcagcttgccgaccaccctggcgatcgccgccggcagcggccatccgttatcttctactagctcctccattctcgcgattcgcgagttgcaggggaatggggaatttgggcggggtgacagtgataacgacagagtgaggctgcgtcaccgggagagagagagagagcaaggctgtgtttagtaggggaaaagaaaatttttgggtgtcacatcagacgtttgaccggatgttggaaggggttttcggacacgaatgaaaaaactaatttcagaactcgcctggaaaccgcgagacgaatcttttgagcctacttaatccgtcattagcacatgtgggttactgtagcatttatggctaatcatggcctatttaagctcaaaagattcgtcccgtgctttatcattcaaact

SEQ ID NO: 54701 - DNA, 4765 bp, Oryza sativa
attcctgcagcccagattcgtctcgcgatttatagctaaactgtgcaattggtttttctttttgtccacatttaatgctccatgcatgtgtccaaagattcgatgtaataggtgaaggggaaaacttttgggaactaaactggccccaaaggtaagggcccctttgaatcgcaggattgagaaaacgtaggaataggaaaaacgtaggattttgataggaatgtaagtgtaaaacaaaggattgcaaaacacaggaaaaatacaagaatgactgtttgattgaaccacaggaaaaacacaggaattggatgagagagatagactcaaaggaaagttagcaagaggttgaagctcttgctaaatttcctccaaaatctctataggattgtccattccataggaatttcaaaggattggataggattcaatcctttgtttcaaagggcttcataggaaatttttctataggattgaaaacctctaaaattcctatgtttttccttcaaatcaaaggggccctaaaaatgttggattgcggtatgaccggcgttgacagcgagactttattttttttaaagggtgaatagctaagagcacccgcaatggtaaagtaaggtgctctctataaaacatgtacatctcagcaataaactcgattaatagtaaaccaccttaatagtatgtctacattggtatctatagctctctcatgcattgcctcgtttttctctatagactatctctaagttagtagatagttttgctctctctctcttcatttaataccttccaagtaggaaaatatgctgacatggatctcttatagagagcctatagataaccattgtgggtgccctaatatggttcctaaagtgctttgggttcagttcaatccttgaggtttcaaatcgtccaaagaaagtcctccaaaataatcatttgtgttaatatagtccttggaccacaaaaagtgacacgtgcgtatgccaagtcatcctcatatgcagtgatataaatgaaatggccattctactcttatatactatatagaaaagaaaagaaaaaaagataaatgtctcacacatgtatgatcgttttagaattgtcacttacgattgctgcagctaaccactaatcctatcttactataaagttagtggggtccttaagcttaacatgcaaagatgtcacatcatcatccactaattaacaagatgccacatcatcatccactaacaatcatcatatttaaacatcatgcaaacaagctatatctttatagtttttataatttaagagcttttcaaatagaaacatgttaaattatcatccaacataattcacataatgtttcaatgtatatctttattatgttttatgatatcctatatacttatatagttcatcctcacttaatctgatgttatctagctatcttacacgttatttttttattattatcatactaaatttccgcagcaatgcgcggggtttcacctagttgtataaattcctttgtcggtcaccctccgcaacaatgttgggcctggactagcctgttatttttttttctatttgtgtctttttttttattgtggtatataagggtagaatggtcatttcattcatattgctacatgcgaggatgacttggcatgctcacgttgcatttttttgggcccaagggctatattaacccaaataattattttagaggacttgtttggacaatttagaacatccaggactaaattgagcccgaagcgaaacttcagggaccatattggctatttaccctttttttttaagaaattacaaacacactcgtaacgcatacactaccatatatctccaaaatactgaaccgatatattttaaaattgatggagtcatcacgaatgccttactgtcgacggaactaaaaccaataaaaagaactcacctttgaactttttttcgtaacgaaaatatggaaaagtgtcatagactcttagtgtgtcgttaaaagaatgagtccatctcataatataagggattttgcccatataatatgtcctacaattttagggatttggatcccaaaataatatactccctccgttgtagaatataagaaattttaggattggacacgcttattaagaaagtagctagaactgagtggtcgagggttgtgattgaatatatcaactgttatattagtttattttttcaccaatcaactcttgtattaacttattctccatctatcaaatcttatactattttattcttccatctatcataatttatactatgttatatccttttactatatccttaatttatgtttaaaacgacataatccttatattgtgggacagaagaaatattttactaaaacaattaatagtaccaattgaaggagctgttaatacatgtgtattcaatttaatgtttattatcagtacttgtttgagttacgcaagccactaccctcatctttaaaagacttcatttttacttatggatttgaacaatttgctcgtaccattaggaagacaatcccttaaattagccataaataataccccattcgttttaaaatataaatatttttaggatttaaaatttatacctcaataaaaatatttctacggcacttatttcaatacaagaaaagtccacacatttttaattcaaattcaaattcaatcgtaataggtgctaaacaacccttttactcactttgtttcataatatattggatatgtttttcttctgtgcaaaaaattaagaaaatagtataagtaagtcatggtacaaaagttgacaagtgagaaataaataggaaaaaaaactaatataaaagttactaaatgtttaacaaagtttcttatatttcatataaacgaaaaggcacataatctcttatactataagagggatgaagtgttttggagaactagggagggaggtaggcctagtacataactcgaaccctactcctatctccaaaattatggccttgtttagtttcctcttttttaaaaaaaaatcattagacacatgcatggaacattaaatatagataaaataaaaaaactaattgtacagtttgtatggaaaagcatgggacgaatcttttgagattaaatagtccatgattagtcctaagtgctacggtaatccacatgtgctaatgacggattaattaggcttaataaattcgtctcgtggtttctagacgagttatgaaattaggtttttttcatttgtgttcgaaaaacttttccgacatccgatcaaacttctaacgtgacacccaaaaattttctcatcccgaactaaacaagacctatgtttattcataaattctgtagaaatcagtaattttcggcttcgccactatttagatcgtagagagtaaaatcgaaaagaaaaactcggattcgcccatggttttgcacggagccattcggtacgggctcgatcgtgggaaaaatggtattgaaagcgaaaaacccaaaccatggtggtgccgacttgaatccaaccatagcatccactgcgtcgcgggctcgcggctgcctgctttggtcaactgcccacttcgaccaccgccgagagctcgaggaatggtcgggccggagctgacggtcggcgggtggttcgccggcgccgtgatctccaacttggtggcgaaggtgcggtccgccatggagcaccacgccgccctccgggccgccgccggcgacatgctgtacggcgtggaggccgcgctcccccggatcaggatcctcgtcgaggcgaccgagcgcagggccatctccagggccagcttcgccgcgtggctgcagcagttcaaggacgccgtcgccgaggccgaggacctgctcgacgacctcgagacgcggaggatccgggcggcgctcagggccaggggcagcaagctcggctccgccacgtccctcgcgctcaggttcctcaggaacctcgtcctctccgatggggatctccagaggctcaaggacgtcctggccaagctgaacaggatcaccagcgacgcgaccggcttccacgacatactgaaactggccgacgacgacgtgggggcgatgcgatcggtccttccggtgccagccaccccgccggcggtcatcggccgggacgaggagcagcagcagcttgtgaagatgattttacgccccggcgcaccgccgtgtcctcaggatggagctgaatcctgctctggtgtttctgtcatatcagttgtgggagcagctggtgtgggcaaaaccactcttgctcagctgatttacagtgatccaaacgtcaaggaggctttcctgttgaggggatgggtgtttacctctcgtagctgcagtcgaacgggtctcgaacaagatatcatcgagtcttttgcgtctgagcaagaggaaaatctgcaaagaaagtcggtttcatcagaaagcagtttgattgatgtcgtacgaaacaagaagttcttcctagtcctagatgatgtgcagcataatctgcacagccaatgggattccctaaggtcgacactggcaagaggagcaaatggcagtgttgtattgctagtatgtcaatcgaaagaagtcgcaaatagtttgggagcgacagctcaggttccaatgggttacctgccatctccagtgctctggagagtatttgagcaccatgcatttgggaatcagaaaagagcttccctcgagtcaattggtaaaaaggtgctccaaaacttgcatggattgccttt

SEQ ID NO: 54702 - DNA, 3198 bp, Oryza sativa
aggaatggtttgatgagcttttccgccgatcattctttcagcccacaatctggaaaaataggtacatcatgcctgatatgattagaaagccattatgttccattgctggaaaagaatgccatgctgctagtgagttgggagaacagaaaagacggctccaagattaccgccacctagccatcagttttcctgattttaatgtgcacctagacttgagaaaggacaacaagttgcggaccattttgctttttgatggtcgcaaaacaatcaaaccacacgaagcatttgctaatattctgtcacacctaagtggcctgcgagtattagatttctcttacagtgaagctaaattggagaaggctcctgatttcattaacaaattcacacacctaaggtttctggatctctcctttactgggatgacagtacttccagactccctctgtaagctgcacctactacaagttcttggattacgaggatgtcagttcaaggagttacctagagctataaatgagttagtgaacctccggttcttatatgcagaagctcacacggtttccttgatatacaagatagggaagcttactaatctccaagggttagatgaatttcttgttggtagaatggatgggcacaaaataacagaactaaagaacctgaatgaaatcagtggacaactatgtattggaaatctggacaaagtagcaagcacagatgtagtgagtgatgctgaattattcaaaaaaaggcacttaaagaagttggtattcagatgggggttgacagcatgcaaaccattagccgaagctgatggtttcatgagaactcttgctggcttaaaaccaaatacaaatcttgaagaactgaaaattcagtgctacatgggagttggatttccatcatggatggcggaagagcagtacttcatcaatctgcggcgcatccatcttattgaatgcaaacaattattaacacttccacctcttggacagctcccatcccttgtagttttaattcttcaaggcctaacagcaattgagaaaattggatatgaattttgtggaaaaggatacagggtatttccatctcttaaggaggtgacatttcttgatatgccaaattggaggaagtggtcaggcatagaagaactacaagatttgcaaattcctccatttccacagcttagaaaggtccaaatcaagaattgtgaggtcttaattgacatgccagtatgttgtttaaaagcgtcacttgaggagcttgagatctctggttgtaatgaaatatttgcctgtaatccaagctgtttagatagattgacttcccttgtgcgcttgaagatccaccattgtttgggcaaaatttatcttccatgtcgattgttggagtcaattgaagttttgaatctccaaagatgtgaagtttatttccagggaggtaaagaacatttaatgaaattgaggaggactgtaacaaatgatgttcatgaattgaatttggatgaatcgaaagcaatcagtacagagctgttagttcttaaactttctgaaggtatgttcaattatttctttgtccaaaattactttggacaaataatttatgaaatagtatcttttatattcctgtgtctatattattggtttagaccttggaagtatagactaaagcttctttgaattgttttatattttcagggtatcactacttgtcttcatgctttcttaacaaatggaattttgaagcatcttcagtttcctgaaacaagttggtctgatgcaaagttagcaaggatgaaagaaagtttatgctactgcttttagggcatactttagtgggttcactctcattatacaagctaaaatttgtataggtgagcttgttgaacataaggtgcttctgcagggtgatctaggaggaacatgttggattttaagaggctaaagtggaggatttaggttttgttgaatcacttcaagtaggtttttccatgttgatagccaggccggacagaacttatcaaattctagggtacttattaagcattagttcattagggatgctgattaagaattctgcttattaaggttctggctccgatcagcacttgcaacaaatgctgcacattttagtaggtaaaggtgcaaaatgtgcatcgtgttgcctccgatttgtagttatgttcattacaatgaattagagctgagaagtgcaacaaagatgaaaagtatcaagaagttgaatgaagaaggtttgctgtttgcaatccatttttttatgcattgaaaaatagtttaaacaaagtagttgctggctagctgcggactgcggtcttgttatcgtcttatcctcttatataactagtataaatttagtacaaaaaatgcctagatctgtgaatttgcactttttcactctgacaacccaactagtgctaatttggtctagattccttcatctgtgaaagtgtgaatctgcccttctctgacgagcattttttttttttgagcaaagggcagagccctccatttccattaaagaaacgcatgagttcttacaaaaaaaggagtcttggaaaaccagaggggaagaacccccaggtgctcacaaaagaaacaaaaacaaaacgaaagccagctagcacaggccttagagtttaagctatctctccacaactcatctcatttctctccaattcaccattgtgtcctcaactaccagctaatcttctttgcctgatgcgccatccgaactgcgagttgaagacctcatttgccacttgttttagcagttgtgctccccattgcaaccttccttgtctttcccccgaattctgcaaaacagcccaatccgacaaaaaggaacaagcattgtatataatgtcagttgggttatttggtaagatttgatcaaaacaagccttatttcttgctttccaaatgcccaaattatagcagccacaccaactagcattagttgttttgtaatttgtcacaaggttgaatccaggaacttaaagcatgtctcaagtctttaatctgattcataccaaaagcacaaatcacaacattccaagtgaatctaactaagggacggtcaaaaaataaatgttgaattgtttcttctgacgagcatattactgttgatttattgcctagatgcatagattagtgaatttgcccacatctggcttcacat

SEQ ID NO: 54703 - DNA, 32788 bp, Oryza sativa
cgatcctcagcccacgcaaaacctgccatccaacaggcaaggttaaatggaaagggaggcgagagcatttcgtcgagcgattggtgggcacggctcacctgccgcgtcggagccggagaggcaaccgcaaggaagtggagccgtgccactgcccacccccgacgcttgcgccgagtgcacctacccacgcgccgtcggactaccgaagtaagccgcccgccatccaccggacgactcctcgctccatcccgccatcgccgccttttagaagagagtcccggtgttctctgccagtagaaatctaaatttatatctagttttatttaggataccacctattaataatagaaatatgaaagggcataactgttaaataaaatatgaacgcggaaagctaaatttgtactactcttttgaaaactagcaatgcacaagtaaggatcttctaccctaatgttattatcattacagtcattaatatgtgtgtcatatttttttattgtactacatgtcagtttctgtaatgataataccattatattgcaggatgtgaatccacaatgtatgaacaccatccactcccctcgatcggagccgtcgtcaccgccgccgacgccatccattccttcccaatctccaattgcagtcgccgcctcgttgcttcgtttcctccggacaagggccatggaattggccggcgcatcgccacccacctggtctagtggtcttggtcagagttctgaggttttcttgtcacgcatgtgttagctcctagctaacctgcaaattagaattccactggcctcctcatccgccgtcgtcccgcctctgggccgaacgcgaattacgcacaagcatgcgttgtgtgcgtccgtgtacatgcatggtactaggatagatctggtaaaatctcctaccagaagaaatgaccattgtcaggtgcaggagaagcacagccaaccacaggtcatgttcagaactatctcattttgcaagctgaaacatgaaaattgaggttgaacaagcatctcgcttacaaatcataccattgaacttgcacaataacatagactacaaacaaagtactaactgattgcaggtactaaactgctattaactgataatacattatctaaagaaaagtaactgataataatctagaccacaaacgactgaggtggtgtttggatacatagactaaactttagtctctatcacattgaatatttagacattaatttggagtattaaacatagattacttacaaaactaattacataaatgagagctaattcgtgtgataaattttttaagcctaattaatctataattagcacatatttactgtagtattacatatgctaattatggattaattaatctcaatagatttgtctcgtgaattagtccagggttatggaatgagtttttgttaatagtctatgtttaacactctaattagtgtcaaacatccgacgtgacatgactaaaaatccgatccaaacagcccctgaatatcctcgaactagctttgcactagcactgggaagccgacgctgaggcagacgtcaggtgggacgccgagacggggaggtcctcaccgttgccgtggtgacgatgtcgccgcagggcctccgccgcagtcatcttatcgcgatgtccttcgccgcgtccgcgtcctcgccactggcctcctccgcgatcggctgactaccactgtcgtaccaagctagcacagccttaccgcctgctagctacatgcgcgggcctggccgcctcgactggcccaaccagcccaatcccttcggctctccgtcgactacctctccgcgctattgttcaaccccctcgccctcaccatgtggaagtccgtcggcgtgtctccacctggtcgatccctccgtgtcaacccccagcagcatcaacctccaccctatcgaggcaggcgcaccttctgtttgaccacgtgcgggaggacaccgcgacaagatgacggccgtggaggctctacggcagcatcgtggacgggaacctaacatggaggtagcagaaatcgaacaaggatcgaaccggaggatggtgatcgaatgatcgataaggtccggagagggcggcggagcaggggcgaaggcaggccagctgacgaagacagtcccggttaactgggctcggccctggctgctgcacagccaccgcggcagatctggggccggcaagcccgcgcccttgaggccttgagtagttgagtcttcttgagtctctcgactcttccgaggacgccgagctgatgagtcttcaccaaatatcttttttttttcttttggagaaaacaacttatatgtccaatatgatataatcatagaactatcatatagtgtaatgtacggaatttcagctcaactcgttataatgaagataaatttattcatgaactggtatcagttttttaaagataggtgacctatgaatttgtatttttttccccttactccttccgtcccccccccaaaaaaaaaaaaacaaaggccaatatggacagacctctctatttctaggttggctcttttttttttttggacggatgcagtatatgttttcaattgaaactagcatggttgcgcgggccagtattattatattttctctcgtataataatatatatatatatatatatatattctcaatgtattatttaaatatattaaattcacaacataattttaaattttgtactacctttacgaaactactaatgtataatattcatattgtattttatatacgtattagttattaattatttgtaatatcaaattttagttatttgtaaattatattcctatatggattctatactcgtctttcaattttttttaatttcgaattttcgttatctatatagactctaggctcttcttccaatattatttatttttaattctgatttttattacttctaattgtatttctacgtgtactctaaactcatctttaaatattctttaattttaaattttgaaatttagttatttgtaaattgtatttttatatgaattctaaactctacttttaattttattatgtttattctaaattttatacgtgtactctaaactcatctttcaatattctttaattttaaattttaaaatttagttatttgtaaattgtatttttatatgaattctaaactctacttttaattttattatgtttattctaaattttagttagttttaaattcttatatggactctatattaatgctgaatttctattatttcttaattgtatttctatatagattctagtctactcttccaatatttcttattttttaattccgaatttcaactagttctaaattgtatttctatatagactctgttttttctttttctccgattaatatgagaatttgtaggccatgagagcgaacgtggaggctcctttttctattcctttaataagttaataaatacgattacaacatgctatcgatttcaatgattatttaaaataaaaattaatcatcaaattgagctaaataaaattttatcaaagtaaatactttgtgtccaagtatttttagaaattttcttgaaattatttgagcactagaagtatttttcaaactttagaagatcattttgaggattaatttaatcagagaagtaattaaaactccctctcctttcgggtcagaactggaaaagtatgcttttcgtccctcctccaaccgacctagtcgcctcctctccctcccaaaagtccagccggcttccctcagcccctcctctctctggcgtttgggccccacacccacagtgcgtcgtctttaagctcgggatggagtccttatagcacccgaccccatctccaggcaatccgactcgattcggcctctctattgcttatcctctaaaattgatcacggaaaccaaatccccttgatctcctttcctttttccctcaactaatttcgaaaaatcttgaggatttgggagaatgaagaccctgatcggtgaaccaatccatgtgtactactaacaactaatgtactagtaccactgctctatcttttgctccaacaatacatatatatatataagaccaagcagcccaccccctgcgtgggccacgaatacggagaacaattttactaaaatgatgcaaagcctagatattatttcctggaacgtgagggggctcaattcggctgcgcgctgtaacacgatccatgagcttatggcagacacgaagtgcagcttggcatgcttccaagagacaaagctacagaatatagatgacggtctcgcccactttttaggaggctacaagctcgacaaatttgcctttaagccagcaagaggcacgagaggggggatcctcctcttatggaatagcgcagtctttgacgtccaagaggtccgagtcggccgcttcttgatttcggcgcaagtgacggtcatactcacaggggccacatttctgctcaccggagtttatgggcccacaaggcaccacctcaaaagcgccttccttcggcacatcagaagaataaggcccggccccgaggatggatggcttatccttggagattttaacatgatctatcgagcaagggacaaaaacaacagcaacgtcaaccttgcacgcatgagacgctttcgctcaacaatcgatcgatgtgaactgcatgagattcccttgcaaaataggaagttcacctggagcaatgaacgacgaagggctacacttgttaagttagatcgctacttttgcaacgagacttgggacttggccttcccccaccatgtccttcacgccctacccacagggccttctgaccactgccctctagtcctctccgacccccaatgtccatgtaggccgagtgccttcaagtttgagaacttctggacaagaattccaggattcaaagacaaggtcaaggatgcctggtgtcagccttcgtcacacacagagcctatgcaccacctaaatgaaaagcttcatcgcaccgcgacctgtcttagagaatgggcaaaaggaatctgcaccgaggccaaactgcagtttcacatggcggtcgacgtcattaaaagactagatgtggcacaagaacatagagacctctctgcccaggaaacaagactaagagcagccctcaagcgtaagatccttggcctcgcttccattgagcgggcaaggaaaaagcaagcctccagagtaacacatatccgtgagggagatgcgaacacaaagttttttcatctcaaaatgaatgcgcgaagaagaaagaacaccattcatcggctgaaaaaaagacaatggttgggctgtgacacatgaggagaaggaagcaacgatccatgaccattttgcgagcataatggagcggccggcgccaagaccaaatgagctaaattgggatgcccttgacatctcactgattgacctagccaccctaggggagcccttctctgaacaggaagtacatcaagcaatcaaggaaatgccaagtgacaaagctccagggccagacggcttcaccaggattttctttaaagtctgctgggaaatcataaaggaggacgtccttctggtcttcaactccatttacaatctcagatgtgcacacctgaatctgatcaactctgcgaacatcgtcctaattccaaaaaaagagggggccgagggcgtttcagacttcaggccaatcagcctaatccacagtatcgctaagatcttctccaagatgcttgcgttgcgactaaggcctcatatgcacagcttgatttcgatcaaccaaagtgccttcataaaagggagaagcatacatgacaacttcctcttcgtgagaaacatgaccagaagataccatcgattgaggcgggcgatgctgctattcaagttagacataactaaggcctttgattcagttcactgggattacctgctagccttgctgcagcgaaggggtttcccaacaaagtggatagattggctgggggctttgctatcaacttccacctcccaagtacttctcaacggcttgccagggcagcggatcaagcacggaaggggccttaggcagggggaccccctatcgccactccttttcatacttgcgattgacccccttcagcgaatccttttcaaggctatagagctcggcgcaatctcaaaaattcgggggagaacaactaggctaaggatctcaatgtacgcagacgacgccatcatcttcattaatcccacccgaggcgatgttacggccttcacggacatcctgcagcacttcggcactgcaactgggctcgtcaccaattttcagaaatcccaagtggcggccatcagatgcggcggcatcgagttgaatgaggttcttgagggcgtccctgtggtgagggcaaatttccccatcaagtacttgggcctccccctagctctgggaagactgcggaaggtggacttgcaacctgtctttgacaaaatttccagaagggtagcaagctggagaggaaaaaacatggcagcggctggaagaactacgctcatcaaatctgtgctaacggcgcaaccaatctaccttctgaccgctctgaaaatcacaaaggaatccctcgagcagctagacaagcagcggcgccgcttcctctgggcaggcacgggtgatattaccggagggaaatgcaaggtcaattggacaaagacgtgcatgccgaccagccaaggaggattgggggtcctaaatctggacaaattcacgagggccttgaggttgagatggctgtggcatgaatggaaggaccagaccaaaccttgggtggggctggagacgccatgtgatgaaatagataggaacctcttcgccgcctcaacaaacataacaataagggacggaaacacggtgcgattttgggagtctgcgtggattggtgggtgaagacccaaagacctcatgccacttgtctttgcgatctcaaaaaacagaggaaaatcccttcggcaaggaaagaaggaggacgcctgggtgcaagatttgaagcttgattcacaatcatctatcacagtcgacctcgtcgaacagctagtcgcactgtgggaagcggtccgaaatgtgcacttagacgttggagaaccggatcagattacttggaagttcacaaacaacgggcactacacggcctcctcggcttaccatgcgcagtgctgcggggcgccgagtacaaacttcaattccttgatttggaaagcctgggcgccggggaaatgcaaatttcatgcttggctcatcattcagaacagagtctggacttcagaccggcttgcgaccaggggatggcagaacaatggttgttgccctctttgccgccgcgagactgagacggcattgcacctcgttgccacttgtagatacaccaagaggatctggcacctcgtctctgcatgggtgggctatcagcagatggacccaacggaatgggaggaagcccggtcagtcaaacagtggtgggagaacattgcaaacacgcctagtgtcccgaaaaaaggacttcgatcgctcattctgttagtcgtctgggaaatttggaaagagaggaatcggcggatttttgatcacaaagaggtggcaacgaacttcctactaatgaaaatcaaagaggaggcgagcctttgggctttagcaggagctaagcggttgcgtgagttaatcctgcactctgtatagtgtactagtgtacagctatagtggttctccgttttccttttacccttaggggtttgtattttctcctgctctattcaatgaaaaggcactctagtgctgttttccgttcaaaaaaaatgtttttcttataactacttatctgatctacgatccaactacaacattctatttgtttgaatctttataacaccaaatccacgcctagatctagcagggaggcggtcggaggcggggtcggcggcgggcgaggtctgtctccgcatcggctggatctggctggtcgacgacacacggcggcgggagctcctatggatgtgacagccggtgctgtgggcgacggaggaagcggctggcggcgatgatgcgacggcgtggaggcacgtgcgacggcgtggaggccctggagaccgcgccagtggtggggagagggggataggaggccacgtcagcggcggaggtggcgccatgcgcgtgcgctggtggctgcggttggccggagaggtagaggctcggccgacagctcgcgacggcagaggtagcaccggcttgccgaaggagttgcggctggcagccgtgcagcgcgagtaggcatggccggcggcgttgaggacggccggcgcgtgatggatgcacagcgggaggtgatgttggcggaggcggagcccggtgaggtggctgcacgcggagactggctggtggggggcgccggtgcagtgtgcccacacaccggcggagtttttgatggcggtggagcaatggagttttcagtggtagattggcaggtggtgaacggcgggtgaaaacttaggacagcctcggccatactgacaatcaatggcgcttaaatgacattcccctcctgagggcattgtcgtgctgtcacaccctaatctggcaccaccgtacaacggcacctgataggagcgtgtcgtaggaaaaacggcgcgaaccgcttcctacgaaaccgcgatcacagtaccagtctcaggacatagcgctggtacccacagtgacaaatatgaaacattgcaatccttaaatttaatagaggacttatttaccttaacttaggttgcagcgcaggacagcctgagaatataaccgacgatgcggacgaggaaacaccaacagcagcagcagcagcggaaccaacgaactaacacccaacaccacaggcgacggctgggaaccaggacgaaaccctaatcttcaattcacttcatcgtcacttcaaggcagaggaactatatatatttatatagagcaagggtgagtactttcgtactcagcaagtcacgggaatttaggtgtttgatgcaagcttggaagagaggcaaggttgttttgcaaatcctttattttgaaatcattttgaaatcactaagtggtttacttctttctaagtttgggccgaaaagagacttgcgtctcgattcgactttaagagatgtttttcaacaactcattaggtaatgtaccgacctcccaggtcagatcattacttctcggctcccagagccatttcacttgattagtcggctcccagagcctttttcattttctgggactcctagagcccagctgcccagcagcacaacaatccgcttccactcgggaagcctagtctatgatgcccgtaaacatcccgaatcacacagattcgtttcttgaccactcaggttatccatctgccacataagctgattctggtaacgattcccaaaccacaacaacttttcacaaagcacagacaaacaaatctacgctacaggaaacacctcacatccgcccatgaccatgggcacggctgttcgaacagttgcggcatatgcagctgcgcaatatacaggcatatgcatgagatcaatctacatgcatacgaggacaaggactagcatgggagaaaaggaaacactacatgcatgcttcgatgcctgctagtaattaattagcacaactaataaccagaacccacagagttttggtctgtactctgtaattgattggatctgtgacttagcagtgttgtgcatatgcctgaccgattgatccgcacgcttcttgccttttgggggtaaaatttgtgcacaccatcggtgaatatattctacgtgttcaattcaaactgttgagaatctcatcgggttgatgatcagatcaaatggatatatatctgtttctgctttatatgagaatgagatagtgcatttggatagtaaagatgggcaataatgagctcatttttttactcagcgcacttctttttcctcaatataatatcaatactgatggtccattttctgctaaaagtatacctcagtagcatggccattaaaattttctttcctttgcaatggactatggcataaacataactgcatagctgcatatgcatgtcttatgaagtaattaaaaataactgatccagccatgaacaacaatgccttatgcgctgccataatttatgatccagcattagatctgagctaggaggtaatatctgaacatcacttctgctatttgatgaacatcatattttcatcatatatactttctttttccagatttcctggtatatattcacatatataaattgtgtagattttagtagatcttttcagttagagcatgaaaaatatcatggtttttagatggctgttgtaggtccaatgcttctcttacaacaaaagaaacctgctatatattcacatatataattgttatagcttcatgaagaagaaatcaaggctgtaggatgacgacgttgctgtgtaagaatcgtgaagaagaaatcaaggctacaggatgatgttgctgtgtaattaagagtcatgagagaacatgttgatataaagggggagaattttcaacaccttgctgcaaaaataaatttgaaggttcatattaccgtgacttgccttcattgcaatggcttttgtctctctttttttatttttttttactgaagtactcatttttcactcctgtttgcttttgttaagttccgccaccgtatagaactaattaagacacgtggttcaatatctggaactaatttgtaaatattttgtggaatgtcgtaaacatgagccaagcttttaatatttgtggccattaggatttgaactctggtgggtagagtcatgcacccaccactctaccaccacactactagtgctttcccacactactacaaaaaccatttttcgtggcggctattttgggctttcgcttgcggcatttggcgctgccacaaagcaaaggccagtgaaaatgtagcatcttcgctgacggcgataaaccgctaaaggagataacttttcgctggcagctagctaaagacagccgctagagaaaatcatcttcactggcggctgccttatgtgggccgccagcaaaaatagccttcgatggcggctgccttatgtgctcctccagcaaaaaatagtcttcgctggcggcttcattatgtgggccgccagtgaaaattattttccataaaaaaaactaatccccaaaatctctttttgccaaaaaaaaagaaaataaatcagattttcgcagcatgtacggattcaaatccacatccaaattttcgagcatcgattcaaatcctcatccagagttcattagattcaattaacatggaagtgagcacagcatacaagcattttgaacatgaaaataaaaagaaaaacagcatcaatagaaaagaggaaggaggttgtcggcgccgtcgccgaccgagcagcccagccactagcgagaccgtgggggggagggggaggagctcgccacgccccctgtcgccattgtcgtcccgtcatcgcgcccccgcccctcgtcgctgttgccatcccatcgtcgtcgtgcccccacgacagctcctcccgttgccgctgtgcatagtgtgtcttacctagtagtagtaggaatactttaatccctattgcctcctcttctaccacattgtggatgcctcgtgccattgatcccatggatactagtacgagctgtccgtgtaggttgccttcttatatattagtatattcatgtgatagaggttgcgagcgcagtaaaggagctagagcaaattagaggatgtgcaccactattttggtattagagtactcaacggtaataaaataagtacatctattaatttttaacatcgataatttgatataagcaacgcaaataataatgtaagaaataaaattatagcgatgaaagtgattatcaaaatgggaaacccaaatgataatattagttagtatagtttagtgaaaaagacaatagaaatcacaaataaatggttacccaaactgaaaaactatacaatttgacatcattgtcttagaaaaaacatagtttaatgttaaaaaaagggaatatccaataagataaatacgatatatttaatttgtttattatatatatattactgatagctcaattacatgtctatataaatattacatattttaaaccgtgtggctagtaacacaaaatcaatgtagcgagtgaggagacggcaatgctaaatattcgcccccatacttaccgcattaaccacttaggtaggatacataacttcgagtcatgttacaatattatacctcgtcatattatttatccttattagatctcgccatattatctacccttattagatctgacataatcattcgatcttgattcgatcagtagaggtgacacaatcattcgatcaatagaggtgacacagtaaaatagacggtagtggcggcggttgaggagtcggcagaacacctaggcatccatgggctttggccgcggtatgtgccgttcgttaaatgttaaatgttgtgtgtcacctacaccatagctgcgacgacttctattgcagtgaagatcagcgtgcccttttataaccgtttaataagattaaattattacagtctttaataagattatctcaatttgtattaaattattacattaacatatattgtcccaaaatgtagatatttttgaggtgaccatgagtattaagaaaattggtgaaaataattagaggaaagttgtgattggttaagaagaggaagtaggtgaggaaattaaatgaaaattggtgaaaatgattggaggaaggttgtgattggttaagaagagcaagtaggcgaggaaattaaatgaagaatgattacgattagttgagatctaatcacaatcaaattctgttgacgcacgtgaaaactaggcaataaagttataacaccgagcattttgataaattactttgctcaaactgggacctaacatcaccagcagtaaatttttgaaataacattcatctataagcaaaattacttccaaacatcactttggtcgttgatgttaaaaagaagcaaaattattttcaaaagcattgtttcaattgctgttaaaaatataaaaaaaaacttttttttggttcacacctactcacctgaggtacgttttatcaacttatcatttaatgcttttttagtgagcaacaactgtaaacagtaggctgtattgatataaacataaccattattgggttgagatgtcaaattctgtatgttctcttcaaaaaaaatatgtatgttgcattctgtattaaaggagtgtgttcttatctgagatgttaagttcttcaattttttgttcagtatgggagttttcacagcagatggttaatggtttcaaatttttggggtattttacaggtgtttgatggctatggttatacatatgaagtatgaaggtccatggttgatgcttggttgacttccccagcagcatccacaatgtaatcaggagtgcattttggcaggtaagttctatagcaagtatctcaaaatgttattctggtggtactcataagattcagagggtttgacctcagggaccataggatatgtcccttgtgctgccgcatccaccgtgagggggagaagggagggccaagcaggaggagagcgggcatggcctggtttcacgacagacgccaggaagaaggaggttggagggcgaaagggtttatgatggccgcaacttgatgccttagcgacagctcaagcagtgtgatggtggtgtcatggcctccagatctggagcgaggaggttgtggtggcgcctcgggttctgaccttctgtaagctccttctgcccatgtaaagtttatgtaaagttctctcttgtgtgatgtctattcaggtcctcctccccatgattctttgtgactgtgttggatccactcatttttgttaaagattgattctgttggccgtgttaagatttattcgaggcacaggctcttgcttcagtttatgtgatgcagaatgttggagaaacaagaatcagggtcctccctccagggccctggtgtgtcgttggctgtatatttatgcaatcgatttggcctaacaaaataataacgtaatatgatataaaatgtgttcccattgcaacgcatgagtgaaatttcacatggtattcaagaattcaaatttgaaatagtaatatcgatctaaatttgataaaaaaatgtatcaaaatttggtgaaaaatgtcatatagctcagggttggcgtatgacctaaatcgaaaaggtgtacctcggctacaaaggcttagttgtgtctggattatccaaaattaatcatgccatataattcatttaatactttatatcttttaatttgtaaacaaaatatcatttggtaacaaaatactagctcagtagctctcagggctcatatttatctttgatgaatcatgaaagggctatcggcggggtaaatatcgagctttgaacatgatttcttttgattcccgttgcaatgcacgggcacacaactagtaaaaggtaatatcttgaatgttcttatttatcttaatttattgattgtattgtactttttatgtgattaaaatatataaatataatacgtgccgtgtttggttgtacttatcgagcgaacatatccgccccatcttttttataaagctgcgtccgccactgactagggagagaggaagcctatgcacacgtggctgggtgactggagaggaagcggatgtgcgcgtggcagagagaaagaggaagcagatgcagatctattgggttcgatggcggtggtgggtaaatttacataaaatttgtaaaggtagtgggtctttagctacccaataatatataaaaaaagcatgtttagaggagattgccagattatacttttctagtttatatattatgataatctatcataataatctacttgtttgttttagattattgcgaataattcatattataataatcctaagctgaaaaaaaatactcttagaattaaaacgacaagtaatttaaaatggaggaagtgctacttcaatatgaatatatgttctaccctaaaaaaaatgaatatatgttcgatgcccagacctgtgtgctgcaaagattaattttgctaactacgaaatcatcatctattcatcgcgagcactcgttgatgcattgtgggctgtgcgacgacgaggacgacgtgttcgtccgcgtcagcgaagccttggttgtttcgcctgccataccgtctgattgacaagcgccgccatccctgcattgcgatgcagctgttccgtcgccgtcgccggccacgccgtcctcgtcgtcgtcgtcgaagagttctccgccttggacgtacacgccggcgagcctcccgacggcgagctccatcctgaccttgttcctggcgtcggaacgcagccaccctgtcaccacctccgccgccgccctgcaccgccgccgccgccacggccacggcgccgcccagcaccaccgcgccgccttcttctccgcctcgacggccgcctccatctccccgacgaggtcctccagctcgttcgtcgccccgtccagccgcagcttccactccaaccgcgccacccgcacgtcggggtcgtcgtcgtcgccgccctcgccgcgcccgccgccgccgagcgggagcgcgcggagctgcgcctccacgatgtccagcgccagcagcgcggactcgtacctggcgtagtcgtcgccgaggaaggcgcgcagcttcctcgccgccgccgcgatcgcggcggacaccagcgcgccgaggtcgtcgcccggcggagaaggagaaggagaagccatgtcgctccggtcgctcgtccgtcgtcgcggcaaaccacctgccgattccggccttgactttgatttatagcagcggcatatgcaggggtgagtgcacgtgcacctgcgcgcgtgcacgtagtacgtgtccgagctggttgctgatgtgatccacttccaccatgtttcggactcgatgatgggccgcgcgaggggggcggagtagtgggcttgatgggctgcgcgctacagattgggctggcttggtgcgcgttgtgagaggcccagttcggcttaggttctatctatcgaataagatcactttgggtccctctatttgtcgcccagtccgattttcgtcccttgaccacaaaacccgggtatgacccgtcccccaacttacgaaaaccgggtaaacgtggtccctcggcggttttgaaggtggttttggctgacgtggcgtctacgtggcttgtttgacttggttttcgtcccacgtgccattgacgtggcgcttacgtggcaattatatctcggaaaaataataaaaagcgtggccccacatgtcagctgcacaaacaaaaatagtttttaaatggtggggcccacatgggccccacatgtcagcctaattcatctcttcttccctctcccttctctctcttctttcctttccccctctctctctctttttctccttcccaggcaggggacggcgcgggtgggcggcggagcaggcgagctccggcggcagcggcgggcgtggtcggcgccgccccccaaccggagcgccggcggtccgcgtgaaggcaggtccggccgtccggggaggtccggcagccggtgctacggcggcggcggccggcggcgggagcactgggcgggcagatgaacggggcggcagcgggcagagcggcggcacgaagccgaaggagtgccagcctcgtcatcgtcttcttccggcgcatagtcgtggagcggcgggcggagggcggagcagatgggcggttggtggagcgacgacgggcggagggcggagcagatgggcggttggtggagcgacgacgggcggcgggcggcgtggcgagagcgctgcgagggaggaggcgaacttgtcggggcggccggcgggagaagaggccgcgcgcgccggtcgatgggagtgagggggaggagcgggggtcggtagccggcgggagtcggcggtgcgacgggcggcgggcggcgtggcgagagcgctgcgagggaggaggcgaacttgtcggggcggccggcgggagaagaggccgcgcgcgccggtcgatgggagtgagggggaggagcgggggtcggtagccggcgggagtcggcggtgcgcgggggtcaacggttagcggaggtggccggaggaggtcaccggcgagcgcgggctccacgtcgtcggctgctccgcccgagatgcccagcagaacggcgccgcccctcctcgctcggtcgccgagcgccgcctccctcctcgcttgggtgccgcccgccgcctctcctcgcccggccgccgccgccgacgtcctcgatggtcacatccgggttggagccctccctcctcgcccggtcgccgagcgtcgcctccctccttgcccggccgccgtgcgccgcctccctgctcgcccggctgccgcgagcggcccctcctctcgcccggccgccgcgcgccgcctccctcatcgcccggccgtcgtgcaccgctccgcccatcgcccccgctgcgccgccgctcaccactgtaagggagagagagggggatagagagtagagggggctgacatgtgggaccacaggggccccaccttttcttattatttttgtgtagctgacatgtaggtcccacatttttttattattttcttaagatcctattgccacgtaagcgccacgtcaatgccacgtgggacaagaccaagtcaaagggaaccacgtaggcgccacatcatccaaaaccgggcacaatactgtcaagggaccttttttgcatggttttgtaagttgagagacccgtcatacccggttttgcgaccgagggacgaaaatcggactgggcgacaaatagagggacctaatgtgaatttattcctctatctattccccgggaagggttttttttattaattaccaggaaaaaaatacccgtgtgttgtaacgggtgaaggttattttaatcttattattgttatacggtttagttaaggtgaaattcactatgggaattcgcctggatatatactttttttagaaaatcatgatcaatttagcatgcgattaggagtccaatcgtctcaatttagcatgcgaattttttttaagagatttcttatacgactcctatattttcaaaagcgaacggatttaaaaactgactcaaatacgaacatgtatttgcaaaagtgaacgaacttaaaaaccgactcatacacggatgacgtaccaaattacctgtaaaaacatttttaatttttataatagtagagatttcggcgatttttttggtctgtgattcgaattgtaatatgttgttactcctccgttttatatcatattagttttgacttttttcacgtttaatcaagtttatagaaaaatttagcaatatctgcagcaccatatattagtttagataaatgtaatattgaatagtatattttaggcaatatatttgttttatgttaaaaatattgctatatttttatacaaacttaattaatcttaaaaaattctaaaaatattaaaacaatttatataatatgaaacggaggaagtgattatttaattaattaatcccctcttaagtaagcagcggcgaagccatacaaaagtagtaactaaggctgtgttctttgctcagtgttctccaacccctctctctctcgtattcctcgcgcacgctttttaaactgttaaatggtgcgttttttttaagaaaaagttcctatacaaaagttgcataaaaaattatattgatcatttttttttagaaaaaaggctaatacttaattaatcacgcgctaatggatcgttccgtttttcgtgcggatggaatgagttcccaacctacatgaacaaacgcagcctaagttttgtctaaaatggagtgatcgaatagtactactagttattctgaaattttctgaaatgaaattcgaataaagtttcaataatgaaatgggcgttattagcagtactccactaccgcttgccatgcacgaacggtgcttctacgtactactagcctttacactttccacttctcaagttttcaccctcgtccctcagacttgatgaattttttttagaaataatattattttaatagaaaaatataaaagtagaagctgatcggctaaaattacaagtttaatgccttgtcgaacatccacagttcaacaggggtacatacagaggcgggcccagagggtagtccaggtaggcccaggactaccctagaatttggcccagaaaggagcatatattcattttttatggcccataaacaaagtctggcccaacaaaaaaccctaactttcctactagcctcctcccggactcccagtcacacgcgcatgcgccgtcgctccgacgcctgatgccgccgccaccgctcccgtgtcccgtgaggccgcgacggcgcaacggcgctctgcccctcgcgcggcggccagccggcccccttcccgagtcctgacggcgccgcgacggtgcactgcccctcgcgccggcggccggcctgctcgccttcccgagtcccgacagcgccgtgacagtgcagcggagctctgcccctcgcgccggcggccggcctgcccgccttcccgagtcccaactcgcgccatcgcggtcgcaccgcctcctgcctcctcgacgcgcatcggcgcgcgcgccctacctcggccgccggcacccgccgcccggccggcatcccacatccggcggccctccccctccggtgagcactgcgccactgcttctctggcagtccggctctcctctccctcagtccctctactctcccccttccagtagtcagcaggcagtactacctccttctataatcaagttctttatatccatgattagctaattggggatatagtaatttgtatagattaccacgaaattgtgcgccgcaatgaacctcatatggcatttttgcatggtgtgatggttgttaggagattgaggaatgaagaagtcgagcattgtatttctttttcagaagcatgaagcaaaaaaagttgcatcttgtgatctaccaatcccacctatttgttattttctacttgtattgaaccatttagagttatatacccgtatcgtttaccagattttatatcgaatcatgatgtattgcatttagatttttttcgctaggcctaccctgggttcaaatcctgggtccgccactaggtacatatcgaacaaccacaattcgacagagtacttgttgaactgcggttgtttaacagggaataaaaaaatatcttaccgaactgcccctgttcgacaggggataaaaagtgatagaaaaaaaaggagatcaatcagtgcgcactgtacactaccgtgcatgcagatctatgttcgataggcccctgccatgctctttcttgtcctttttctattttttaagtgaacaacaatcctgtcgaacaactgcagttcgacaggtacatgtcgagctgttcgacaggtgttaaatttgtaattttagccgatcaatttctacttttacaatttttctattaaaataatattattttaaaaaattctaaggtgtccatcttcttcttctttttttttcacagttcaaggtgtccgtcttgggaaactattctaatccctcgaggggatgttccctcgtttgctcaaaaaccatctaaacaattatgaaaaattttggaaaaatttgacaacattcatacaacacatatatataactccacaaaatcttaagtccaaactcaactcacacgtcgagatataaaaaagacaaattcagcatatgaatagtagcgtactgtttatatataaatttatcttttttgtttctcaatgtgtagatcgaatttgaacatgaattttggtggactagtaggtatcattatactctacattgtcaatttttttcagaatttttcacaactatttgcatcgaatttagaagaaaaagatatacgagggatgtcccatcgagggattagaatccactcccgtccgtcttggcaagtaattaaaccgtactccacacgtggcaatgtttggaattaccatagcgccatgcatgcaagggcgcccaagtcgtctccactaactctacgtgaaaaccaaataacgcaacgaatgtgatgcgattaaaaacgacagcaatctgctcgtgcaatttaattaattaacgagattgatcaattgatcgttgcttcttctaggcagagtgtatatatattaatggtccatgtggagcaacttgaactgcaattggtaattaagatcaataaaaccatcgccttctgaggacaagtctaataaaagagtaattaagcagccatctattagatgcttacatgttatttttatataattaaagataatataaaaattaaccgagccattattttttttctcgacgtgggccaagccttggttctctctcgtaggctatctaccaatcacagatgatcttttcatgtgggcccaccttaattatctctcacctaatttttttcaccaatcaatttagtcgaccccttctctatctccactccctctttcttctagcaatgcaaaataagttgatatcaacggctaatagtaggcatattttccctattacacttgccctaacagatcaggataattttctaacggagaaaatacgtcaaaaattttattttttgagcgaatagaaaaattaatacgtcaaatttgtgactgataccgacaagtgactactgatattttatgctaaggccagctatagcaggaaacagctagagagagaagaattctcgtcgcatacgacattggaaatgaaatggaataatggaagaagctccgcaggttcatgggattgatgactaccagagaggcacggaaacaccaccggttcttgctgttgaattccaagcacatgctttctagaattccagaaccccatgagagcccagttaagttgagttgatctcgacgacgacgacgacttctgttgatcgagataaaacggttgggagatattccgagattgagtagtattcaaagctattgatatgctgatttttcgtctttgaccaccttgggttacttggaaaagtattggggtttcatctactagctaggttgtttgttttagtaggagtagtactgtagtagctaacttggtggctacgcagggcatatatgcatgttgctagaagatgattagtgtgtacacacgttttaacgaaattaattgtgcaaattaacgaagatcatcacttcattagtactccagtagtttataatcaatagagtaactattggtttctaacgagacaaaatactcaatgttttaaagcaaagagagtactgtattatattttctctcgttgaaaaacagtcacaaagttgtttttgatgcgctcacgtgacacgtgtgcactttgcatcccgttcgttgtatccgaaaccctctgaacacgcatcatgtctggaacaatcattgactaatctttccgattaccttggggatcaccacccgcgtagccgcctagctctgaaccccagcagtagttgaatcgagtcattgctttatgatgcactgccgtcatctatgtatcttttagggtggtcaaagtaaacaagttctgtcgttgaataaatatatactgctgtccagttaactgtaatccttccgtttcagattataagtcgttttaactttggtcaaagttaaactactttaaattcaactacatataataacctagaaccagataagacgtatcccagtacttgcatattcgtagtactagaatacgttctatccgattctagtttgctatattttgggatggagggaatataacctaggtacacagccaatggataattgacaaaaagaatcctataaataagaagaaaatgtatctaccggaaaacatatcatttctaaatagtcactgctaaaaaacgattttccaagaggccaaaagtggttttcgcgtgcggacctccggtccgtctacccgaaaaggtctgcgaaaatccaaattttccgtgcaagtggcacacccgcacgcgaaaattagtttttcgcgtgttgatgcttatgttgcccgcacgcgaaaacaaaaatacgaaaaaaaataaaaatcgcaaaaattgagctgctgtcgtcctcccgctgccaccgacaggctcctctcgccgccgcggccgtgctcctcccgacaccgccgcccactggatctgcatgggggatagccggcagcccgttgcccaccaccgcgcgccccatgctgccttcgtcgctctcctgttggctgccgcgcgcgccagcctctacagccgtcaccccacgccacccttcctgataacaatctggcccaggtggggtcggccgaggcccaacaaattaaggttgcccggaccccaacaattctttggcacacccactcggggaaaggcccaatctccctaaaagactagttcaataggggaagggtggctctcccttttaaggtggcttcctcctcccaagctaagtaaggtgggattattcagttcagaggctcacacggtcgccgcccgactttgtcgtctttgccagtggataatagtggaggatgtcctcatcacttctgccggccactgcgtgcctctgccgccgtcaccccacgccaccttcaccgtccttccgccggccgctgcgcgccagcctcttctgccgtcacccctcgtcgcctgcactgcccttccgccggccgccgccactctcccggataggagagtttgagagagggagagagagagagagaaagaggagaaagtaagagacaaatgagagtggggataaggatgagtaggtgagagagatggagaggataaggatgaaaattttgaagtgatgggaggaaaaaatctagagaggagggagggtattttcgcgtgcggttctctcaagaggtccgcatgcgaaaattcaattttgtgtgcagccctttaagatatctgcctgtaaaaataggctaatttttgtgtgcatacccttaagagacccgcttgcaaaaatcgaatttcacgtgcggttctcttaagggtccacacgtaaaaatgggaggacgatttttgtagacccgaccagttacggttcgtctgcaatataaagaggtccttgtacaagaaaatcatttctgtagtagtgaaccattgcgacaattagctagcggtttctcaacatgaagatgtggtttgaaatcattgtgaacattcgaaagccacccagtaaacaaaaacgtgagacattggttggggggggggggggaatagattcctcaatctatcatcgtcgttggcgaaaggaggaatagatgggtgtggctcactactgttcgtccgatctaacaagagaaagacccttttttgcagtgacgactggggatcgagatcgaggccttcagctgtgaacgccagccgtcaaagtgagagctgaaataattcaacacttttgatggtgtggccaaacatacagcaaacgtacgttagttagctagccagtattacaaaatacatttcggtcgctttcaagttaattaatttcaacggtgaatatatagcttattccgtggagtctagctagtgtgaagaagtaatagcttttccatacgttgacaagtctccagctattcttcttccttcattgttgctaaattataggagccatttctagaagcagaccctggaaaattggacttagaatagcgtgtattgagaatatatggcatgcctgttagataagttaggttttatctagtcatgtgtccccggcatcttcttaattcttatctttatctaaaaaaaaccttcttaattcttatattaattatattgttgtatgcaaaacagcataggtcttgactgaagaaactaagaaagaaaacctgacctagtttcaacagatttatttttttttgaaaaaaaaatggtcatgcatgactgatcaacggccaagatagaagtgtacgttcagtacgtacatgcaagctagttaagcttaattactcgctatatatgaactctagaaaaaaatagttaatatcaagagtcaaaattttgattacgtcccaagcatccagaatagtagaaacaatctacaagctagctcttgtaattaattaaaagcaccattctagaaggtcaaaattaattaagaacagcggattcccctacacacacgttcttaactactattaactccaagatgcgcgggatggatggtttatctagagcatggattcataaatttttgtgtacgtaatctcgtatattacgacatctttcaaagctagatgtactataagtaagatcgatctctgactcatgaggttttcattatgaatttaacatatgcattaataattaattaatgcactaccacagtttaagcaataacatcacgtatttttataaaattatttggcgagataaatccagcaatatatcattcagtagtccatcacaactaagtactatccccgattttaataattggtgtcgttgacttttaaacgaacctttgatcatatcgtattattcaaaataataaattgtattattatttattttgttgtgagttgagttatcattaaatgtgctttaaacatgatttatatttttcatatttacattgattacattgaacgagacgaatgatcaaattcatgttcaaaagttaactgcgtcaacgatcggcattccttgcatttccaatatcatcaaaacatctttctcatgctactcctagtccttggcactcacctcctgtaaatcattctaattaaccactgaaccttcctacgtcgcctcgagccaattaattataattcaattgatttgatcaattaaataacgacaacgtgcatttatcttcccgttaattagttcgttctccaggaccaggaaccttcccttcaaggcttcaaatctgcagcgtattatataacacatccggaaaattcacacggacaaatgctgacgtcgacgtacgtaaggtcactgtacccagtcatacggtgcggctgattaatccaactccctacatatataaaccccccatctcccgccaagcctagcaaccacacggcgacggtcagaacgaacgcctcgccgccgtcgatcgccggcggccggaactatctcgcaaagtaatcgatcgaaggtatcaaaagcatcatctgagctgagctgagcggcggcgcgatggcgggggagataaccccgtcggggagccggcggagctggctgtcgtcgggggcggcgtcgctggcgcggtcgctgcgcgacggggacgacccgttccggcggtcggcggcggcgagccggcgcgacgccggggacgacgaggagaacctgcggtgggcggcgctggagaagctgccgacgtacgaccgcatgcgccgcggcatcctccgcaaggcggtggacggcggcggcgacggcgagggggccgggtcgctgttcaaggccgacgaggtggacatcgccaacctcgacccgcgcgagggccgcgagctcatggagcgcgtcttcaaggccgtcgaggacgacaacgagcgcttcctccgccgcttccgcgaccgcctcgaccagtaagcataaaaacttttcttcttcttctcagagaccatatttacgtgaggactgtggaggggatacgagcgggtcaactcacgaacccgtttataggcaaaatgagtggataacccgctggctggcttgcgggttacctactaatttgatatataaatgggtttatagttgatccacttgcttctctatgacgcggcaagctgagtcatgacacgaaaacccgtagattactctttatttaacatataagtaaattcgtgagtcggcccgcttgcatccctgtgaattttaactatttgaatcaaaatttattgtgaatttgcttcgttgatttgtagggttgggattgagctgccgaagatcgaggtgaggtaccagcatctggacatcgaggcggacgtgcacgtcggcaagcgcgcgctgcccacgctgctcaacgccaccatcaacacgctagaggtatatacacatgtacatcgctcagctcagctcagctctctagtgtgatcactcaacaagttggatgtgaagatcagtggcgccttaatacttaatttggggcgtacgatggattttactgaaattttaaagggattaattaagaaaactgaagggtatgaaaacatttttgtctcttaaaaaaaaagtcattggatgaagccactagataagtacatcaatcgaaacaagtcaagcatgcgcagtacaaaaatcaagaccattttattgtccgactctggagagagagattagcttaatttggagctagtagattcttgtacgatgtccactagcttagctcacgtatgactgtggggtccaccgtagaatcttgataaatagtaatgcgtaaaacggccggtcgcgggttctcgcggcctgcaaatttggaaggaagctcatgtgttcatgctgatgagtggcgattagtcgccggttagtcaaagcacgtttttggagctgtgttcggtcggtagtgtttggaatttaaagccctcacacatgtagaacagttctagtgactccttagcttataattaattaattattagttatttttttaaaaaataaattaatatgattttttaaaaacaactttcgtatgtaactttttttaaaattgtattgtttaatagtttaaaaatcgtgcgtacagaaaaacgggagaaaagtttgggtggtttcgacctttgaccagctagctgttagtctgttaatgcccacgccctgatcacaatgcgtgatagaatttctgacagacaacgacgcctatagaatacacaatgcgtgatagaatttcgcggctagcaggtcgtcgcacacccgacgaaaagtcccacaaaactgcacacgcatggtacgtacgtagaattagttagtactagtcagtaaggatcaggtttcccagaccgccggcggtaagcacgattatcacgcggtaaccgtaaaaaaccgtgtaaaatttatcaaaaattcaaattatttttcaaatttatttaaatttaagggggttatcgtggttttttattactgtaccccgcggtaagccggtaaccgatggtaatgtaaaccctggtaaggatagatcgagttgtactcggctcgagatcttctagaagttatagtgtactcacgagatctttcagatgtggtaagtttctggtgctgggtttaagttttcgcgtctacgcttacgcaaacgacaccacacgtacacacaccggccggcagaaaagtttatgagatttccatatatatatatatacagtacttgccaatctcggttggtatagtacatgtactaagatcacggaaggaaagggtgtcaaagtcaaacacatgatgatttccccttgaaacttgaaagtgcacgagcaaaaatttcaaaacaaaacaaaacaaaacaaaaacgtgcacgaacacgaagatgtgggcttttaccaaaagccactggttgaggcctttccaccggcctatatagcggcccacttcttcgcgagcccaggcccatcagaagagaagtcggcccacaaatggtggaccttgggcctcgcctgccgctctggactctccctcctcgagcgggcgatgggcgatggcggcggaagcatcccgcttccgtcgccggctcgccgccgctgcggcggaggaacggcgagggcggcgcttgtcggccacgcgcggtcagtggtggtgcggcctctgcagctctgctcccccatgcgtcggtccgcctcgccttcgcctcctccagtaggagccgtcggttcgtgtgtttctccccccattccgctctcgatccgttcccttctccatgcgggaggggggaggggggggggccggttgctgacgccgtagaggcagacggcgccaccaaaaggcctagttagggtttggttgattgatgccatcgaacattcccacacgatgtggctatcggtttggagagggcgtttcgttggtactaatactagtaatctgaactagcaaagttcattggtaatttttttttaatctccagttgttaagttttgacgagcagactcgattttgctgatttgtggttgtagtggcagaagttcgatgagatgctacctaatgcttagcgtcgcttacttgttacttgctctggctcaaacgttgttttttatgcttcatgacagggtctcgttagcctatttatctcgtcgaacaagaggaagcttaagatactcaacgatgttaatggcattatcaagccatcaaggtacttggaaattctttgatactcagctatggaacgttttaatccaatcgttaatcatttctagtcttaaatggaactttatgtttttaagctgcattctaattctaactagtttgataaactatctgtaatttattaagtaatttctattcccaagtgatacagatatagatatgatctctatgatttatgcagacatggttactctgcaatttaacttttttccccttcataatagatttgaagcatggcctgaaaattcagaaagaaaaaacgtatacatgcaaacatcatactgtagtaattacccacaaaaaacagtgtaaaaatatgatcctatgtctactgcaaacattatctgtcttatttgtgcagtgcagatatggtcattaattaattttaaattagtgataactaaatggtttctcttatattggccatcccttttcccatcagtaacaaaatgaactatctcatacattaatacatatcatattgttccaattgctattgctacagacctactatatccttcctaacaacaagttccccctgtcccctctagcattcttgctaaatgattggttgaactatggctgataagccgtagaaatataaaagaagaaaccaaaaatattttgaactttttgtctgtattattcatggtttaaaagccatgctggaaaatagactgcaatgaagaaaaacctcaaaatcacctataaaattatgtttcaaaattcaattttggctatggatgataaaccatcaagcagacaataagagttatttacaattgttgcattaaactacttgtgtcaggatgactcttcttctcgggcctccatcgtctggaaaaagcacacttatgcgagcactaaccggcaagcctgataaaaatctcaaggttttgatatttcttatttagtttaatgtagccacctctaacagtagagtcgtaccacatgactaatcactcgatggctacaggtgtctggcgagatcacatactgtggtcatacgtttaaagagttctatcctgagaggactagtgcttacgtcagtcagcatgatctgcacaatcctgagatgacagtaagagagacactggatttctcgagacgatgccttggaagtggtgccagatatgatatgctgtcagaattaacaagacgggaacgtaatgcaggcattaaacctgaccctgagattgatgctttgatgaaggcaactgtagtagaaggaaaacagaacaatattgtcacagatcttgttctgaaggtaacactgtttgactttttacatgttaaaaaatggttatttaggccttctagcctcaattatccatctgcttcttctttttgttgaaatattaaaaggaagctatgtgagaatctattttctagtacaccttttttacaggaagtaatatacatgtatgtatttactttgactgtgatacacaagtgaaaccttaatacttctgtttatgatgaaaactgagtatgaattctaagtcaatatttgctgtgctgattgagtttataaatcttcacaggcgcttggactggacatttgtgccgatactattgttggtggtgctatgataagaggcatttctggtggtcaaaagaaacgtgtgactactggtatgcatgcatatgacatacattaaatatatcagtaattaatcatgttctccatgaaatttacttcaatcactacatcataatcataataattataacttaaatagggataatggattttctaactggaaaagttatttgtctcaaatcatattgttcagaagtcagtcgtgttccttttctcctgtggagcctggatttagccttagccttgtggggtctacaccttagccttttttatgctaaatcgttagatttatcaatatactataacagaatccaagactgaaagacaactcagccactgttttcctctttaaaccttttacactaaccggtacctaaaattttctagataaaatgttcatgagatcctggcaggaacaaattttgttctttttcgtacatggtcttttttgtactctaagcttgtcgtcttgtgcacatagaccatgtacaaaatggatccccactagcccatggacctgttgggaacatgttcggagtgggcctaacagtaacgagcaagcacatagatctattactgtcgatgcttggtgaatggtgattgatagtagagtcatgttgtagtactgatcataaatattgatggtcttgtaaatcaacgataatattcagcattcaataatttacagctgcatgaggaatcttgatattacattactgacacatttacatcctaagattggagttctgtcattgttttgttgcaggggagatgctcactggaccagcaacagctttgttcatggatgaaatatctactgggcttgatagttctagcacatttcagattgtcaaatacatcagacaggtgacccatgtgatgaatgctacagtgatgatgtctctcctacagcctccacctgagacctatgctttattcgatgacatcgttcttatagcagaaggttacatagtctaccatggaccacgggagaacatacttgaattctttgagagtgctggttttcggtgtcctgaacggaaaggagtggccgactttcttcaagaggtgacttctaggaaagatcaacagcaatactggttccttgagcaggatcattatcgttatgtgtcagtcgaagagtttgctcagaatttcaagaaatttcatgttgggcaaaagctgcagaaagagcttcaagttccctatgacaaatctaagacacatcctgctgcattgactaccaagaagtatgggttatctagtctagagtcccttaaggcagtgatgtcaagagagtggttgctaatgaagcggaattcattcctcttcatattcaaggcctttcaactgtttgtccttggatttataaccatgactctgtttttgagaacaaagatgccccacgagaaattttctgatacctctaaatatgttggtgctttaactgcttctttgattacaatcatgttcaatggttttggtgaacttcaattgactatagataaactcccgatattctacaaacaaagagacttcctgttctttccagcatggacctatggacttgcaaacatcattctgaaggtgcctttatcccttatggaatcatctctttggatagttttgacatattatgttgtgggttttgc

SEQ ID NO: 54704 - DNA, 3452 bp, Oryza sativa
gtattgtccattcgtatcaaattgttcttgttgtcggccctgtttggatgaacattcatcaggaagcttacagaaacagaacatctatattgctggatgtttgatttattatgagattttatgagaattcaaatgggtcctgaattgtgttatagatggattctgctacaaatttcatagcagttgattctagcatcatgaagcatgttgtttgtttattattttaatgtgtatttgacatctcataatttatcctgcacccacatcattatcttaggtacgaatggaacagaaaacagaagaagccagagaggaatggtcttgccattccagcctctttccctttctttcaaccatatgaactactacgttgacatgcctgctgtaagttgatatcctaaaaatatatcccaacttacataaccatgtttgcaaagcttacgggacaaaacatacctcaatatcgtaattaatttcactttattcttcttatagattactactagttcttgcagtgatttctttttgcaattcaacataggaagtttgcaaagcttacgggacaaaacatacctcaatattgtaattaatttcactttattcttcttatagattactactagttcttgcagtgatttctttttgcaattcaacatagaaagtttgtaattctacttgctttacttagttctattgttctacagaaatatgtagtagctatacgttgttgaaattaacaatgtcctttatcatataatctagattgtctgactgttttccttattatatcattggattggtatcatactgtacatagtgattgtgatggcacggggttctcttgtgtcccctgttgcacttagatatttaactttgttaaggattaaatatgtgtattttatctagctgataaattactagttgtcattcattaaccatttattgaactaagttagtagtgatttaatcttgaatcaaggggtgcatttcaagtatgaacttgaaaatttaaattctaccttgtaggaaatgaaagcacaaggattcacagaaagccgcctccaactactatctgatattagtggtgcattccgaccaggtgttctaacagcactagttggtgtcagtggagctggaaaaaccactctaatggatgtactggcaggaagaaagactagtggaacgattgagggagatatcaagctttctggttaccctaaaaaacaagaaacctttgctcgcatcagtggctattgtgaacaaactgatatacattcaccaaatcttactgtatatgaatccattgtttattctgcttggctgcgcctttcctcagaagttgataagaacaccaggaaggtatgtgttcctattatttttgtggtggatgccatttagtaaactcaataactcatgatgtttcttggggggaaatcagaaaatcgtgttaattgtagttgattgtgtgtactgtccattaatttaatccacttattggtcactaattatatattatcacctaccaaaagaggccacacgattgtgtaggcttgtatattacccgaatctcgtccacatgcaagacacacttattcgttgagttcctaggaacctgacagcacactaaactgtcatttgccattttttatgagtactaacaaaatgaccatgctttgctatggataaaataaaatatattatcatatgtaatagataaaaatatttattgaatatgttagtattcacttgtttcaaccaaatatgtagactattccaaaatatcagaaaatatcaggggccaatttgtaaaaactgtaaacagcggtggggtgccaccaccaatagagacttttaaggagtatacatatacaaggcatttttgacaatcatgatattgaagaatagatgcaacatttttttatcttgtgaagttgaaaatactaattatttctgatgaaattaattccactgtgtaggtgtttgtggaggaagtgatgtcactagttgagcttgatgtattgcgtgatgctctggttggtctccctggtgttagtgggttgtcaactgaacaaaggaagaggctgacaatcgcagtagaactagtggcaaatccttcaattatcttcatggatgaaccaacttcaggtcttgatgctagagctgcagcaattgttatgcgtactgtgagaaatacagttaacacaggacgaactgtggtttgcacaatccatcaacctagcattgatatctttgagtcttttgatgaggtccttgctactttgctcttgtttgtttgtccgttagttctcctttcagcgctgtaaggttatactgaaaaatggattgtgttttttcagcttctgttgctaaagaggggaggacgggttatatatgctggccagcttggtctcattcacaaatactagtcgaatatttcgaggtgaactgtctttgatactatatttcagtctctatgataaccaatttgcaatatgttaaccatctgtattgctaaaatcagttaatacttctcatctattgtgacccatgaaattccattgggcaaacttggatggaattagtagcccgaagacatgcattttttttaattagtgaatgtatgaatactagttggtaatctatcaactattgaaggtcgtttaggccctttctagtgatgcacaaatgttcaggcataaatttcattgtccatgactgtatcattttagaacatgtgcagttaaaaccttccatcttaaatcaatagcatatgcaaatagacttttcacgagaactactttcatatagttacatctttttaatgatttttatatgattacaaaatgcaactatcaaacatgtgcattggagactctgaatgcagaagtaaaaaataatggagggagtagaacacattattgttggaactcataaatatttttttctatagtactaaggttgattcttcaaaactgcttgtacaattgtgcaacaaactctttttaatgacattgaggcaaagggcaactataccacctcaaaaactaatatctcagataaaagtaatttgtaattgtaaaactaaaagatatacaattctgtagtccctctttttacaaatgctatttcagaatatgtgtaacctgtaatctattgttttgagcaataattaataaaacttgaataccaatataagtgcttggatctatcgcacggaaaacaatattagtgtatttctcatcgacagtatttatataccgttgtgtttttttatttgctaacatataattagaaaagtaacgttcaaatgtttagtggagactatctcaatgcctagaacaaatgtttattaaaagagcatggggaacatgcatggaattaagagaacttgggtaaccgtattcaatccgagactaaataagaaagaaagaaaggctacttgcttctaatgt

SEQ ID NO: 54705 - DNA, 6591 bp, Oryza sativa
  unsure (1)..(6591): unsure at all n locations
tcctatatgtacagagagtccgtgaatgatctgaacaatctacttggagccacctatgctgctgttttcttccttggagcagcaaatttgctcacacttttgcctgtggtgtcagttgagaggacagtcttttaccgtgaaaaggcagcagggatgtactctccactgtcttatgcgtttgcacaagtaagttctgaacacccttacaagatatgcttatgcatttaccgatgtacgatgaacaaggtatatatgagccttcctccagctagaacctcccaattcaaagcaggccaaaaagaatgtttttttttttttgaaatgatgccaaaaagaatgttaagcagcagaggacaagtcgcttcccttctcgtatttgacatagtaggataaggaggcatgttgaaagaatgtcataaggagacatttaagagattggatttgattgtctgtcatcacaaatgcatttgcgttggccctaaatatatgtgtacatcagcataatctggattgtgaggaaaaactcccaatagtctgatttcaagagtagaaggggctcggtatccggattcatagtttagggtgggtggtggactttagtgatattcaacacagctagtattcacacctctggtttttgtagctggaccttttatttaggcgaacttttagagtatgcgcaggatgcatttcattgtttacatgtcaactgaagtcttaaaaataccaaaatatctactgaagcttctcccaaaaactgaatgatgtgcacagggatttgtcgagttctgctacagtgcagttcaaggtgttctttacactatcctcatctattccatgattggctatgagtggaaggcggacaagttcttctacttcctgttctttatgattgcggccttcgcctacttcacattgtttagcatgatgctggttgcgtgcactgcttcggaaatgcttgcggccgttcttgtttcatttgtgctctcctcgtggaacaattttgccggattcattataccccgtccagtaagtgctttcaataagaagtgatgctatcggacttacattatctaggctctcagcttgtcatacatctctgaaatattttctcttgcagctgattcctgtttggtggagatggttctattgggccaacccggtctcctggaccatctatggagtgattgcgtcgcagtttgcggacagcgaccgtgttgtcaccgttcctggccaatctaccaccatggtggtgaaggatttcttggagaagaacatgggctttaagcacgacttcctcggctacgttgtgctggctcatttcggctacgtcatcatcttcttcttcctctttggatacggcatcaagtgcttgaacttccagaaacggtaggaggccggtgtccagcaggatgtcaatccgaggtcacgtttttggagtgtaaagcaaatgtagcaacttaataccgatgctttttttgtgtagatatatagtctgttcgatatctgctagcttgtattgacacttaatgtacaacattatttactcaaatgttctgagtttatggtatattattctttttctatgttatcgccatcttgccattttgctttccttattccttgtgaagttctgcatgatccactaacaaccggatatattggtacacttggaagttgtcccgctttgccatgcctgttgtataaactgagaattgtacttgaaatttcgcaagaagatatatgtctattacataaagtgttttttattttgtaactcttttgattggtatttgagaagtgggaagcaaacaaagtgtgcatgcactcgagttgtaaaaatccaccaactccctaaggtttgaagtgtgcaggtcatcaggctaagaaagtgtgactagacatgactaaacctttgcatgtctaggttagacacgaaccaaatggccattgtattttttttttgaaaaaaaaaagacctttgtattgtatgttagcgacaacagtagggaacctctgtagcttattacaatttagatacctgttcatcagccatggatggatggattatcaacaggagtcccacaaggattgagtagcctaatttaactgaagcaagacactgtacatggtgccaaatgaggaattgttgttttgcatttggcctaaggccttttttttaatgaaatacgaatgaaagctgatggggatggataagttaaaatattatatattacgaatttagcaaataacttgggaaaaggtgatgaagatttacttttgaaaacttggcacgagtaattcggttaataatccggtggttatcagctagaaaaaggaaagggagggtgtatagttgaatgccaaactttaccgcaccaaagttggccaagtttaagggcctgtttggatggttgctgcactttgccaaacttttgagtcaaaagtgtggcatgttgtagtatttgcagtaccaaaatagttggccgtacttgtggcatattttggctaggagatgaatttatgccatgtgagatataaaagaggtaaagtttggtacaacacaagtgtaacatgtaaccaaacaaccacatcgaaaagttaatcttggttaacttttaggtgcgctaaagtttgccattcagctgaacaccctttaactttttgaggtgattgtttagttacatgacacatttgtgttgtgccaaattttactacttttatacctcacatggcataaactcatcttctagccaaaatataccatacttttggctcaaaagtttaacaaagtgcagcaactatcaaaaaaggcccagtactccggtactccctagtccctactttggcctagatgagtaagcaacgtgctctgctaagaaataagtttgcactgtcacgttctaaatcttaccaaattattgcaagccaaaatccaaacatatttggtaaagctgctaacgtgctttcggctatccctaccaaaaacgaatgccaaaatctccccaacgaaccaaacgaaatatgtgattaccaaatgtaggtacttaaagaaaacgtggactcgaaataaaactaggatgcaatcatgagaaattctcctagcaattttgtgcagaaaccatttgaggacatgtgcccatttttaggatcccagatcgctgaacaagtggagaaaagttcgagagatcaacatttccagtttccacattcgtccttccgcttacgccgatcacaaaccataacggtttaccaagaacttaaaaacaattaaaaaaagcttttacatatacattattagcaatttaaaaacaaatattacaaaaataaactaaggtaaaaaaaaccttaaaaaaacttagaattaaatctaatgttaattttaaaatccttaatacaccttaaaatcaccttctttttcctctaaggcccctttcgacatagcaactggtgaagattgagtacaggaacgcaaaatgagaaaatcattagtgatgattaattaagttatactaattgtttcaaacttgaaaatagatttatatgatgttttaaatcaacttttacatacttcctccgtcccaaaataagtgcagttttgcactattcatgttcaacgtttgaccgtccgtcttatttgaaaaatttttatgattagtatttttattgctattagatgataaaacatgaataatactttatgtgtgactcaatgtttttaattttttcataaatttttcaaataaaacggacggtcaaacgttgaacatgaatagtgcaaaactgcacttattttgggacggaggtagtagaaagtttccgcgcgatatacaaattagtagcgtaaaaagcgtgctaatagaaactaaagataaaatccgtattttaatccaccaatccgaaatgattagagacgccaaaaggcccactttactgtagtgacccacgagtgctccatttcctttccttcagtgtctcagtcagtggatcactgtgtcagcacaggcagaggctttgctcttgctccggtccaagccaaggtgggcgccccgcaagatatcttcttcttccccaaatcgaggacccgattgcggcagctccggtggccggagcagctccctggtcgacgcgtcgccgtctccgtcccggtcgctgccggattccgcgcgcgtgggcgtccatcggatggcaattggcaagcgctaagacaaatcccttgattttttttaatccgttggacaggcggcaagatgattaattagcatgtttgtttgtgtcttcgatgatatctttccctattcaatttttgttgttgcagggtacccgcgctcgccgtttcatccggtgagcatttcgtcgagcagttggtaggcggggggagttcggggtttcttgattcatggggaggagctttgccgttgatttcctgcgctgaagcagttcatcgtccagtttcttgggcaatcgtttctagggaagcaaatgagatgtctctgctgctagacgcgagctctgttcctcgtttttaccattctcagaacttgacgattgagcatggcagattagggtcgtagagaaaacggtgttcgtgtcagcttcttgaggtcagagagccaagaagccatttgggtttttcttggttcatggaggaaatgggctctgctcagctttctgccctagctgtgtgtgtctgcattttcggatgcctagccatggctgatggccagaacgtcactggaggtgatggttcaaggccagctgagctgcgcatcggtgcattattcacatttgattcggttatcggtagagcagtgatgccggctattgagcttgctgttgcagatgtcaatgccgatccaggtgttcttcctgggacaaagttgagcgttataacgcaggataccaattgcagtggctttcttggaaccatggaaggttagggcttccttcttttccatcaatttttcttttatggaattgtccttaccaatttagttgtaatttacacattattctctcgctttcattgtgcatttgcaattagcatatttcccttttatcctcnnnnnnnnnnnnnnnnnnnnnnnnnnnncagttgaaaaccccaatcagtattgtttttaagtttgtggaggtttcctgtcaggattcttaatctaatccagattcagtttaacttcaggttgcaaagtcgtagagccatgctaaggtagctctacttccatgatatcatgggatgtgtgcaaattgaagccctaatgaatatctatgatctataaagaatacctagaaatcagaactttcctgtctttattttttcttcacagaacttcgcttttgtttattctcactaaacgtaagttgtcataagttatatttatcttgcactgaaagcttgtatatatgagattaacaacgattcttcctgtgcagcgttggagcttctggctaaggatgtagtcgctgtattaggtccacaatcttcaagcattgctcatgtcatttctcatgctgttaatgagttccatgttccgcttgtctccttcgcggcatctgatcctaccctttcttcccttgaatatccttactttgtgagggctacaacaagtgattatttccaaatgagtgctatagctagcatcatcaatcaatatcgatggagagaagtcattgccatctatgttgatgacgactatggtagaggtggcatcacagcattaggtgatgctctagcaaaaaagaagtctaagatagcctacaaagccaaattgccacctggtgcttcaaggactaccatcgaggatatgttgatgcatgtgaatgaaatgcagtctcgcgtctatgttgtccatgtaaaccctgactctggcctggcagtttttgctgctgcaaaatctttgggaatgatgagtactggctatgcatggatagcaacagactggctctctgcagtgttagattcatctgatcatattagcactgacagaatggaacttactcagggggttattatgcttcggcaacatgtttctgattctggcattcagcattcgttggtttcaagatggaacaatctgaccaggaatggaggtcattcaagctttagttcttacagtatgcgtacttatgattctgtatggttagttgctcgtgctgttgaagattttttgagtgaggggaatgcggtatctttttctgctgatccaaatttgcaagatataaaaggaagtaaccttcagttagattccctcagaagtttgaacaatggagaaagattactggagaaagtttggcacacaaatttcacaggggtttctggcctggtacaatttactgcagaacgagatctgatccacccagcttttgatatcttgaatattggtggtacaggtttcagaaccattgggtattggtcaaacatttctgatctttcagttgttgctccagaaaagttgcattcagaaccactggactcttcaacaaacaatatagagcttcatggtgttatctggcctggtcagacgtctgagaaacctcgtggctgggtgtttccatatcacgggaagccgttgaggattggggttcctctcc

SEQ ID NO: 54706 - DNA, 1961 bp, Oryza sativa
atttctgtttctgtaccactcagcactttgacgctgcaataggggacatcgctattgtgacaaatagaacaagacttgttgattttacccagccatatacagaatctggacttattattttagctccagcaagggagattgaatcaaatgcctgggcttttctaaaaccattcaccttccaaatgtggtctgttctaggtgttctcttcctttttgtgggtgcagttgtttgggtacttgagcatcgtactaatactgagtttcgtggacccccaaggcaacaaattatgacagtatgctggttagtatctgcctcgtgactcttctctcttttttttcacttcttcaagattcaaaagttattgtttatttgtttataatttaattttgttagagttttgtaccatttcaggtttagtttttctaccatgtttttcgcgcacagtaagtgtaaacatgaaactagccaaaagtttttttttggatctcatagtccagattcatatccttctatctgttgttttacacaggagagaacacagttagtgcacttggtagatttgtgctgcttgtctggctgtttgttgtgctcattataaactcaagctacacggcaagcttgacatcacttcttacagttcaggaactcacatcagggatacaggggctcgatagcttgatatcgagtccaagttcaattgggtatcaagttggatcttttgcgagaagctaccttgtacaggagctcaatattgccgagacccgattggtaccactaaacagcccgtcagattatgcaagagcgctagagttaggatcaggaaatggtggtgttgatgcaataattgatgaacttccatacgtggagatcttcttgtcaaaatactgcaaattcaagacggttggccaggttttcacgaaaagtgggtggggatttgtaagtgacttggactataattgtatactagagatttcgttccagccttccaggatatcttctgaatatagtttattctgtttcaggccttcccaagagactcccctcttgctgaggacttgtcaacagcaatcttgacattgtcggagaatggcaatcttcaaaggatccacgatgaatggttaactgggacagaatgcagtgcagatgacaatgaggttggctcaaaccgtttgagcctttcaagcttctggggcctctacctcatctgtggcttttcatgtgtccttgctctcttaattttcttcttgcgaatatgctgtcaatacagtaagtacaataaccaggttggacttgactctcctgaaccagagattgtaactcgatcggcaaggttaactactatcaagtcaataatctcatttgtggataagagggaggaggaggtgaagaatgctctcaagaaaaagcctaatgacagtctgcagccaaggacaggaagcacaggagaacaatctacattaccaccatgacacatttatcactgcctgactgacatattcaacaaaatgcataattttgcactgggcttgctggcagcttcagaaacccggtgatgatttgttctggttctgaaggtcaaacctgtaggagctcctcagagtattttctctgaactctgaagcatgacaggaacattctgaattgtgcccaacagtaacatgtctgaatctccttccaacagctacttccaggagaagtagagcattggttgcaagttcaatttcaaactagttgagaagtttgaacctctgtcaagttgagaggccccttttttcgttcggaagcaacctctgacaagttcttgtagctacaatcttaagcatcttccaaataagttgagaagtttgagtctttgtttggtgtggaatttgtctggttgagcatttcctttcactattgcactgtgctgaaaaggcagtaacatatcttctcttttcaattggctatgggctgcaggaat

SEQ ID NO: 54707 - DNA, 1304 bp, Oryza sativa
  unsure (1)..(1304): unsure at all n locations
agaaagatgctctctgtttgactctttctgtttgctaataatggcactacggaagtagggaacgaagcaggtaggaccagaaggcaggaagacgatagatctgtttgagattaagcctaagcaaattccacttaatgtagtaaattaatgtaagcttatattacacccttttctgttcgttcaagtgaactgcatcaccaatatatgtaacattcaaaaacttaggctctgtcattttccgctcgcacgtttttcaaactaccaaacggtacgttttttacaaaaagtttctttacaaaagttgcttaaaaaagtcaaattaatctatttttttaaaaaataactaatacttaattaatcacgcattaataaactgctcagttttccgtacggaggggatgggttcccaatccatcctatggaacacaaccttaaggctgtgtttggaactccaagttcccaacccctctccctcgttttccgcgcgcacgcttttcaaactgctaaacggtgtattttttgtaaaaagtttctatacaaaagttgcttaaaaaattcaaattaatccattttttaaaaagaaattagccgattcttaattaatcacgcgctaatggaccgctccgttttccgtgcggggagattgggttcccatccctactatccgaacacagcctaagggtgactgatatgtttactttactaattaagacatagtgactgatatgcttactttactaactaagagggctaaagatgttggtatcttaaaggggttatccctcatttagtagatgatggtttatcaatattgcaatatgtggatgatatcattgtttttttgagcatgatttacaacaagctaagaatctgaaactaactttatctgtttttgaaaaactgtctggcctgaaaattaattttcacaaaagtgaattattttattttggtcatgcaggggattatatgatcaatattctaatattttttgttgtaaattaggttccttacctgttaaatatctcggtattccaatgcattttagaaaacttagtaacaatgattggaaacttattgaacaaagaattgagaagaagtttagtagttggaaagcaaaacatatgtctgttggaggagattggttttgattaattctgtactttcgagtttagctatgtttatnngatatccttttttgagattccgaaaagggttctttaaaaaattaattattatagatcacatttcttttggaaggggatgataataagaaaaagtacatgcttgctagataggatattatt

SEQ ID NO: 54708 - DNA, 15707 bp, Oryza sativa
tgttatatttcattattaaaaaaaatcaccaatatatgtactgctttaattccacttaatgtagtaaatttgcgcctaacttgactaaatgttcttcaggtggaagctctgaagtcgtatcaggtaatcctaacgatgaattattgactgaaactgacaagatgggagaggaagggaacagcttgcaagttgcaagcgcgaaggcgactacgatcacctcacaccagccgagaggcgtttacatggagcagaagcagatgattgataaacacaagtggccaacaagtcacacagggaatcgcatcaagtatttcaactaatacctggcactacgacatcccaaaaagttgggccccggttaaatcttgaatgttcttcagaggttttatgctggtatgctttctgtgctgctgacccatccagccatctgttagcctgtgatgctcctcctacctatatggtagtctttgaaactcatgaagataaagattaagctggcgcatcacaagactaaacgtttggttagtcttgggaagatctgaagatctgagtgtggtatttcgaaaatccaaaccatgtttaatacttggatgcatgtatgtgcttcatatgtgtccaaatttacatgtatgttagtgaatctagacaatagatataaagaaaaaaagtcttataatgtggaacacagggagtacggttttaaatatgaaatgaaatataagagagccgccatgttgaatgatgcaagttttgctatgtaacaagtaggttagatgcattagcagataacacgattaaaagggaaactaacaacttcctagatgattcatgcaagtttttttttacatgacaaaatgcttggggggacggattttgtcatgtaaaaaaaacccctcaaatctcgtattgaaagatgtaacaaaacccaagctagaaaaatgcaagaactacagggtctagcatattgctcagagattcatgagaaacaatcagagaactttgaagactatgaatggatttagatacttcagaacaaatagcctcttcatttgtatttccatttcccagcaacaaaaagacaaagatacaacagtttctattaacatcattcaaaacctcgtaaaggtatatcactatacagccacagaattggaaaaacaatgaagctttgataattatcagagggaaaaatatcaaagattgcattgagataattgtcaattataagcaaccacagaacttgctcattttgtttcacacctatgttattctttgaacacgattaaaaaacttcctccgaatcaactaatcaatcatcccaaattactaatagctacagactaaggaaagactcgaaaaagatagtttttgaacatgaggtgatcagagaaatttgaagacacacccatacccttttctcgcagttatccctgtacccaatctcaagagaacaggggctaatggtccgggtcaaacataagaaaataccatccaagaacagcatgcacatagatgactatcaaacaaaagtaccttaagtcttggtaataacttacataatcatacaagaaataatatcagggaagcctatcacacaagatcattgcatgttgcgatctaagaggagaaaaagctgaaagccaaacaaaaattacccactggaattcaagttactccactccccagcatggactaaaaaccatattcaccagcttcatacattttaattagagcaggacaatccgagtacaaagtttataactgaaactaggaaaacacagcaagccagccagggttcagactcctagaatggaaaacatcttgcctctcaagattggcaagaagataattggagtaagaagctcagacagtaacacaaatgcagctcctagctcaaaatgtctgaactccgaacaatgatataatctggtaaagaagttcaggccacactactcttaagaaccagtggatgtgttgaactgaccaaggacacagtaacacatctactacaagttcacaacccctggccattctgtatgctcaacaagcttcctgaaaagaaaccaattgagtgaatattcttaacatccaccaagtctgaacccaaagtgtccgtctccggatcatataaccgcatcacccgcctcgtgtattgcccttcgaagttggctaagtgcacagttatgtagatgagtatcctgccatcatctagaatcagtgagggatgtgcatgagggaaaatgtgttcagtgtcccaggtatccatctccaaaacaatcctatacttcttctcccaaatctgcttctccgagtccatcagataccagaggtctacgtaggatttgatctccgcgcttcgataatccgtgtactgagctacaaccaatgcaccactcagctcggacaatgacagattctggtacaccgacatctcaaggggctcagggaggatctcatcgatgttgttcatctccggatgggtcgccattggtccctccaggtatgatatccacctctcggagcagagatcgaacagggccatgtgatccatctcgtaggattcgcgatgcgcgttcttgacgccattgggacggccatccagcaagaagtagacgacgccattgatgacgacgccgccgatggcgtccctccggacgcacatcggcagcgccttcttggccctccaccgcatatggtatctgctgctctcgtccagactcaagatctcgaacagctgttcggggaattgcttgttgcggcaatccgtgaggacgcggagcaccttgtaatcgccattgctgtccctgccgtacttgaaggagccgtcgaagtcgctcagagatcttccccggagggagtgcggcgtcgacagcggctccggcaggtggacggcggcgccggtgatcgggttgaggagggtggccctgcaggtgtagacctcggtgacgcagaggaggtcgaggttggtggtggggaggacgaggtgggtggcggcttggcgaatgcacttgaccacgctgccggagaggtccatgaggaggacgtcgacggaggggaacacgtcgaagtcgagcacgccgccggcgaggagcgggccgcggtggcgcgcggcgtgcgcggcgacgaacgtcgcgtcggtggtgagcgcccgccacgacctgcacacgccgcggaggcggcacacgtccttgggccccagccgcagcagcacctcgaacagcacgtccgccggcagcgccgcgcgccgccttcgccgccgccggcggcggagggggaagccgtcgtccccgcctcgccgctcaccttggcgcactggctccgcgacgccattgctgacaaacacacaccaaatcagcaagacactttactacctcgagcacataaatatctttaaaccgataatctttccgacttacgtgtagactattcttttatgataatcttctcaacttacgtgtagactatgtagatgtcgctggagaagtgatttgagatgatccaaaagtgcaacaacgataatcttatctggtccaaaatgaaagtattagctagagaattatccaaagtgaaattttaataatataaaatatggatcaaagtacaattaacttaaaaaaacaacgaaacggaagatataaaagaacagtcgatgcgacgacgacgacacagcgcgcgattctggtggcgaagaaatcaagaaccctagctagctagatagtacgaaggggaagattagcgggggttggtttcagatccgacgccgacgaactccggtggaaactaaccttcgtctacctcacctccggtgcggcggcgaagagaggaggggatctccttgcaatggtggcgatggtgggaggaggaggaggaggaggagcaccattatttgtgtccgtggaaagagtggggcagcaacaattcagccaatgagaaggctacaactcctgtgtgcatggtacgacgacgatggagtgatactgaagattttttttttttggaggttagttcaagaaaaacgtgggaatccaatatggatgtttgttttggaagaaaaaaaatgaaatgattattcaaatgcttggaaggacggtttgatagggactggtcgctggacgggatcggttttcgacaagcaggaaaccacggctgatgaagcctgttgtggtttttctttttctttttttttttggagaagtctactttacgtccctagaatatgggtactaggtaggttccaataatattcttcaaccgcaaaattggatagagcactgtcacgcccggaatttctatacaaaattccaaacgcttacatgtgtgttacatcctcgtccaggaatcagccgaggcacacaataacaaattgataatagagtactattaaacagctaattaatattcgcaaaatagcaaattattacagaggtggatagttcctctcaaagaataaaattctacgcagcggaaataaaacaaaatacagaacagctatggcgactccactccacaagcaacttaacccggacaaagcctagtcctccaaatcattaccttcactgaaatactcctcctctgatgaatgaatattgcaagaatgagcatatgacatactcaacaagccacacaacaaatatgcaagtgcacaggataacaaaggatggcatagtaaagctcatttgcataaataacatttattaaacctttgagagaataataaaacagttgaataattaatcagtattaaataaacaccatacaacacaactgtgttgcataggcccaacctcatctgaacaaccaaccccggttgtacaaatcaaacctccataccaggaatatatcattccaaaccaggagtcaaattaacacaatattatcattaatgagtagtgtgagactaatcacgaaaaatattgttaaactcacccataaccgcgggtacggctattcgaatagtttactctgatcagaggtgtaccactgtacccacaagacacagctccacaacatgtcaccatgcgccttagtaccaccacggtaccttggaaaggaactgtgacaatacctctcacactgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaatttttaatcatacaaagagcatttcagtaattacccacatattaaattaatcattaaatggtctgtttttaatattgttaaatactttgggtgtccaagtatgttcaagatttttcttggaattatttgagcataggaagtatttttaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcgtccctcgacactgtttatcttctacctctagcagccgaactgagaccgatttggctcggtttttctcctccaaatctgacctttccccttgtgtttttctaaaattagttgaggggaaatattcctcttatcctcctctatctttatccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggacccctagtcctcctctttcgtttgccccctctcccgtggtctcccgtgcctcgtagcgccgccgccacgtgctccaccccgccgtagtcgccggccgagctccatccgcgtcgcgccgctgcctccgccgtcgccgccggtcgccgtcaccaccgttaggtgcgcgggagggtggagaagcccggccgctatctccccgaagccgccgaccaccgcagccccgtcgccgccgtcgaccgaagccgcgccgacgctagacctcgtcgccggccgtcgtcgttcgtcgtttggttcgagggtgagtaccgttgggttcgtctcgtcgtcctctacgtgttcttgtcctccaaagtcgcagccgaccatccaatctccggcgaggtcgccatcttggttcggccattgatgaggtcatcatcatgacgtcatcatcgtttttttctttttcctgtttttctaatagattaaatcttcggaaattcataactaaatcatcgtaactcggttttgagtggttcaagttgctaaattcatctaaaatcaggatctacatgtttgtttactttatatgtactttttatttggtttttattagtctttttcttcgttttgcgtgttagtttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaaactattcctttgttatggccaatttgcattgattactttattccttgataccttgggttattataacttgactagttgagctttatatattggttcagctagatattagatatgattgcttagccatgcttagaaacattagcacactattgggataacttatgactcattgtttaatgatggtttaatcgtagctcacgatggttaatcatgttatgataattaattgataactaaaacttgacaatggtgggttgtgagcacatggttttgaaggtcatgctcatgataattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccaggatcgcgacgcatggtagacatgatgaggaggctgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgctgcagttttcttttcttttgaaagtatgtaacactataaatagtgatgattctgtatattaaattgtcagtttgtgtacctcggctgattcctggacgaggattttatgcacaaataagttcggaaattactagtgaatttctgggcggcgtaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcctccctcgacactgtttatcttccacctctagcagccgaactgagaccgatttggctcggtttttctcctccaaatctgacctttccccttgtgtttttctaaaattagttgaggggaaatattcctcttatcctcctctatctttcccctcaagaatcggagcaaatggttgagtatcttgcccgaatcaaactcgttttcgagtttatctccaaaaccgagttttctcggatcgatttcttgcgggaggagtccgatctcttcaatccaaggctataaataggaccccctagttcccctctttcgtttgccccatctcccgtggtctcccgtgctccgtagagtcgccgccgcgcgcacctagttcgccgccgccgccggccgtcttcagccacgccgcgccgtcgcttgcgtcgtcgccgccgcttgccgccgccgccgttaggtgcgccgtggtgaggagaacctcggccgcccgtcccccttcgccgccgaccaccggagctccgccgtcgccgtcaagccgagccgccgccgccgtcctcttcgtcgccggccatcatcgttcgtcgtttgtcattgtggtgagtaccgttgggttcgcctcgtcgtcctctacgcgtaggtgtcctccaatcacccggccaaggtccctagctccggcgaggtcgccaaccctagccggcctccgtgggtgatgtcatgctgacatcatcatcctttcttttttttccttttttctaatagatgaaatcttcggaaaatcataactaaataaccatagatccgtttcaggtggttcaagttgctaaatttttctaaaataaagatctacatattaaaattgtccataaattgaattaaatttatttaagtctttttaaatggactttaattagatttaatcttgtaaaattcataataaattcatttgaagtcggaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgtgagtgcgtcggaagtgatcaagaaggttaattgaagatcgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaaagttatatatataattgcttagcaatgcttagaaacattagctcactaatgggatgaatcatatatactacattattatttatggttatatttaatggtagctcacgatggttaatcgtgtgatgttaattaattgataattaaaacctggttaaggtgggttgtgagcatatggttttgatggttgtgctcatgacaattaaggaccggttcgcgagctactgttgtgagacattaaccgtaccaaccacaagccagcgtgggcaacggctttatcctttgtatagcatggttcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgtttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgctgcagttttcttttcttttgaaagtatgtaacactattattgatggatttgtatattaaattgtcagtttgtgtacctcggctgattcctggacgaggattttatgcacaaattagttcggaaattattagtgaatttccgggcgtgacaagttggtcaaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaaactaacaactcaccacagtgcaccgttcctggatcataatctccccctcaaaaccagaggcaatggactccccagcgacccccaccgacttctcgccgcttcacagtctggcaccctataatgaatcatgctatacaaaaggtaaagctgttgcccacgctggcttgtggttggcacggtaaatgtttcacaacagtagctcgcgaaccggtccttaattgtcatgagcacaaccatcaaaaccatatgctcacaacccacccttaatcaggttttaattatcaattaattaacaaaacacgattaaccatcgtgagctaccattaaatataaccataattaataatatagtatatatgattcatcccattaatgagcttatctttctaagcatggctaagcaattatacatatagcatttagctgaaccaattcaatatataaggtccaagctaatcaatttataacccataggaaaataaagtcatattcgaccattaattaattaggaaaggctcaccacccaatgacattcgaaaataatgcataagttgaaataaaacattagctttaaacgggttcaacatgctcaaagggttgtttgggatctgtgtgacttgccttgaacttccgcaaatgcttccgaaccttcctcaacgaaaacgctctcctccagaacgtcggaaactaaagcaaaagaacaaaatcaataaaacagtacaaaaacaagcataaacagtacatgtggatatttttaacatgtagatcttgattttagaaaaatttagcaacttgaaccactcgaatccgagttacggtgatttagttatgaatttccaaaatttaatcgattttcatctaataaagaaaactaaaaagaggtttatgacgtcatgatgacgtcatcaccgccggccatgacacgggtgatgtgaccaccggcgctagaggggtcggccgggctaacggaggacatctacgcgtagaggacgacgacgcgaactcaccggtgcaaaaaaaactatgacggacgacggcgaacggcggccggcgacgagctccaacggtgactcggctcgggtcggcggcggcggcggcgctctggcgaccggcgacggcggcgaagggacggctggggtgctcctcctccgtgcgcacccgacggcggcgaaaggaggcggcggcgacggctagggcgacgtggcggcggcgctacgggcgacggctcgacttgggacaagaggcaaacggaagaggacgactagggaatgctatttaaaggcttggattagggagatcggactccaaccgagaggaatcgaagacggaaaatcttcgggttagtttggagagataaactcgaaaacgagtttgattcggataaaatacgaagcaattagctccgattcttgggggaaaggatagaggacaacaaagggataaaaacccctcaaccaattggactcggagatggccggttggggtggattcggcggggaacggcggcggcttgggctcgggcaggccggccgaaggttgaagacaaccccgacatgtgggccccacatgtcggcggttgaaaggaggggggcgacggctaggcttgggccgtacggccacgcgcgagagaaagaggagttaggccgggaacagcctaggagaggatttttaagacttttccaattaaaataattcatgaaatgatgtttcatttattaaaaatacttcccttgctcataattttcagaaaaatctagaaaatagataaacaagcaaagtatttaatgaaattttatctagctcaattttatgttgaaatttttcctaaattattagagtttaacttgtaggcttttaaaataatttctaattgaggcgattttcagggcgtgacaatcactcaaaacatttaaaaccagtgtaaattaagttccctcgatggttttacctaatataccatccacgtagtatgttgacctggtcatcatccttaaaacagagctgcacgatgaggggtgcccaagaaccattcatctagggcaaaatttgctacgggacacttaaagattgtggtctttgctgtgagacacctgaagatcatgtatttgcttgtggacgctgtaaaaaaatactagtaattagctgctgacacttcttttattattttattattttgcatgaaaacggaaaggaggtccgatgcagcggcgaggcctgtcacggcgtcatcgataatctggccgtgagatttgcaaatttaagtgcgaaaatgataccgtagcgaacatcatcagtataaccatgaaatttttatcgaatctcaactttcagcaatgggcatacattcatattatttttttctcggtgggaggagtaccattccataattgtgtccgtgaaaagggtggggagcggcagcaattttaaccaatgagcaggatagaactactgtggatgggtactactagtagtagtacgacggattcttttgcaggcaactcatcaagaaagcgtggaatggaatccaggagtgggagatactctcttcgttccatttcaagtgtagctgtgattttccgtgttcaattttgatcgtctgttttatttaaaatatttttataaattagtatttttttgttatagatgataaaatatgaatagtacgacttatatttttaatttattttcaaatttttttcaaataagatatatgattaaagttgggcgtgaaaaaccatggctacacttaaaatgagacggagggtgtaaatatttgtgaaaaaaaaagaagcggacaaatgcttaaaaggacggtgtttgagaaggactagcttcgctggagtggagggactgtggttttcgacatgcggagaaaccacggccgacggccgggcccgttgtgagggattgattggttttcgacatgcagagaaaccaccgctgacgggcctgttgtggttttgtggggggactggtcattattcagtggtcacttcatgctgtattcctacatagagtaagggcaggggcggatccaacgtgggtgcagggggactcgaggctccctacacccacaagacccatgaatatccccggagcacccccttcaaatttttcaccatgaataataaactaaaggtttctagatagctggaggtggaagaaactgtgtaattgaacccctccaatttttttgttcctagatccgcccctctaagggccactttgaatcgtagggtagaaaaaacgaaggaataggaaaaacacaggattatgacaggaattgaagtgtaaaacagatgattgcaaaacacaggaaaaacataggaatggttgtttgattggagcacaagaaaaacgcaagaatcagatgagagagatagactcaaaggaaattttccaagaggttgaagctcttgctaaatttcctccaaaatccacatgcaatgtgccattccataggaatttcataggatttagaaagcttcaatcctttgaatcaaagggccaaatagaaaaatttcttataggatttgaatcctatgaaattcctacataaatcctttgattcaaaggggccctaaagtttttctggtccgatgtacaggagtagtactacctccgtcctaaaataagtgcagctatgagtttccgcgcccaactttgatcgtccgtcttatttgaaattttttataattagtatttttattgttatgagatgataaaacatgaatagtactttactcgtgacttatgtttttaatttttttaaaaaaaattcaaataagacgaacagttaaagttgggcgtggaaaaccatggttgcacttattttgggacggagggagtactaatttactctctcgatctcatgaaaacctaaactagcatcggatgtaataagtactacctctgccttaaaatatagcaatttttagctataaatctagtcacatatgcgtccagatttgtagctaaaaatacttacattttaggacggagggagtagaacttttagtttagacagagatatattcagatttatgagatagaggaagtgctacgtttttaaaatatagttatttctagcatagtgacttattctgaaatagagctatttctacacgtattatcttctcttaaccaattgcacctattctccatttaatttcttccgtcatcttcttttctcaacaaatcacaaccttcatcctattatttctacctactaatttaatattgtgcccatcttggaacgaagaaagtaacttcgtatcaccgaaacttcatctttaaattaacgaccatagtaagaaattaaagtcgtcctcgttaatatgataatagtatcgtgaattgataggtaagagatggctgataggtatctaaggaataaaactaattgatttatgctatgttttttctaagaaaaatcaattatgggccttttgaatcacaggaatggaaaaacagaggaataggaaaaacgcaagattctgacaggaatatagctgtagaacagaagattgaaaaatacaggaaaaacacaagaacgaccgtttgattggaccttgattggaccataggaaaaacgaaggaatcaatttttctaagagattggacctcttgttaactttcctccaaaatctccgtaggattacccattacatagaaattttaaaggttagtataggattcaatcatttgtttcaaagggtttcataggaaatttttccgtaggattgaaacccttcaattttctacacttttcttacaatctaaggggcccttaagtccttccgata

SEQ ID NO: 54709 - DNA, 1202 bp, Oryza sativa
taaccgattatgagacccgtgcctgggttaaagaatatagcattcagactgaatcgttcatccctgttcttgagtacgatgtaaagccattgctggtattagatgatgggaggatactcatatggttaggatcgacaggactactgctcatatatgatccaagaaccagcagttttgcggaagtcaagatgagacatcttgctgaagttggcatgtacacaggaagcctactgagtttacaaaatggtgacatggtgtagcattgtaatattatgttacacacttcagtttgcagttaatcacttatgcaggaaaccatttctattgcttttggttttggaagtcatttttggacacaaccataaaatgctggggttgatctcatgttgcattggagccagcaaagctgttgcaaattcttgaagatggtaggtgtctttatttatttattttgtacattcttatgtaaacataacgtagagtgtacctgtcagcatacattctggtatctgacataatttaggggaactgcaaccttacttttcagctgcttgttgggtggctagtgtgacttatgtgcaatttgatattttgattcaagaaaaataccaggatgatctgtgttatatgtgaaatttgcatttcgaatcttctgtactatattctcgtttacttctggaaatgactctttttgcagccggttgccagtcacttgtattcaattcaaacagaatattgtgtaattcagaagacatcaaacacaactgtactctgctcatcttctgtgcctaaactggatgctaatgaaaatgagttttgggaaattcaagtgttcgcaattacttgacatgtacagtccatgaacaaggatcaactaactcaagcctgaacttttctaaacttcagacctgagagtctgaactcaatccaactcgtgcagggttcatttttggaattaaaaaagaatcaagtaagaattttactgcctttattgcagataatcagataataattagtgctacttaagcacattcaattcaacctatcaacaactaatgatcttagcctgctaataaatacagtgaccgttagaggactaagctcctatacatctctatttctacatctacagaagaatctatttctacaaaaggacaatgtcactgctaatccatctctagctccatagatcgaacagctca

SEQ ID NO: 54710 - DNA, 11373 bp, Oryza sativa
cattgtctgtcagcagcaggctattgttttaacctataaatccttgcttatttcagatgagccattttatcagtaatgatccatttcttcttaatgaatcagtagtgtatccaaagctgatacttgtatctttgatcttccatcaatctattgtcaccatttatatccttgactatgtggatttgtattgctagctcatctggacaatctgatattctacgaattcagaaaaattgcagcagagtttgcaatcaaggatatatgtgggctgtcgtattttctgagcattgaagcaaataagctatctggtgatgaactgatgctggcacaaataaatgaaaagaggtatctcattgatctgccacaccggacaggtatttgccaaacagattgccacttttatgtcatgttcagacatcagactttcagaagctatactagactactgctggtgctggtgtgctacaatacttgatgatgacagggtgcgttagtatttacaagctcctacagatgtgcgttagtactctgaacttctgaaggcacagctttgcactgagttcaaaattcagagaatgcagtcaagctcttttcagcccgttttcaaacacggacagagcagatttttctgatcatcaccagatcaactaatggaaatgtactgtgccttgtacctaacttcatatctcctggtgctcacgctgtctcacgatcaatcacacaggctgaatacaatgctacggcagagttagtatgtggagtgacaatcttgaagcaacttacttgatgacgataatgtttgcctattatgctttaactgctggagattaatacatcagcttcctaaattgatttgtgactcaaatttaggtgttcacaattacttgacattttcagtacatgatcaagaatcgattaactcatgtctgaacttttctgaagttcagacttggcagtctgaactaaatacagttcattcatagtacacttttggaattaaaagaataatcaattaacaatttggcttctttcattagatataatcagataatacaattagtgctacttaagcacatttgattcaacctatcaacagctaatgattatcagctttgctaataaatacatctctgcttctacatatacagaagaatctctttatttctacaaaggacaatgtcactgctaatccatctctagctccatagatcgaacagctcatcatcaatggtgaagtcgatgcagctcaggtcgtccatcgtctcggcgaagtcgatgcagctcaggccatccatgctgtctggaactccaaaaccagtggcctccacgtccatgacgcccgatgaggagtgctccttctccttgtccggcgatgacatcatggaccctgcaccaccactggcgtcgacttcggcttcatggtcatggccgccttttgagggagagtcgaccggattgcgcgcggcgtactcaagcggaaccttcagctcagcctcatagtacccgggaagggaatcatccaccatgccggagcagctctgatcggcgccgtcagagtcatcggggaggtccaccactgctgaaggaggaggagcggcgccggagcagccatgatcggcgatgtcagagacagagtcatcgtgatggttcaccattgctgcaggaggaagaacgagctcctcgatcagagcagtctctgacacggcgctagtgcagctctggccatccatggcggcaaagtcaaagcagctaaccatgtcatccaggctctctggaagctcgaagaacattggcgcctcgtcgttttggttgtccagcgatgacacccaagacggcgctggtgctgcacggccacccccggcaccggcttcggcttcatggccaccttctgctggagagtccaacgggtgaatattagcaaacaccatggatgaatcgtccaccacgccggagcagctttgatcggcgccgtcagtctcattgggaaggtccaccactgctgaaggaagaggaacggcgccggagcaaccttgatcggcgttgtcagaggcatagccatcgtcatggttcaccattgctgcaggaggaagaaagggctcctctgatatggcgctagtgcagctcgggtcgtccatggtggcgaagtcaaagcagccaataatgtcatccatgctctctggaaactcaaagaacacaggcgcctcgtcgttttgattgtccagcgatgacgcccaagatggcgcgggtgctgcgccactggcttccaccggtggtaagacgatcaggtcggaaagattagcaaacaccacgccggagcagctctggtcatccatgttctctggacctccaacatcagcaaacgacgacatagattgcgccggcaatgcgccaccaactacgtccgcttcagcttcatggcttccttgtggcaaagagacgaacaggttgcgcgcggagaactcaggcacaaagctctgcaactcatcctcatcggtgacgtcagagtcacagttcaccaccggtgcaggaggaggaacggcgccatcagagacagagttcaccaccgcagcaggaggaagaacgggctgtggcggcggggcgctgtcctcgagcagagcagtctcgggcatggctatctgtggggcgcagcgcgctcgaccgtcgtcgtggtgggcgctctgagattccggttccctcttgcgcttcttgccgtggccgctgaaccggatgcgatacagccgcatcgtcgacgacgcgaggtcagccggcgtcgtgatggcgtactcgtgcatcacccaccccgagctccccttctcgccatccgcgaagtagctgaggacgtacttgcgccacgcgatctccaagccgccatcggggacgaccagcctctcaccatcgacgcacatcctctgcccctgccagtaccctccgccctcgaccgtgcgcttctgccggctccccttcccattcttggcccgcgcgtcggcgaagaagaacgcctcatcgcccctgccatgatccgcaagaagcctccatggcggcgcgcagaggggatcagcgtcgaggatgacgccgtggagagggaggggcttaccctggatgcgcgcgaggaggaagcgggcgacgagctcgtcgtccttgggctcgaacttgagccccggagggagcccatctccagccgccgacgccatgggagatccgcgggagaggagtggaatttctagggtttgggaggagggtttggttgggaagagaggagacgatttgaatcgaggaggggatggggatgggagagcaacggataggaggctatttaaaggcggcggcttcgcgggatcagcctcgcgctcgcgcgcggaaagatctggtgagtttcccatttttcggaaagtttgatgaaatatcttatctttgcgattcgatatgaaagttatttagaaaaaaaatagcttcaaaattcgaggtgaggttggtttgaattttgcagttctgctcaagctatacatacgtattgctgaaggtgacactgaacaaatgatgtttgcagcctattggctattgcagtattgccaattgctgaaggcctgaagctgacactgaagaaaagagccataagaaagattcaggatgaatatcaccaaaagaaattgaccaattgagcaaatccagctgttgacgaaagttcgaagtcccttgatttgtcttttgtcttgaggaacattgatgaggttaccgcccgttggcacagttctatgttcttaattgctctgaagttcagactttagagcctgcactcaatctaaatcatgcagagtaaactattggcacaaacaaaagaatcaagaatttttactgccttcattggagatagtcagataagagcctacaataattaatgcaacataagcacattcaattcaaccattagtgattgtctgtcaaacggattttgtgatatctgaaatactgaatgtgaatgctacggttttgcactgggcttaaaattcagaaaacacagtccactctttacttctgtgagagcattttcggacgccgactgagcaagttgttctgatgatggcagatcatctaatggttgatttcctggtgcttgtggggggtgatttgaactctgaagagattgtttgggtgcagtacctgcctcaagaaactaggtgttcatcaggttcagagttcagacccctcatctcctccttggacaagtttttcagacatttttacaaagccaattgagggacggccgtttgagaagcttggatgcaatctgaaattttggactttgttaatgctagttaataacttaggattgtggggagatagccctcctctgctagcaggaagaacggatccaggagctgaagattcagaattagcatatgtacagtccaaaagtgattggccactcttcaattttttttaattaagcaaaattttgttcaaatttcaacttttttctaaccgaaatttctgtaatgtccacaatttcgcttctatcagtaaccccgaaatatttgtgatttccaccatatagaaccctacggtctttcccttaaaaaaaacctacagtccatgaagccgaatttttttaggcaaagatttgaagccaataatctttcataaaaaaacaaaagaaaaagtatgaactcaattaaataacgtgctggcgtgaaatatacaaaactcatataggagtacatctcttcactctctgctctacagaaggcactcaaatcaattcctacacgcgacaacgtgccaatgtcagtcttgatctcactccaaatcggatccaatttaaatcgtgttcggacttaaattcggattcgaactaagcgtcccggcatataaatcggatccaaattaaattgtgttcgggcttaaattcggattcgaactaagcgctcgcgccatattaagcgcgcccgccaccgttgccctcgataactcgtactacataatcagtgcgcctccggaactagattcataagccgtctcgaccagctcgctgtggcgtcatcaatggcggcgccgccgagaaaccgcacgacggagaaggcccatgttgacgacgaggcgttgcagaggtattgcggcgcgtggcgggacatgcagtgccctcaccgcggcggcggcggcggcggggacgcgttcgtcgtcggcgcggtgtaccacatcgccgaggacctcaccgacatcaccctcatggacgcgtactccggcgaggtcgtcaggcggatggacgggctgagcaggccaggcctcagggtctgcgctggcggcgacatgatctgcgtcgtgagccccggcgacgggctgctccgcgtcgtcgacgtggccaccggcgacctgaccgacctctcgatgggctgctcggcggcgacggggaggaacgtctcctccgggtacacgctggggaaggtgcccgccaccggcgagcacaagctgctccacgtctacgccgccgccaacgggtcccagtcaagcgaggtcctcaccatcaccaccggcgccggcggcggctgccagtggagggcgacgcggagccacccgccgatgaggatcgagcacgggatcagccggagcagcgcgaccgtcggcggggtggtccacttcctctccccggccaccacctccgccccgcgcgaccgcggcgtcgagtgcgacaccatcgcggggttcgacctcgcgacggagcagtggaggccggtgctgatggacggcccgctccccgccgaccagcgccaccgcgggcagcgccccaacctcagcctcgccgcgctcggcggccgcctcgtcgccgtccaccacgactaccccggcaggaccatcaacctctggtccctaacgccgaacaccacgacatggacaaagcttcactcgctcccgatcaagaacgtcctccgcgggtgggaagaagaaccgacgagccacccggcggcggcagcggaggcgaagcgcggcgggcgaagcaagaagaggaagaagaagaaggaggaggaggtgaggtggttgtgcagggagaaggtggcgcagccgctggcgatggtgggggacgggaggatggcggtgtgggcgagggggtgcgagggggcggtgcggctgcacgacccgaggacgggggcgtgcgaggaggtggcgcaggtggaaaagggcggctgcgtcctgggcttttattccggggctctcgcgcagggcgaagagttctaggtagcacttgggtgtgtagctagacgaaaccttaagtgttactgcaaaagaattgtatggtaaaatagtagagatgagtctcttgcgccgctcatatataacgggcaggcgtgtgtatggagagattctttttcttttttaaaaacaggaaaaaagtttatttagtataagttttaattactctattgttaattaatgtgatatacttccttttattatgtaatatagtaaatatttagtatttaaatttatattaaaatttggttttttctccctctcttatcttaaccaattacaattatcttctgtttagtatctctacttatttcttcatctcaaccaatcatatttatcttatttaattctgtcaatttttcagccatgtggagaactctaaaaataacttaggaccgagtacactttaccagtattaggaaaaacaaaccaaatacactctacacatttctaccctaccaaaccaaatattgataatgctaaaattcgatattaccaaagattgatactgtttattttggcatcaaaccaaacaacactttggtgagttggtatacatccggcgttagttcagacaggagaagggtgagactgctgtgagattatctagttaaatacagtgatatattataagagtaaattgtgctcgcagtatataaatttgtgtggtgggtgcaaaataggtactacaacaactataacttgcacattctgataaagtaacttgactagtccatcacaaatcgcaccgaaattatccatgcaaacaaaattattgtaaggttccaaactgatagcatgtattactatgttttagagatcttatttggaatccaaagaaaaaaataaattaattgtgcagaaattttcatgtacaggacaagaatttattttttttatcatctgtataactctgtataatgctcacttatatgttcaggagcaacaaaatttctgccatgccatagtctcctgaaaaattcattttaattttcattctcaaatactccatttcaccaaaaacttgtttttagaagtttatttccatggttgggctttttcaattgtttcactttttttcaatctaaatctgaaaaatatcgagcgcataataattatacattttgtcggtctaaattttgtgtaatagtaatatgcgccacattagctcaatttgcttacaatgaccgttttgccccaagttctcacggactaggtaagttattgtatcgaattgagcaatttgctagttgatgtacctatttatacccatcacacaacttcacgcaccatgagcgcaatttactcatattatcgtattatatctataccaaattaaaaaaaaaatctaaggcttccttagctttttttggtgcatacgtcgtcgtctctcagctgacttatttggcctcttcctcccgctcccttttctctctccctcatggcctccatctctctccttttggacctttcctccttcggccaaaagtcctttttcacttgtctccttgcctcggcctgctccctctcctctatccgttggcctagctatgcttaggctcagcccagccgttgctagttctacttcgacacacgcctccagccgacatctattcttatctcccagccaaaccctagcatcgttgccacgtcgatccgtctccctgtgtgcttcctcatcctccaaccgattgcaaaaatcgattccccactcctcccttgtcattccccatgattttccctttcaattcggctttaatttgccggatttaatctccgtctaactgctaatgatggccggtcggcgagcttccttgccgcttttatcccgagttttgcggaattgggttgtgacatttgcatgtggattctctctgatttttgggaaacgaaaagagcaaattgagtggatcaaaagctcttaaccaattttgggagatcgagaaagattcggcatatttgatggggaggatcagctctagcatcatacaaggtacgtgactgtcgttcagaggttgaagacgctactatagcgcaacgagaggagacagctgacagtgctagctagacgctccacttgtgagccgagccaaagagataaaggtcaagccgaatgaggtaggagatagcgaaccagactagggctaaacatagagaaaggaatgaattttacctaaaactaaggtaggattgtacttactttttttcaattataatgtatagtgatatcaatattttaatttattgtttagctcttaacagttgtttaacatatatctctactacttaaaaaagtgtagtggtggtcttgaatccccatccaagcagccccatggaatatgaactattggatcgcgaaatccaacgcctcgatcgcctatcttttcttttcctcgagctctcggggttttggactatttgccactctcccgaatgaattcgctattttgccatcggggagagaagattcttgcttgtgtgccatttttgagcccgcaaggcgccacgtcacccgatctaatgacaaaataaccatcttacccttcttcttcatttctcctccggtctttttcatccccttcctttcccagggcgccaaggttattgggctccggtgagctccccgcctcgcacttctccctcctttgcttgctccttactccacggcccctgctctttcttttgtgtcatcgccggtgccttgcttcatcgtcaccgtcgtcgccttctttctcctctcggctcttttccactctccccgatgtcggcggttgtgtcaagtccaacctcgaggcttcccctaccttgtcattcgccacctagcgccaggaggtcggtccggcggtggtggtggcggtgtcaccagctcacacgcaaggaggaaggttggaggagagagaccccgagctagaggaagaagataggcaagacggttattttgccctcggatcaggtgacgtggcactttgcaggctcaaaaataatactttgcaggctcaaaaatgacacacgatcaagaaatcttctctccgatgacaaaatagcgaagccaaccttgagagcggcatttgaaaacacgccaccgggagagtggcaaatagtgcaaaaccccacaacccaacaaagctctcatcctgaaaccgccgatcccctatccgcctcacgccgccgcatacccactcggtcgctccccctcaaccgccgccgcccccatccacgccaacgccgtcgccgccgccgccgccgcatcccctccaacgccatcgctccacgccgcagccgcatccccgatccacgtcgcatccctgatccacgccgcaacagccgcatcatcggcctaccctccatcgacggcgtgattccgcgcaacggctggaggaggcgaggtcgggccttccctatcgacgctccacgccgccgcagcccgcagccccgtcggcgccgtcgctgcgtcgctccatcgtcgtcccgacctcgaaggtgaacctgcttcgagtccctcacgccgccaccgatcccaggactcgtcaaccctgcaagccatccatcctgcctgtgaacaaggtaagagtgctgctcgatccagttcctgtacaggaggcatacgaggcagggtatgttagatgcataatggctttagaaatcccctgcgttgactaaatccccattgttcattattaaccattgttcactgtgcatgtatatctgtgatgcaaaactctaatccaaaatctgaagttcaaactctatcatattagtggtttactgtacctgacaagcaaacatctcaaatttgctactgttaatgtatgctactgaaaattctggagaaaaaaaaaacatcgtacgaacgttttttcagttctctaaaaaattcagaaatatacagtacactctgggaggttgacagccatccgattcaaatcgaacggacgataccgaccgtacacctctacagagctcgccctctactacgccccttctccgactccggcgagcccagatctcagcaggtcgccgcagacctctccgtcggcggcgagagggtttcgatccacccgcagcgccatggccgagctcgcggcgggaggcgaccagcgcgccgcgctgctcgcggcggccaccctcttcccgccgccgcccgacggcgcgaggttctcgtacgggacggcggggttccgcgcggagggggccgccatgggccccgcggtgtgccgcgccggggtggtggcggcgctgcggtcggccaagctgggcggcgccgccgtgggggtggtcatcacagcctcgcacaacccggtccgcgacaacggcgtcaagatcgtcgacgcggacggcgggatgctgtcgcaggactgggagccgttcgccgacgcactcgccaatgcccccaaccccgacgccctcctccaggttgcctctccttcgctggatctcagcttaccacatgccctgaccttgttagattgcgtactacagctagctagtcagttcgatttgttactgtctgacgcgtaatctctttcctctgtgttgatttttgtaacatgagagctaattttgttaataggatgagctagccagatcgccagtcacctaagttagggtgtgtttagttcacgccaaaattggaagtttgattgaaattggaacgatgtgacggaaaagttggaagtttatgtgtgtaggaaagttttgatgtgatagaaaagttggaagtttgaagaaaaagttgggaactaaaccaggccttacaaactctagaaatttattgaaccagagcaggtgatgctcgagttcttgggatgctccaaattgtgctagagcatggataacacttcacagtttctaggacagtgcatgactctttaagtctctaacatgaacaaaacatgttgctaacaagaatctgacagctctagagatgacagtattggcaccattgtcttgtcaaagttcattcagagctgaaccaatcctctatggtaaaatatactgcaagtcgtaaaaccttgtggttgtacttggtcctcttctgagtttactttgtttctttcactccaccatctccaaagcaaattagttatattcaatagtttctctttagaaaggtttcaggtttcctccatc

SEQ ID NO: 54711 - DNA, 2225 bp, Oryza sativa
aacattcttgcatttgaaaaatgagtggtcatcatcctcatgaaacctccagcatattggaattatagtaatgttaaattccttgatcaatgttaaagactctgatggtgctaattggtacttgatactgttggaaaacagaacttcagtgcctcaatattatcattggattgaactatggaactaatgaggagtggcatcttctgcctgagatgttaagtttgttcagatagttgatagttttgttctgcctactcttaccctcagttttcttttatgtttgttgaattgtagatagtgcttcagtttgcaaaagatgaggatattaaacttggtggaagccactcggcacaagtgctgctggcaagagacacgaggccaactggagagtacctccttgatgtggcggtgaaggtatgacatcaatttacatcctttattctgtattcactgtatgtctcatgttcatgagtcaatcttaatagttttctggaactcatgcatgaagggagtaaatgcggtaataggtgcagtagcagttgacatggggatcctcaccactccacagctgcattggatggtccgaagtaaaaacaaaggactgaagtcttctgagacggattatttttcacaagttattgattcattcaggttcttctgaatttaattctctgctactgtaagtaataaatatgtggcatctatttgtttgcataatttaactatattgcaataggtgtttattggagttagtcccaaaagataaagaagctgatgtgataaacaatagactaattgtggatggagctaatggcattggtgggttgaaacttgaagaaataaaggcaaaaatctctggattagacattcatgtgaggaattcagggaagggagaagggatacttaatgagagttgtggtgcagactttgttcagaaggagaaagttgttcctcttggctttggtcctgaagatgtcggtttcaggtgagtcagttaattgctccttaaatttctacttgtcagttgtcactgatcttacctggccattctgatctaactttcaggtgtgcaagttttgatggcgacgctgaccggcttgtttatttccgtatcgtatcctctagtgacactaggattgatctcgttgatggtgacaagatattatcactattcgtgctgtttattagagagcaattagatattatcaatggaaaagacaataaaggaaatgaagtacttcctacacgttttggtgtaattcaaacagcttatgcaaatggtgcatcaacagattttctcaagaacattggtctcgaagttgtattcactccaactggagtgaaatatcttcacaaggaagccctaaaatatgatatcggtatctactttgaagccaatggacatgggacagtgctattctcagatcattttgtctcacaactggaatctttgaccagtgagttttcttcaaaggctgcaggtgaactcttcatgatttttccagcatttcttttctcttttgcattgttggatctatttgtttatggttgtcgtgatgtttccccctttccttttaccttttcacattaggttcttcacaacaccaagctgctatgagattgttggccacaagtcagctaattaatcaggcagttggagatgctttaagtggaatgcttttggtggaggctgttttgcaatacaagggctggtcgtttcagaattggtgtgacctgtacactgatctgcccagtagacaattgaaggtattttcgccaaagtacctggagttattacctcttcttttctaagatacgcctctagttatcactgtcatatcaggctcccataatataattatgatttcaggttaaagttcaagatcgaaattctattgttacaacagatgcagaaagaagggtttgccagcctaatgggctgcaggaactgatagatggggagatatgtaagtaacatcttctctgagcatataatacttatgtttctttccgacatccgattttcttggcataaattgaagtgttactgaattctgaggtaccctgcagctcattactctcatgggcgatgtttcgtgcggccatctggtaccgaggatgtggtgcgtgtatatgcagaggcatcttcagaggaagcagctgattgccttgcaaaacgagtggcgcagcatgttgagcgcattcttggataatttgccttccct

SEQ ID NO: 54712 - DNA, 1620 bp, Oryza sativa
ctgctggtgtgttttggcaaaggcaaatgtgctgttgctagggcattgccaccctgtctcttagagcattttgtggcgtcctgctaagctgaaaaggaaggggatatataaaaaacagacaaactcatcatgggctggctaaatgccattgctgggttaataacttaacagtactacatgataaaaaaaagaattaaaatgtttgtgaattagattggtgatgtgtcagaggcactttcttttttgttttcatctgattttcatacgatggtttaattttaagcagattttctttataggtatcgaagagattgcaggagcttcttcttgttttcttctcagagatgtttcgctcagagaattggattacaatttagctcaggggcaccaccacaccatgtgatgtgcagcagtgcagtttgaatttaacgcggcaggccacaaagaccttgttcagattgttgcgtaaataatcatatcaatgttcgataatatcaaatgatatagttttgtgctattaaattttggtagagttagggttttgttgccaaaatcaaccttaccatttgttggtaaagctaaattttggacaagttgaaaatgtaaaggtaatgtttaccttatcaaatattggcattattttatgaggagaagtttctagaatcttgctaaattctatgggcattaccaatatttggtagcaaaccaaatgaagccaaattttggcaacttgcgaaataatggttcaaaatgacaacaatctgaacggcccttagatgtattgggtttgaagcctcaccaagttttgataccgttttagtgaaagtttctagaattaattatcaaatcttgttaaattagtatattttttatttgttatccattaaattttggtattgttaacatttagttaagtgaaagtgacaataaactgaaagtgccctaaattagattaaaaggggggggggggtcaattttaaggtgggagaatattaaaagagacaaatcaagggtagctggtaaacaaactggagaagcaccaggaaattacgtgtttcttactacaagcgaagcgaggtcagcactcaactatttgatcagacatgtggcgttcatgcatggatggatcatggatggaaggtgctagtgttgaccgttgagtcaatgcgctacctttctagaaggagaacggacatggacgcctgcatgtgtggaatgtcctcgctaaaacagcttattttaacaaaataaaaactaacttataagtaaaacttatatatattacgtagtgacttaaaagctactccctctgtctcataaaaactttatttttagatttatatgtccaacgtttgaccgtcaattttattttaaaaaaattatgaaaaaaatattaacgcataaagtactttttatgtttctagaaataaaaaatattaatcatagaaaactcttaaataaaacgaatagtcaaatgtcatatccaaaaattgaaaaataaagtctttgtgtgatggaggaagtaatgctgaaaaaaaaactacgataaaaatatctaaaaccaacatctaaattgagttcaaaatttaaaattttgactttacctttgtcttattaggg

SEQ ID NO: 54713 - DNA, 10786 bp, Oryza sativa
ttggtaactttaatagtagaaaatacatgtttggtttgctactaaatttttatcacaatagtttaaattcattactccctctttccctaaatgtttgacgccgttgacttttttaaacatgtttaaccgttcgtcttattcaaaaacttttgtgaaatatgtaaaactatatgcataaaagtatatttaacaatgaatcaaatgataggaaaataattaataattacttaaatttttttataagacgaacagttaaacatatttaaaaaagtcaatggcgtcaaatattttgggatgaagggagtactaaccagtttgatagtggccaaacttggcaaggcaaaaattgacatcaaaccaaacaaacccggcgtcttaacgaaggaacgcggcagccatgcaccgccaccacctggcgattgaaacaggagaaggcaaaaaaaaaaaaatctctctcacacacacacacaccaccgcgtgccccaccggctgccgttgcgagtccagtatgtgtgtgtgtacgtgtgatgcgctgggtcgatgaccttctttcttgcttgcttctccgcgttgattacaccacacgtgggcgcacagcgcactcggcagtcggcacccaggccaataccaggattcatcaaaccgttttaaaggctatggccttgtttgcatccttcgagctattaaatagccctttaaaatcttgctatttagaagtattaaacgtagattaccgataaaaccgattccataatccctagtctattttgcgagacgaatctaatgatgtatattaatccataattagcggctaattactgtagcaaattatggattaatataactcgttagattcgtctcacaaaatagcctaggggttatgaaatgggttttctcagtaatctacgtttaatacacctaaatagtaagatttcggagggctatttaatatatagccctccggatccaaacagggcctatgttccggagtactccggttctctagcatgtagaacggagcagtgtttatatgattaattaaatattagttaaaataatttttaaaaatagattaatataatcttttaaagtaacttttacgtagaattttttttaaaaaatacaccgtcagttttaaaagcttgcgcgcgaaaaactaggagggtgagctggaaaattagacataagaactcagcataaatagggttaccatcaccctatgatttgacgtaggactatcgtattggataacccgtaccatatccaattttacttatccccatcacaaaaatattatccatacctaaattaagtgggtattgctcaatgggttggataacccaatagatataagagaagagacatatgtgggtttcacccgtagaaatggatcaaaaattatactccctccgtcccataatataagggattttgacaatttgcttgcactgtttgatcactcgtcttattcaaaaaaattatgcaaatataaaaaaacgaaaaattgtgcttaaagtactttggataataaagtaagtcaaaaaaataattctatttttaagtaagatgaatggtcaaacggtgcaagtaaaatgtcaaaatcccttatattagggaacggaaggagtacaaaattgctcttaatatataataaatcatccctccaaatttcagttaaatttgataagattttctaatgtgaacgcgagtttaaaaattttaggttcaaattttacacgcagcaaatgggtatggacgaagtgggtaaaatggataataccttccccaaatctaaagtttaaatggtaaactttttcacctatacgctacccaaatactacctccatcccaaaatatttgacgccgttgacttttttaaaaatatttgaccgttcgtcttatttaaaaaatttaagtaattgttaattctttttctaccatttgatttattgttaaatatacttttatgtatacatatagttttacacatatcacaaaagtttttgaataaaacgaacggtcaaacatatttaaaaaagtcaacagtgtcaaacatttaggaaaggagggagtatgtgggtatggatatggggttgggtaatgaatgcccagtggaatgcttaaatttgtaagcatgaggtataccatggttttaaaaactgacgagattaagattacgtacgatgttgtaaactctgtaaactctacccaacacccatcgcctcgtactgtaccaccggcgtaaaggacggatgccaaaacttagaggctagagagtagagtagactaattattaagccaatagaattaaccttttttttcgtgagatttcattttcttggaaacttttatttaaccttttcaaataaagtatgatgcctttttaatcgtacgaaatattcgctacgaatgcctcgatacatgtcgagcaaagttggcaggagcgccttaatcatctccaaaattatcttttaacctatctctcatctaatttatgtgaaattccaacgacttatttaaacggtcatcgttgtgtttttttttctacttctccattttacatatgtatttcatataaaatcatgtgtttatatttatttccgtgtttaacatatggtttcattttaagtaacttggagtacagcgagcgaagaaccctgtaattaaattttggggaaattcccagttgaatatatatttcgttttaagtatctatctatcactttcttacttttaccatgtttttgtaaatatcatacgctaaattatttctcgttccgttcgtcacttgtcttcacccttcgtccacgggtcgagtctacttcatttaggtattacttcaatggacctttatagctacttgtagttaattaattagttttcttcattaacttatggagtaatatttttgcctagagttaatcaacatgagtgacgggtttgttagcttggacgtgtacaaccgtacgtgtgatcgacactactataaagttggtttttcatggcgataccattttttttttttgctggcagttttgtgcaaaaaccgctagcgaaattgtaatgaagggtgaggagctaagaaccgccagcgaaaatagattttcgcaggcggttgagctatatagtccgccagcgaaaatagtatattttcactagcggcccttataaacaaccgccagcaaaaatcattttttcgctggcggtagttaaggagacccaactgaggagagaaattccttatataaaaatttcgcacaggccgcctcccactccaactcccaccggtcttatctccttcctccctcctcctcctacgcccctagcctcctcctccttctctgcgctccttcctcctcctccacctatcgacgtcggcaacgaagaccccggcgaactggcgacgacgacggcggcgaccacgacgggcgggaggggggcggcgcgggtctcgcggatccaccgccgagaggggcgcaggccgtcgatccccggccgggaggggcgcaggcgcggtggatctggccgccggagggccgtgggcggcggatcgggccaccggagggccgcgggcgggaaacgagccaccggagggccgcggtccttcccctcccctccaagcgacggtggctccgatctgcgtgggcggcgtggtgggcgactccatgtgcacgtcgatgacggcgagcacctcccccccccccctctccgcggcgtcgggaggtgggcatgcggcgacggcgacgggaggcgggtgtgcagctacaacaagaggcgggcgtgcggcgacagcgatgggaggcgggcgcagagctccgacgggaggagggcatgcggcaacggcggcgggaggcgggccgcgggcgcttcttctccttctcctcctccccctccccctcccacagtctcgccaccaacacctcctcgccggcggctggggttcccagattcagtgtctcccccatcggatcgagctcggctgctgctcggtcggcgacgacgacctccttcctatctcctgcccagatcgatggccgctcctctagctgctggtgatgatgtttttttccatgttctaccattgttcaaaatgcttgtatgcctgttcacttgcatgttaattgaatctaatgaactctctgggatgaggatttgaatcgtttcctggaaatttggatgtggatttgaatctaaacatgctgcaagttgggattgtgattggggatttgggacaaagatttgggattgtgattatttggcacaatgatttggaatttgtgatactattttggacctggattttcattgtttttcgctcaaaaaagttttcgctggcgggtctcttaatattgccaccagagaaaaccgattttcgttggtagccgtcttactgttgccgccagagaaaacccattttcgttggcggccttcttagtatggccgccagcgaaaactcattttcgctggcggttggctgtccgcctgtgcaaatgcattatttttactggccttttgttactggcggcacgccaacgaaaacctaatttggccgctagcaaaaatcattttcctagtagtgcgatgtatgttaattagcacataattacatacttaattttgctaatactgagttaggagagggacaagctagagatatgatgcgagccatgtacatggagaaagcaactcatgaaaatttcaacttccaaattaactccaatgcaaacagaaaatgaatatgaaaaatagtaggatatcttttatactccatatagcatcgtttctaaaagtcaagattttcgaacaaatggagggaacattacaaattccatttctaatcatgaacgcgtgtttgagaaaagctgggaacaatccaataattcagtgtagcacgttgatcaacaggatgaccaaaccggaagtctaacgttgccagtctcgtgtcaacattagatggtgtagtggtgtactcttcataatagcatttttcttgggaaatgttttcatatacaccataactaaagggctcatttaaagaaaatcttgacaaccaacaaatgccttacaatacatttcttttattgaagaaatctagctacgaatacacttgcctttggaccaatctccttattccaaaatgctccccttctctcgcgtgaataaatggttgttacttcagcgcgtacgacgaaacatgttatactccccctacctaaatatattgattttattaaatatgtttgaccattcgttttattcaaaaacttttgtgaaatatgtaaaactatatgtatacataaaagtatatttaacaatacattaaatgataggaaaataattaataattacttaaatttttttaataagacaaacggtcaaatatattttaaaaagtcaatggtatcaaatatttagggtcgggtggagtattagtttttcaaaagtagagtaagatggaattatttactcatgatctaattgcttagctttaacatatgatcaccaattctaagattaatgtggaatttggatgattaaaactgaccggattaagactatatattccaagtaactacaactatacgtttgataacttatcctatgctatctacgtattgtatacggaacttattagttagataaacaattgtttgagtactcattgaatatcaaagctaaaaatagaattcaataacctgtaacaaattatctgtctttaaccgttattaattcctccgagcagaaaaagagacggtttctccgataacatgtaaaaccccataacatctactccctccgttccataatataaggcacaactattttttttaaatgttccataatataaggcatgcatgcatacatataattaattaggaccttttctccattaaattattacttttttaaatcctccatactcaagatctctaattctattggatgcatgcattatatttattagagtgatccaaactaggagatgataataattgtttcttggtctttaggttaagggtggttgtgctttatattttggaatggatggagtatctatttagtaattgctttaaccaacacaacaacgcttacctcctcccattcgagtctcctgtgtcactcaacgcgcgtcattgatgtaaaaggtcgttttttaatgagtttgtgacaactgcagctttaattcttcaagcagttgagttttttttatcctgattttgagaagttatagttgtaaaattcagaaaacgaactcaagacatctagattctcagaagctcatataaagtgttgtttagaggagtttctagctgctatatcttctcataaatccccatctccactaaatagttttgattcttagaatctatagttacatagaattcatagaatgaattagaagcttagaaactgaaaaattcatcttctcattctaaaagttgattaccaactatccgtttctcataatcttaggaagtgtttatatgcagggctgtaaagttttagcgtgtcacatcgggtattatatagggtgtcgtatggggcgttcggacactaataaaaaactaacatcagtaaaccacgagatgaatttattaagcctaattaatccgtcactggtatatgtttactgcagcatcacattgtcaaattacggagcaattatgtttaaaagattcgtcttgcaaattaatcataatttgtacaattagttattttttagcctagtagtgcttaataattcatactggtgttcaaacgttcgatgtgacagggtgaaaaattttagagtgggatcaccttaataagctttaaaagcgtgcgtgtggttgtagagctcacaattcacatgtgctgccattgcggagttgcggtgtttggtgttccacccgccgcagctcaccaccgctagcgccagcctcccaacacacaacggtcaggtcccccgatccccgttaagtccaatccccgacaggtattagtaccaccccgcatctccccctcctccactcgaaacggctacttcctccccttcctccccctccaccaccttctagaaccttccacgatgccgccgccgccgcggaagcgcctcggccgcgcggccctgctcctcgccgccgccgcctacctcgccttcctcctcctcttcgagctcccctccctcgacctcttcccctcctccgacgccgcggcgggcgcggcgatgcccacccaccgcccacgccgccgcgagctcgaggcctcgtcgtcgtcttcggcgttcgcttcccccgtcctccgccgccccgccacggcggtgtctcccgcgccggcttctgctgctgccgcggcggctggggcgctcccgatcttctcgtcgctgctcctcctcccccggcccaacgcgacggccaccccgttcgacgggaccgccgcggaggcgttcgccgcggcgaggccgcacctcgaccacctcaggactgctgctgctgcggcggcggaggaagcttcgtcgtcgtcgacggcgccgacgtgcccgacctcgatctcggtgcacgcggacgggttgcccggggacggggtgaggacggtggagctgccgtgcgggctcgcggtggggtcgcacgtgacggtggtggcgcggccgagggcggcgcggccggagtacgacccgaagatcgccgagaggaagtccgggcaggagccgctcatggtgtcgcagttcatggtggagctggtcgggaccaaggccgtggacggggaggccccgcccaggatactccacttcaaccccaggatccgcggcgactactccggcaagccggtcatcgagatgaacagctgctaccggatgcagtgggggcagtcgcagcgctgcgagggctacgcctcccgccctgccgacgagacaggtgagctcgcagcgcggagatcgagctcttctgattcattccattttactaatttcattcggttcgatttgatttgatttgatttgattggattggattcggatttgcttcaatcagatcgtctggtggtgtgattccatgattgcattccgttagtttagaatcggcaaattcgatgttgatgatctggagttaggtgtgaagggggcggtttgttagttaggaaaaattagaggcgtcaacttcagtggtctaaattgcgtggaatagctttgcttggtggaaattggccagaaaggttcagcctttggcaagaaatttctagagaagggctgggtttgtttaccaatttctggagaatattttgatggtgattgtgtttgacctgaaaccgtgtctgttgcctgaatgtcgagtttgacttgataacgtgctgcggtgtcggtgggaagtgttaacttattattcttctctttttcttcctcaattagagggagctcaacgggttgattgcttagtttggcttgtaatagcctaaacgtcaaattggttgcaattaatctaatttagcaaatattgtgggagtgtagaagcttccaacttgcaagcatgcttgataacagtaggtctattttttgaatgagctataccagagtttgttctaaaaaaagagagctatacgagagttgcagcgagcatcttaaagcttgcagcatctcataactgggcattcttcaagacaaagttggaacatcattttttgcagcagatctagtttcttgtgatacaggaaaaagacttgtacttacaattaaagttacactgaagatctcttctactttaagagtgtagcgactttgcttcatggtgatgtctttggtctttcagttgatggccaacttaagtgtgagaaatggattcgtgacgacgacaagaagtctgaggaatcgaagatgaagtggtgggtaaagcgtctaattggtaggccaaaggatgtgcacatcagttggccataccccttcgcagaaggcaagctgtttgttttgactctaacagctggtttggaaggttaccatgtcaatgttgatgggcggcatgttacttcctttccttatcgcactgtaggtttttcttaaagcatcaaaaagtcattcagttgcatgagttcttgagcaccatcctgagatctccataactaattttgcccaactaatggtctctgcagggttacactcttgaggatgcaaccggcttatctctgaatggagacatcgatatcgaatccatttttgctagttccctgcccaattcgcatcctagttttgccccagagagataccttgaaatgtctgaacagtggagggcaccaccactaccaactgagcctgttgagctttttattggtattctttcagcagccagccattttgctgagcggatggctgtacggaagtcgtggatgatgtatacaaggaaatcgactaatatagtagctcggttctttgtggctctggtaactatcgattgacttaatggttttactactcttttgagtaaattcataatctaaccaattaaagtaaatttacagaatgggaaaaaggaggttaatgcagagctgaaaagggaagcagagttctttcaagacattgttatagttcctttcatggatagctatgaccttgttgttttgaagaccattgctattgctgagtatggggtaagtgaattgaacatgtaggactgttttgttattagacattagctgctatcccatctcacatgcttctctgcgttccaatttatccatatttatgctcatttaatttggtctgtttatgcaggtgcgagtcatacccgcaaaatacatcatgaaatgtgatgatgatacatttgttagaattgactcagtactggatcaagtgaagaaagttcgaagtgataagagtgtgtacgtaggaagcatgaactacttccataggccactaagatctggcaagtgggctgtaacttatgaggtaaattgttctttcccttattttaaagcaactactatgaatatcacattagacaagtgcaacttgaaaggatattgtgttgtgaaacatgcaataccctatttgccttgcagttgtgttttcatatgcttgctagccaatcattagatattcaccaactagcacatgttgttcttattttctcttcttcttttgatgaaatcgtcgacatgcataccattgttcatgtttccccttttatatgactatgaaccattagccgtgccactaaattatattcaaatatatagtatcttcacatatttaaaatccatgttagcttggccctttgaacaaggcaaacatgccggttgttcaaattgtacatatctcatgaaaaagctggcgctcaatcttctgcactgtccttagctgtcagcttttagcataagaaatggatgagacctcttcttgtcatcatattggatagcttcttttatttttgcaatagtaatatctaatgttgcaatgataactcctcttggcaggcatcatattagatagtttttttttttggcaattgtaatattctaatgttgcaattctgattctattttcaggaatggccagaggaggcatatccaaattatgccaatggacctggctatgtaatttcagccgatattgcacgctacattgtatctgaatttgacaatcagacacttcgggtaagcatcaactggacctagtatgtcctaccgtacatcctgctgtaacttgaactaaactgtagtgtatttctgtttcagctatttaagatggaagatgtaaacatgggcatgtgggtcgagaagttcaacaacacgcttcggccggtcgaatgggctgcaggaa

SEQ ID NO: 54714 - DNA, 14625 bp, Oryza sativa
  unsure (1)..(14625): unsure at all n locations
aactgcagtccggaagctcacggtgctgcaacgtgagatgacaatggcagcaaaaattagccgtattttggagcaaatagagacgatgttaactcgtaagctcagctcgctgttggaacaccagaaaatcatcagcattcagcgatgctgacggttcggaggagcgctcatcttctggactggacctgatatatgattcgttcattcttttggtcggtggctccgtttcaagctgctgatttctgacacctgatcaatgatgttcttgccttcttggggattctttcgcctgttgatatttatactcgcgtcaaatttatttgacctaggaatttttgaggctggtggtggtggtggtggcggcggtggtatgccggcggcatgttttgtgtataaaaaggattttatgagttttactgtttgtgagtatatattcggtggactcctattggctgacactcttaccattactgtttttatgagttatttttagctggggagtgttattagagagatccttttgaacgggcagtacattcgtgagggaattcaatatataaaaatataatttatgcttaaaatactcttaataataaaataaatcatgacagaataaatcatatacatgtaatttatttaaatatgatgaatggtaaaacttaattaaaaaaaatcaatggcattaaacatttaagagatgagggagatgagggagtatgtttgatgaatgtagtccctatgcttaattcattgctatgtcaaaatacgtccaattttttttattatgacagcaagttgtaaccctttctattatttaataaagagtaaattgcacttatggtacaacaacttgacatgtgagtgtgatatagtagagaattgaatgtctgggtgcaacaacttaacaagtagcgcgttatagcataagaactttgacaatttagtattttggtgcatcaacttggctaagtatatgctaggtaaatttttttcaccatgtcaatatgctatgtaatcctacggatattatcatattaccttataatattgaatttaatctttaagaattatactgcacatacaatttacatccaattaccttttaatttttttttattttcttcaccttctcaaatatcaatcgaaatataataatttctacatcagtttaattgacttttaggaaaaaaaatataaatatgcttatacaaatacactactgtatattgtcaaagtacttaaaaattgaatctatataaaaaatgctctaaataattaagttgccgcataacttgttaatttattgtatcaaaattatagctatcttgcaagttgtcgtatttatatgatcacttataaagttattgtactaaattacatctacatatcaagtttttgcactagaacactcatttcttaagtttttgcactaaattgcacccacctgctaagttgatgtaccgtgggtacaatttactctaaagaataaatctattctgtttcgataaaaagaaactcctattctgagttgtttcagaattctgtttgttgatatcaattgaatctttttatattttattctctccccaaaatttttttttgtatagtttagccgaatttaacttcagtggaatggattttccaaaaaggttcaacggaagggagtgaaaaataacgaagcagcacgcatggtatcatatgatgagttgcactactcttctcagttcagacttcggactgcatataacatggactgggctggacaacatactcggcttggtagctcacttggcttgtgaacagctcggctcgttgagaaatgctaacaagctgagcaaggattgattttttttattttaaattttatttattaaaatattaaaaacacaaattttttaaaaaaggtttacaaatctacaccctaactctccttgagagggcttttttaaaaacgcacttccagagagcattttttataacgtgcacacatgcattggtgtggtccaacggttgcgtaaatattttacagatgacccttgcaactctctaggagggcggcaaggggtccgcctgtaaatggccaaccacgattgttttgcaggtggctctctttataaccctttgggagggcagcaccgcggcaaggaggttgcctgcaaaatgaccggcgaccctccatgtggccattagaatacactaacggacgtgtgccacgtcacaaaaacatcctcaggaagggtggcattaggggtgtagatttgtaaaacttttaaaaaatatattttaaaaatattttaataaataaatttaaaaatttaaaattcagatttagctcggtggctataacgagctagctcgcaaactgttgacgagcccaatgagccagagaaacattaggggaataagttcactttcggcctctctatttgtcgcccagttcgattttcatccctagaccacaaaattgggtacgacccgtcccccaacttacgaaaaccgggcaaacgagatccctcggcggttttggctgacgtggcgcctatgtggcttgtttgactaggtctccatcccacgtggcattgatgtggcgcttacgtggcaattatatctcgaaaaaataataaaaaccgtgggcccaccggtcagctacacacagaagaataatttaaaaatagtggggcccacgtgggcccacatgtcagcgacaaaaaaataaatatgggccccacagatcatcccacgtggcgggatctccgcgggcgcaccaccccgctccagcaccagcacgcggccgccgccaggaccggccagcgttgcggcgagcgggcacccgccataggggagccattggggagctggagtgggcacccgccgtgctgccccctgaggagtggaccaacctcaccgccgctgtcgcgcacgagggctccggcttctacgtcctcgccgtcctccgccgtgagcgccgcggcggtcgctcctgccgttctctgccatgagcgcacgcgacgatggtggtggaggtgggttacggtggagggtgtgtgccgctccctcctctcccgccggcgccgctccctcctctcccaccactgacgccgccgcacgtcgctccctcttctcccgccggcggccatcggggagaagggcggcggacggctaggcgagctccctagcctaccggtgagcgcgcgtgtgccgttcctttttctcctgctgctagctatcagggaggagggcggcggacagctaagcgagctccctggcctaccggcaagcacgtggaagagagagatggctggcggccactcttctccatttctaccgccgtcgttgtcgccggccgcatcccctccccccaacgcaagaaagatgaagaggggagaagggagagaggaagcagaagaggaggggtgagttagactgacatgtgggcccacatgggccccgctatttttaaattattcttttgtgggtagctgacaggtgggcccacagtttttattattttttcgagatataattgccatgtaagcgccacgtcaatgccacctgggacggagaactgttcaaacaagccacgtaggcgacacgtcagccaaaaccatcgagggacctcgtttgcccgattttcataagttgggggacgggtcgtacttggttttacggtcaagagacgaaaatcagagtaggcgacaaataaaggaacccaaagtgaacttattccaacagtaggagtccaggaccagggcccaagcaagaaaagcccattagtgaggtggagtcaggtcagccgagcagcccctttcaaatcagctttgtttgtccttatgcctttgatatttatatacttgtatttaatgaactaatgctaatttttaaactctttctataggaggtagatgatgaaaatcattgagtttgtggagttcccacattgtgttgtggcaagcagctagtaattctgtgatggtcttgatgctgaggaggatggtgttgtcttcaactcttggtgttgcttgatggaagggagatgttacttgcttgttttggtgttgaagttggcaacttggcatgtaacttgtgtgattctatgatggtctgatggacctgaagttctggattgtaatatagtactatctaatctagttgcatggcaacttgcattgtggcatatttgcatggaccatggacatgttattatgttaaccatggacttgaagttttccctattacatattggatggacatgtaatctgcgcacaaatgttgatatggctgacgagctaaaggagctggctgctgagccgagccgagctaactcgatatccaccacccctatatatgatcaaatgcatgctaactgctaatgactgtttgagtggtacatattcagttaagcgctcattctgttgagggaatagtaacatttttctaatattaatcaattagtaacgtccaattaagcacagcagcgtagaattgttgataaggaaactctggttttgtttttgtgtgtgtaggtgggtacggagtaactaataaatggaggcccaaatgatccatttgatggattgagatctgcctgtagcctaccatttcaagcccattgcacgtgagagttctgaccacttaattgtttgatttctatcctcatacgacgcctccaactgaaagtaaaagtttacttcacaaattgtgccagccatttggttcatctcctcctgcgtggcaaccacaaatatgcaagcctccttcgtcaccgacagtacatcttcagagagaatctgagttttcatggttttgtcatggaagcctcaacctccaagcggaggcccttttgagtatacttccttgcgttttcatctgcagttactcttggttttttcgtcaccattgcagccatggatctagcttgctatcttgtggagaagagaaggacttgattgaattttctagtttcttaggagtccttcctagcaaatttcaggagcttatgttaatttggctatcttcgtggggcccttttgcaaaactggttgtacttgcaattgattttccgctggggataagtcatgtgatatgtacttagttatctataatcaataaaatgcatgagtttttttttaaaaaaaatgttctccttaatagttaaaaagttaaacggttcattctgcctccttcgtgattttctacgctgattttatcttacatgatatcgttggctttatccacttttcatggacagagcagaaatataaggcccatctattaatgagcccttcgttctcttccatttccatttccatctccctctcttctccctccagcaaaatcctgctaataccgacctccaccaccgcatcggggctagagacaaggccgaccgttggcttacgacgtgcacccatggctccttagctcacgtagcggtgggacacaagagcaagacaagtacattgacctcgtccacccacatatggactcaacgacgttgaactcacgaagcgatcttggcgttgtctgccacctctccttctcgagctctggcagatcgatgttgtgagagaggagtgaggatgagggagagcatgatacgtgggccaatacgatatttttaattttgctaggagacttaggctttagttcttttttccaactcgaaacttcaacttcctcaatttccgttagcacgctttttaaactgttaaatactccctccatttcaaattgatcatcatataatttttttgaaaatattcctaaatgatcataatatttgtgttcactcattaagtctattcgttatttgtgcattggggtaaatgagcattgatgtatacatccatacacacaagtgttttgatttgctattggctaagaaatagtggggattgtgcatgtatcaagtttattgctaaagtaaatgtagcatgagagagttattatatttttttggtcttgtgcgctcatgtaatatgaagatcaattaggaatggagggagtaatgtgtttttttgcaaaaaatttccatatagaaattatttaaaaatcaaataaatttatttttcatgtttataataattactccctccgtcccataatataagagattttgagtttttgcttttaacgtttgaccactcgtcttattcaaaattttttgaaattattatttattttatttgtgacttactttattatctacagtatttaaagcataactttttgttttttacatttgcaaaaaaaaaatcgaataagacgagtggtcaaacgttgcaagcaaaaacttaaaatcccttatattgtgggacggagggagtaatactttatactaatgagctttctcgttctgtgctcgctaaacatctctctccaaaaggtgagaacgaatgcaaccatatgtggtcatatatactttttattttttaaagtaaatttcacaaaactatagaaatattaaccaaattatctcaaaactatatatttaaaatattgtatcacaaaactaagttttttttaacattaaatataccacaaaactataaatttagtaacaaagttatcacaaaactatgggtttagcactaatttaattagaaaaattggacgtttataactcaatcatactattagtgctaaacatttaaaccctaaagatgtgatttttatgataattttattattaaatctttagttttgtgatacttagccttaaatttgtagtcttgtgataaatctattgttaaatatgtagttttataatacatcaacttaaatatatagttttgtgataatttgatcaaagtattcgtagttttgtgaaatttacttttttttttagctagaatgccacatagccgtacgttacataaaagaccagattaaagtgtcacttagatatcacatataacaaaaccaccatctcaaaagtatacaaggagataaattaatccgattttaccagttgtggaagcctttatagccgatagtacggtttgtgaacgtggatcaaactaaccacatagtttaaggacgcaaaataaaccttttccaacgggaaactctctgatacatcgatggaacacgcagttgagacttcagggacatatgaaggagttncncgaggtccctcaacttaacaacgagatttttttaaagatcccttaaacataaaatcagaaatgtgtacccctaaactcacacaaaccatgcactcaagattctatggtagtatatatgggtggtttcgctgacgtggctcctagtcagcaaaaaaattaaagagtaaattgcatctccggtacacgaacttgttaggtgagtgcaattcagtgtacaaacttgtaaaatgctcgttttggtacatgaacttgtctgctgcgtgcggaggaaggcgaaaaggatactacatagctaatcttattgatttaggggttgattaggatactagtaaacatatatctgagaaggttgatattgacatacacctcttcaatgaaaaatagaataggatatagtgatagtataaaaagtttaaaaaaactgagcaataatataagggttagaaatgtatgaaagtcatcatttccatgataaaggatacaattgagaccaaaattataaatattgcatgtcttatgcatactcactacacgtatgcatgtcacatcctaatcaacatcagcttattttggtccttgttcgcatgaactagacaagttcatgtaatgaaacaagtattttataaatttatgtactaaattgcacctacctaacaaatttgtgtaccaccaatgcaatttactcaaaattaaaaaaagtacataacgcccacatgtcagctgcacatattttttttcttctcttttcttctcttttctctcttctctcttctcttcttcaagccggcggtgggcgagcgccgcggcggagcgctgctgcagagcagcagggagcgagtgcggcagcgaagcggtggcgggctgcgggcggagcacacggcggacgagcgcgacggcggcgaggaggctcgcacgacgacatcgggcgtcactgagatgcgcgcagctatggagtcggcaagctcgtcggctggtgcggccttcccgcggcagatcgggcacgaggcgtgggacgagagccacatgtcgatgcactcctggtggagctgcctcaccatctccccctcgtcgacagcgctgaggcaaaccgcgcactcgaccgacgccgccgtgtccgagatctcgccgttgtcatgggctcgcacgtacgggaacgacgggaggcacgcgatggtggcggcgtctaggccgaacctcggcggcgtcggccgctgctgctcctgctccatgacaagtggacgatcacgccgacgacgggcaatgcggagagctcgagagcagatgaagatggtgatgaggaagaagctcagggcgaatgacacggccaaggcgccgaacaacatcgtggtgctgtagcatccggaggcgcccgccgccgagctcacctgctgtccgctccgcccgtagcccaccgccgcatcactgtcgcacttgtccactgctactctgccgccgcggcgctcgcccgccgccggcctgaagaagagaagagagaagagagaaaagagaagaaaaaaataggtgcagctgatatgtgggccccatatattttttttaattctttttgctaactagattccacgtcagcaaaaccacacatatatactgccataggaccttgagtgcacagtttgtgtgagtttaagggtacaaatttttggttttatggttaatggacctcaaaaaatctcgttgttaagttgagggacctccggtgaacttattccacatataaatacattccataacatgcatatgaccttccacaatacttcaaatctaggcatttctttcgattgaagaaattttaaaggattttccttaggaaataaactaatttatatcaaatttatgtaaaattcatgcggtttaaaggatttgaaaatggagctctcaactcaaataaacaaaccattttctaaagaaaaaaagaaaaaaaatgagcatatgaacaaactcatgcaaaattgatgctcttaacacaaattagacaatcgcaaaaaaagaaaaacacacaaattaggcgatctactccggtcatcaggtcaatgcccctgatgccaacgcaaagtccacgaaccagttaaaatccacaaatttcactgcctccatgtcagtagaaaaaaaggataaaagaaagcttcgagtcaactccctttatcctgctttgtttccttaagtttccgccatgcgagcctaaaaccatacgcatatgtatataaccttccaacctaaattcaaatctagatcttcggccgagtttagttccaaactttttcttcaaacttccagctttttcatcacatcaaaactttcttacacacacaaactttcaacttttccattacatcgtttcaatttcaaccaaacttctaattttagcgtgaactagacacacccttctttagattggagaaactttatgggactttcgaacaaattagactaatttatatgaaatttatgtaaaattcatgcattttaaaggaggaaaaaagtcagcataggaacaaactcatgtaaaatcgatactcctaacacaaattagacaatctactccggtcaacgcatgtcagtagaaagaggattaaaagcttggagtcaaccccctttaccccgcccgtttcctcttgtttccgccatgccgtgggctcaaaccgccggcgccgccgcgcgccggcgaccaaaaccaccggaaaaagaaagtcagaaaaaaaaagtaaggctcaaatccaccgtcgccgcgcgccaccaccccgcgggcgcctccgtctccggatttcacccggtataaatctatgaccgagccgacgcgagctttcttgcgtgttgtagctggagtgttcgaaggaattactggctggcacgcacgcgcgcacgggcatggtggcggtggtgatgatggcgatgatgaagaggatgcgcggcgcgctgctggcgctcgcgctgctgctcaccgcgacggccgtcgtgccgctgctcctcctcggagaggccggggacgacggcgtcggggccgtcgccgccgcgccgccgttcaacgcgtcccgcgtcagggcggtgtcgtggaggcccagggtcttcgtctacaaggggttcctctccgacgacgagtgcgaccacctcgtcaagctggtcagcacctgctgcaatcatagatgccaccaccatggctgaatcctatctgcgtctcgattgattggtgtgtgtggttggagcaggggaagaggaagatgcagaggtcgatggtggcggacaacaagtccggcaagagcgtcatgagcgaggtgcggaccagctccggcatgttcctcgacaagcgccaggtactacatttttggctatatatctggacgccataaatgcttatattttaggacaaaggcaatagtatgtcttttgctacaaatgacaatgatcttttagatattgtgttgtaccatgttcatatagtttgtgggaaattagtatttttggtggccacaaattgccatattaattgggttacaaacaatttttgaaaagaatttaaaatggttgcacaattgcagcgaaaaccgataatgcatttgtattgtggggagacaagtctgccagattaacagctacagttgcagtgaattgatttctagttaatcttcacgagttactactgcttaaaagatagtatttgaactgaacaaaaaactattttttttgtgtgaaattcactgttaaatggacctcatcattgcaactaggttctgacttgctgacatctctcctgcacacaacggtccatttccctgcatttcttctccaacttttgtctctaaattcatcccatccaatcgcaattactggcaactgttcagatcaacatgttcacaggatcaatgcaattcctgttgcgatgcaatgccgcaattactgaacacatttagatcaccatcagtggtctgctgtactaatactgaacctgggtatccggcaaccggtgaacatacaggccggcgtcagttactggaccactggctctcctctgagcagcagttactaaggatgcagatatcagtagcatccatccatccatctattgctgcaggaactgatactttctggcttagctagcattagcaattggaatagtagggaccagatttggtagtaacagtagttaggagatttggtaataacaatggtttgatatgcagtaatttgttttgttgcttgctctcgtactttctaatggattctgtcattctggggtgtaatgtaatggaaatgcgtttcttgttttgtgaaggatccagtggtgagcaggattgaaaaaagaattgcagcatggacctttcttcctgaaggtaactcttctgggcttcctcagattgtctcattgtttggttctattgattgttcaagtagcaaggttttccaagttaatgttactgctattttttttcatcagaaaatgctgagaacattcagatactccgatacgagcatgggcagaagtatgagccgcactttgattatttccatgacaaggtcaatcaagcactgggaggccaccgttacgcgacggtgctcatgtatttgtccactgtcgagaagggaggcgagactgtgttccccaatgctgaggtaaatttcaaatatcacgtccttcacttttccaaatccaaatgatgtatgagtttttgtaacattgctggtgctaatcaatttaggggtgggaaaatcagcccaaggatgacactttctctgaatgtgcacaaaaaggattggcaggtaatggttaccttttgaagtgttttaaatgtgacacctctctaggctctagtttctcttcaaaaactgaaacataacacacttggaatataaccaggctagtttaattgcagtgaaaccagttaaaggcgacacggtgctcttctttagccttcatatcgatggcgtaccggacccgctcagcctccatgggagctgcccagtgatagaaggtgaaaaatggtctgcaccaaagtggatccgtatcaggtcctatgagcatcctcctgtctcaaaggtgacagaaggatgctccgacaacagtgcacgttgcgcgaaatgggctgaagctggagaatgcgagaagaacccggtatacatggtaggtgccgagggtttgcccggcaattgtcggaagagttgtggcgtttgtgattcctaggatgtgtttattttcctaaatctgatgtttgtgtcacttgctgaacacttgatttgtacatacttagagcattttcagatgaaataggtagcatttgaattttcagacagtgaacagtagcatactatttcttcaaaaacaacggcttacatcctttgcacatggttttgaaatctcaagtttacttctagtggaggtgaagactgtgaagtaagttttggtattttactgatgcagaaatggaatctgtccttctggcaacaatgctactgcctgttccactttaattttgttggcttgcataacagtggatttcagtacagcagtgtgtcaggctgtctcaaaaataacaaactcctttggccctttccacaatatagaagttctatggtctttatctcctgcatcagcctggcttttagacaaggaaactttgtttgttgctacctcaaaacatgtttctaatccacagagaacaagtttagatcctaacaaaagttttgttctactgcatgcgaaaaatcgtcgaattagtgtacattttcaacagtagactgaaaatgtccttgcaacgatcatgtaatccatgtagggcttatgagaacagtgtgatccatgtagtcacaatctaataataaggacagtgacatatcacctgaaagtggtagatgtgtgtatttcttcagggtgcttcacactttgaaggatctgcttttggaccttgctttaccagagcaatctctcatgtgtcatgcctcctcctagatttactcaaactttaccttaaacacttttgtgtaaactaaattatcctctaacttggttttgctccaagggtaactaagtaatccctgatggtccatcagacagcattttcggtttgccatcttaaaactccaattggctctttttaccaatcaagatctaagagaaagaaaaatgaaacaaaagaaggaaaacaacataactcaaaaagcaaaggacaaaagcaagcatggcctcacctcctttgatttctaccatgcctcttcattagctaggcccttcaaaagcacatcagagccagcagctcaaggaagaaagaagctgagaagaaaaccagaagcaagaaacacataccactgcctccacaacaatataatgtgctgagacaagagagaagaagcctcacatttgagggggggctttcctcacttgcaccactctatgagatgctcatagaggggtggtggtggtggtgacaataccccaagatatagaaattagggtattatgagcaggtttgccaggtcagcgaggcgggtatcagcgacaacattggccatcctatttggaggcctcattttggtgtcattgttggtggagacaagcgcgaaaccgccgtctccggggagtagtgttcttggtgttgggggtagaaggatgatgatcaatggaggactagttcacagtcacaggagcttggaagatttcaatgctggtgatgctttcagcagcatgaagaggagggtgccaaatggaccagatccaatccacaacaggtaacttttatagcgtgcaaacatgagatgtactgctctttttcttgttcctcttctccttttttctgtttcaccaaatttagtcagaatgttagcttgagatgtgtcaactacaagtttttttaatggccttttaactaaccttccatggatctctggaaattcttattgataataaaagattaatatagcagaaaagtattgtcgatgcctaatcgtgttatctgaggtgcggtcttgttcaagaacaccttaagttttatactgaaatctttctatcccacttcagtctaatttaaagagcatatatgttcaaattatgttcatgctttttgtttcatcttgctgagtataagctggattggcttttgaaatctctatttgttcaatataaaatgaactatatctatgtcattccataatatgacttctttatggaattaagcttgcttgccatatcgaaatttaatactgtacaagtttgaaaggcatgacttaaatttgattgcacaatgaaaacaatgtataagatggtcacactatttgtattcactacacaaacagtgctcatgatgatgtatgctaaccttttaataaaggaaaacaattactccacccaatgaacaccctgcatgaaccttatcatattgaaatgattagccaacatgcatctagcacccttaacgaactactactcatcaatcagagcaatatatgtgtgtcaccttgaacattatacttgcaggctttcaattccttcctttat

SEQ ID NO: 54715 - DNA, 2781 bp, Oryza sativa
tgcaccctgaatgtggcctaaaagcaaagcttgtgtgacagtgtgaggaagactgataagaaactctgtccttggttaaaagatgaaccttcttcttcttggggctaatctattcttttcttgaccagtcttcttgtgtactgcatctgggagaataagatgtgtaccaagtgcctttctctgtatcagatgcatactaaagtggggacaaaagtgtgtgcagtttgtactgcattttacagccagcttagggaaaagtttagttactctcttgatccaattacttactatacttggatccaagaaatagtggggattttcagaatttttggggagttgatgaatctactaaaatttgaaaataataaaaccaagcaagtacccaaggctattaaacatcctgtaatcttgtaatgttgtgtttaccttgtgacaaggagcaagccacaaaatttcttcttcttaagaaaagaaatactacatttcatcccatatttattgtatattagttttcaccatgaggactttccatatttgaactaaatcttacaaaatccctataaaactcctggagttccaaacaaaccttaaaatccaaaccatatatactcacatttcccttacatagaccaatgctttcatcctccctcgcagttctgagttccttgttggcacaatatcatttattgtgcagcatagaccccacgtccccacctgtcaatgaatatatcacaagaatcttatacatcctcgattttttaagagactttttaccatgtgcagcttgacgcaaaattggctgctctctatacagaggccgttctctcatatgctttgacaatatgtgtctatagaatgagagagtaactcagtaatcacctactagtgagcttagcttgttaacaactctcgccagccaatgagtaagcagtcagttattaagatatagatctagtgcgggaagcatgagaggtatggtgaagtcgtggtgcatgactccacccaccagggtttaaatcctagtgcccacgaatattacgcacatgtaggtaggttttcaacggaactttagtgagataaggaatgcgccgttggtttccgtctctcaaagcatatgttagggaatacattcgcgggagtgtgagtgtagtgttacatgtgtagtggtgtgtgttcgtgtgcgtctgtcgtgtaatctcagaaaaagagtctaagatctcttcaaacaagaccaaaatttccatgtacaaattaaattaagagctatggctactgcgccatcgatcgcgtgaatgccccaaaaaaacaaaaaagaaaaagagaaaaagaaaagtgcagcccgtgagtaaacctgtactatgccttttgacctggataccaacgacggcaggtgacaactaatttcacatggctcttaaatttgcagctactccagacgatcagacgttagaaaattaaattttggtgtagatttcagttagtttgcttatatgtatggtgtagatttgcagttggaattcacatttagttaacgagattagtaaattttcactttacatgcatgcaatcatctcaatttttttctctcctgtgatgtttttttatgttggttgtagatggaaaatctaattaataacacgcacagtggaattctccttttgtgtgtgtgtgttagtgattgtatttgtaggccttcatgcttgcaatagaagtttaattgcaacttgccagcaaatcggcgatgatattactaactaaattctcttgctgcagtgaatcatagatctaacagccaatcttttttatgagaaaaaaaaaagaacagctagcattttgtggggccgcgctagatcaaaccaagaccagatgcatataacacatctattgcagatagtattgaaattaatagctgacacgatttttctttgaaaaaaatagaattgcaatcatcctcctaccgtccccttttcaccgtgcgcatgaggtgtccactcattcacaggtacgtcactgtaggatacagtattttattcccaatccatccaccaagtcaatctctaattatatggatctagccaatactttatttttaattcacgtacctagttagtcctcaattatttaggcttggtccgttgcaaaacacgaatatattactagacactgaaagaaaaagagttataatatttaattcacaaaaatatacgtacagttgtgatgcaaaccaggttttgaaaacctgtttcaaaatttcctaaattgcgggtaatttaccaacgtgtccagagaggaaacacctttggcctgaaaattcgaatttgtctgaatttagacactgtaactgtttgaattcagtgaaaatacgttcaaatctcacaaacagtatcctaacctttttgcattgcgaaaagaaaaatcctgatccaaacagcaaaaaagcaaggcaaaatttagaaacaacttttgaattcagcgaaattctgttcaaatatcatgagctgtccggattttcttttgcattgtgaaatgcaaaactctgaatcgaacatgacaaatttaaggcgaaattggggaagcaccaagtggtggaatcctagatgcatgcatgacttcatccaacatatttaaatgatgcccacaaatactatgcatatataagcatattttatatataacaagattttagtgggatatctcattggttttcgtctatctaaacatgtgttagccaggggacgtatttgcggtggtgtaatcattggtcctgtttggatccggcgg

SEQ ID NO: 54716 - DNA, 4433 bp, Oryza sativa
cgaatctaacgaggtatattaatccatgatttgctaccgtgatgctacagtaatcagccgctaattatggattaatatacatcattagattcgtctcgcaaaatagcctaggggttatggaatcggttttgtcggtaatatacgtttaataatcctaaatagtaagattcttgagggctatttaatagcccgaaggatccaaacaaggccattgtgttgcgtgtgcagtgacatgtaatcgggaaaaaaaatttaagactaaaattttgaactagtagtatgaagctacagtgccttcttcctgcagctagctactacctccgttccaaaataagtgcagtcatggatatccatgcccagcgtttaaccatccatcttatttcaaaaaattgtgaaaaatttgaaaatatttagtcacatataaagtatcattcatgttttatcatctaatagcaataaaaatactaatcataaaaaaattttaaataagacgaatggtcaaatgttgaatgtgaatagtgtaaaactgcacttattttgggacagagggagtagatgcaatggcagagatgatctcgcattaactaacttcccccctccatggatcgatctcatctaccccctcttcccctcccatttattgcaaccccatgtcgatcgccatggcagcagcagcagcaacgaaccacttgctcccgccattaatcgcttcctccaactccccatcgtctctcctcctcccctttaaaccccctctcctctcgcctcccgctccaccaccatcgatcgatctccacctcgccggagttgagagagacgacgctgcagggatcgagatcgagatcagagaggttggcaatggcggcgcgcgtggcggttgtcctcctgctactgttcggcctctccgccgtggcggtgacggcggcgaggatcatgcccgacgacgactgcggcgacacggcgaacgccgccggcgccgccggcgtgggggaagccaagacggcgttcggcgggagcgacggccgcggggggctcttcggcgggtacaccggcccgctcggcggcggcgccgccgggttcggccccttcggcgggttcggcgccggcggcgggccgttcggcgggttcggcggcggagttggcctcggcggcggcggcggaggattccggccgtaagacgatgactcgtaggacgacgtgtgcgcatgcgtatagtagtatagtgcaattaatgtgattccacgtgtataacgttgtgggttaattgtgccacgtcagatatatgtactaatgtacggtgagatgtatctaccgtacgctggagtttgtacggctatcgttgattagagatttctcttgtgttgcttaagtgtttgtgtgtgtgttcattgagttgttttgtgttgtaatttgctaaactttcaagtgcttatctatgattgacagaggtaagattcatgtggctgactatttgggcccaccagtcagccagtggaagggctgatggttgggctcagccaattgaatgttgacacgtaagcagatgcagcctcctaagtcatacctccgtgttcaacttatatgcaaaatttgccacgggacacgcaaaaaatgtgtaattggctggaagacaccacgaaaacgttatacggctgatggacactaaaaaaatgtgaaatttgctgtagaacaccggtcgcattattttattatttccggtcaaaagaggtgagatatttttctaagtgtccagattacccttctctttccttccttttctcctactctttccttcttttccccttcttgttgatttcgctgggaacggcatagcaacctcaaagcagcagtggggcgaggtcggcgcggcgtggtgtggcatcaccagcggccggggcggtcaacggcatgggcgaccatggaggcgcggtgttcgaccagatcgatagcgggcaggcgacgacactgctggtgcagcggggcgcggccgggaggcagcaccaagcgcaggcggggaggctacgattggtcccggcgtcaccactgctacgatggccagtgccctcgctcccttcggtgcgcttgatgagtgccgacgacggcggcgggttcagatcggcgccgacgaagaaggggtgtgatctccctctccggtgcaccatttttcggggtccttgaggggagatggagaggaggatgaagcgaagatgctggtgcaacagcttggcccggcttggtccagataagtgggaacggcgataatgttgctgcgcggtgcacagagcgcgctccagagctccggtgggcacgacagcgttcccgtcgattggctacacgaatcgagaggttgtcaaagcaagatttgattggcatggagagaagataatagaacatgaattagataggaacggagacggctcgttggtgatcggcagtgtcctccttctcagcggctgacaacgaaagataggtggagagggagagctggagctctcttcctaggttcgctctgtgtggaaatgaagtggagtagatggcgatgcagcagggacgagatgaagacttgcctcggcattttgaggcattgacacgtcgtgcacacgcgtcgaactcagccgacgccgatctctctctcggttgtctctggtcgatctctctcacgtcgcgtgctagctcatgtcgcttggcccaacctcccccaaacacgacgagctgaggaggctattctccaggttcggcaagatcgagagggaaaagaagataagggcaaaactatcattttacgttgtttctctctcatcaattgaccgagtattatattttaatgtgtccagtgttctgcagcaaattatcacatttttggagtgtctttgggcaaattcacgtctttagggtgttccagctaattacacattttttttgagtgtcctgtagcaaattttaccaacttatatatacatcatctgtgccataaaaaatcaatatgtgtagattcattatactaaaatgtgttaaattacatatactgtgccataaaaaactaacatgtcaagattcgttatagaatgtgtcacgtccgatcctaagttgttattttgggacgaagggagtacatcacagtaatgtataaaatttactgcaagtaccgtgtatgacatgactttagatgagatgtttgatattttaacatttcataaagcgggtttcgattatttaacatagtaggcatagataaaaggagacaatctaaattgataaatcctgacggatttaattagtatatatttgtataagttcatctcatagtgttatatgtatttttctttaatttttccctctcatacatgctagcttttcctttcactaaaaacaaaaggaaaagagggataacctaatatttcctcagattatttcttccttggaggagactgttaatttctaccgcctcagttaattgctctcaacttggagcttaactctgagcatatgttgaggtattgaagctgtgggccagaaagcctcttcagatccatcaggtaattcccttccccttctgacttgtacagctacaataagcacaagaggtaaaatttttatcatgggtaaaaaaaaattaaaggaacggttaaacacatgtttttttttgcaagtattaagatttggagggagtaataattgtcaaggggagaaacactatcagtctcattgtttggcttattcgaggaacaagccaaatgatatatttaaaaatgaaaaatatttttttaataaagttcttatatacatgttcttaacgatataaatgaaaagactaaaaaataaactacgatgaaaaactttaaaatcacctctaaatttaaagttaaatatttaaactttaactgataaatataaatataagcgaaaagatgaggttacgagagtgtatgaatgatgcgcttgaggagaatacctgaatttcaaagaacacagccgcagacaagctctcgaggacagcatcatcgacgggagctccaccgccatggccagcctcacctctgccactgccaccacggcggaggaggaagaggagggcgcgtcgtcggtggcggcgaggtagctgcggatgatgcggcggacgccggcggcgccggcgaagcgtgcgcagagcagcttgccgtagcggccgcggtcgtcgtcgtcgtgcgcgtagacgacgccggtctcgcgcagcgccgccgcgatggcgcgcatcgcctcgcgggggcactcgtggaactccacccctcccagcgcccatccgttgttgcgtccgtcgtcttctccggcgacggcgaccggcggctctccggcagcactgctgccagttgcttctgctgctccctgtccagagcaaataggtgtatgatggtgttgaatcagttgatccaatacagtgttagattttttcaacc

SEQ ID NO: 54717 - DNA, 5009 bp, Oryza sativa
  unsure (1)..(5009): unsure at all n locations
ctttgtttagtacaaagaaatttcttgatcattattgtgcaaataaacatttttgtctataaacattactccaggttgattatacttattgttttggataagagtattgtcaaactttaaaaacttttaattataaataacatctaaaatgtttgtcttagaaatgtggtgaccatatatatagattggtcttaaaagtgctccaacaaaatcatatatttatctatacatattttaatagaaaatagtggtcaatgttgttttttttgaagaccgtatactttttaaaacgataggtattatcagtctagatggatggagtactgaattagaaattattcaacattaattctagattggtaaaattgaacatcgtgaatatacttttatgtgctcaaataagaattttatggaaaacttttactgtcatactcaaaagaaaacaatccaccagagtcatatgtttgaactttgaagtgcatgtccaattgcacatatccaagatatttgtccttggacatgggaattttagtattgccatgaatgaagatttattttctgcagaactagttagtttctatacgtaccgtggtgttactttgtccagcttcttgatagacgtcaattgtccaaacataacgtgttggggcatcgaacttcttattgaggatcaggttgtaggcgaccgtcgcctacaaacaaatccatacatgcatattttgaaccacaagtgaattgcaattgcatcgatccatctgtatgtatatgttgccaacatgtcatgagtggcatgtcattaacctttctatgtaccaatactcttatagttgttactttcaaaatgtatgatgacgttgacttttcacaaagtttgaccattcatcttattcatttatttttgttatgatttgttttattatcaaataaaatacaatcataacatataattttatatatgcatactaaatttgtgaataaaacgaatggttaaacgttatgcgaaaagttaatggcgtcatatattttaaaaatgaggtagtacattacatacctcgttttcgactctgttctcaagtgattcaaccaagtacctcctttcaaagccatggccgactaccttgtcgacagtctcagcatcaatctagcacaagatataaacacaattaatcaaaaaaatgcgtaatcaattaaaattaagcacccaaatagcacataattaatcaaaagtaattaattaagcaacacttgccctggtgatctgtgtgcgagcgttgagaggaggcattgcgaggtagcgagggatggagtgctgcagccaacggtgcgtcctgacctcggtgatggtgaggcgcttgtcaggtctcacgatcagcatgctggagatgagatccctcgcgtcgtcaggcacgtacggtgggatactgaactctcctctctgcaacgcaatacgaagagaggaagaagaaaaaaacagatcagctgtttctcaatctcattgggattttcagttttgaccactgataacttcttcttccatttgcttgtctacagttgttcagcagctgaataatatatttttttgtcatatgttttacagttggaattttataccttcttttatttgctggtctagagtaattcagctgaataatatatttttttcagatgttttacaattcacagtttataacttcttattataccgtatttgttggccggtctacagtcattcggtcgaataatttattgtcagctgttttacaattgacattttagtatccatgatgttgaacttctaattcagatttttttttagataagggtatttttttacccggcctctatatccaaccggatatatacggccattgaaatagggaacttagccccgaaaacaacccaatctgaaattcgctccatagaagatttgaactcaggaccttggggtactactcaggtcactgtaactactaggctatatactacaagatttgaactcaggaacttctaattcagataacttcatatacgttgtttatgtttatatcaaagtcattctttttgttaatattaacacggttaattagatattgtaactattgtgattagaattcgaagagtaatttcctaccttgatgatcctgtgcagctctgatacatcggcgctgtcaaagggcaagcgtccacagaagaggatgtaaaggattactccacagctccaaacatccacaggtggaccaacatattttctacccgcgagtagctacaatacaaattacaataagcaacataaacatctcacatatgaatttcaatacattccccaagttactatatgatcgacgacgacatgtaactccttttttttaacacttaaatttcttctaattactaggcgtattgacattgaactatgtattctctccggtccgttccaaaatataagcatttccgtctatgtattttggaatggttaggaatatttcatatgagaaaaagaatatttgtgaatttgtggctgacctcgggagcggcatattctcggcttccgcatgacgcgctgagcaccttgttgtgcctgaagaacttgctgaaaccgaagtcgacgatcttgacgttcatctctgaatccatcaggatgttctccagtttcaggtcacggtggacgaccatgttgtggtggcagtattcggcgcctgatataatctgcctccatcgaattgaccaattaaaaaaaatgcattcgttgttgcatcatcaaattaacaacatttcattaaaatgtttatgtcgtctgactttctttctcctctttctcagagtaaaatttttcaaagtttggaacatggaaatcggcgttcatcaaaccataaaaaaatctcgtagactaacacaaatcattgtcgaaatttcagttcaaaatggggagcaataaatcggtgcaaaaatgcagagttcttcttcttttttgttaactctgaacttgtgaagagctgaagaaagcagggttttcaacctgctggaagatcctgcgagcgtcatcctcgcggaggcggccgagctgggtgacgtaatcgtagagctgcccctgcgtcgcgagctccatcacgatgtacacgtggccgccgccgtcgccgccggcgatcgcctcgtggaaccgcacgatgtgcgggtggttcagcagcctcatcaccgcgatctccctctccactgccgccgccgccgccgatcgaaaattcaggagagaaagaaaatcaagaattcaagatgagagacggatcgctcgagctcgacgatcggagaggaagaagaagaagaagacgaaggcggtggctgcttgcctttgcggatggggatgccgctggcgagaagtccggcgaggttgaggatcttgacggcgacgctgaggccggtgcggcggtggcgagcctcccacacctgcgcgaagctaccgcgcccccgcacccgcaccagctcgtaccgctcgagcagctcccggtgctgctgcgtcgccgccgccgccgccgccgccgccgccgacgccgcgccgccgccgccctgcatcctcgatcgcctcactgagcgtgtgtgtgtgtcaagtagtagtagtaattagtatgtgaaactatgggtagcttaagctactagtactaggattatggatgtattagtaaagctaattaggtagtgattattgcgagattaagaacgagattatatgcaaagtagtactccctccgtctcataaaaaataaatctacaactagatgtaacatattctagtacgatgaatctgtacatatatatctagattcgtaatattaggatgtgtcatacccggtattaggttggttttttatgggacggatggagtacgtagcatcactatgtggcgtctacattatgtgcattggaatcaccggaggaagaatcaattctaagacggtgaaatcaacaaggtaataaggtaattaaaattgaaattaaacttgccagtgaaagcaacacactaagctgggggacaagggggtgcatatagccagacaggcaaataaacatctttcgatgtcatagaaccaaatggttttctcaaatatgtcgacagtattgtgagacaggttttaccttattcgtcgatgtcatttacgccggcctaaatttaactcggtaatttgttgcaagccagccaatcttaatattttttaaagaaaatatatacagcaatttggctgtgcttctttggtttctcatgggtgatgttggctagctagcttgatagccccatgtatgctgctttgctttctcatggctgacgttagctagcttgtccagcttcaagtacttggaactttcaaactttcagttcagtttcagcttagttttttttctcttttttttttgcgggtaccacatgtatatactttgcatctgcatcacaatatattgcactttcatatattcacatagttacacatgtgcaaccatatatggccgggccggggtatcatcgattgttgaaattgacattttagggctccttcggaacaaaggatcaccagaggatttcgatcctatggaaaattcttcctatatggttacctgaatcaaaggaatagctatcaaaaaatcttatgaattttctttggattagctcaaaacataggaattttaaaggaattctaacatgagttccaacctcttaaaaaaaatcttggtgtctatctatcttatataattcctgtattttttcctatgctacatccaaacggccattcttgcagttttcttgtgttttttcaattcatggaatttgaggtgttagagcacttcaatccaatattatttccttccctagtgtattgagaatcatgcgttcatttccacctggaactgttatagtactgcaaggatcatcatatttatgtcaaaaaaatacgaatatattggttttttttaacgaaaggcnnnnnnnnnnnnnnnnnnnnnnnnnnnnnnnnnnnnnnnnnnnn

SEQ ID NO: 54718 - DNA, 855 bp, Oryza sativa
tttggatgcgtagatgattattatactgcacattatcaatcaccaaggctgatgttatgtctgtggcagaagttgctagatggaaaaccacaatgttgcaatatgagatgacaatagtttaactggtagcaattgaatcataccgtactggcaatcttcatttaatcaacaaaagggatggatttgctgatgtccttcagtagccatttatcactaactatatctttgatggtaaattaagactgcttgagactgacatgtagaaattgatttcctagattacttgagagtagccagcttagtttcaacatttgataagccagtgcactattactctcttttcttaaaaaaaatgggtacaagtttttaggtactgtagaaatgaatgagcatcattcctgaacatgaagaagtggcaattcagttaagttacttctacttctaatacgactcactacaacgtggcggttgttcacagcttatctggtgtggtgagagcttgaagtataggttgattttgtcctgcaacctgtcatgtaatttagtcgctacctgaatgaactagtctttttctccttgactaatcaaatatgtactcttaactcttctattttttatgtctacaacaaagtatggtctgggaaatttcatgtgatgcgacatctttaaaactgcaagctttcgctgttgctttagttcttacatgaaagtcgtaccttcacaaatcgaaggtgcttatgtaatggtttgctgtttctgatgcctttaataaatatacttttttccactatatccttcatgcgtgcaaatcattcatcatagttttgtctagtaaaagaaaaccttgtatttcgg

SEQ ID NO: 54719 - DNA, 5042 bp, Oryza sativa
tcccaaacagcaaggctcctattgtgaatttgtgattgctgaataattgaaaatgccactaagatgtaaagcttgtacagctactgtttattcatgcgtgggcagtgactgtatttctacgaaagtgctctctgtctcagtggtggcaatgacaccatgtttagaaagttgcaaatgctttgctgagagaatattcatcatggtgtagctggcaagcatagttcacatctttttatgctctgatttgctgctttctttacgggcatggcactggcacgaagatatgtgttctcatgttcctacaccttttgagctttcctcccctctccatggtttacgaggtaagcaatctgaactaatccattgttatacagtaacatcgattctaatgcagtttaatggtttgtttgtgcatgcaaaagcaggtttactggcttactgctatgtaaagttcttcagattatggtagctgatttgtctcttgattttgttttcaggaacctgagctatctgccagctgaccaagaaatacttatttcatcattaaaaaaactgaccaagaaaaaaaaattactccattgtctaaaaaaaaattgaccagaagtagtcaggtcaacctcagcatgtgctgcagatgaggtaggtttttaccaggtcgacctggataatatattgtataacttgctgctcagaaagaaagctctgttgttgatacgctgttcgtttcagtagttatcgctgttgtgttggcatttgtcttgccaaaattctctagtcccaactgggcgtgatgagcgattcaacactcaacagctatattacactaatgcagttggatggtcagatggtgtcattcttacttcttttttgtccatcatcatatggattatcgaaatcgtcgcaaaacaagatggatttatcgaaaataattgggataatatttgatgctgctcttgtaatatgagctagcgctttgttggcgagttggacactttggattggtctaagagccattgtcagctatggcacgtgcattcttttcagcatctcgtgtttttctgtcaaaaaaaaaaaaaactggagaattggtccagagtggcatgtattccagaccaagattctgtggccgcgtcaaaccaaaatcaactctggaaacctccatgattggaacccaacaattttggacgaaacaaaaaaaagaactttaattcaaaaccagcaaaggattgagagaaggcgaaaaataaatggtatcccgggagcaactgttcttgaaagctatggttccttttgaactaatgaatttcgtggaatttttataggaatttcactggataattaccacagattatttgttttgcacctctaataaagcattttcttaacttttcttaattaaattttttttcttctactgcattgcttcaaccacttatcttaagctatatcttagatttatttgttaaaatattcaatttatgcctataaaataaataaataatccgcgacaatgatcacaggaataccatctccggcctatttgccactcatagccagagtgagcaactgattggtaggcaatcatatgggatatgggatagtgatataacatatttcaactaaaatagatattcctgatttggcaattatgaaatgttgggcaaccaaaagacacagtaccaaaataccatttgaactaaaatagatattcctgatttatagggcagacgaagtacttacttgcatcatataaatttcatagaattttcatatcaattgcacacaaaaacagctcaatgattttgtgcaacatcccaaataaactagaactaaaataaaagagtactgctatacgtacgacccaattgtataattcatgtacaactaaaaacatataatcatatatcaataaaaaaagagcatgttcatacgccctgcatccgttaacaacacttaccaaaatttagtcgcacatgagtcggacagttggaacgtatgtatagcaatttccaaaacaaaattaaaacaccgcgggaatacaaatacagctctgagtagcacctaaaatcccgagttcaaatctctatatgagcgaatttcaggtcgggttatttgcagggctaagttctaaatttagtgtctgaatataaccgactggatgtagaggccgagtaaaaaaatatcattctctaaaaaaaaatacagctctacttcttctcctaacctcctttgatcgttcgttggtttgttttttttttcttttctcgcgtacagctggacgcttcgtttgcttctcccgttccgtctcttctcctctcctcttcttctcccctctcctctctccacttctactctcacctctcgctaccaaacacgcgcacacgcagccgagatcgagagcgagctacttgccctagcagcagcagcagcgaggagcgcgagggggcggcggcggcggcgtgcatggcgggggctccgtcgaggtcgcgcggcgacttcgaccacctcatcaagctcctcctcatcggcgacagcggcaagttttacacctcctcctcctccccgcctcacaaatcagagctctgtcccgtgctgtttcggattcctctatggctttttagttgcttgctcgctcgattcctggttgtactgcgctttctccctctcttctgctgattcgtgtggtggtagtactagtactagtacttttcgcatctcttaatgggtccgtggccgtggggggagctcgggggaggagcagtacgaggggttcttgttgccgaggatttaagggatgggatttccgtgtattggtttaattgttggagtggtacgtactacgtagcagtaattgggagctttcttggaggactgattagctgctgatttgggttttggtcggttgctaatcttgtcggggaacattctccaatgaggagtgagaaccatgctagtatgtgttgcatccataagtagctatggatagggatttctgtaccgattggaggttggtcatgtcgcaattggacaaggacttgtgaagtaatttgccgagattagcctgcgaaaatgtttcgtaggtgtgcaatgtctgtgtgcgatattgttcggatcataggtgattgtgttgtggttgtgcactcctctttgatcttctgtttattgcggttttcgttgaggcagtgggttcctggggattttcacgaattttgctctccagtagtttattagactaggatgatagtaattgttttggtttgataggtcgatatagaaatggaacaaaatgggttataactaacatgggaatccccaaaaggtgctctagtgtcataaaagttgagtaggtcttagattttcagcatttcaccatggttgacatattttgttagtctaaaataggtaggaatagagattaggacttgaagctatattggagccaaaagtcattaattggaagggtcctttaaatccaacttgtaccagctcagacaccattactgtttcagactagtagtgaaaatgaatcatcacctcatcctcatttatttgttcagatgctgaagttttggccttgtttcacagtcgtgccagaattgttcctcatcctactttaccaaaagtgctgaaattactcatcattaaaataggactaggtgtttttagaaagaaccttcatgcttgtccagtccttcattggattgaaattgaaaattgttagttgatcatccctttgtagtgatattgcaattcctcaaggcacatctgactatctgttatcaaatttatcggatgaccacatgattgatttggtatatctgatgggtctccaactccccattttctcattgtggtgtttgacagttttgttctgtctttattatcttcagttcgtgtgatgtctagtggcattttctttctcagataattatgttatcattcttatttggcacttatttgtttaatgggttaatctgcaggagtaggaaagagttgcttgcttctgaggttctcagatgacactttcactacaagttttatcaccaccattgggtattcacacaaccattaattcttctatttttgggcattcacttatggaagccaatattctaaatatgtttatttttctttatgtaaagcattgatttcaaggttcggacagttgagcttgatggaaagcgtgtaaaattgcagatttgggatactgctggtcaagaacgtttccggacaattacaactggtatatttttcacttccttttctgctaatgactcacatatggtaatatggggcaaattatgaaaggcgacaaattcctgatatatgacctaaggcttgaacactgacagaaatttgtcgtcgaaacgaatatgaacatgaacaattgtcaaactgatgcaatttcaaccaaacaatatgatatattcttttagattcaaatctttattttttttggaatagcacataaagttacccttttctatgtgctccaatgaggaagaaatgcataataaaaatgtccctctttgcaaatgtattttgcttggtttctgaagctgtagacattcaatatgcatattcatatgcccaatttttattggtcatctggaaacctttaattgatgacgacatatataacctgtgaattagagaatgggcatttatataagcatgatggcagtttctcatatatatcctcatgtacttactgaaaatctggcactataatgacccgagctattcagatttacccattgattgctaagcaagatttctgcaccttatttgatccttttcctttctgcagcctactatagaggtgctatgggcattctgcttgtttatgatgttacagacgagtcatccttcaacagtatccatcatacttgtgcatcccatttgttgacagagtgcaaatatatatatttttttcttaactgatgtgtagacattagaaattggatccgcaacatagaacaacatgcatctgataatgtcaacaagattttggtgggcaacaaggttgatatggatacaaa

SEQ ID NO: 54720 - DNA, 2135 bp, Oryza sativa
gttcttcacactggtttgtataaaacagtgaaaaaaaacttatgcaaagaatgaatcaagttattaatcagattttgatatctacaaaggcatggtttcagtcttcaaaactttaaacataacaggaagttctgagacagcacacagcaaaaacagagaaaaaaagttgcatatatcaattgcaactataataagcatccataaaacacatattttcagcttttttactgtgaacaatgtttggacttcgagagtaacattagtagtacatatccataaccaagttcttctaatggagtctatcactcatgactaaagtaattagcttgctcacttcaagcaaatagaagaaacgatgacaaaaggtgcatacgcaatattatctaacaaccaccatcaaacaaaatacatatgctttacctcataagttacagcccatttcccatggcgtagcggcctgtgatggatgttgatattccctatgtagaagcttctgccactttgtaccttgttgacttcagttattattgaatcaagtctgacaaaagtatcatcatcgcacttcattacatacctagcagagacaacatgaacctgagcagacaagtcaaccagtcagaaaatacgaaaatagacagcgtacagtttatagatcattaaataagaatcagtttgagcaagaaaattgttggcataccccatattcacatattgcaagagtcttcaaaacaactaaatcatagttgtccaggaacggacaaaaacgatgtccccaaaaaattctgcttcctttttcaactccacattcacttcctttctgccatgctggaataaagaaagttcatcagctcaggtttacggaagacatgaagcaaggaaatctatcaagttaattctcaagaattaccagtgcaacaaagaaacgagctaccacatttggtgagtttctgacagcagacatccatgtcttcctcacacccatacgctcagcaaaatgattgccagatgacaggatgccaatgaaaatgtcaacaggttcgttaggcagaggagacgactgccaaacagttgacatatccaggtaactctgtggtgaaaagcttgggtgtgttgtgggtaaagaccccgcaaacactgattgcacatcaaggtccccactcaatgctaaacctgtagcatcctcaagaacaaatccctgcaggagccaaagcaaaacaaaaataaacttaaggcaactgttgcccagcactgatgtttgaactaccgtaaatcatagtgttctatcattcattatgcaagtcattcaccacaatttcgatcttggacacaagataaatggaggaacaaatgtacttacaggacggtatggaaaagaagtcacatgtcgcccgtcgacgttcacatggtacccctccaacccagcgctgatagtaagaacaaacaatcggccctccacaaaaggataaggccaatcaaaattcatctccttcttctgtccgatcagccggttcagccaggttgtcgtcgattccttggaccgttcatccgcgttcagaatccagttctcacacttcacgaacccatccactgcacaaaaaattattcactcgatcaacaaatttccacagaattcacctgaactaacataatcaaaatggaattgcaggggtccccaaccggtctcctcatcagagttggacttccagccctcacagcggagcggggtgccccactgcattcggtagcaggtgttctgctcaatcaccggcttgccgctccagtcgccgcggaggcgtgggttgaagtggaggatgcgcggcgggtcctcgccgtcgacggtctttagcccctgaagctccatcatgaactgcgacaccatgatcggctgctccccctccttcagcacggcgatcttagggtcaccctcggcgtgcgccggccgtggcgtcgcgaccacggtgatgtgggaccccagcgtcagcccgcacgggagctccaccacgcggcccctcccatggaactcgtcggcggagcgcatgaccgactgcgggcacttggccgcctccgcctccccctcggcggacggcgactcgaaggcggcggtgtcgaggtcctcgagttccgcgaacacgcgg

SEQ ID NO: 54721 - DNA, 707 bp, Oryza sativa
tggtggatcctgcagctcagcaactcttgactgaattagcagttgtcaatcctaatgctaaaggattttccttgtccaatggtctcattaagaaagagggcagaatatgggttggggctaattcggggttgcagaccaaattgattacaacctttcattcttctccagtagggggacattccgggattcaggctacttatcagcgtttgaagaaactttttctttggcctggtatgaaaactgccgtggcggaatttgtgcaacaatgtgccacttgtcaggctgctaaacatgagcattgcaagtaccctggactattgcaaccgttgcctattcttgctggggcttggcaggatatttcgatggatttcatcgaaggtttacctctctctaagggcaagaataccattttggtcgtggtcgatcatttcactaagtatgctcactttctaccactgaaacatccattttcggctcttcaagtggctgaagtcttcctggatcaggtggcaaagttgtatgggatgtccaagtcaattgtctctgatcgtgatcgagtgtttactagtaacttttggaagacactgtttggcagatttcatattcctcttaatttgagcactacctatcaccctcaatctgatggacaaactgagcgtgttaatcaatgtctcgagatgtatctcatgtgtgcagtttctaacact

SEQ ID NO: 54722 - DNA, 2110 bp, Oryza sativa
  unsure (1)..(2110): unsure at all n locations
taaatgtagcttttttttggtaaatttaacataacttggtaaggttacaaatggcatnaaagtgaacaggccccttaccaaattttggcattaccaaaattttggcatagttgccaaaattttggcatgattttttatatagttaccaaaatttggcagcaaactaaatgtagccacttttttggcaactttaccaaaatttggtaaggttgaaaatggcatcaaagtgaacaggccattgccccagttaactttgttccaaacatcaatttgttcataaacttcgaggaaattagtttttttaatggtaaacgatcaaagtagcatcatttgtgaggaaattagtttttataaatggtaaacgatcaaagtagcatcatttgtatggaaaagatcggtttccacccatcgtctcaaagttcatcaagttggtctgtaccaggattcacaatatatgtaaaccggcaaaaaccaatgtaattcggacgctttttctttgttaaaaaaataattaaattctagtttgaatttttttaacttgaccggaaaaactgagtggttttgtgttatcgagccgtcccaggaaatcaggttttcgttgggtttgtgaaccctggtctgtacgcacatgtgttctcctttcctgatgctaaatattgaatgcttgtaggctttggagatggccatgaggtgttcttccccactaaccgaacaggccaggaagatgcatgattcctcaaattctggcatcctccctttggacgtgctgttcgacgtcctggtgcggctcccagccaaggagctctgctgcctccgtgttatctgccaggcatggcggtccctgacctccgatccccttttcatcaaggcacacgcagctcaccacagacagccgctcctcttggccacatttagagacgacgaggcacatgttcatatcatggatttggtaggcaatgtgcttaagacgataggaatcccggttggccacaaggtgttgtgcacacacctcgatctggtctgtgtagccacaaattggaacagctgccgtgtgcttaatccggccaccggagctgtatacgatttgcctgaaaatccagcagaggagcacatgtaccatgcccacctatgcaaaccttacacctcatttgcatttgggcgtatcaccttattgttcaatttggggaatttttctagggttagccttatcagctcaccccttcctcatttattctattagcataccactttacagataggtccttggtacaatacatatttacaccaacactcccctccaagatgggcaaaagatatcaatcatacccatcttgttacatattgattgaatctcactaggacctaacccctgagttagacaatcagctagttgttcacatgacttaatatactccaaactaagcaccccgctatcaatcttctccttaatgaagaacctatcaatctccacatgtttagtgcgatcatgctgaacagggttgtttgcaatgctgatggctgatttattgtcacaatgaagcatcacaatgtcacttcttagcactcgcaattcagtcaacaagctcctcatccacaacatctcactcaagctcaaagccatagctctgtattctgcttctgcggtagaccgagccaccactgcctgctttttgcttcgccaagaaacaagattaccaccaacaaacacacaataacctgatgtagatcttctatcatccatactactcgcccaatcagcatcacaatatccttccacatttagatgctcattcttcctaaaccacaatccctttccaggagtccctttcagatatctgagaatcttatgaacaacatccaagtgaccagttcgaggatcatgcatatacctactcacaacactaaccgcataggaaatatcaggtcttgtatggcaaagatagatcaagcgtcccaccagtctttggtatgcttccttatcaacgggatcacctgattgagcacacaattggtgattcctatcaataggcgtagtacttgcccgacacccaagcattcctgtatctgtcaatagatccaaaacatacttcctctgagatagaacaatccc

SEQ ID NO: 54723 - DNA, 15061 bp, Oryza sativa
  unsure (1)..(15061): unsure at all n locations
aataggatgtccatcttgagacaacacagccccaataccagtggcacaagcatctatttccaacaaaaaaaggccgagaaaaatcagggagagccagtacaggagttgtacacatggcagccttcaactgttggaaagctgcttcagctgcagcagaccattcatacttcacatgcttatgtaagagcaaggtgagaggttttgctataatgccatagtgctgcacaaacttgcgataatagccagttaatcccaaaaaacctctcaactcagtggtgttagtaggagtgggccactactgcatgatcttagttttgtccggatcagtagcaaccccttctgctgaaatgatatggcccaaatattccaaagatgtggcagcaaaagagcatttactcaacttagcgtataactgatgttgttggagcaattgcaacactaattccatatggtggacatgagagtctaaatcagggctataaaccaatatatcatccataaaaacgagcacaaatttcctcaaataaggagcaaagatggaattcatcaaacattgaaaggtggttggtgcattagttaagccaaagggcatcaccttaaagtgaaaatgcccatggtgtgttttgaatgcagtcttctcttcatccccttctttcatacgaatttggtggtagccactgcgaagatccagtttagagaaaaatttggtgccagcaagttcatctagtaactcatccacaataggaaggggaaacttgttctttactgtcaaagaattaagccttctataatccacacaaaacctccaagtattgtccttctttttaactaacaaaactggagaagcaaatggactacagctgtgaacaatcaatcctgaggccaacatctcagtgacctgcctctcaatctcatccttctgggcaggtgagtatctataagggcgaatgttaactggggaaactccagacagtaaagggatagaatgatcaaattgtctctggggaggtagagaagaaggggtctgaaaaatctgatcatactgatgaagtaacttggtgacagcaggtggcagtggagaaacagatgaaggtgcaggaacagtttcaaccacagccaaggcccaaatatcattaccagcttgccacttacacggtttatcagaagtaacagcagtgagttgctgaagggagtgagagacaataccttgcaacttaaccgtttgtgcctgataagcaaaagagagacacttctcagcccaattacactgcatagggctatactgagacagccaatccatccccaacactgcatcataacctcccagatccaagaccttcatagaagagacaaaagtgtaaccctgtatccaccaagtaaatgcaggaacttgagcagaacaggtgagcagagtgccatcagcaattttcacggtggcaggatcacaggataccaaaggcagctgcaaacgatgacagagatctgcattgataaaactgtgagaactgcccgaatcaaccaagattaacaccacctgatttcccaccaaagctctcaactgcaaagaattagcagaactggtaccagccaaagcctggacagatagtaacataccatcatcaggaggagtatccaggttggtaagagcatccagcacactatcatcaagaatttcagtagtgtcagtcaattccatggccttcaactgaaccccttcaactttgccacacacatgagtaggactatacttctcaccacatttgaaacataaaccattggcacgacgataatccttcagttgttgagctttccacaattccctcagagtagatttccctttatccccaaatttaccaaccccagtatccttcttgacaaaggatttatttaactgttgagcaccttcaaaagccagggctgccatataagcttgagtgactatgacaggttgctgagcatgtacattatatctcaattcctctttaagaccccgaataaactgagacaccaaaacagagccctgagtaatagcaggattatacaagcgaatgtggtaaaccaactgattgaactaggagcgatattcagtaacagtactagtctgagtcagaagcaacaactcatccattttggttttctcaatgtgcagctcaaattcagcagctatagcagtgcgcaattgatcccaagtcggccaccccatctcctgtttccaagcttggtaccagtgcgccgcatcccccactaaattaagagcagccgcagacacccgaaattcatccacaatattatagaaacggaaataagtctcacagttgtctaaccacacgcgaacatcagacccatcgaatttaggaaaatccatctttggtgtccagtgacgacgcccccccgactcatcagaaggacgaacaggtggagtaggcgcggtagtgaatacctgatgagacggtgcagagtgcacatgggtaggggacggtggcgccgaagatgaagaagaggccccatccttagtaggcggcttcggaggtggaggaagaagtggaggcggttgcgacggcagaggtggagtcggcggtggagttggtgacgaagaagcagacgtcaccgccttgagagcccgcgcgacctgagcttgctcatgctgaacttgcccgagagaagacatggacaaatccaccttgctttggaccgaatccagccgcttcccttgagtttcaagcttgaggtcgatctgcttaagctgcttgcagagattgtcgaccctctccaccttcgtcaccaacactgcaatcgcttgagtgatgtgttcctccatcgcatccatagccgccacaacttgacgcacctggacgccttgcttcgccggagccgtggtgactacgtcgaagaaccagatcgaaccaagcacgagattaacagagaaatccccgaagataaatcccaaactctgatgcgaggatttaccgagctgaacaacgaagcagaaccccccacgccacgaacgaatccaaatctgataccaagttgtcacaacctcgtcgccggcgagaatctcgccgccgcaatgaggatgaacacaagatggattcgaatttcagagaacagaagagaggcagaggaaagagagtttggggagaggttttgatttcatttcttcagacttgttttccaactacagttcacggggattatatactactccctcgcgtttccgccctcagggccacacaccgaactcacgctacacatttacttaagtcgctttctttacacaaaaacgcctcagcgtgattacgcttccttctcctgttcctcgtccgttgtcatagcctgcgatatgacacgccgccgccgctaggtcgatgtgccgccggcgccggcagggagatcggagatggcgcagcgcggagggcggagggcgacgccggtggggagtgtgacgtgttcgtcgtgttcttgagttgccactatgtttatatgggcttttcatgggccgggcctaaacgaggcccaaaaggaagagcagaatggtcagttacagtcaggtttacaatttcaacaaaaagagaccggtcagttttcacgagatctcgtgatttcgaggaggctggatttcgaatgattttctagaaatataaatttggtcattaaaatgaattgaaattcaaccgatatttcgtcaaattttctaggtttctgtgcaatttttattcgtagctcactgcatattctccatcattgttttattgttttagaacagtactagcagtaacaactatcgagctcaacttaaagccgaatcgtagtgtaattaaaactaattcggatccgaatcgtataagcaaattcatattcgaatcgtacattcctatatattcaatcatgttgcccgcctcgcctgcatcaacctgtagctagctagcttccataaattaagcacgtaacggcacaagcctagactcgggcagctactctcttcgttccaaaataaacaaaactaacaaagaaccaaggaagtagcttcttgatctagtcagaactcgatctacgcatctgatctatgcaacgtacagtggcagccaactggcggtatgggtggagtggttttgtctgacatggaggtgagcatgatggagcaggggaagacaacaacactgccgcagaaagtgagtgtcacgcccgagcatgagaggccagaagctttgttggacgccaacttgaagatattgctaatggtaagcttgtgttctatatatatacactccctcctctccgttttttgtttgacgccgttgattttctaaaattttaaatttgatcaaccaattttcttgtaaaaaaattatgtaattattgtttattttgttgtagcttgttttgttgttacaagcactttaaccatgacttgtgtttgtacgaaacttttggatcagacaattaaccaaacgtatgtgcaaaagctaatgttgtcaaatataaaaaaacagagggagtatagtatgccttgatctggaaaatatctagtatattaaaaaaacatcattaattattaataggaaaaagtccatattgctccctcagctatggtcatagtccgattatctcttaactaatctctctactcttgaaactattcgtatttcatcattggcctaaaccagggtgtttttcgaagacatagcgtcacttgatatccttattagaaatttaaaatatataaatatataatgtctatgatagaaagagaaaacggaggtgagcatgacacatagataagcagtatttttatttttattgttattatttattattgattggtatgttgatgccatcactaattgcctatatggactccatgtagaagccacatcgttgaaagtactctatttttgaaatataaaaagaaaatcaatgtaactgataatttttttctttacaactcaaatctttttgactgaaagtacaaattttcccgtatatacggtgatctatgcatatatatattcttctaatcactctcttttctgtcctcattttcagataatcgttacgggcgtatcgctgggggtattcgtcacttgccttgtgttggcttttgtattggacttaactgtggagggtagggcaatggtagtgtttacggcgctagttggtgttgtctacggagtggcaggctataacatcattcgagcatgctaagcgaagccaaacaaacttttttttctctctttttaagtttagtttagtttgacgaacggtacaaaaatttccaagatttccaactgtcatttccactttccactttccgactgtcggtatcggtaattatcggtgtcggaaatagaaacggtaatagcttttggaaatggtaacgaaaataggatggaggtttttccgaccgttttgtcggtaaccatatttgtctagtaatttccgtcaaaattcgaaaagttccctagtgatctagctagcctaaccaaccagaagcctataaatgaaggaagtctggtaggcttgcagcctgttaggaatgggaagtggccaggggaaaaggttgttaagacgtgacatgtggactttgctaaactttggtctcctcaacttatcgatgctgaattattattgaagtttgtttatattgttcgtcgaagttattatcatatcattaatcatcatataatagtgttatgtggagtgtgatgatgcacgaatgaagttataaagttatcttcatgtatagttaaatgtgtgattatgccacgccccattgtttccgatatgaattttcgacttccaactaatatcgatagattccattccgacagtcccatttctaatataccaatattatcgatatcgttaccgttttcgggcctatcattccgattccgctttcgataaaaaaaatatagaaatgaaaatggtagagggtcggttttcatccattcctaggtgaagccaaaaaagggggttcgttttccataaatttcatgatttgggggggtggctggatttcaaatggttttcaggaaatccgaatttggaaagtaaattatgttgaagtttattcgatatttggtcaaattttcatgttttcgagaactagcggggcacggaaccctggtattctgaacagaagaagctcctctaacttaaaattagtggaacataggtcctgacaggtgaggcacacccacatgagcccacgtatcaacaacacgtctctcttacttaagttagaggagcctgcctagatcatccaagatatccaaatcagcataacaataccacaagcacacaaagatattggcacaaaccgatacaactgattatgtatatttatatatatttcgcagggctgtgaaagagagatcgctggccgatttcgttcatcagaaaggaaataaggagttgcagagatttgatcaaccacagggttcagaaggttgtaagctagaacagcttgcacatgaaagaattcgcacttcctcagatcatcttgcgatagtttacctaatctgataaagcagaatactctccattgatcgacagcttccatgcaacaacgtcaaccaacacacaaagttcagatacctattcaaggcctgaagagaaagttcagatacttgccaccgtccatttctccggtttgacagaagtggagacgattggcaccaggttagcaactgcaccactgtctgggaaccaatcatctacccagaaagatgttcctccatcccccaacttgatccttgtgggcgtggcagttctaaaacagtcgtcgatcgccttgtcccgcactggcttcagtccgcaccatggatgctcgagggtgcttccattgcagcagcggccaacgcaattgcaaggctgtgccgagcatctggagatcttcaaaccctgcattcatatattgttaactgatggggtatttaacatccgaacactggatacaacagatagtgtttaactgtctatactttcatgatttctcctaaccgtttatactttcatgattgtgccctctgatacccttaggaagatatccccaaggtctgatatttaattgattattgttatcattcatatatatatgcctgcagcataattatcgacatttcagcatgacagaaattgtccaaaagaataaattgcataactgctcctttcatatagcctaagttagtactcaattctgatatgttgagctttcagactttcagtcctaaatagcagttctacattagtgtaagcaacactaccagatagtacttgatatcctacaggtttgggatcaatctagataaccaactaaagtgatatatgcttaagtactatgaatgtttgtgcgatttctgtaaactcttttatgcttacgcttctattatccttacctgtggtgtcctcttgcttccccttctccttgggcagcacctccttatgtatctgcatcatgactgtgagccacgacatctaactagttacactcgaggcccaaagcctatgtctcatatttccgtacagcataacagcaagaattttgaagtccgattcatctaattggagtggactaactgggacatattgctacttagctcttgttatatactttcttctcatatcaaaagcatccatatccaatcattgattcctagtatagtatgtactctttccttctgtaaagctgtcttatatatcttcatgtgacaaaaatatggtgtttatagtttggatatggttgtgctcaaaattttgggaagcacccaagaaattttattgcaacatttgacttatcaagggaccacgatatgacaattaagaaaattctggattcatgacctttagcaccaacaagaacagaagaataaaacatagtttccctcattaaggtggcattttcttgcttgaaagcttccctgcaagcaagactaacaacgcaggaagtctaccagatactaattgattatcagacttctagttccctatcaacaaactacaatgcacttctattagattaactatgggattcataagcttggtactctagtaaggattgcttctccaattcattatcatgaatagtatctgagtttgagtaaactaaaaatcatatattgcattaccacgaatttggtaaatttgtccaaaattgactatgcttgcatgaaagcaaagttcattaagaatcccaacatgcacaaccttttaaagttcaaatgtggcataagatgaagggagcactaagatgagttgtgcttcaagagtcaagaggtacaatgagtggcttagtaactaactagtaaccgtgcacgtgcattgcacgtagtaacaaatgtaaattaaaaccattgtgggagaaaaataagaataacagcaagcaagttatacatgcatggtagcaccaaagaatccatcaccagaataaatatatactgtatataaataagtgaaagtgctaagcctattttatgtgaaactatacttgtttattacagtgtattccgcacgacttaacttcactacctccctcttatgacaaaatcaggatcatgcacacacccagtggctcacatctcatacatccacagcctcatatgtgttgtcaagtgtcacacggagaaggtctgtccaacttttttcgccttcagcacttcatccgtcaagtaaaacacaaaacaatgtatgccaagataaaggatcagtattgatagtaaaatattttcttatgcacagtgtatgtcaagtcaaattaacattgaccaaagaaaatccagattccaatcataaagataaaggatatctcatcagaaatagtaaaggctaatattttcaaggtcaatttgatgatcaaaagattattgaattacaataagcacaagattcaactgctaaacaactttgcaagtaattcatgaagcaattccgatgacatcactttatatcgaaagaaccatcgtaatttcttaagttatgtgccaccaacatttttaggtgataattgtaatttactacaagcattttttggaccgggtagttggaaacataaatgcagagtccactttgagtctaatttcagtaccaaatgcgcaaattttcaagtatctgatgatcacatgatcaagaaccagttcatctggagtatgaacattttagtgtcaaacttaaagtgtaaaccatcaaaagcaaacgtggagatgaaaaattcaaaacatgagacgacaaggattaacctgttggaaatcaaagatgccatggcctctgtgaaccatgtgatgctcaatggggatgaccatcattgataggtcacgaatgattctgccagtgacgctggatacatcacttggtgttgctactgcttggtgtagttccaatttttggagaacttgaaaagaaaagaacaagatcataactcataggctcatagcatgtcactgtaaagttgatatactctgcagtaattttaactgcatgaatctcaaatctattactgaaaaagaaaatcttaggaagatgatatctaggatatgaatagctgttcagattctcacgtcggaccacaaccctgtttcacatcaatcaaatattacaattaggtggcagtaagaaagaaaaatgaattcaggcatgcatgctgaactggttaacagggctagcagtccttactaaatcttaacattacgccttatgccttgatttgacaaccctgattgattttacatttctattatatatagcaatatttctgaaagcaaacacccagaaatattttagcaggcattttgatatggaacttcttggcagaaaacattagagagttgtaaactaaagtgcatgttgtaagttctaattatatgtgcatactaatagtgctcaacatttcccatctactttgcccaaattgccagctcaatgccttcatttaatttccaaagtatctagtcaacatacatcaccatttactgccctcctaactgccatgattagatcaccatggtaagctgctatggtgatgtgtagtatttggaaagaagtgttgcttcaggatgacatgtatagcaaccaaaatgatccaaaattgtaagggttagccctacaacacttgtattttgcataggtgctctgcaatttatagaacgaatcaaatagcctacaaatatcctttaccaacaaataaacctcaatttatcggcatcaactctagggtatccttctaaaagactcaaaaaaatatcagtaattcacaagaatagagaattgtatagaataattagaattatcaaatctcaccaaacaatcaaaaaagaataatcatccccaacaattcacactcggctatgttgccaacatggttgaagagcactggattttattttattttataacgaaagtgagacaacacaacttttgattgaagtgttcccatctattgaaacaatggtacagtaattctaatatgtgagttgcggtacaaatattatgtttggagaacaggttgggtatgataaataccagaaacaagccgagagagtgagttggtgtgatatccccttgtggttcagataattgtctgcaagcgtgtagtaaacaaatcgttagagaaaaaacatgaatccagtagaaaacaagtttcttaaccacattctaataccaatataatataaagaactgttgatttgtttattcggcaaactgcaacacattaattaatctgaaagtttcatattcaccccttccagcccatatggcagaagaatacatgcaaaagagtagccagattgcaaaatagaagatgattttgggcattttcaccttacctgttggtacttctgcttttttgtccagaagacggtggtcgagggaaggtagaggccaatcattgcattggcggagcctgtggacgacagcgagaagggaaacatggatgtactccggcggcagggacgggaggggccgacctcggcggcggcggatggggctgaggtcggatctggccgcgacggtagggaagaagccggatttggcggcggcagcagaagatgtcggcgtgggcagcggctccggtgaggatgcggcagcagtacgcgcggggaggagctccggcgacggcgaggatgcggcggcgctacatgcggggaggaggaggagcgagcgaggaggagaagcgaagtccgtgcgtggaggaggagcgaagtcttcgcgtgtggaggaggaggagtgaagtttgggcgtggaatcgtgcggtggtgaattcgtgcgcgcggatggacggtagggattaatccgagtgatttggctcgtaggattggaggggtacaactcctttttatattagtatagatatagatatagatggtggtaatcaatacaaattgtactctgtttgcaaaacactatatcattattgttacttcactgtcttcctttaccatccttttaaatctgctgctacacttattcctgagtaaggcaggttatatagaagtaaaggccctatcttttcatatactctttcaaataaacaaaaatcatgggaaaccagctatcaggcaaacgtaaactacaatgcatagatagttgctgtgcgaaatactgcgggattttgaagtcatgtcaggaataacgaacacttgaacattcatactctgtacaatttacaatcatgaaagcctggttacctgactgtcatagcctcttcgcttcaagaagcaagagatgataattcaagtttgtaaaaaaaaaaattaatcctaccaacataatgaactatggcaactggtgcccttgtaggcatttcactagcaatccggaccaaacgtgatcaaattgatcaaacatatagcaattcaacaaagaagctaaacttttatctccgaatcgtttgtttcatagtgccaattcacactaagattccaactgtacatatagcaattaacaacaacacatttactcacttcgaaattactcatcgaatagataatatatatatatatacccctttcacttccatcatctaagaaaatatagatagctgtatacatacaagaagaagcagaagcagcaatggtggtcaagccgcggcggcggtgccttcctcctccttcttcttcttggcctcctctccctcctcctccttggccacatcgtcctccatctccgcggcgagggactcgagcagcacggacttagggttcaccatgggcgggcccttctccctcccctcgagctcgtcgagatcgaaggtgatgagcctgtcccagatccccccctcgaacagcaccccgaccttgccgtcggtgacgcgctgcacgatgccgcagtacatgtggtaggcgttgttggggttcttgacgagcaccaccatcccggggaggaacagcggcagctccggcgccctcggccgctccaccgtggcggcggcggcgagacctttcctgtgcgccggcttggggggaggcgggttcttggcgacgaagtccttgaggccgacctcgccgccggggaatccgccggtgaggcccatcatctccttgtcgaacgcgtccgggtccaccccggacgcagccggcggcggcggtggcgactccgcgggctcgtcggaagaagtggtggtggatggcggcgcggcgggggagtcggaggcgagctccttgcggatgccgacctcgccgttgcagagaccccggccgccgaggaggtcagcgacgcggaaggtcgccgagggagggggcaggcggacgatgcgggggtggtggtggtggggcancngctgcgggcggatgaaggaagcggnggtggtgggcgccattggtggagcagagcggagcagaggatgtgtggaagtgacgaagcctttaaagcctaggtggatgaggaccgggggtggctaatgggcgactggtactgctatacggagtacagtatatacttaaagtactactagtactactaccactgtactactttaaactactactccctccgtttcataatataaattattctagcatttattacacgttaacatcaatatgaatatgaaaaatactagaatgacttacattgtaaaacggaggaagtagtagtaactggagtactactaactactactactaaggctgtgtttagatccaaagtttggatctaaacttcagtccttttctatcacatcaatctatcatacacacataacttttcagtcacatcatcttcaatttcaaccaaaatctaaactttactctagaataaacacagctaactagaactagtactagtactactagtactggtaactaggaccactacaccactactactgttattatatactactagtactatttaaaaaatatattttatatgtaaatatatacgcatatacaaaagtttatatataacgtataacaaagtttatgatatatatacaaactttatatatgttcattttaaaaaataaaaaaaaatagaggaaaaccatcacgtatataaattttatatatacactatacgcatatatataaactttatatacgtatgtatataaactttgtatactgtatatacaaactttatatatgtgatgttttttttttaaaaaaacaaagaaccgaagaaaacaaccataaaaaccggcgaaaaaaaaagaacgcgggcctcccactgtgcgcggccgccgcgccccctccccctcctacgcgcgccacgcgtccatccgcgcggggtgagggggcacgcgaccagtcgccaattaggaatttcggatgaggacctcgtgtttttcgactgaaaattttacatttaagcccctttttattttttttcataaataggcccctaaagttactatccgtaagaaatacttcctccgtaaaaaaaaacccaacctaagaggagatgtagtgtccagattcgttgtactgggaggggtcaaatcccctcttaggttggtttctttgggatggagagaatcacaaaataactcaatctagattcgttgtcttagaatatgtaacatcctatcctatattgagttattttgggacggagggagtagacgacgagcccaaatcacgtcaaatgtggtataagatcttcacagtctacctctcagccaactcatgtagtagttagctcttaactataaactatatggttcccatgtttctctcacatattttcttggttcctatgcctaagctagttttaagcataccactcgctttccctctctctctcctctctcatccacgttagcattcaaccttctaacggccttttattatacttgctcttacagtgaaaggtactactaaggctgtgttccctcacctctcgcacagaaaacagagcgatggattagtgcgtgattaattaagtattagctaaaaaaattaaaaataggttagtatgattttttaaagaagctttcctatagaaaatattttttaaaaaataccgattagcaatttggaaagtgtgcgcgcggaaaacgaggaggagaggatgggaataggcagtgccaaacacagcctaagaggaatctagtatgtcatatcggatgaggcttctttaaagattccagcaccacaagctaggccatcctcacaacgctgcttcccgccagattccaactctcttcctagctgctttttcatataggttccatcttcccacctgctttttttagctttttttcagaggaagcactcgtgtccatgcaaagcaccgagtatctatgccaaggtccgagggcccacaccttctcttctccacggcatcatacggcttagatggagcggcgaatccactcgacatcaaggcgcactggaacagcctcatgggaagagagatcgacattagtcttattggcgccgagccatttaacctaggggccagcctctaaaaagggctccagaaaaggattcatttctgaaaatagttttttaagatctatttatgaaaatagtctaaaagaaaagctaaattgtaaaaatttcagtgttcctcgagctcctctgctttatggtctttcatgggccagccccaaacacactaatcaaat

SEQ ID NO: 54724 - DNA, 4280 bp, Oryza sativa
gggggcatccggggtgggcgatggcgccgcccgggacgagcaggaggagggggcggcgtgtcgtcgggcggcgggccggtgcgcggggctgcccctcgacgcgctgttcgagatcatgctgcggctgccggcgagggacgtctgccgcctccgcgccgtctgccggtcgtggcgcgccgtggcctccgaccgggccttcgtcgacgcgcacgcctcccgccacccgggcccgtacgtcgccgcgtgcttctccgatgaagccgacggcggcgacggcgacgagtcctgcggcggcgtcgacatcgtcgacctgtcctccggcgacatcgtcaagactatttacaccgaagtcagtggatccagagtgcagcgcacgcgcctcgacctcgtctgcctcgttgaagggcctagccccttggatgtcaccgtgctggatccggtcaccggtgctacctacatcccggcaaagagtatctctgcggataataaggatttgctgagttcaggccgtctcataatggaatcctgtgcttttgggaaggtcccctctacaggagagtacaaggtggtccgtctccttggttctggtaatccatgtgagctatacgagtgcgagatcatgaccgtgaacagtgctggcgctttgcaatggagggcgatacaaggacctcagttgcctgtttgttcaagtaacaatatgagaagtgtggtcatcaatggggttgcgtatttcctgttagattattcgaggctctattgctcaaatgatggcttgcttattcgaccaggtaacatagttccatttgaccttgagacggaggaatggatgggtattctaaacggaccgaaaccagtcgccaggggacgggatatgattgttatctcctcaaccttggaaattatggagcccctctcgctagccgacttgaatgggtccttagtgatggtgcatgctgtatacggttcccccatggacctgtggtttctgtcagatcttgagcaaggactctgggttaagaagtacagcatagatttcgaatactataataacaatgcttatcctttgctgctgttagacgatgagaagattgtcttcctactgcggggaactaatgttctacaaagttatgatctaaaggatgacacatacactgatatattggtggtgccagatttcagatccgttggcatttatactggagatctattgagcttggagggtggtctgaactgattatgtaagtattatttgctgatgttttctttatatcgcattgcaatggtagctgcttttcaatggtggtactatattttttaaggcatttggtgcgtggaacaactctccttgatttaagccttttaacaattagagcttctcaatgaatgaaaatatacattagaaagaatcaaagcatactagtttcatggttaaaacggacaaaaaaaattgtaactaaattccatgatttcttcagatttgtttcggcatgcttattgtatgtacaaagtggacactagaaaaggtggtaaaatatagcgcattgcatagatacccacacctttcattatgcttttcttttgtgctacatgggtctgtatttaacagctagtgattctccctgcaaatgtagcaattaatgttaaatgttagactatactaggatcagtacatgaaaattggagtataattgctgctgatcgttgtttctgggtgaggaaggatcatgattgtaaaccagttttatcttgatccatgtctcatcccttccacctccttttgttcctctcatgttagcattacaatgtaacaatgtgtccattggttttaaggtcttaaaatttgaatgtgattgcttcagtgttctaaaaatcagcgttaggtggcaagtcccgctgcgatttgcacttagtcggggggctacctgccgaggcgggattaggtggcatttggcgctgctaggcagggtttggcggggctcagcggaggtggcacatggaggtgggagggctcggctctgctcggaggagctcacgaggcacggagctgctcggagttggagtttgtcacatcctgatttttgtttcaggatttataaattatttaataaattattattagaatttatattaaatgttcattaatttacaagtgaagttaaatgtcggaaataaaatttcctaaatttaaagcatggatggatttaatttttattaaattctccatgattaattacactctctgaaattttctcggatttttcagagctcaattcctaaatgatacaaagaacagttcagtaattatttgatcattaatgatctaattataattgttaagagcttttcttgtttaaaaatccttaaattataaattgttgtctaaaagggaattattagaaatgatcttaaaagcctagaagagaagatctaattttaattaataaattccaatataaaatggggccagataaaatttcattaaatactttacttgattctatagttcttagattttttctgggatttatttgagccaaggaagtatttttaatcaatggaatatcatttcatgaataatttaaattgaaaaaggtttttgaaagtctcttttggctttgggccgaaagccggcccaaagccttctctctccccggcccagtcggcccagcccgccgtcgcttccttctctctctcggtgccgctgataggtgggtcccacctgtcaggcccgtcttcctcctcgcgccgctgccggccgaaaccctagccgccgccgctttccaatccggtcgatcctttccgtttccggtgaagtcgtttgaggggaaataatctcctcgatctcctcttccttttctcttatggaatcgtcggctaatttcggtttggaaatccgtggattcgatctcgaatcggattcgtctctctcctccgaaccctaatctttccttctcgtcgctggtcgccgtgggccttcgtcgccgccttccaacccctataaaaggacccccaagcccgccgctacccgccgccactctcgtcttcgactgccatcgcccgtagagccctagccccgtgagacctcgtgccgccgtcgccgccgcagctccagccatgcgccgccgtcgctccggtcgtcgtcgctgctcgggaaggttgccgtcgtggtcgccgtcgcgtcgccgtcctcgtccgcccctccgccgttgctgtcgaccgccggaacaccatcgccatcgtcaagccaaatgtcgtcgccgcttcttcctcgtcgccgttgccgtccgttgatcttccgccgctgttttggtcaccggtgagttcgccgcgtcgcccgcatcgttttggtgctctcctttcgcgctgtcgcgccgttgttcgccggcgagcttgcgcgcccgagccgctgccggtggtgatgtcaccgctgacgtcatcgtcgtcgtctcccgtggtccggccgtggaccagtcgatcttggccgtccgttgtggataggatcgatctcggccgttcgtttccttagaccgtcccgtgcacccggtttaccgtggatcgcctttgatgacgcaataatcctcttttccttttcaaaaataattcattattgcgtcataattcaattaaaatctatataaatgctttaatccgatttaatctttgaaaattcataactaattctttgtaactcagtttaatgtggttcaagttgcaaaagttatataaaataaagatctacatattaaaattatccataaatagaattaaatttatttaattctttttaaatgggctttaattagatttaatcttgtaaaattcgtaataaattcatttgaagtcagaatgaggccgttcaagtctcataattcatctaaaatcatgatctacatgtttgtttactttatatgtattgtttatttggggtttcttagtgttttccttgttttgcgtgttagcttgtcgtttccgtcgtttcgaaggttcgcgagtgcgccggaagtattcaagaagattaattgaagaccgattattgtaaggcaagtcacacagatcctaaacacaattcctttgagcatgttgatcctatatttaaattctctatttatttcaactgtgcatttattttcgaatgtcaccgggtggtgtgaacttattcctttgttatggccaatttgcattgattactctattccttgataccttgggttattataacttgactagttgagctttatatattggttcagctagatattagatatgattgcttagccatg

SEQ ID NO: 54725 - DNA, 6675 bp, Oryza sativa
  unsure (1)..(6675): unsure at all n locations
gtgtctagtcgctagtcggtagtcgctgggtagctgcttgactagcgccttcttgaacactgtgagccatgcctttcttattgctccattgtatgcattgaaattcttattatatattgacacaattaggtgcccaaactggcaggtatcgatgcactgactatgcattgtgctggcagtagggctaagctagggggatcatattgctggactggtgacaagttaaatgtttgttaaggtacaagtcattttattgagttcgcagtattgggtgctacactccggagtctgcgggtcggacattctaggtccctgtccgtagtgccctttggtcgcttggcatgcctattttgaagtgacactgtgttgtcatgcactgtcggttcttctttctttaaacgaaagccatgcaactctcctgccagggaaaaaatggtattgggtgctacagaacacgtttcttgatcttttgtgcaatttaacttctgctgacttagtgaacacgtttcaagtaattcatcatcctgtggtttgacatgataattttgcattattggtaataaaagataatatttgtccccaaaaggccttactgtgggcaactctagaaccttttccatagtatcatagccatgaccatgagtttttatgtactccatggtccaccatgcttatatttatctttggtttttactgtctgtttcctttaccatatgtgacgtttgctgttttggttcttgcaggtagaccattgcgcctcttgtattctccaaagacaaagatgttgctgctttcgcttgctgaggctacttgagctacttcgtctcttaatttgctccccagatggagcaaatgatgctatctcattcagttacaataatgaaatactcctatatcagatacctgtttgtattccgacggtacaagctgatgttatcagcctggtttaccgtctttttaaaatgtcgacaaacctgtggtggtgtgatctgtatgcatggtacttgtcctttaagactatgggaaaaccgtgtatcactgtcagtttagcttgggcacatgattaccaatgggaattttctgaacaatttcatcctcgtttgtcttttttttcctgttgagctgagcttgatctgaagctactcgtctgtttctaattctttttaggatgcagtttgaattacagaacctgcaggatctggtattccaagaaaaactgaattatcgattgctgccggaaggaatttctgattttgaatgaacatttggcagaaacatctgaatttcaactgattctgactgaaaatttggtagcaaattagaatcacggcggttactacttattagcgggcccgtaattgtgggcttgtggccaagctgggtaatttgaagccgggtaaaacgccgttttccttggtgcttaattagtttagccttgctttgctgaattttgtgttctgtcactcgaagcaactcatatttgtgcatgcagtttgttcgtacttgaactacatattatggtttgcacaatacacttttgacatacaaaggattcaagaatccagtaagcaaataactcaagtaggactagtattcaaatattcaattcaatcaagaatcaagtacgcttcagttcaaccaattaacaattaattaattttacatacactcgttttaaatttacatttagttaaaccaatcaatagtgatctcaactaaaacacttgtttctgcatacatctggcattcagaaagaagttgacacagttacttgacgtgtacagtccatgaacaagaaacactcaagagaagttcagtcttagggagtctgaacttgatccgcacatgcagagaacacttttggcataagcaaataattattgcaacctaagcatatttaatccaaacaatcaatgactaatgatctcagctcaattagctcagtccatgacacatactctcaagtctgaactccatcccatctcagggaaagcatgtctgaacacaatccagctcataacacgaatgtttcaccattcttgaactataactttcagaagttgatacttttgatgcgctgcaatacttggtgatcacaagtccagacatttcaaaccgaatatgtacatttcatactcgatttattcagagaatgcagtcaactcttgtcagcgcgtttgcagctaccgattgttctgatgatcacagatcaaccaatggccatgtattgtaccttggaccccaacttaatttcctggtgctcatgtagagttgttttggtgcagcccctgatcaaggagcttagtgtttaccagcttgcagaaatgtgtactctgacactgaaaatgccatttgagaagctttggtgcaatcagaaccttgttgatctcggttaaaattgaagggagctgttaaacaaaaatgtgcatacaaaacaaaaaacagtagcatagccagctagctgttgctgtaattctgttccaaaattacccgcatcagcttcaacatcacaactagccaatgcaagtctgaacttttctgaaaaataaatgaccaactcaagtttgaacttctctgaaaaataaacaacaacctcaactctgaacttctctgaaattcagacttgagaatctgaactgaatcaaactcatgcagagtacttttgcacaaacaaaagaatcaagtaaatattttattcccatgaataaatattacaaaaatttctacttcagcacatttggttcaaccaatcaataactaatgatctcagcctattaccaatacctgaacttctgaaagattttatccatgctgagtaaaactgacgaatcgaaacatgctagagttgcttgtattcaattcaaacaggacaatgttgtgccaccagaacaatgtgacaattaattgacatgtacagaccatgaaacagaaactgtcaacccaagtctgaacttttctgaaattcacagacttgagagtctgaaatgaatccaactcgtgcagagtacagtcttggcataaataaatgaatcaggcaaatattttattaccatgaataaagattacaattagtgttacttaagcatattttatccaacctatcaacaactaataatctcagctttgctaataaatacaagccatcagaggactaagctcctatacatctctgcttctatatctacagaagaatctctttccttcaacaaatgacaatgtcactgctaatccatctctagctccatagatcgaacagctcatcatcaatggtgaagtcgatgcagctcaggtcgtccattgtctcggcgaagtcgatgcagctcaggctatccatgctgtctggaactccaaaaccaatagcctccacgtccatgacgcccgatgaggagtgctccttctgcttgtccggcgacgacatcatggaccctgcaccattgctggcgtcaacttcggcttcattgccgccttttgcgggagagtcgaccggattgcgcgcggcgtactcaagtggaaccttcagctcagcctcatagtacccggagcagctctgatcagagtcattggggaggtccaccactgctgaaggaggaggaacggagccggagcagccatgatcggcgatgtcagagacagagtcatcgtgatggttcaccattgctgcaggaggaagaacgagctcctcgatcagagcagtctctgacacggcgctagtgcagctctggccatccatggcggcaaagtcaaagcagccaaccatgtcatccaggctctctggaagctcgaagaacattggcgcctcatcattttggttgtgctgcgatgacacccaagacgatgccggtgctgcacggccaccgccgccaccggcttctgctggaaagttcaacgggtacatcatggaagaatcatccatgctctctgaacctccaaattcagcaaactgcgccggcgctacgccaccaccgctgtcagcttcagcatcagcttcacagcttccttgtggcagagagacgaacaggttgctcgcggcgaactcaggcacaaaactctgcagctcatcctcatcgattgacccggtaacatcagaaaacaacagggtagagttgtcccccacgccagagcagctctgatcggcgccgtcagtctcattgggaaggtccaccactgctgcaggaagaggaaaggcgccggagcaaccttgatcggcgttgttagaggcatagccatcgtcatggttcaccattgcagcaggaggaagaaagggctcctctggtatggcgctagtgcagctctggttgtccatggcggcgaagtcaaagcagccaacaatgtcatccatgctctctggaaactcaaagaacactggcgcctcgtcgttttgattgtccagcgatggcgccgatggcaagacgatcagctcgggaagattagcaaacaccacgccggagcagctctgatcatccatgttctctggacctccaacatcagctaacgacgacacagattgcgccggttcagcttcatggcttccttctggcaaagagacgaacaggttgcgagcggggaactcaggcacaaagctctgcaactcatcctcatagattgacccgggttgatcagagaacaccagggaagagtatcgatcggtgacgtcagagtcattggtatggtgcaccaccggtgcaggaggaggaacggcaccggagaagccctgatcggtgtcgtcagagacacagttcaccatcgctgcaggaggatgaaccggctgtggcggcggcgcgctgtcctcgagcatagcagtctccgccactgcgatctggtggttgtcgctctgagattccggttccctcttgcgcttcttgccgtggccgctgaaccggatgcgatacagccgcgtcgtcgacgacgcgaggtcagccggcgccgtgatggcgtactcgtgcatcacccaccccgagctccccttctcgccatccgcgaagtagctgagcacgtacttgcgccacgcgatctccacgccgccgccgccgccaccatcggggacgaccagcctctcaccatcgacgcacatcctctgcccctgccagtaccctccgccctcgaccgtgcgcttctgccggctccccttgccgttcttggcccgcgcctcggcgaagaagaacgcgtcgtcgcccctgccatgatccgcaagaagcctccatggcggcgcgcagaggggatcggcgtcgaggatgacgccatggagagggaggggcttaccctggatgcgcgcgaggaggaagcgggcgacgagctcgtcgtccttgggctcgaacctgagccccggcgggagcccatctccagccgccgccgccatggatcgatccgcaggagaggagaggaatttctagggtttgggaggagggtttggttgggaagagaggagaggcgattcgaatcgaggaggggatggggatgtgagcaacggataggaggctatttaaaggcggcggcttcgcgggatcagctcgcgctcgcgcgcggaaagatcaggtgtggtttcccatttttgggaaagtttgatgaaatatcttgtctttgcgattcgatatgaaagttatttagaaaaaaaatagcttcaaaattcgaggtgagattggtttgaattttgcagttctgctcaagctatacatgcgtattactgaaggtgacactgaacaaatgatctttgcagcctactagctattgcagtattgccaattgctgaaggcctgaagctgacactgaagaatggagccataagaaagattcagggtgaatatcacaaaatttttttttttgacgtattgagcaaatccagctgttgacgaagttcgaagtctgttgatttgtcttttgtcttgaggaacactgatgaggttaccgcccgttgacacagttctatgttcttaactcctctgaagttcagactttagagcctgcactcaatccaaatgatgcagagtaaacttttggcacaaacaaaagaatcaagtatttttactgccttcattggagataatcagacaagagcctaaaataattaatgcaacataagcacattcaattcaaccaaatcaaccattaataattcattaatggttggctgtcaaacggattttgtgatatctgaaattctgaatgtggatgctacagttttgcactgagcttaaaattcggacgccgactgagcaagttgttgtgatgatggcagatcaactaatggttgatttcctggtgcttgtggggggtgatttgaactctgaagagattgttttggtgcagtacctgccttaagaaactactaggtgcttatcaggttcagagttcagacccctcatctcctccttgggcaagttcttcagaaatttttacaaagccatttgagggacggccgtttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54726 - DNA, 12816 bp, Oryza sativa
  unsure (1)..(12816): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctggaccttgaagattcaacatggatgacatatcagacatattttcctcttcctctaaatctgcatcaatcactataggaggaatgtcatccagagtcgcctctgagtcagaacttgaatattcagaaccactcattggagctacgccctttgaagcgttattactcatagagagagagagagagagagagaggaaagtagtataaaggggatagccttaaacaacttgtcaaatatataatactaacacaaaagggtccaaaatagatgttgtcgtgtgtgaatacgtcctggttgccctgaacatttacagctcatgcttccaactggaattggtggcatactgtagtaatgacaaaataaagtgtatcgctttaactgatacatatcttcctccatacaaggattcaacatttaatgcgatatatatttcttcaatatatgggcgtatcatttaattctacatatatacatctttcatttgcacaatttaattctacctatattttgcttcttatttgaagataccatttaatgtgatacttttttaacagatacacatatcttcctctgtagcacaaggctggatcattaaaatttaatgtgacagatattttgatccatttatggctgtgtcatttaatacaatacattttttcttccttgtatgggtgcaccaattatttgtgacaaatattttgttcgtatattcacatatcattcaatacgatacgcattttttttcttacaaggatgtaccttcaagaaatacatgctttcttcctcgtctggttctgctgtttgttgcaatacacgtcctctaacagatgcctgtatttacaaagacatttgtcccaccaactagagggaaaaaacaacgtacctcatgacaagcatgcatctgtggtccacatgcataattacaatattataattctttatatctttgcccttttttggatgtccttccattttcttattttgaatgtacatctacataaggatagtgtgaataatccagagtagtaacattctccaatgctttattagctatgtaccaaatgaatggcacacctaggaatgtgttccaagctgtataattttttggatgaatgtacaccgcaagtaataggaaaactttgaagcactttgtttttcttttctattttagcagaacaattggcttttctaagaagcaaccaataaattggttagccccaccttaccatggtcaccttcgcatccaaataggtcatggttgtagcatgttacacatagggtttaattactggtagttaccacgaaaactaggcttaccatcgagctttagtagcggaaacgaccagtaaggtttggcaaaatttatttaaattcatttctttttccaaagagaggaaattaaaaataaaatcatataagtagtatagtgctatctggtgaaacatttatgaaatatatgaagttaactttatattttgtacccaacccaagttgaaaataaaaaaaagaaaaataagcaaatgggctaggctaatagtgagtgctattcacaaaacctatcttagagagccgatcgtgatttctactatgtttcagtttccaaaatacaaaaatggtcacacgaaattgcatgcttgattgctttattcttttacatcttctgaatttgccctactttttctagaattatctatgatttacctgaatttttgaaactttttctcacttttcgggtttcccaagaataatgtttgtccccctgagtttgaatttttgaattcaattttttttaatatgaattttatcagggttatggataccacatacctaatagtagttgactaaatctcggcaggacccaccacatactatgtcttatacggaaacaatcttcggatataggaggagttccgcacaaggaaggatgaatagagttctacatggaaacgacaagaactactcagattgtatccatattggttttcctagttctacttggacaaggggacacctatgggtataaatacaaggctccataggaggagaggggacacgaaacaatagatcaagacataagatcaacatacaagccaacatacgccaaaacaagacgccggatatcgacttcagagataagtatggctagtcccctacagcgtctacgaatactgtcaggagagacatagcgatgtctttgatctcgctggatgcggattctaggaggaaggctaccctgttgtcgactatgagtcagcacttcagaccgccatgtcgacaatagttagataggctaccccaaatattgtactagtgtgattatgatgaataagagcaacgaccggcttcgaccaacaggagtaggcttattacttgacaatttaggggctcgaacctgtataaaaatcctcgtccctatatcttttattacaatctcgcatatatcataataccaacgatcctcatactatgcaaataccggaatcgcgacatcaaacgtcgacaaatttcatctagttttcacatttaccatgtgctatatgtgttatcctagggtggccgtagggtttcaattatcaaagcacaaggtcactgataagtccgattttcccgtttatcgctacccccgataaaatctcctatcggccaaacatttcgggttttttttgaattttctggacatagcgtcaataactactacaaagttgctttgattaattcgttatgacctgtaggttttaatcaataggttttgtgttcgattcaagcaaagatatgaatttcttctctctctcttttttcacttccatttgcttgcgttgtgtgtgctataaaaatgttgatattatctcatttataaagtatatattaattttttatacaaaatggtttggatataatctgtatgatttcctaacaacttttgttcaatttcttttcaaattttatccaaattttttttctatcaccgttagaattccgataaatctgataatcccatttatcgctacccttcgatattttttagctatcgataattaaaactaactgtggaaactactagctttttatttttttttaaaaaaggaaacaaactggccttttctaagatacaacaaataatttggttagccccacctaaccattatccacatcaccacccaaatagtccatcatggcacgcattaagcccatccacaaccaagatatcatgcatggtaactaggtttacaaccacgcaaggccttcttcgtttagtcaacaagagagggattagagggattgtgaaaaattaattccacatctcaataggtgtggaattattctcctccaaatcctcctcgatccccttgtgggtgggattaactgaacaaggtctaaatgatagccaatctaattagttgtagtcacagtcaaagacttagtgcaataggtgatgttgtcaagctaaatggtcttatgggcgagaggggatagatgcatagtactccatctatcctaaagtctttatccaatttcattttttgtatttttttttcaaatgagatatgcttatctgtagtcttcatacatctaaaacttaaataaaagggctgtcttttcattttacaatgctaaattaaatttttgatcgaaactagagcgaccatcttaatattcattggttgcatgcaaacatataatttcttgattttgttatatgagggatgaattaatccctccttaggttgtgttcttctctcaactttcccaacctcttctctcttgttttccgcgcacacttcccaaattgcatttttttcgaagattttctatagggaagtttgtcagggttacggataaggtataccctttatccttggatgtatgttgtatactgatacggtatacccgcgcgtatacgaatagtttccgtatacgttaaggaaatctatcacgtgatagagacggtatctacggatggaaggagttctactcggacaaaactgggtctttaccatatcgtgaggggtccgatatctccgagtcctacttggagatcaactgacccgcggtatataagggaccccctgggcaggacctaaggcatcaaatatcactgccaacacacccaccacagcctacggagctagagcgtgcaggagccaagtcgccgggagatatagtcggaccaactcgactgcggtcttatcggtatcatcgagttctgctattccctttgtaatctgtggtttccatcatataatgccataccaactggattagggctattacctaccaagggacctgaactagtataatccttgtcttttgtttgcttgatatcgtactacgtagatcctcataccaacggaccccaataccctctatatccggtctacgggtatcccccgtcgacaaagttgttttaaaaaaattatattaatctatttgtcaagatttttttaactaatacttcatcaattatgtgctaatattttgctttgttttccgtggtggtgtttggatccacggattaaactatcacatcggatgttttgacattaatttggagtattaaacataggctacttataaaactaattacataaatgagagctaattcacatgacaaattttttaagcctaattaatctataattagcacatctttatagcatcacataggctaataatagattaattaggctcaatagattcgtctcgcgaattagtccagggttatgaaatgggttttgttaatagtttacgtttaatagttctcattagtgtcaaacatccgatgtgacaggaatatttgggagacttcctcattgcaaggctgttaacagtcatatatttgagttgaattaatttagtcggtctgaaacgagcttaaagaacatacgagtatttttccctatgcaaaaaaccctttttaacctttgtatgtggctgtgtttttgaaatgtacacaacatgcaactttttgacaaaaggatttgctaatcaaatccttctctcccacacaacgcactccgaagtccaaggaagaattctccccatcaaagctgtaattgcaaagccagcaatctcacgctgtcacaaaatcagctaaacttgatgcctatcgcacaatgccaaacccaaaaaataaaaatatcaaattttggattgcctcgagcccctgcattttgtgcggatcaatgcatcggcctgtagtagctgtaggtgccgtagaaggtctgcgtcatggtgagcagcagcaacaagacaccggcgaccaccgagacgatcgcccatgggttgctgaagtagttgtgcttgaggctggcgatccaggtgctccacttgtggtcgtagtacctgttcacctggtccgagagccccgagaggtagctgtcgttgatgtcgaacaccacctcctggcacagccggttgaagaggtcggccacctcggcgtcgctgcccagccagtgctcgatgatgccgcggtcgtggaggtacttgacgtcgtcggcggagttgatgaggttgtccatgaagatggcgtaggaggtgatgttgttgccgcccggggtggcgatgtccatgtggcattgctcgaacgcgatcaggttgaggaagagggacttggtgccgtcgtggatgaggatgcgcgggatctggagcacgccgtcgtggaacctgatgtcccagaagcggtccgtgttccgccgccggcaccggatgccggcctcccggagctccgacacgcagtggacgaactgctgccgccgcttgtccgccacgcgccggagccccgaccacttcttgagccacagccgcgcggggggcggcggggtgggctgcagccccgcgcggaggaggctgcgccggaacacgtcgaggcaatggagcatcgggccggacagcgggtcgaactcgaacgccgccgccgccggtgaggcgccgatggaggactccagcttggaccggtccttgcggagcagcggctcgtcggtcggcatgagcgggtcgaagaagcgcacagcgaggccggcgacggcgccggtctgctccgggttgccgagctggaggccgagcaggaggtcgagcacgaacaggggtatctggttctcgagcaggatcatgtcgttgcggatggcgtgcatcgcgccgcgcatggcgaagatggggtcgtgccgcgagtaccccaggtcgtcgccgagaccccttcccgccgtcgtgcgcgccgcggaagagctccagcacgaaggtcccgtccagcaccaggcactcgacgagctcgttcccctgcatcccggcgacgcggccgtcgtagcaggcgcgcgcccgctcctccatcggccgcagcgcgtcgaggtaggcggtgacgtcgtgccccgtgcgcttcaggacgtggtgcagcgcgcgccacttgtgccgctccatctcccgcagccgccgccggccgcggtggagcgggccgatggacaccacctgcggcatgtacgcgcgctcgtcgccgtcgcggagcgacttgggcacgcggtacacggacagccgcgcccacgggcacgctgcctcctcggcgcgcgcctgcgccagcttcccgcggatggccaccacccattccgggtcctgcggcttcgggctgtgcgccggcgactgcacctggaccttcacctcccgctcccgctcctggcgcggcggcagcgcgtcgcctcccgctccggcggcctcgccgttggtgagcagcggcaggttgcggttcagcgcctgccacagcggcagcgcgccgggcggcggcgcggacttgttgaggttggcatcgacggtctccttgagcttgaccgtgatcaggtaccagctcaggacgtccttgttgaagacggcgaccatcgagatggaggctggcagtggcaggtgcagcggcttcgccggcggcgtggggctcgccgcagtagcgtctcgtggttgccaagatcagtggccccgggacagagagagcaagccaactcgagagggaggcgaggcaagcaatgtacctatgaatatcttagaacgataattttatcagctgatgatgattgatagtggaatttttgggattgcttgcttgttgtaaaatattgtgtggtctttgacaaaattaaataaagtttcctcttgcgatcatgtgcaattttcaacgatggacattgctgccagcctgcgatgtgcgctcatcagcaacttacgctgcattgcacgtactccattccgtcgaagactaattggcgactgcacgataatcccaccgctgtaatataaagaatatagatactttggatttgtaatataacgatgtattccatctaattaaaatattttatattttaagacggattgagtatttaactacgacacgtatgatcggtactccctccatttcataatataagactttccaacattgctcatatttatatagatgctaatggactagacacacatatatatatttagatttattaacatttatatgaatgtggttaatactagaaaggcttattatgaaatagaggaagtagttcgctaccctaacaatctcagagtttttcttttccggagaggatctagacatgtagttcgatccagtgcactgtaaccgcacacaagctaacatcgtagaagtacctaccacaagcgactgaccagcgatctgaaccagaagattactctacccgagcaaagcgccaaccagaagcccagaggcaaccgattctccttacgcttcgggaatcgtggaccagcgaaagctggcgaggcagtccggcacatggccgcatgcccgcatacatgtatccccttgattcccatagccgttgggttgcctctcggggatcggaagtgacgagctagtgcgacgccacgatgaacgcacatcctcactcacccagcgaaagccggaacacccagctgaagccttctgccggcatattgtcacgcgccccactggcgaaaaatcacgccgcccgtgctacgaaatgtacgcgtcgatgaagatggccgccaggtcaggtcaggtcacgtcaggcgggtgcggaagcggtgggccgatggtggcaggctgggcctgttggaggcagcctgcgggcaattaattggaaggcctgcagtagcagcatgggcgcgtatttagagcaagttcaatagtataacccgctacagacttcaaattaactataactaatttaatagcttatttatataatagttaattataaaaatatatattactcctattaatatccggtctcacatctcatacacacatacgtcttgaaattcatgctgcagctggctacaaatatatagcccgctttcttctctctcttctatttttttctcgatacgtggttataggtggcttatagcctgctattgtcgctgctcgtatgctccggggccgggggcaaaggtggataagctctttcggtgagacggtgacaattattgaagtaactgatcgtgattgtgatcccttcattgcatgatcaggcaatatttgagcagtagtaatttttgctgcacaatagattgggccttcaaacaggccgatgggcttcagtgcttcaccaagggaataagttcacttcgtgacccttaaaaagtgatcaaaatctaatccgtgaccctaaactacaaaaccggatatctcgacccccaaactcttaaaaccagtgcaatttgactccttcagcgtttttggagagcggtttcgctgacgtggcgcctacgtggcatcccagtcatcaaataaatttaaaaaattaagtggggcccacctgtcagtgactccctcctatattctctctttcttctcgttggcatcaaataaattaaaaaaaataagtggggcccacatgtcagtgactccctcctatattctctctttcttcttgttggcagcggcggcgggaggatgaggggagcggcggcggctggcggcaccggggcgcagcggaactaggggcggcggtcggcagcgtcggcatccggtggtggggacggcgttcggcagccgggggaaggagccgttgcccaatcgacaaagccatcggcttcctccgcctcatgccacttccactcgcttcctcccacggcggtggcatgatgcggtcgggagaggggtggtgagcggcgcaatgtcgccgcgggacggcgctagacgccgcagccttcgctttggcgccccgacgcggacggccaagccgccgctcctccttaggccggtgccgcttccattcgcctcctcccacaacggcggcgggatacggtcgaggaacggggtggggagtggcgcgagggacggcgctggccaaaggagttgctgccgggggacgcaacggcgaccaccacgacgtcgccgtcctcgcctttcgacccgaccgccgcgctgccggggagcggctcctggtgttctttgcggcgtccaggtcgcgcacccgcttcttttgctgcagcctccccttgccgcccagcgcagctccagcgctcgccacctgccgccggcagaagggggagaatggatgagaaagggagagaaagagagagaaaagggagagaagaagggatttatgtggagaatagaaatggaatccatggcggcggctccggcttgctcccacccgccgccatccatggcgaccgccggtgccggaaaggagaatagaaaggggaagaagaagggggagagagagagaaggaagggaggaggaagaaggaaggtcagagggaggactgacatgtgggccccacatgtcagtaggcccacatttctttatgtgtgaatgactaatgggtcccacgcacatttttttatttctaatgccacctaagtgccacgtcaacgccacgtggaaagaagaccgagtcaatactgctacgtaggcgccacatcagcgaaaccgccctccaaaaccgcccagggagtcaaattgcatcggttttacgagtttgggggttaagatattcggttttgtggtttagggttacgaattagatttcgatcacttttgagggtcatgaagtgaacttattccctgagctaatgacagaagggatgggcctcttgagttatgtatgaagaggcatcatctcaggcattggtatcaatgcactgcatcaactttccttctctttttcagaatccgagggagcgatgcctatccagattttgtttggatgggaaataggaggctatccagatttgtaatattagaatatgtttgtttcaaccaaaataagggagtactaagtacatggacatcatactacttctttgttcatcctcaaataaaatgttgctacctagtatctgattggagtacttcctagtacaaagaatctgaacagggagtatctaatcaagtactaggtatagtaacattttaggacagatgaagcaaatgatgagcagcagtgcaggtgatgaagtggtcaagagactatccttctcattgcactagatgtcgtagcatgccacgcctctcataccgctacggaacatgacgatggggggcatcgccgcgcaactagaacactctgggactctgagtaaacatatttaagtataaataacaggacctcacgaggaagaaaaatacatcatataaaggtagatactatatagaaaatatgtatcagattaaatagtatgtgcatataacaaacaaaatatttgtcccgttaaatggtgcactcttgtgaggaaaaaagatacatcatatcaaatgctacatccatatcaggaacataatatctatcatattaaatggtgcaaccttatatagaggaagatatgtctatcagttaaagctaaaaactttattttatcaatattgtagtatgcccccaatttgcaatataagttgtaaaagtttgaaatacctagaacatgttcacaaaacacgacaattattttggagcatttaatgttcacatggtatatctatcaatgatatttcgcagaagaaatgtttaaggttaatggatagattcctcctatccccttacattttactttctctttggaactctatccaagagcactgaagctccaaagagcgtagccacaaagagagataggagtcgtctatctgttacccttaaacatttcttttgagaaatatcattgagagatatatagtgtaaacataaaggcttcaaaatagctgttgtgttgtttgaacacgtacgagtattccaaacatttacagcttatgttgccaactagtgggatactacaatgctaacaaaatgaacttctaaaagctttaattgatgtacatatctttccctgtacaaggttgtgtcatttaatatgttagatattttgttccttgcatagacatagcatttaatatgtacatctttttttcttccttataaaggtggaccaattaatgtgacagatattttgtttctataccttttaatatgatacatattttcttccttatatggacgggcctatatgaaatacattttagaatgaaagagtagtaattatcccatcaatcaactctcatttaaatttcttcatatctcataccccagtcatccttgaaccttatccacctctcatttaatgttgtgtgccaaagtgttttgttttttcccttattctctataattattttataaatgattattgtagtcggagggggtatattctaggataaaatttgaactctaaaaaagagatattccctctgtcccagaatatgaggattatatttttaacctaagttaaactattttaagtttgactaagttttaaactacacccgtctcaaaatataacagaattttcccatataattacatgagccaaatcacttattctttgaaatgggtatagcacagaagaatattaacatctaccacacaatctaccacataaaaacagtaaattataatgatatattttataatgggtctaatgatgctcatttgatattgtaaatattattttgttttcataaacttagttaaacatagtttgacttacaacaaacataaggtcctttgagacagagggagtatatgatatagtagtaccgaatgtaagagcatctccacgagtcccctaaacatattctgtaaatttaaattttgggaattaagttaaaacacatgtctccaacaaatacccaaaagagctcccaaattttaaacacctctaataccggcgccatcctgagctagatatggggcacctcatagaactcccaatccccggccacaatcacgccaattttttgccgctggcatcattttttggcaatcgtgcgcgatcaacctcgcaatgatgtacaggagaaatataatcggccaaaaatagttgaggagggcccactagcgatgagataatatatttcaatgttttgaaacctaagcactgactctgttggagaagtgggtgattttcttcttgcatatttttgagatgaccataatccaagattatcgggagtacaattttaagccattggcctaatctatacacacttatcacagttaacaagtataatccaaaattagcaggagtttaattttg

SEQ ID NO: 54727 - DNA, 5632 bp, Oryza sativa
ttgtgtcccaactttccccacataaaatttcccgtcaaaactttacctacataacccttccttgtataaactttctatcgagaaactttcattgtataaactacttcccgaaaatattacccatataaacttttttcccaaaaacttgcccgtataaactttcgcccaaaaactttccacatataaactttctccacataaactatttccatataattttccatatagaaacttttatagagaggagattacaaataaatgaaaaaattatttcaaaatcatatgaaattttaatcaaatctcaaaaagtatatactcaaattcaaagaccttgaaatgaatctttcaataaaataacttctcaaaaccctgaacttaaccatggcatggagctcaccggggtgcagtggattttttgctggagagaaacagatttcgtgcacacaacaccttgccagagggaggaaaaagcacgtcgtcgttgacaaccacagctgcgacagggccacctcgcccttcgcttcatctgtgatgacgacctcatcactgtgcgctccgtccatctcgccaaggtgagaagagaggggaggggggaacagggctcttaccgaagaggtgaggaggaatagggagtatgcacacaacttgatttgtcgcgatagtggtggaggaagtgtgagaggaactcaagcagggaggaaaaaattatgtgatagaacagatctacttcctccgtccttaaaaagagtcgattcctagatccccaatgcaaattttgtataaacgtgaaaagacaaaagtgccctcattaactatatccatttatcaactatgccgtttctatgcacatgtatgtaagagacatcttatgcataataaacaacgccaaaaaaatttaaaaaaattcacttgctggaagaaaagaaaacatctacgatctctccaatctgaggggaaaaatgctcttaattccccctgtaagaactactactgcaaacaacggcaaaaaccaagaataaagaaaaaagaaagacaaaaaagaatagagaaaaaaatacaatggtatttgcctttaccactgtaggcttgtgcatcgagagtcaggattagatcccctgtaaatgaaaagcatacaaaacgcaagagaagagagatggggcggagataagatttgtggtgttaaagcgtgaatgatagggagagaggccagagtcattgaatgcttctattttttaagcattctaagtcggttttttataggacaaactctccctcgtacattcgtggtgaacgttcccccacccccacacaccccccgttttcacaaaccgatgcctaacatgcttgcgtgcaaacatcgatagtgcgaagtttttgaatttgaaatgaagagctggaattcatgagcagaagtatcaagatttcgctgtacgaaaatataaatgcagagacgctcagggggtgctaaacaacaaaaactgaacgaatgcacgcatccccacgctgggctcactcttcccctgtttccgtgccaaagatgagcatccgaagcaaaagagcgtagcgcaagaggaaaggagtagacaaaaaccgacaagcttcacgtttcggattaatggcaccgaggcattttcccagcacccaggcgttcgactgacgccgacggggccaacggcatttacgcctagcaacaagcacacacagtgcttgtttaccctacagtggcattgtggcaagcggccagccgaagccatgttcatgataagggagggagttcctgtcgacaaattcgcacggcagaaacaacagacgtttttcagtttttcacatgcatattctgtagattgtagatttccttctggttaagcaaggtttgcaattgctcccgtagccagctgaatacgagaatgtttggggagcttctgggagagagagcataaaagctttatcaaacagttttatccgttcagaagttatttagaagttaggggaagttaaggccggaaaggctgatcgcgatcgatcgccaaggccaactggtagcaatcagtgcccccctccctccacctggttttatttttttggcaccgcattactttcatattttagtaaatttatgcacataaagtttatacatctcgagtttacacatctaaagtttagagactaaaagtttataagtcaaaagtttatatatccgattcaaatttgaatttgaattcaaatatttttttatatatagtatttctagacctaaagtttataagtcaaaagtttatatacccgtttcaaatttgaatttgaattatatctgatttaaatttgaatttgaattcaaatattttctatatatagtatttctatatatctaaagtttatacacctaaagtttacagatccaaagtttataagtcaaaagtttacatacccgatttaaatttgaatttgaattcaaattttttatatataatatttatttacataaatttttctaacttttgttttttaaaaacaattttgtggtgttctgtagtagggaagagaaggagaggaggggggagaagagggacgtataggggagggggtcagcgatcacccgcttcatacgattaattatttttggaggaatactatccaaaaaaaattccctttcctttggtgctggtttcacaggaaaagtccaggaaaaaatcatccatcacaagctctttttttgcttcctacatgcaagtcctagacagtcaacttactgtgatccgcatgccctcaacttttgtactcctttgtttttcattattctgttttacgcttaaattccttctctattcctatacttttcagatcctatggttttcctatcctttaatccaaacgagcccttatatttacgaactctagaaaataaactagaagctagaaacaagtttttttcttcttctagattgtttctcaagactcatactctcccaaactcaattgtactgcttggagcctttggatgcctactttcattaccatccagtacccagttacccacagaagaaaggcaaagaaaatttccagccccccatgacgaagcatcgaagaggacatcattgactaccaagggaattcgttgcttttccagctcagaaagtgccctttaaaaccaatcgtgtctaacacatccacggtatcagaattaatcgacaacaaaatggcaattttcccaaggactaaataaaagtacagcaaaggtctcattattaagaggtgaaacttagggcatgttcactttgatgccaaaaaaaaaccttaccaaattttggcattaccatgacaggatttcttatatagttaccaaaatttggcagcaaactaaatgtagccacttttttttgataactttaccaaaatttggtaaggttgaaaatggcatcaaagtgaacatgcccttattttacccagatgccatactaacttccatcttcatacctactattcgctacgcagttgcaaccgagttgcttgcacataaacattagactatcgttaggatacctcgctactatttgatattctgattgaactcattcaattaacactctcaaggatgtactaacagagggcatcaaattggggagaactacaaatacaagaaggcataccatacataacatgaaatcttccactatcagcatatcagtatcacctactgcctttaactaaacttcaaagcaacaactagcatatcactatccaacatctctataattaacgacaaaaaatggcacttggcataacatatgcattatcttcattgtttacagaataccatttcaatagcacactacatgtataacaagctagataaatggaagaagaatcttaaaagagaacacaagttcaattatgcatgtttggttctaaaacctaatgcagaatcggagactgcagtgcaaagagcaaccaattatatataccatgttgtaggctgccctatacagctaattattccaatgtgctcgacagcgatggcagctatttttagtactgaggtagttaagcttgcaggccagatttctacaactcgaagcaaccaaagaaataaatttgtatagatgcatcctaatcatcaacaaaaagctaaaccaaacccttttttttaatcagagaaagggcaacaactgctgatgaaatagcaatggtaacacagaattatccatcatgatgattttgcgagaactagatagtaaaattaataacctaaggaacatgaatatgagattagaatgcataaagtagcaaataggttcatcaattttttttatctcacatcacagagctggaggattgccaaacctcctcctgagtgctgacatgacgctcctcatcctactacttgcctgggcagatgattgtgcattgctggcgttagtcgggagatccatggctgccatctgatcagtaagctctgtaatttgcacctgtccagcctcttgcccgccattttcaattgcacctccagcatcacgctccaatacaatatccaagctgatagagaatgagccacccctaaccaccttcaggttctcaatacattcatacgatacgccccggcatctcttcaatttcaccttgaccaagctggggcagcccccattcagtgcccacatcccacggtctgagactgggcaacccttgatgcaaagcttcttgagcgcagcgcagcgctcagccaggcaaatgatctcaggatccccaacggtctcacacccacaaagggcaagacgctccagtgagcggcaatgttcaccaagcatacggagactctgcacggtagggttgaccccaatcaagacgagctcttgcaggtctggacatcctcgtgcaacagccatgaggccatgatccccaatcctgtttgtgcgccacccatcaatatgtagcttgcgcagtttgtgacatttctcggcaacgctgattatgcctgcatcagtacactctggggtcttgacaagaaacaggacttcaaggtttgcacatgccgatacagcggagaggccgcggtcacccacctgcagcttctcaaggtggagctcaacaaggccaggtacacgcgcggcgatgacctccaatgggaggtcccaggagccagagcacctcaagatcttgagcgaccggaggttcggcgacgaggcaaccaacggcacgaagcagagggcgctgtacaggtctttcaggcagactgaccgcagcgacgaggcgggcgggaagaggatctcctcggtgatggcggtggtggcgccggcggtgtcagggaggccgcgaaggcgcttgacggagaggtcctcgaggagggggcacgaccggaggacggcgacgaaggccttgggcccaaaactgcaggacgcgacggagagcttgcggatcaccggcgtggcgccagcgagcgacgcgagcccgtcgtcggagagctgccggaggccgcggagcttgagcctggcgagccgcgcggacggcagcgcggcggccacctggcgcgccccgtcgtcggagaggctgtccgtcccggagccccgggcgcagcggagcgcgagcttgctcaccgccgtgaaccgcgcgaagatcccctgcgcggcgtacccgagcg

SEQ ID NO: 54728 - DNA, 10393 bp, Oryza sativa
  unsure (1)..(10393): unsure at all n locations
ccgccggcggtgggcggcgcgtcccccgccaccaccagcatcgtccgctgcgccctgggcggcgccatgggaggaggaggaggaggaggaggaggggagggtgaggcggaggaggtggaagaggaagaggaggagctggatttggcgaggcggggagtcgagggggattggcccatgctacgctatccccggggccgcgatgggtggggaggcgcaagccatccgggtggtggacgggatgcgcggccggatctgccgatccggtttgcggggggcaagcgaggcgacgacgcctcgtctaatcgaccaccgggagaggaggacgaggaggagatggggaaagtagccgagtttagtacaccgatgcgtcgaattgatggtgagcccgtgagagcgtttcgattttctttttcctctcttctctcgttctaatctcaggtggttgggcgaggttgcggacggtgtgtgcgtcgtcacagccgagccgcctcgcggagagggcagcaccgcagcagcgtgccagcgtctcgtctctcgtggactcggtcattcgctggcgtgtggccaaggcaaagggcgtgagcgctgctgcctcggatgcgcgcagcgggtgggggcgcaaaacttgtgtgcgtattgaccgtgtttttttttttaactgaggcgggatatttctgggcttctggcgagcggcggagccagcggccagtgtatgaacctgtgggagcaacaccgtttctgaccggtttactatactaggaatttgtttggtgtcacgcgaagtacgactatattaaggtctgtttataaaacccttatcaaattttggcatgtcaaaattttaatatagctgtcaaaattttgttaattaaatatagccactttttttttataactttaccaaaacttaataagattaaaaatagcatcaaagtaaacagtctcttaatctgaagttgttgcgggggagggatcctctctttactctcttttagtacgtgcttgacctaatcctaaacaaaagaaacgggcccgatcaggtcaggtctacctcaacctcaaccggacaattgccgtgtggttgcccaaaatgggtggtctatcgcgtgacgtgccgaattacatcgtgttttgtattcggtgcaggtgtcgatttcgcgtggagagacccacaaagagctgacgaagagaaacgaaaacttgcagcaaccattgttttgttggggagaagaaaaaacccaaccaaacaaacgcattgatgacgtccacccaaaaaccacaaaaaaacgtacggctctagctacagtagcgtaatgctcgcacattgaaacagtaataatcccttgctgttgctgaagactgtgtacatcgtacatccagcatgcgtctacgctactgctcagctgtaccgacgcggatggcagttgcatccccattatttgccgggaccggtgcgcaccgggtcggaatccacgtcggtcagcgcctcagcgggcgcggcggcaacaaacagcgcgaacgctccacgacgcccgcctttgctggagaagagggaaattcggagcagtttgttgccggtgagcctgcagaattcgcgcgcgcgtacactatttctgcagcttgcggctgaattttaacagggacatcgcatcgtgatcaccacgatatccacatccactgttccgttctatagcatcgttccgtgcaactacttgaggttgatgttttcagaatcttcagacaagcaccacaagcctgcatcagcctttcggtccatttttacagactacacaagttaaagaagttgcccggaaacattagcttcggtccagaaattcagtccatgcaatggtgtagtctttatcttgctttacagctcaggcatacacacaggtgtatgtacgcagaagcgtagtaatcagtggagtcaaatctagctaggaagatttcgctttgcagttaactacgctctctttctgctaagtggtgcagctttgctgaaaagacgagcttcccatacgtagtggggcgcactactgcagaacaacaagaagaagagaaatggcgcaggacgatgtgaaatgatgaagtgattatcataatcatgtaagacaaggatgttgcttgttaaatactcgtggcctgctctgaaaagaggaggattctggataagaaaaggagcagccattggttgctttcagcacaatactcagcttatcctgtcaaagaacaaccaacactcgagtaatcattcaccattaactttcagtgaatcctacctacaagctttctgaatcgcctttagcggctctgcactcattagctaaaattgcaaaattactggaataaagaccaaagcagttcatgttcatgttcatcctgcctcatgagtcatgaataaagttacttcgttctacttttattgtcagatttccatttgatgagtaatgagccttcagatgcaaaattgccgagctggagccctggaaggtggcgcgtctgtatcaaggagccaattttgtctcttttttggagtgggatacatcaagaactactttttatacaacttcttttgtgcaattgattgatcgatcaacagtaatacagaggagatagtaagatacagtggtttctgtaagtctattataatctcatccccatttcgtcttgtctgttgggacatgggactgtatcacagtacagtcatgacaatcgcaccgccgtgaactaactgcctttcgacatgctaattatcagttcgcaactgtattattgtaattattgctgcagtctgccgaaacatttcactcaaagaatcgagattccgaaggaacccggttcttttctttcttcagccgaggtggtcaggtgggtgtgttagctatacctggtttccaactggaaccatccacacgaaaaacggagcggtccattagcgcgtgattaattaaatactctattagctatttttttctcaaaaatggattaatttgattttataaagcaacttttgtatataaaatttttgcaaaaaaacgcaccgtttagcggtttgaaaagcgtgcgcgcggaaaacaaaggagatgggttaggaaaaggggcatccgaacacaagtatagccaactactagctctaattcatctatagccaatctaatagcttattcacataatagtacctataagcatatactacaccattaatatatggtcccacctctcatatacacacaacgtattggagtccacgcggtagctggttacaaatctgtattccgctttccttctatattttcttctctcctccacatgtgcttacagctaacttgtagtctgctattgtactcgctctaagggtgtgatgatgtcacggaaactgaggattcgttgggtttaaccgtttagagcaagtataatagtgagctataagcttactgtaaacttatgtggaggagagaggtaacaaaaaatcaaggggtggctctcatgtaagagctagcttaacacaatatctaagacaaatacattaaatgtataagtgagagatagcgagaggagaagaaaattatagccaaacttatagctaattttattatatatgttggcttaaaatgagttaatagtagaagttgagttatactattgtccttgctcttaagcgtcgacggaaggttgatcgattggtgggaatttgggtggtcaatcaccgcatcccatgagatcgttctccaactgatcgaatcgcaaggagttaccggtacttctcgcatagctatttgctgctacgcagtctgcaaagtaacagcaaaatcttcacgggaacaatgaccgaggataaaaggaagtgggctttctgggatggaaacaaaggtttcattccaggatagtacggtataactctggatttcaggattggttttataattctgacttccagtgttgaccttttttcttcagaacgattggtttccatttagatgaacaaggcttcacgtacgattcatccagtgttaggaagggcctgcgaattcggcatgttttctacagttaagatgggctgccaaagtccaacaaccttaaggctcactgggatcagctaattacagtaattgctctaactgtttaattaaacctaacatgtttgaacagtgatattcatgaaacttatttagtagtaaaaaaatatagtacttcatccactcaaaatataacaacttttaatctttaaaatttgtatcaagtataactacatattcatccacattctatttttaactgatcacaacaccattcaaatttccacatacctcatctttctaatcaatcacaacattcttctatttaattctaccaacttacttagcaatcgtgtataattttaaaacttcttatgttttttggacgaagataatactccccgttataaaatctgagctaatataccacgggatcccgtctaaatgggatgataccgatcaagtatcagattgatctgatacccgtaggtaccagtcaccaacctatacctcgttagtattagctaatgcctgctgggaccacgtacctggtcgatacccgatggtactaggcgtggtacctatcagtactagacctggtacctattgagtatcagaccagagcttagaggggaagagaataagggatgaagatggttatatgtgttggttctctcacctggagatgatgacgccaagctcgatcaatgccaaatccaatagccgaggatcttggggtttcaaatttgtcgaacatgagcaacaagaaggacacttcctcccctatcctcccttgcacttggcggcaatggtggtcggtggtggtcttactcgacaacaatggcatcgacactgcctcatcctctatcaacggtgatggaggcggaagctccatgtcttccatcaatgcaatgatggcgcttcccatctccttcggctacgacttcctttgtcctcgcagcgtaagtccacctaattttattgtggtcctacggcacaccctagccgatatgggactgttttagtgcttacctgcatcttgccctccgacttgttgctccgcgttgatccttcttccccgccgtgtcggtccaagtcttctccgctgggcataggtgccggagaggggatctcgccccggatggtagggattgggtgacggtatcttgtattttctaacatgggttatttttctttagtgacaattttgttctttcccctactctaacaccacaaaatcttccccttgagttgtgattcttactatgaacatactacgtccaaaccgagataaatatacacgtctaacagaatatctaaaccgagagaaatcagaaattagaaagagaattcacatcaacattgacacgggtggttttcgcgctgcaccaatcacgaagcacccaagcacgaatctcggagcgccgatgcctcaacgcatctgagaaaccgttccaagctcgccgccgacgacccggccggaccctcccacgccgccgccatcgcgcgcgcgatctcccccgccttcctcctcatcgcctcgcccttctccgtctcccccatcaccgcccccacggcctcggccacctccccactctccaccgccgagctctccaggttcccgcgcgccacctccacgcacaccccccactccaccaccaccatcgcgttgaagaactgctcggcccccaccggccacccgagcagcggcacgccgtggcggaggctctcgaggatggagttccacccgcagtgggtcaggaacgcgcccgtggacgggtgcgccaggatccgcgcctgcggcgcccacccgcgcaccaccagccccctgcctgcgcgcgccatccggtcctcgaatccggcggggagccacccgggatcgaatccgtccttggggtcgaaccccaccggcggccggacggcccagacgaacggccgcccgctcgcctccagccccagcgccagctccgccatctgacggatgctgatgctgttctgcgacccgaacgagatgtacagcaccgagcgccgcgggtgcgcgtccagccaccggatgatgctggtgtcgtcgtcgtcctgcgatttcgaaggatccggcgccgcgaggatcggcccgatcgcccatgtctggacgccgaagctcgctctgagcatgtctagcccggaggtctccagttcctggatggtgttgacgagcacggcgtcggtcttgcggcagcacgggatgacccgccggaagaaggccgtccaggggtccgcccccgtcgcggcgagcatgtactgcgggatctgggtgcggtggaggacgacgtcggggaagtcgggcagcagcgggaactcgtcgccgccggccgtgagggtgtgcgggaggtgctcccacacggagaagaagacggcgtggccgaaggcgcctccggggaggaacacggcgtgggacgcgccccgcgcgcgcgcgacgtcggccgtccacgcgaagaaggagtcggcgatgacgcagacggggggccggatgccagcgacgaagccatcgaaggccgggcggagggactcggaggcccggaagagggtgatgaactggtggacgtggaggtcggcgagggactcggcgccgtcgggcagaccgtggtcggcgggcgcgaaggggagcgcgtggagccggatcggaggggaggtggccgggagggagagggagccgaggaggcgtggggtggagacgagcgtgacggcgaggcccgggcggagcgtctggaggtggccggcgaggcggaggaaggccgggatgtggccgtgcgcgaggaaggggaagagcacgacgtgcgggctcctcgcctcctctccctctgccgccatggtgaggtgatgatggggacggggtgttcggtacttcggtggaagtggacgctgagagtgatgcggctcccgcgctgccactgaaaaacaaaacgctgatgcgctgaatggctggaaaggcgccctccactcaccgggtgagataccgagatgtgaccgcttcctttctccaattcttcaatttcgtccaactgaactgtgcactgacgccatgatcaaacaggtccaggtttgagcagcagagcttcatcagattatcaaaaggagtacagaaagacgaagggatggcacattggtaccgatcgatgcaatgtctgcagttctccactgcattctgctggtactcctatatgtactctggcccccggtagtactaataccacatgagtaacatcagtgattatatgattattatcaaaggcgaactttaggaagggatggagatactagctgaattgcttgaagcagaaccgtagatggagataatcagagctttccaaacgggaacactattaacaggtatttggtctatcgactattatttacaacaactgggcaatgaactcgaagaaggaactagaaaaacccacatcaaagtcagataaaaaaactctagaagtaagaactgccatcccgcccatgaagaactctgcggctctaccggtaattcttcgttgttctgaaggatatgctgagagacactggatgtacagaatggcatttgtatgagtcagttttatttatctccctagaaatatgacataaagaatgaatgcaaactcccaaaaaattcctacataagtaaacagagagagggagcaaaagggcattgccctgactagaacatatataaatacatcataagttatccttctttgaagaatgatcagaagcaggcgaggatgaagagctcatcctggccctatctctagactcacttaacataactacaacattccgcatcggtggtctgtcatatggagacatactagtacatagcaatgcaattttcaagacctcaatcatatgatcgacagacgttttgtcttccaaattcagattcttatcaagaatccctggacccaaagaattgtccctgatgtaattctttacccatgttaccagatcacctcccagttctaatggttgtacaggggcacgtccggttagcagctccagcagtacgacgccgtaactgtatatgtcacttttttcagtaaccttcatggtgtatgcatattctgatcaaaggagaactaggttagtactttgtaggaaacaatcacatgtactttctgctagtataaagcaatcaagtggtatagtagcctaggattttacaagcaatttcaagtaaaagagataagagctataacaggaataagtatgcaaagtaacagtagaagactcaccaggtgctatatatccatatgaaccagcaattgcagacattgattttgagtatggcatgtctatcacctttgccaatccaaagtcaccaacatgagcttcaaagttctcatcaagtaaaatgttatttgattttatatcacggtggatgatgcgaggtttgcaatcgtgatgcaagtaagatagcccttcagctgatcctagggctatcatgaagcgtgtctcccaatcaagtgaagacgaagattgcccatgaagtaactccccaaggcttcctcttggcatgtattcatacaacagaaggttggaaccctggtgatagatgaacccatataacttcacaatattacgatgccttatctttcctagagtaaggatctctgcacgaaaactattgtctgtgttgcttccctctctgttagaagccagcttctttacagcaattgtctgtccagctttcaagatggctctgtacactgttccacatgcacctcttccaataacacaactctcgtcaaaattatttgtggcagaaaccaattcctgaaatgtatatgcatccttggtagaaacctgcatgttagacccagcagaaaatatttgcttgtcttgcaaaggagctactgtttctagtggttttctcatatgatacacaattataacgataagaataagtgaaattcctccaataacagcagcaacaattgctatgaccttgcccaaaggggggctgcctgaattggatgactgggaagaagatattgactcagacccacatttgccaagttgtccgccacatagtcctttgtttccaagaaagctggttgacgccatgttatcaaaaagtggtatagtggggagagcgccggtgagattattgtaggagacattgaactcaagcaaactagacagatttgcaaaggtatctgggatttcacctgtcagcttgttattattgagaaacaaattttccaataatgcaagattaccaagctctgatggtatgttgccagagagattgttataactcaaattcatggcgatctgcaaacttgagagtagtccaagctccttcggtattccaccagagaattgattgccaccaatctgtagagctgtcaaatgtgaaagtttaccaagaataggtggtatctctccagagagcctattgtcagcaaatgatagcagctccagctgaggcaggctgccaacttcatttggcaatgaaccttcgaagctattttggctgagatctaggcgttgcaacatagtgcaattgaaaatttctaatggtatgcttccgcctagtctattggatgatatattgaagacgacgagctttgacagattacctatttcttgaggcaactctgatgtgaaatagttatttgttaggtcaagcctttggagagacttgcaattgcctatctgaggaggaataggaccattgaacttgtttcgacccagctcaattgttgtcaaattcaccagattgcagagatcagttgggaagcttcctgtcagactgttatcagcgagacgaagctgcaccaaggatttacaactggtgattccatgggggatgttcccaatcagcttgttagcccccaaattcaacaaaataaggttcgactgcctgcaaagatctcgaggtatctgcccggttatattattatttgagaaatccaccacccaaagccggctatagataccaaatcttggaggtatgtcacctgacagcatattgttgaatagttgcaattggattagtctgctcatgtactgaaaacaggctggaattgggccactgagtgtattgatcgaaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54729 - DNA, 782 bp, Oryza sativa
acgcgaaccgacgtggcaggaggagggcgctagccatgctggcgccgccccagggaggagggcgccagcatggctggcgccgccgcctccattcctgtttctctgtatggagttacaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcttttagtaaaaccctttgatcagcatgttaaacataatgcactctaccactatatgaaattacttaatctaattcaaaatataaccacatgaaatgacatatataagttaaacagtacatagagatgcaatttttttatttttattttatttttttgatatttttttcacacttaggagaacataggaaccaaccgtataaaaaataaactcaaacggacaaaatatatgacatgtagaattttccaaaactctaccgaaatggacaaaatatgtcatctattaaaataggcataactttctcatacggactcggaatcaggcaaataatatatgcacggacatctacagaaaaagttacatccgattctccctcgcttcgccgggttcggcgatattaaaacctccaaattctgcttgcaagattgtgttttcgaggagagaaatttttcggtagagctttggaaaattccacatgccacatatttcatccgtttg

SEQ ID NO: 54730 - DNA, 2886 bp, Oryza sativa
gatacaatgatacatgctgcctcgttaaaaactttgtcatgtaaaaactcataggggaaaatgagaaaaccatgacaaagaaaagagtacagctcaaaggtcagaactacttctaaaaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgttacatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggcaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgctgcccgccctgtcagtgcgccgctcgggccgccggcgtgtcgtgccgcgggccgtgccgtgctggcccgctacagtagccgtgccgtgccgtgccggcccgcgggctctgccagcggcccacgcacgggacggatactcgggccgtgccggc

SEQ ID NO: 54731 - DNA, 4300 bp, Oryza sativa
cggctactcggcccgtcccggcacggcccgttactgtagcaggccgtgccgggccgtgcctgctacaggttcggccgtgccccgggcggcccgtttggcccggcccatttggccacctctacacaactctactaactactacaaatgaacacagccatagtttgccaaaaagaatcacatcatagctaaataaatgttttatgtaatatatatcgagagaaaaaggaaatagggagaactccaattgccccgagagtggtgatctcacttaataggaatagccctatgtcaatatggtataagtgaactcaggataattttaaaccaaaacaaatacttatagaacctacgtggataaaataaaactgaaacgactaaattgaacttttggtgaaacttaaggaattagatctattcaccctaaaaaatcagctaaagaaatattttacgaaataatatatcaaacaataataataataataataataataataataataataatgaagaaaaaataaatatagggaggagaagtccaatccccaagagagcggcgaagaaagaagaaagagaaacacgggtgcacgcgctttcgcacccttcctttttaaaacgccactcccggccaacccggcctctccccatcctctccgtctcctctcctcccttccaccacgacgcgaccgacgcggcggagaaacccgcgaagccgcagtccagccagcgaggggccgccagccgaagctgaagcgagagctagggtttgctccaccccttgaacccgcccgcgcccccgccgccacgaggccgatcgaggtgcgtgccaccgtaatctccgcgcgtgtttgtcgtggggttgggttgggttgggtggggtggggtttggtgtggatcagggaatgcgggatctggtggggtttcgtgcctcgctcgctcggggatttcatttggtggggtggtggtgatcccatcctcccccactggattttgatggatgcgacccccttccgctgaaatcggagggattttggttgccatgcgctgctccttctgtccgtacggttcggtgaatcgggagttgtagattggtggtgatgatgacccagtagttggttctgatgctcaatactcgctgcgatttcgctcccctttatccaagggaagggaagggagaggggcttcctttgcgttcaaatttagcaaagtaggaattgtgtgagattggtggtagcgctcacttttttcagctctagatcgttagttctgcataccatgaagattcttgtatcaggagaagattattatatttattctgtggagaacgatatcagagatgatttgtgggggtgatttttggctgatttctgctctgcagggttctgcttctgaggctgtcaagcctggcggctaattgggatggaccttgtgggatcgctgctggtgaacatgactcacttggttgacacctcggggctccagttcttcggctggctcatcaccgccggctccttcggcctcgccgcgctcatctacgccctcctcaggctgcagagggcggcgtcgctgtactggatcaaggcggctgccagggagaagaaggcggcgtggaagtcgttgcggtgccccagctccggccacacctggaccgaggactacttccgcggcggccagccttcgacgtgctgcgtgtgcctgtcgtccctgaccacagctcagggtgtgggctctcggggtgccgatgccgttgtggtccaccgctgctcggtgtgtggggtggcggcccattctggctgctctcgtggcgccgagaaggactgcaagtgtgtttcacagcatggtgcttccaccttgcttcatcactggtcggagaggtgggtggagctggatgacaacccagagatgtcctctttctgttactactgcgatgagccatgtggtgtgccatttctcggcgtctctccaatatggcgctgcctgtggtgccagcggcagatccatgttgattgtcatgcaaagctgttaaaggagacggggaatacttgtgatctaggccttctcaggaggctcattgttcctcctctgtctgtgaaagaagttgcccaaggaccagcaattactggaatgctcaactcgatcaaggaaggtcttgtcacttcatcagttaggggcaggattaagaggcgaggcaacaagaaacgcatgaacaaccatcctggtggtaagacaagtccagtccccacaaacagctctatccttgattctgtgcttgaagggtttgctagactgcagaacttgaatggaaagtatgcgctggcaaaccataagtctagtggggattctgtcaagcaaacacatggatatgacagccctaatggagggaagaaaaagtatgaaatcattgatttgccacaagattcaaggccactgcttgttttcattaacggcaagagtggaggacgaaatggaccttctcttagaagaaggcttaacatgttgctaaatcctatccaggtaattttccttaattctttacttacgaaaatggtagcagctcattcttatcaactgctgagtcaattaaactgcttgctagtttctctagctttatatgcatgatacatctgctgaaaattgtagccagcagttttccttggttcattctacgatacttgctaattaataggcattttatacctatgtaggttctagattgatctatttgtcttttgatgttgccctcagagtgaagttgtactatttttgtcatttgcacactttattccgccaaccaaaatagtcactgagatctgacatcatcaaatgtttagttaatctactgttaactttagtattagccgtggttgattgtgacatatttgatactctattcttaacctggaaaatctcattcttgtttcagatatttgagcttagtgcttctcagggacctgaagttggattgcaatttttccacaatgtaaaacacttcagaatccttgtttgtggtggggatgggactgttgcatgggttcttgatgctattgaaaagcagaactatgaatctcctcctcctgtttccattcttccattaggaacaggaaatgacctatctcgtgttatgcgctggggtgggggtctgtcttctgttgaaggacaagggggaatatgtgcacttctaaatgatgttgaccacgcagcagttaccgtgcttgatcgctggaatgttgccatcaaagagaagaatggagcagaagatcaatgtaccaagcaagttaaatttatgactaattatataggtacgatgcatctctcaacttccatcatcttactcgatattatgatatatatctcacttcaaccagaagttgctgaatatgttattttatcatgtttggcctgtaggtgttggatgtgatgccaaggttgcatatgacttccacactacgagagaggaaaaaccagataaattttgcagccaggtagggattgatttctacatatatttttctgcaaaatgatgtttctccatttggaacaagcaaaatccctgtagaaattgaaccttttatggaaacccctgaaatattgacctcccttagcatttgatcttatgctacctcctcttctatcacttttactagtcaaaataataataataattcaattttctactgagcagtttgtcaacaagctgatatatgctagagaaggcgctaaggatatcatggataggtcatgttctgatttaccatggcatgttagtcttgaagttgatggaaagaacgtcgaaattccagaggtaacatgctacgcatcttttatgtacctccacagtccacactctgatttatcatcggatgagcttcttatatatatgctatttctcatcaggacgcagaaggtgtgattgttctgaacattcctagctacatgggcggtgttgatctttggcaaaacgacaatgaacatgatgatgattttggtttgcaatccatgcatgacaaaatgcttgaggttgtctgtatatctgggacgtggcatctaggaaaactgcaggtaagcttgatgtgtatgcttgcatgttgttagactattctccatctttccattttctaggagtcttctgttcctgctgcacttggtagttttagcttttacccttttagtaatgataatgtgaaggcagcaactcagtcttctttctttgtttgataggtgggactctctagagcacacaggctagcccaagggaaagttataaggttgcatctccacagttcattccctgttcaggttgatg

SEQ ID NO: 54732 - DNA, 6104 bp, Oryza sativa
tacgaagagttttgtagcgcgtagaaacactgttactgcatgtagggttcaatgagcattgtaagctgtatctagggtgtatcggtggcctatacaaaaggtatgaatgtaagtttaatccctcgttttttgacagaagaaaattgtggattttgttcctgatgagtgactaaagattcttttggtgcctgtcgtgacagaaatcagttgtgatgatcctgctgattttatttcttcattgatgtttgtttctaaatcttgtattcgtctcaaaagatttacgttattctcaacctggctctggtgatggaaattgttgatttacctgaagccatgattctcttttacctcctttgccattttccctaccaagacaatgctccaagtttttttagcgatccccgttgccgtagtttaccatctgcttgaaggtaaattaccctttgccgtcagtttcaggacgcggcagattaaaaactctagcttagtccaacgtagacaagtgcacgagggcagtatactggcaccaaattactttcaatgctataaatataaaatcggtgttttttttattgctacagaaccaattttgccaattgcaaaactgaaacagagacgaatcaggttcatttgcttgaacctgccacgtcggagcagacgaattgaaggaagttgctcgaggctggcagaagcgaaaccactcaaactagaggattacatatctccttaaaataaaggctactttatagtatatcacagttaatcaacctccgttcccaaaaattagttattccaaaatgattatcatattagtattttcgttatttgtgtatgaaaataaatggacatatatgtacacatatgtgcgcacaacctttttacaagtcttggtctgtttggtgctaggaagtaatggggatgggaatgtgcatgcatcgaattagttaacggagtaaatatattacgggatagctattagcttttttttatcttagtacactcttataatgcgatgataaattggaaacaaagggaataataactttatagagtaggaaaacatgctttgaaaaatttcttagtagtgagtatcctactccctccgtcccaaaacatatctaattgacttttcatggagagtaattctaatgtttgatctttctactaattgtgattgcaatgtatgatattgctaatatttatatacatatatacggtttatttggtagatctgtaactacacctctcctaaagatggagctcaaccaaagtgtttaaccttcacctagaaagggcgtggagcagattaaagtgcttttacaaaatgaaatagtgaggtgaatctccacaactctacttcaaacctagcttttggagttaaatttaaaagtttgaactctattacataataacatagatatagtacgctagtaacagagcttatacacggagtagaaacatgtggcacctaatttgggtatattgatttttgctgtagctagtaggtgctccctctgtttcattttataagtcgctttgaccttttttcctaatcgaacttctttacgtttgatcaaatttgtagaaaatactaccaacacccgcaataccaaactagtttcattaaatataatattgaacatattttgatgatatgtttgtgttgtgttgaagatgttcctgcacttttccagaaacttgagcaaaagttaaaaaaaagagcaacttttaatatgaaatgaatgtagtacaacacttcaggatgtccttttgttttacacgtcagtttcacatgttgtccaaaaggtttacaaatgaagctatatccaaaccaatatattaccttcgtttttctaatatttggcgtttgatcgttcataaattaagtacaaatatgctaaaatataagcatacttaaaatttcttaaatgctaaaccatgtcacaataaaatacataataattatttagtaagataaataatcaaacatcatactaaaagttaatggagtggtctattgaaaaataggattgttatatacttcctccgtttcacaatataagtcattttagtatttcccacattcatattgatattaatgaatttagatagatatatatgtctagattcattaacatcaacataaatgtgggaaatactagaataacttacattgtgaaacggagggagtattatatatcactctataaacgtacgtacagctccaacgaactactccctccgtcccacaatatctcgattcctggagggagggctttgtcccaaaaaaatcgattcctgcacagaaaaccgcgtgacctctctatccgtatcatgtgtggggataggtgggtggtgagtggcgacttctccagaatactcctctctcctcccagaaccttatctcctcccagccgcatactactcgtacgcttctctctccccctctcgtgtttttctccctcccgttcctccccatcgcccttcacccctctggatcgaaggcatcgacgcggcggcgtctagatgaccgaccctagcaagcttccaactccctccctacctccctcccgctcctccccgcacgtccctccttgctctacgctgctccgccaggctcccacatctccctgccaagttccccgtccaactagttgcttccactcagatgcggcgggggaggtttacgagcagttagatcggatgccggagatggctgcggtggaagtgtttggctcgatagcgccgttcatggaagcggcggaaaattttagggttttgattcaagagacacgagccaaggcggaggaggcgtgtcggcttgcggttgtgatccaaaaggcggtggcggcggcggcgctgggtggaggcagttgggatgcggcggcggcggaggaggtttgcaagaaggcggcggcggcggtgggtggaggcagttgggatgcggcggcggcggcggaggtttgcaagaagggggcggcggtgggtggaggctgttgggatgtagcggcggcgtcggaggtttgcaaggcggctgatgtaatgctcaaggaggtggcggcgcccgcgaatctgataaaggaggggacagtggaggacgaggctgaccagcctcttattctaattccggcatcaacaactagggtttttggcggcggtatgcgtcgattgactcaaaggtacatctcccactcgatctccctggctccaatgcctctcagcctattccatcctaaaatatactaagcagatctcatattcctctgtgcgtaagatagttacgcagtgtcctgcatctccaagtcattagcacaaaactaaactaacaaaagaaatctactccgtagctagcaacacaagacttacccaattaatcagctaattaaaagcccaaagtgatttctaggtgattgaaatgtgatccttcaaattacagagcctacaaaatcgtgaagcacttaactaaactcatggatgaatgattaccattcggcggtgtgtgttaatagactggttgctgctttatggcacaaaagaaaaggatatacagtgtgttttttatgttttgagacagacagtgttttttttcgttaagtactcgattgggtccaatggcatattttcttcttgggcgaaagctgcatgcatattctttttgtcttcaacctgcatgcatattcttcctctcaaccacagtagccagctcattctaattgacagcaagtgacagcaatagatgaggacttatgtcacgtatcgatattgtttgtttgtgctttgcctaaataagttgaatatagatagatgcagcatatctgattgattcctaacccacttaccaagttgtcaacctgattgatttctttaaacagtaatgattaatcaaggttttcttatttgagaacaatgattattttgtttcaacaattacatcgatataaatataaatatatggcagaaatgtgatatttttgaaaagaaatttcaatttcatcttctcgcatatcttcagtaattatattgttaaaaaaagtggttattttgttgtgacttgtttacaaatgctattgttttatccttttcaggacaatgttggttgacgatagcgaccacacggcactgtttgagaagaaggcaagcgtcaagcaaatcggcatcgaggagatgaggggaaaagctaaggatgtgagcagcgaggagggaaacagcgaggaggtgaagtcaagcgactatgatgaagacatggtcattaggggatatgcgcaaaatccatatgatgatagtggcctagaagacctcctgcaagaccaagatgcattggaaaaatcggtaaagaaatttctggagtgttttaagaatgcaaaatttagatgaatgcttcaattatgtgatgtttgtgtgctggtttggtggttatgaatagtggcctaacaaagcaactcaataagtacccttttggtattgtatgaaattatgtgtaaatatggtattagataagattaggtggttatgaatagaagccttgacagtctgtcaaagtaggcacacttttggtattgtatgaaagcatgtgtaattacggtagtagatgatattaggtggttatgatggtaatgtatcgaaatatttcaaattatgatggtttatggtggtgactgaaattaaggagacgtttgcaccatgatttactctaatgctgatattacaatgtcttatgtacaatctgaaattaagccaaaagctgaaaccatcataaaacttcctatattacatagtccaaaagttcaaaccatcataaaactttatattacatattccaaaagctgaaaccaccataaaacttcctatattacatgatttgttgcatttacttgcgtaatactgatcttactttaccatatatacaacctgacatttaaccaaaagctgaaaccatgatagagcttctcatgttgcatgatttactgcacttggttggataatgctgttctgaccttgtcatatagctgacgaccacaactaagggtattagggagaatgtctagacgctctagcctctctttacccatatgaggaatcctgtatccatttccaccatcaacttccataacctctaacaagcaagattgtagagttaggaaaaccctattcagcttgttgtcatcataagcctgaaattcctgctcagcattatctattagctcatccatattcctagatatccttctatatgttaatgattgcagagatgcaaagaacccaagatctagtgcattcatatatggggaattaggaggctgatacataaggcgaatgtcaaaccctgtttgagatactgcataggcaaattgaggatcatccaccggcacatgagaaggagcattatcttgctgaatccatataggttgtgtcgctcttctcgaggccaacttgatatatagctggtaggactttagcaattagaaatgatctgacaatatctcgatcaaccttgattgtcttggtgacaagagtccctcttggcctgttttggcttgccctttgtgctggttcctaaatagtaaattatgtaagttagattaacaattaagttttgcatcacaagcctatcttgccgtcagtaattaaaaatgcatatatgaagatgttatgatacctttttggtgaaaggccacaagcctatcttgccgtcaaaagtgcaaataccttcttcattgtatctaggcctagccactgctgccaagaacatcactttatcaatagaattcttgttttgcacaggcctgtatatcctcccaatggaccatgtaaaaatttcttgttttcttagtggtattgaaccatttttcatcgatgtgcacaatattgcgcatatcaacaaacttgggttcatttggcaaagtatgccaatctaacatggaaagacaccatcgcagccttgatcgtttgttctcttcttcaacaatggctttaatgtgttcgagtgacgtcttagtatccgttctttcaacatcctatgcagcgtgctctttggtacacctgcggctgatgtaaatgaccgtaaagtgccccttagttgcaagggaacattagcaatatctgat

SEQ ID NO: 54733 - DNA, 4215 bp, Oryza sativa
ttttatcgtcatggatgaacatgcttgcaaaattatggctgatacaacatgcatatactttttatacatgaccatgcattatataatttgatgtgtactgaacaatcgtagtaggcaaaactggaaatgtgatctccatattaagtgctcatgttgataataaagttcttgcacaacttgttaggctcaccatgtggtttactttataatatgatttaaccatacatatcatttagaaggcagagaaacattggcacaatttactgtatgtgctttctttgagattgctatggctgtgagccaattaacatggaaaatctatgtaaatacaacatattagcatatttataatccttaatctcatcattcgttgtgatttactatgtgctgaaatatccaatttataatccttaactattgatgcaactaatgcagccaatggcattgctgaattattctaggtagttggcatgatgtaataatagtacctgcttgcatttgtaggtgttcctcgaaggcatcggagttgatatcaaaaggaaaggcattatggatgtgacctccataaagttgcagaacttgatccattgcatcgccattgtctacaataacaattaccacggtcagtagttagtaccatgtcaaatagcaatattttttgcaagcacaatcctttttacccatgattcaatactgaagtggtatgtgttcaatttgcaaagtatcatctattccagatagacctatgaaatgtccacttagtgatcatctctgtttctctatatataactgaatgatttagttcatccattctatgcgtgcaaatagatatagtaagtaatacaaaggctgccatgttgtagaaaacatgattatgtagactgtaacagagtgccctgttcgctgctggtgatacttgatgtttgacatgccatggcatatttgccttactagatgtgtgtgactaaaagaataatgtttatactttttttccaatatatccaaaatacttttattactaactaatctattaagttacataactaatggaaccaatgattaacatatgttcctttatgctgtacaacatcaacacaggagattatgagatcaaataaccacaatcaaggtaccaactgtatacccatatgaaatttagtttttttgtgtagcaattttattattctaccctcaaccatgtttttcagtagagggagtctagtgcacagattttaaacaccggtcttgctttctgatttgtcctgtttagtatgtagcatatcaggattgattctagacattagataagcattataacaggagataagtattgcattagttcagctagctaaatgtataacctgtgatattatggaaggggaattaacttcattagggccaactcattgatagaatcaagtcctaacaatttcctcatacttatcaaagattgattttgttccaaaaacatagcgattgcatcaaggcacatgttactgatcatcttttcagagaactagcaaagattctgagttatttatgctagtcagtgctacaaatgttactcatttcatattaatgcttgcaaagttacctggattcatttctccttgatggccaggtgcatcaatattgagatcaaaaggaagcacttgagggccaggtgcatcaatattgagatcaaaaggaagcacatggttgtcacctccctggacatcacctccaagttgatcctcctcctgaccaagatagatttcaacttcagcaatttcatcattgaggtcaggcaaagcctattcatctgcctcatctattggcttgtttagatcaagagccatggaggtgattttgaagactcatgcagtgattcagtgggagggaaacctgctattgaggttcatttcaaacttatatagggttgttgtagtggtgtgtgctgaaatttgtaatgcttgccgccaatgaagcaatgctgagtttcaaaatatttggcgcactggttgctgtgtattatttgtatattgagcacttaatggcagcatcagaaatatgcttatccaacttggtggctgagtagtactactattttatttgtctccaatgattgcatgtactttcactgagggtattttagtcttttgccacctgtcctaaaattcccttgggattctagggtttgagatattatgggacggagggagtatatcaaactatagcactagcacatgtccatcgacgccggcacagcgtcctccggcgatctcgacctcgacaccaccatagacgacgcctccttcccaacaccaaatcgctcgaccacgagcccggagacgacgaccacgtccaccaccaaacagagcagcagccacgccgacgacccggccttccagctggtgaccacgccgcccggcgaggctcccggcggcgcggccgcggcgcacagcgcgtagaacacgagggagccggtgaagagcaccaggaggacggcggcggcgacgctccggagcagcgtcgcggcagcagtactagtactaatactaccacggtggtggcgccgcctgcaggtggtccgctcctcggtggccggagtcgtgccgccgccgctcgccatgccgatcgatctgtagctaggatcgacgacgacgagagggtgatggccttcaactgctcgagcttttgcttacaccgcaacggaaaggatgcgagggaaggcgattgttttgaagttgattgatgtaagtccgattcggaatttggatccgaaacccaaaatttccaacttccaaaggcccacgaaaatctcacccggcccagcccaatcgcaggaggtttcgaaggtttctcgcttgcttatgatgaagtgctctctttgcttggtttgcaaggtgaaattattcaattggttaatcagtgaaaaaaagagcataaggtagattgatgagaaagctgagcatcattaaagagagtgacaagggcgatcaccagttcgacgaaaaagcaatgggcaaatgctgagagatcatactactacatccctccagtttggttaggatagaagattaagcgtgcacaaagaacgagaaaaccattagcgtacggttaacagagttttaattatttaatttttttaaaaaatagatttatttggtattttcaagcaatttatatataagaaccttttaatggtttgaaaacatctaacgaaaatctaggtaaaatctacatctattaaaaaacatatcaattatggttgtggctatcttttttttccttaaaaaatatggtaggacaatcaatgcacctttggatgcataattaatagtcatctgcattaaatgttttctactgaatttatcatttaatcatgtaaaatagtttatttactaaaatatatcttcagaatttagtgtcattcatctataggcttatgtttttaaacattagtttttttttttgaaagaaagttttataacattagttaattcctctacaccctataattctataccttctacataatcatcttctacagtatggttattgttatgaagatgtgtataagtgaagccacgtcatttgtatgaatatattgtgacacaagttgccagctgatccatccatcctttaatgaaattgatggcaaagagtgaaatttctctgctgccaagcgccgcgttgtcgcatgccacacacctttgctgacacgcatgtagtgcagatatgcctctccttcttcggcctatattttttccccttaaacacagataaactctaatatatgaatgctctcatgtgcctttaggatgcgtgaattgaaagatacgtgcaatgccatacatctcgagtcgactggagggggcccctaataagcgactggtcacgcgggggcgtagccacgcgaccagcccgctcctcctagactcctactactactactagtctactggtactactactagtctactactacaactgctggtgcaactactacactacaacaacagtactactacgcgtatatatacgtttgtatatactttgtatacatacgtaaaaacctttgtataatacatatgtattatcagtataaagtttctacgtatgtatacaaagtatacacatatgtatatataatttttatgtgtaccaaaaaattgacgtataaaaaatatacatgtatacaaactttgcatacgcatatacaaagttagcatg

SEQ ID NO: 54734 - DNA, 1977 bp, Oryza sativa
ctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgtttgttcgcgacggctcgccttcctcttcgctcgcgtgtttcgtgccttcgtagacacctgcgaaaagtttcgaccaagcagccggtctttccgtcacctcggtacgtgttcaatatgttgcgcatatttgatttgttcatgttatactgtgtagtttacatgtatagatctaatgatgcgttcatgctagttttcttctgtaatgtcatgatttatttatggaatagattaaatcattatatgtctataatctcaacaccctctcctcatcgtcctccttctccggcaccggcggcccgccgcgcatcgacgatatcgtcgccgccgccacgatgacgacgccacgcgatcataagcttaaggtggtgaccaagcctggcggcggcgcgcagcgcgttgcggccatggagacgctgccgcgggagacgttctcgccgcgcttccgttgcggcggcggcgccgccgccgccgtggcgtcggccattgttggtagaagctaccttggtggtaaatgagctgttggccattgcatgaatgctagctagactaattgttaattcatggcgaattggcgatagatgtttgtgcagtactaagcaggtaatcttggctttgtgatatgcatggtttgtgtctgaaccttcagggtaattgcatttttcctttgtaacatgagacaatctgagttctgaaggattccaattagaagatttatgacctgttcgatgctttcgttgctgatttgctttgcatacctccaaaacctgattatttaatcaatgtcgctttacgccatatgtttgaaacacatgcatgattattttcttcaaaatgatgggatagttcatactttaattgctccaaatggacccttaaatagttatattagtaaaattactttaacaccagcggaccagaattattttaacagagtttatgctgctatgcttagagcaagtactataaaagctcatgtgctgtccctaaaagaaccatataggattagatgataaggtggaagagataagtgagcaacgagaatatgagcacctcttatgcaagaggtaaccactgcacaatcttaaaaaaaaggtgaaaagagaaagtgaaatagtgagagagtgagtcaattaaagaagattttagagtttgtgtgctagaggtaacatattgtacatgttgcctttatagatgacatatacaatatgttacctctaaagagcatcgggtcactacgccgtagaacacaagatcatcgaaagaagttcagatcaagccacaggagagagagagaggaagaagctagatctagactagtacatattgtgattttttttatctttcaaccctttttttttgtttctttgtattagatcaaaatgctttagtagagattcatgtggtgtctcgtacttttgacttcgattcctagggatatgttgatgtttcaacagttgaaactcaatgtatggatgagtgtgatgtttcagtcattattcaaccatgtttcaccaccttaatcgtttgtaatatttttggtctagtggtgaaacctagtagcgataacacagtggggaaaaatcgggcatcaaatttgtagtcttgcgtgaatatgtgctagattggccggctacatcgtgagagtttctagtgtgaactactaatatactcattttccttcgaacttctcatatccgtaattcggcattccgattcgaattccgaattgcactagactgctactgcctcagtagacaaagcagctgcaaaattaattagttgcaaaatttctaatttatatggctactagcacg

SEQ ID NO: 54735 - DNA, 1856 bp, Oryza sativa
tgttatgtgggctgaaggaaagtatttctactcctgctcattgacttgcacccttgttaggtaacttggggtaagcccacttttagctgcagcccactatatggcccatcgtgtatccgaccatttgggtacatgacaacaccgagccagattcctttgttgtctctgttcatagccagcggcggacccctttccaggaggcctgggccctgccgccgccacaccaccactgccgttcgtcgccatcctcagctcctcgtccatctagccggctactggcgctggctcgttcatcggtggtggctgtgtagcagtctcggctatgcagcagctcagtacaactgcttcggtgaattgatgaattcatgttttagtacatcgattcaagtgaatttttgcttcagtgaactatcagcaagcttcttcttcaagcgcatgataaaattttggatactcgtgtcacgcttttcaaaatgctaaacggtgtgtttcgtgtgaaaactttcttatatgaaagttgctctaaattatcagattaatccatttttcaagtttgtaataattgaaacttaataaatcacacgttattaccacctcattttgcgtgaaacactcaatttttatcttcatattcatatccaggagattcaaacaccacattaattaatacaccgtgtggatttatttatcttgttctgcaatctgtgacatgagacttactatgtgcatgatttatttatcttttgcgaggactcaataaaaatcgtcagacgttttctgtactgatctccaagcctgagtacatggcaagagcagagtacaagttctctgtactgcacgaagctacatatggcaattttcttggtgggagttttcgttggtgcgaggctgcgagctaatgatgtggtaccctctgtaggacttgcagtggtagcacttcattttatagagaatctgttatatgccactaaaaattggttttattacttatatgccactgaaaattagttcttcccctatatatattattggtctaaatttacgtaccctctcataccactcccatctattgaccatgtgttgaccgttaactatcaagtaaaaaaagacggttttggcgttttgtccttatgagtataggacatatctaacaactcagaatgataaatacatctttttacttaaagttaacggtcaatacatggtcaacaaacgggagtggtatgagagggtgtgcaaaattagaccaatgacatattggggaagagaccattttcaatgtcataaaagcgatcagactaagactaatttttagtgacatataagggattctctcttgatttttatggcagctctctcactctcttgaccctcgggcgatggggatcgatcggctagggcgctagggccaggccaatctgctgccagcgatggcgatgggggcgtgcagcggaatggtgagagaatggttctcttgttgttctggttctgcttcatcagatgagagagatcgattgatcgattgatccacataagggcagcaatgccaattcatgtacccaatccaatcaacgcagtcaaagataacgggaaaccaagagggatcgacgaaattgctttcaacaataacgaaatgatattttgggtgctgttaagttgaccgcgaactttggatgatatgaaattaaaaagaaaaactttcgatgctatagaatcaatttcgcctccatttttttatagggtaaatagccaattcagtccttgatgttttgctaggggtcgaattagtcctttacattttgcattgtccaaacaaatccttaaaaagattatcgtgtggcttaatatagtccttg

SEQ ID NO: 54736 - DNA, 3943 bp, Oryza sativa
tagatttaggctagaaagaagaacattgttgaaagggacagattagactaattgatattcatcgcctaattgataatagatacaatcccatccttatatggatagtacaacttgactcctaagtaagaacttaatcttatcttatctctaacttaattggtataggctgcctatatgcctctgccttccggcccaatacccatgacaatcctatagaagtatttaatgcatatggtttatttagtatctaaaaggttcattgtctacttctatataactaaggacgaatgaaaattgctaacatatgcttacatgcatactgaaacataagacaaaattagaaacacaagaaaaggaataaggccataggtcactggtggagaaaccctttgtagtcccggttcgtaacccccctttagtcccggtttccaaaccgggagtaccaatccgggactaaagatcgctatctttagtcccgggtgaaataaccgggactaaagatcgagctgaccatttttttttgcatggccctgttgctgcatggtttatatatatatatagtttatatatatatatatatatatataaaccatgcatatatatgtttcaatacatatatatgcatacatatatatatatatgtatatatatatatatatattatattatattatatgtatatacatgcataatatatatgtatttatacacatatatatgttatgcaaattaatgcatatgtatatagatatatatatatgaccaaaatatatttacattatagaaaatgtgtacacatgcatatagaaacatatgtagtcatgtattaattacaatccattatatgtcctagctagctagctatcatttcgacgtagtagtactcgctgctagctcagaagctaaggaccggtgaattgtgtttccgtcgtagtagaattcacccttgggattaaggatttcttcgttgatgaatcccatgagttgttcttgaaccgccgtgataaattccttgtgtgtggtcaggttatcctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttatttccctgcttttgctttgcgcactacaaataaatgacaaacaacgagagatctaattaatatacacttgtatgtatttgaatcggagaaatataaatatagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaatttaaactaactctgtgttgtatggcaacagttgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtatattattttctatagtctacttatatacaaggacctaatttattaaaggagacgtatagtaagaaatctaaccgaacgatatacttacaaaatccagcaactcataatagagacgtcgagggcgtccagctggtatagttcgtagattcccttgaaattgatccagagaatgtcatctccttgcaagaagtccgtgtccctgatcctcgctccgatcatctctctaccggcggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtaaccaacggctcgatctctgttttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggcttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtgcagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcatgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcaggaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgcgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtcgggtcggaacgtgccctgagaggaggcttccactgcatctgttagtcgttgcgcagcctctcgtatctgaacgccgaataccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgg

SEQ ID NO: 54737 - DNA, 3181 bp, Oryza sativa
cgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaacttacgtgctaagtctaattacaaatcgtgatataagctaagtctaggtgacgtatattatacaaccctagctagtaaataattatatactaagtctaattacaaataaagtaatcttatattaaaactcaaataatattacatgctacgactaaaatagtcatgtatgctaagtgtttcgtgcatatatgctaagtctaattaagacaacaatagtcaattgctacttgtcgcaccatttccgtagtaaataattatatactaagtctaatctcaaataaagtaatcttatattaaaactcaaataatattacatgctaagactaaaatagtcatgtctgctaagtgtttcgtgcgtacatgctaagtgtaattaagactacaatagtcaattgctacttgtcgcaccacttccgtagtcaataattatatactaagtctaattacaaataaagtaatcttatatatatattcaaataatattacatgctaagactaaaatagtcatgtatgctaagtgtttcgtgcgtatatgctaagtctaattaagactacaatagtcaattgctacttgtcgcaccacttccgtagtcaataattatatactaagtctaattacaaataaagtaatcttatatatatattcaaataatattagaacactacacaatcttatatgataagtctaattacaggtctaataatcttaattaattgcattacaaatataacaatcatttatattattacgtcacttgcctgctccaattccttctagggctagctcttccactcaggcttgacgacgactccgacaacacgtcttttctgcaagatacaaaaagatgtatatagtcaaatgcgaagtaacatatacatatatatatatatatatacatatatatatatatatacatatatatattatacatatatatatatatatatattgcatttcacgttaacgttcgtcatcgttcgttcgctcgttcacgttccctagatcgttcacgttcgttccctcgttctcacttgtcatcgttcgatcgttctcgttatcgctctcgttcgttcgatcgttctcgttctcgttcacgttctcgcggcaacatacattgacgtgttcgttctcgctctcgttcgttcgatcgttctcgttctcgttcacgttctcacggcaacgtacgttgacgtgttcgttctcgcttctcgttcgttcgatcgttctcgttctcgttcgttaatggcggtgtggcggcatcggggcgacggttggcgccgtggcgacggcggcggcgtggcgacggcgtgaagacgccggcggcgtggcgacggcgtggcgacggcggcgtggcgacgacggcggcgtggtgacggcgtggcgacggtggcgtggcgacggcggcggcggcggcgtggcgttgcggggccgtggcggcatcggggcggcggttggcgccgtggcgacgcgggcggcgtggcgacggcggcggcgtggccacggcgtggcgacggcggcgtggcgacggcggcggcgtggtgacggcgtggcgacggtggcgtggcgacggcggcggcggcggcgtggcgttgcggggccgtggcggcggcggcgtggcgtggcggcggcgacggagagagacggagagagatcgagctgagatcggagagatcgagagataaagggagatctggcggcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtctaagtgttggtgaagaagacgcggcgcaccgggaatatatatacccccggatcttactcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtactaaagattaatgacaattacttcgaaaaattatttttgtctgtaataaattaagtggataaatcgtaataagcaaatatatgacttataattaataaaaattccaatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatataaaattgccacttgcgtgatttaaaacttttaaaaatcctctagtcaattataattagcatatgaatgctagtaaattaaatgttaaaacctctaatgaacgtacatatgaaattgccacctgtatgatttaaaacttttaaaaattgtaagtatcacatataactagcatatacatgattt

SEQ ID NO: 54738 - DNA, 1870 bp, Oryza sativa
caggcaagtgcggaaggcgaggtccctctccctctccttcccttatcacactccctccacttctcctctatgaccggacagtgagtgtagacgggtgtgtgaggtgacctcgcaatggcgggatcggatgagacaaggtcatggtggagcttgtgacttcgcacgagtgaagaaggtcgttgggggagagggaggtccgacacgcttagggtgacgcgtgatgacggcgtggtcaactgtgttggggaaggtgatgtgcacggtgctatgtgatgatttttgtcttatgcgctgtgtagtaaccaaaataaaaattttcacgttgtcacattgaatatttggatatatgcatggcgtattaaacgtaggaaaaaaccaattacatatattgcatataaattgctagacggatcttttaagcataatagtgccatgatttgataacatggtgctacagtaaacttttactaatgatgaattaattaggcttaataaattcgtctcgcagtttcctagcggaatctgtaatttattttgttattagagtacgttcaatactttaaatgtgtgtccgtatatccaatgtgacaactaaatccaaaaatttttcccaactaaaccaggccttagctcccagatctacacggtagctgtccttcttatcctcttgcgttccaggaggctggcgagctcgaagaggacttcgtcacttcactgccaggagcacgtaggggaggagcacagtaagaatggatgggtgcgttgtgaattttcaataccttagtccaatcatcatgatgtttcattacttcgataaaaatcttgcactgggttttaatggtgttttattttttttctttgatttcactcagatctaatgatgtttcaatagcttaaaaattgcttgtttcatacgtggaagcaaattatttcatctagtgctaattgtgtttcactcttttcaagagttgaaatattttgttgagtgctaaaacattattttaagagttgaaataccgatcgttttagaaaaatcggacacctgatttatagctgtgttaaatagatactactacataatcgatttttgcatgcggtcagaattggttttcgcaagtagctaggcgcccctcctctacgcaggtgtctgcggaaatcaaccttttcgcaagagggtaacgcaaccgctcgcgaaaactgtattttcgcacgcgggcgcactaagttgtccgtttgaaaaacaagtttgaagaaaaaaaaatcctaaaaccaaaaatctagaaacatgccgtcgcaagatccgacaccaccgcttggatctgtggtcgttgttgctcaaagccaccgtcgtcacgcacggatctgttgtagtcgtcatcatgcggaagcttccacctccgtcgcatcgggatccaccaccgttgtcgtcactcaaaggagctgcgccgtccttgctcgaagccgccgcattgtcgttgtcgttgtgcggaagccaccaccattgttgcgtctagatccatcttcgtcagtgtcgttcgagggaggcggagaggcagcggaatctgcgcgggaaggagagatgccaccagatccgcccgtcccatcgccgcagtgggtggatctaagtgtgtgggggcgaaaggtagcaggatccgcacgatccgaggccgctgtcgcctcctgagcaatgcaagtcattgccgctctcgccgttgcggccgctaacccgagttagaggaggccagacgagagtgggaaagagaggatgggaggagggaagaagtgggagagatatggagagtgtggaggaaaaggagtgcagcaaaattagtggggagagaggaagcgggaaaaaaaagagcgaagagaa

SEQ ID NO: 54739 - DNA, 3311 bp, Oryza sativa
tgtgagactagtacgaaactaatgagtatttctataaggtcgtaataattatatctggttaacaaatacaatagaggaaaactgatacatgaaaattattaatggtgatggttattgtccgccgaagcctcattcagccaactgttcatatgtgttgctatcatgtcttgatttgaaaggtactacctctgtttcaggttagaaagtacctctgtttcaggttataaaactttctagcattgcctacattcatataaatattaatgaatctagacacgcgcgcgcgcgcgcacatatatatatatatatatatatatatatatatatattcattaacatatatataaatgtgagcaatgctaaaaagtcttataatatgaaacggaggaagtagaagcgtagaacgtaggatgggttgatgggaatggaatatgacacgagccgtgtcagtccgtctgtagtatatgaccgtcggtgttggatcgcgctcctctgacgtaaagtcagagggacgtgggtcactgatgtcagagaagacttatccgcgttggtgtttaacttgctctcgtgttctgatgcatttggacggtttgtcatttttatttattttttgcataattcgttttaattttttttagtttttagcaccaaaagttttcattttccctaatagcattaaaaattattattattatttttcatattttaaatatttcactaatttttgtggaaacccttagtgttggtcggcggatgaaaaaaaagatcaattgggcgctctcctcgccgcttattctcaactcctcgcatctctcttcctctacatccttatccattcgccttctccctcttgcgctctctctccctctctcctcatcctttctcatctcttgtcttctcgcctagtctgtgagcattggaggcgtggggcacggagaccctggaggcgaggttggcgctgcggaaggtcgtcatcaccaagctgcccgtagccttgtcgtcggcggggcggcaacatcgcacgggcggaggccggcagcaggatgcgctccttgctcgatccctcccttgctgcctgctgctggatgggggagctcgcagcacatcggaggagagagaaatttagttggattgtcttgtgcttttatgtggccctattgaagaggaggaagaaatcaaatttcgactggtacaattttgagtttttgatgtttcagccaatgtatatggatttttttgggtttggattgaaatgttgtacttgatacttcgatggtgtttcatatttttatttactagtgagtgtgcacgtgcaaggcacgttaacatatattgaatggagtaaattagaaaaaacacccaatgcatgtgaaccttaataaaatgatgataatagttgcactgttagatagatagatacttctgttcaaatcccaaaattaaaggaagaggtggatatcaatcccaacataaagtaataggtggatatcaatgtatcaagtagtatatcaatattcatgaaggccagaaacaatcaaacatgtggagtacgcattaaccataaaggccagttagcagtcttgtacataacaaatagaagcaattaacctgtatgtgcatgtgcaaatatttacatatggagcctagtccttgtagaagttaccaacatctatcggccttcttgacagcgaggagtagtcatcactaacatctctcttctgtccatcaggagttgagagcaacgtcaacaataagtatgtggtcctatcctatagacaaacaattgtataaagttaaacatgtattggtcactttgaaaatcagtccagcattcttgaaagaatgaataagatgtgcaataacattcttacggcactgctgtatacataatggatacatgaatatgtacctgaattttaccattaataatgttgatttttgcttcatttgctgaatcaagcaactcataggaacaacatcatccatatcttagcaagctcgatcgttgcagtttgcaatcctctttggtgaggcgcctagctatcacaataggttgtcgaggctgaattctttggtaaggcacctagctatcacaatagtttgtcgatgatgcattcctgctttaaataatcagaacaacaatgatgagcatgttaattagttgcaggaaaaaaattattgcacagctatatatagattgcaatcaagattgattactttgggctcgtgaagttgctttgctctggttgctttaccaagcagctaaaagtaagtcaaccatatctggaagcctcgctgttgttctctgtaaatgggagacgtccgagtgtcataacaggttgtcgattctcgtttccaaaataaaatgtttattgcaagaatattgacttgatgacttatactaatgttcattatatatactattaacattaaatgaagtgaacacgatatccacaacagttgtataagcagacttgcctatggtgcttgatgcctccttgtgctacaattaatggttcttttttattcttacttccttctgctcggcaatgggggaggcgtacctctctatagcatgctttcttctcaactcgagtgcactaaattgttaatatggccaagcagacatttctagttagtctgtattggtaaattattaaaccttaattgcacatgttgtcatatagagaagcgattgaaatattcaaatatgtgatagatcatgaatatggaaaacataaaaaaaacattgacatgtaaaaaacagtctagaagcagagcatgaccaatatgcaggatcaatatatgaatttcccagctgctctaattcagttaatttccattagcgcaatatgtgtcaatgcgatttactcaaaggcaaaacatattagcaaataaaccgaaacaatatgtgtttttacctggccatgcagccgattacgatgtagagcttcatgtgatgtccattgaagtagggcgagagaggagatgagtgcattgaatcacattaaggcgcacaattgacatagttcattgagatgtaactcgagtacttagccaagataatcagtggcaataaaatagagatgggcattgggtagtctgcgagcttgagattccaaaaaaaaaaaagaataatcaatatgacactctatttaagaaataaattaggaaattataatattcataaaacgaaatgagttcaactataaacaaaaataaaagtaagattgaggcatcaaggtgtgactacaagttgcatgtttttagtgccttaattgatcgagcatcacactattcagaaaaattca

SEQ ID NO: 54740 - DNA, 13229 bp, Oryza sativa
tttttaccgtgaattggagaattgggtgatgttgtagctttgttgctgctggtcgtcgggcttcttgtgggacgggttgaaggcgacctgctcggcgcaatcgcggttgtcaccagagtggtcgcggacgacacccatgaggtcgaggttgtactggtagttggagataaaaatgttcatgtcgtcgatgtagcccttgccgtagatctggtttgcactaccaattcaaaattgcacttccttttccatgccaacaaaacacaggctaaaaactgataagatagttctaataacactaagaggggaaatccttgcattatataacctaattttcatcacattgctgatggaaaccaagtttctatgtgagtgtttaacaaagttgcaaaacacaacatgtactttccagtaagtctaaggtattgaattaattttctaagttgagagaacattacatccccatagtagcattataaccctaaccattataaatatgcgttaggtatttgagtatctgaaaagtcttatttgttacagcatggaatgggccaaaccatgattagaaaggaaaatcacaatatttatgtaaaaaccatttaaaaaatgaaactaaattagtataccaatttcaactaacctgttctgacagcagatgagtgtaacagggagtggcaatttgatagtgttgtgcatatatacaagtcaaaactccaatggaagtttgcacttacgatactctttaagatttgataaaaaaaaaggtgggctaaattggagggaatatttcttttaccttcatcattgttgttgtaagtacacctacccagctgccctcatcaaagtagaaatccttaatttaatttgtaagaaaacatgcttgctcacccatctgcaccgaaaacagaaattaccattcgtgagaccattagaaaaacacaaacggcttgtttgtcaacttaaggaaaggggattgggagtttacacgagggaattgacggtgagattaagatgggaatttgatttttcatcccagtctcttgtttggtagaggtggtggaaattgatagggaatttagttggagattagatcattaatgaaaacggatggctgagatttgtttatgtgaagtaaaggaggaattccctcccaattacctgcccctacccaggtattgaaaatgagggagttcattcctcaattccccatccctatcccacaaaaattcctatgtcccccaaccaaataaaacagttaatagcctcatccctctaaactcccaatccctcctaaaaactccctccaaccaaacagacagaaagatcagatcacatgttatagaggagtgcagattggaaggttttgaacaaagatgtattcagaaatacacatattctaacttgtatgatctagatctcctccacctagatcttcttctgtaaacatgttaataaagatttacaatctccaattatctttaggggaaataaagaaagaaaggtttggaacatgagaatcaccttggatttatgcacattcatgtatggtacggtcatgctcgttgttgcttgccagcttcttgcatccttgtagaattcgtcatgattcaacgccagtccaaatagatgcctggacgctcgattgcctcggcagtggaggggcacaggacgccaaccacatcaatatatggagccgacatggctgaggaagccgcagagctccaccatctgcatctgcttgcctcccatggtgcaaaagctgaagaactcgaagaggggcggcgacggtgacaaaggctcaacggtttggagtgcgggggaggcgcgagcggggtgactgctcggaggcggtgtgcggcgtaagtgatcgcggaggagggggtgggcggcggggtagggcgagcggtggaaaaggcggctgccgacggtgaccacggctctccggcgagcacgcgcgaggaggcgacgacggggacaccggctgtccggcgggcacgcgcgagcaggtggcggtgtagggtggccatcctgcagttgtccccgtagcattgtccggcggatgctggcggattgatttctggcgcagagaggcgcggacgcgagggggccgccggctggcggtgggtggcctggcggtttggagtgtgggcgaggtggccagcggggggaggcgaagggcgcccaacggcggtgagcgacctggtggggaggaggcgcagcaggatggcggccggagttggccccggcagttgcgattgggatgagactgtgaagaagtggatgaggggaaccggcgggctttgagcgaggaggcggcagggtagggcccgcgacggagccgcgcccggagccggcggcgacggccggctgcccggcgggtgcgcgcaggcgcgggaggcggcgaggcgcactaccgggaaagaggtttgaccaatcgctattttttttttgttgtttggcgttcttttttttatcggcctttttctcgtgcgcgacgtggtccgccgatagaggtggccaaacgggccgggccaaaacgggcggcccgaggcacggcggaacctgtagccggctcggcccggcacggcctgctacagtaacgggccgtgccggcacggcacgagtagccgtgccgtgcttgggccgccggccgagcccgcgggccggcacagcacggcacggctactgtagtaagtccgcatctcatccttccgcaagtccgtatctcatccctcccaactgacggccagcccgctagccgcctccgcaagtccgttgagcacccctcctagctgatggcccagcccgccagccacctccgcaagtccgcatcgcatccctccgcgccatttcggttcctgggccaaccgtgccccgtccacggcccatttttcattcacggcccgtactgacacggcgggccacacgcatgccgtgccggcacgggcacggcccggccatccacgggccgtgcttgggccggcggctcggcacgtgggtcgggacggcacggcccgtttcatgagccgtgcctaacgggccgtgccgaaacgggccgtgccggacccgtgcccgtgccgtgccgggccgggccgcccgtttggccacctctatccaccgatggcgcggtttgtttgagccggatgacaggtgggtcctatgtgatattggatctgaaggattgcaggattggggatgaacctgtactttttatattagtatagattactcttgtaatttgttgatgtttcaactgttaaagtttgatgtttcatctatgagaataatacatttcaatcatgattaaactgtgtttcaccatttaatagtctgaaatattttttatttagtagtgaaactttttcgagtagcggtaaaacatcacatgattgggagttggatttgtagtcaccgttagatatctattttcttgtttttccaagaaacaaaacgggaaatgccaaaacaccactgcagtgcagtcatccattccgaaaatgccggcaccatcaaattaggttactttttaatattagaaacatgtggataaaaaaattaataaaagagatgacaaaggaaaaaatatagaaaattaagataaaagaatagaaaactaagttaattgaaaaatcgttaaaatagttagaaataagtacaacacattaaaaatatgtttagtactttagaaaatcttctaaaaataattctgaacttctctttgttctcgccgccatatatctttgtagcttttgtgtagaaattactcataactccgaataagtgcatttaaaacttgttaaaatcgttagaaataagaagaattcataaaatgtgtaatgtcagttttgagtttaaatatgatgttttaaattatgatatgattatttaattagtttcacttttttggacttacttaacatttgtttattttatgtataggtggatcagcaatggatgtacaccacgggccaatggtcgaaagagtttcttgaaggcgtgcattattttttgagtgtgggcaatgttaacatgcataagggttttatatattgtccatacaaaaagtgcaaaaccagaagaagtattatacatcaagaactattcatgcccacttgtttgagtcggggttaggggcggcaatttcccccgtggggcatgggacccacccctacgggggcggggatgggtgctgatttcgacccgcgggaattcggggtcggggccctggccatgggcggggacgggggccggggaggatagccacccgcgggtgacccgcggagccccgagggtgtatattagactattaatactaccatattgcaagccaaaaagcccatctagcctatcatatataaaccaaaccctaaattccccaccctctacccatcctcctttcctcaccaacccagcagtcactctccacaaccaccagaccttcctcagttcctccggcggcggcatcggcagccaggcacgggcgacggcgtaccaatcataaatttggtaagcctggagtaatcatcggcttagagtcagcatcggcttcgaagtcctgagattagccgatgagagttatcaagtcgtcggttgttggattctttctatattcggttaaggaaattgatctactaaaggaaatttatccagaatagaccgagttcaaagagaatgcggcatggcaagttatctattaattaggaatagtttgttagtttcctttttaactttaggaaagtgtgtttagtgtcctataaggactttatgttttccttttatctttaggaaagtttctttcttgtcctacaaggactagtatctacccatgggtataaatatgtacacctggggtcattgtaaacgatctctcgatcaatacaattcgtctcatcgccacctgttaccttttctattttattttatcgtccggcgggacttggcacctgacgcggggctgcatcggtgttcgatctctggctaaggggtaagtccaatgtttcgccggcctaggcaattgtatcgtttacgttggcgtcgttcaaggctgcatcagtacattcgacctcttggattgctctggtttggatgatatatttgcctacctatttatcatatgtctctgttaatctagtcttagcatatcaatttagctctatcggctgcttctcgttttagggtttctgccggtatcggctaaatcgcattgctagattagattagcttagacatctaccaccctgaaaactcagtcaacggcttgattgtttagatattatgtttcttttcaatacttagtgttgcatcagttaagtttgatctactatgtcatgcttagagccataatctctagcctgcttcttgattgccaataagagtttcatcggggtttcagctggtgagttatctggacgttgcatcggctcataaggattgcatatacatataagttggatttagccgatgacaacaaaggtttcactgtttaatctaatcttgtggatttcatgacatcggacctccagccgatgtatactttaaccttcggatcagtgcttattctatcatatcaatgctcgccgattggtttatactggactatattattgttatattttattatcagtagccaattgcctatatatcattatttgctaaagtgtaagaatctacattggacgtatagccgattgctcaaaaccctatcgctatcggctggtatcggcatcggttattatcggctatctgctggaactactccatcggcttgtcaaccgatcggctgttttgtctactatttgcatatcttgtcagttgtaggatcaaactgactggcacgcccgcatctcaccaatctttggacctacacaggagctaagcagatctctcaggccggtgtgttcgattttttcatcaacacacgggcggtggcagcggctaggcgcgtgtgctggcggcgttggccaggcgggggtggcggcgtcagcggctaggtcacgggcagcggcggccaagtcatgggtagcggtggcggcggcggccaggcgccggcgacggcgtctgtggccagggcgcgggtggtggcgtcgacggcggcaacagccatccgcgggcggcagcggctcgcctcgtcgtcttccagctcgctgtcctcgtcgtcgtccagctcgctcagctgggtattgcggggccccgctcacccgctgggtcccctgcggggatgggggtgggtggcgttttccacccgaccacctctgcagggccggggtcggggggagaagtcggggagcggtggcgggggtgttctagcccaacccacccccgatccgccccgttgccaaccctagtcggggttcatgcgtagctataattgctggacctcacacggagagtttggggttgcaatggaagaagacgaagaagaagacgagaacattccggactaagctcaatgcggtggattttaagaaaatataacaggtgaggcagacggggctgttgaagataacgacgatgcggataatcttggtcagatgttgcacgacatacacaaggactgcaaaagtgaaaaggaggtccagaaattagagcgtatgtttgcggaccacaaagcgtcgttgtacccaggttgtgaacaggggcaaaaaagttgggtaccacgctgaaattcttgcaatggaaggccaaaaatggtgggagcgacaaggcatttggtgagttattgaaatttgtaaggaacattctttcggagggagatgaattgcccgaaacaacgtacgaagcaagaaggtagtctgccctctagaactggaagtacagaagatgcacgcatgtccgaacaattgtatcctctatcgtggtgaggagtacgagaacatgtgtcacgtccagaaattcccgaatagaattccaagcagaatgtgcattaaaatccccgtccaggaccagccgaggtacacaaacgacaatgttgaccttcagatccacgtcttacaaacatcataaaagtcttacagaaatgcagcggaaaacaaaagataactggagctaatccttgacttgaactgcagcgggaacaccactccacaggcatcctcgacggcacggacgaagcctactcctcggagaacccgccatcggacacatactcgagctctgagatcgggggaaaatagagcaagactgagtactacccactgtactcagcaagtcataccggaatgggggtatggtgcatggattcaacaagggatagctaagcaggttcatttgcataaatactggcatttataaacaggaattgaatacgaaaacagttgtaataattaagcagtattcagcatccactgtccaacgctacaccacgttgcaacaggcccaaccaaccacctataccatccaacttcattagactaactaatgtgagtctaatcacggtgaatctggttgaccgcccataaccgcgggcgcggctattcgaataggtttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgtcccgctccatcacgcccacccttgcctggatgcgtcgactagaggatagctacactacaagcccagccgttgcccacgctggcttgtagtaagtacgataaattcttccagggcatcccgcgaaccggtccttaactgccatgggtgcgaccagcaaaactatgcacccacagcccaccatgtgattcattttaattaaccaacaccaaagcggtgtcactaatccaacatgaccattagaactaacagtctaaacattaatatgattttccccattgtgaactagttgaactaagcatggctaagcaaaccctagtcctaactctaatcatgttataacccaagctaacaaaggagcatggtatcaaaatagcatggctgtaataataggtaaccatcccatagtaacattgcaaaacaaatgcggtatttgaaagaaaacattaggacatttgcaatataggatcaatatgatcaagtgacaagcatgacttgccttgctctgctgctggaggaacctcggcgactatctcaaagtacaccggagcgtcggatgaaacggaatctagcgacaaacaaagcaaacattgcaaacaggctataagactactgaaacagggaacaaaaccatttttaatggattctacacatttttcttgatttactgagacttgaatgggattaaacggagctcggatgaattagttatgaattttagaagattcactgtgtttattactataacaaaaatccttaaataatttattgcgcaatattaaccaggctgacgtcagcacgggggaagcggcgccgacatgcggggcccaccggtcagcgactcgggagagggaggaagggcgccggcacgcgggcccactggtcagcggctcgggagagggcggtctacggcggatcgggtccacggaccggggaggagcggcgcaccacgtggcggccgaaccgatggccccgatctacccacggagcggcagcgggagctcgcggccggggcgcgcgggcacggcgcaaaccggcccggcggccatggcgcgcgacggcgcggcgcgcttacgtgcagcggcgcaagacggcggccggcggtgaaggcgacggcgcaaaaggcgacgcgaaggcggctgcgctaagcggcggctaggaacgggagggaacgggcggcgataaaggcggccgccggcgcggctcggcatcaaagccgaccggccggctaggtctaacggcgacggcacgcggccgacgacggcggcgaccggcggcacgggaggcggcggcggcagtcgaaggcgacggcacacgacttgaagcggcggcgcggcactaagaggagaggaaggggaaaaaaaaaggggaaatgcctcaccgagggtggccggcgcggaggaagacgatggcgaacgacgacaacaagccacgggaggacgacgtcggctagcggacgagcttcggggtgccctaaggaaggagaagagagggattagagagagggagatgaaccacggcgatcggaaaccatggccgaaggcggcggtggaggtggtgctcacccgtgcgcgaggggatgagggctccggcgacgaacctcgacggaggaggggtggacggggtggatctcggccacgcgaacccgacggcggcgacggtgcagcctggcggcgaccctaccggcggctagcggcggccggagcagcgaaaaaaagcggcggcaaggggttgcacggcgcgggagcgatgggaggctcgagagagtgcggcgaaatggggaaaaagtgagaggggacggcggcgatgcttaaatagggggagagggaaccggacgtggccgagagaggcgggaatcgccggccgacgtgggggagtggggaggagagagagcgggattcgattttcgaatcccggccatctcgggcgcgggcgcgagcgggagagagaggggagtgggcgcgggaaacgcggcgcacgcgcgggcgtggtcgacgtggcccgggggaggcggagacgtgggcgcggcggcggtttcggcgcggcggcgcgccgggatcggcgggaggagggagacgggcccgacaggtgggccccacctgtcggcgaccccgagagaggaggcgggcggcctgggtgggcttcggcctgcggccggcccagcaaggaggagggaaggaaggaggggaatgggccggcggcccattcgaaaaaaaaggaggaaaaagggagggaaaagaaaaagaaaaaggaaaaaggattttccctggaattaaaaatattgcttgctcaattttaattggttaaaattatttctagagctctaaaaattccactaaaaatcctgttaatgaatttcgacatgtagaactcaagaaaaattccacatgtcaaatccgattattatttgcattactttcttagggttttctcctgatttcaccagcattttcttagggtcatttataaaaattacaattttggcttgggaggaaaacttcggggtgtgacaacatgcccgatttgtaaggcactacgacaaaaaattagacaagatgacccaggtgatgttgacggacaaccttcaaaaaagagagttccaactaagttgatgtgttatttccctataataccatggctgaggcgtttgttcaggaagaaagcgcatgctagaataatgcgttggcacgcagaaaaacatcaacaagacaggatgctgagacaccccaccaatgggttgcagtggcaaaacatcgacagaacatttgaagactttggagaggatacacgaaacatagggttcggtttaagtacggatggcatgaatccattgggagagataagcagcggtcatagcacttggcctataaccatatatatctacagcttccccccttgattatgcatgaagcggaagtacatcatgatgccaattattattcaaggtccaaagcaacctggaaacgatattgatgtgtagctaagaccattggttgaaaatctgaaactgttgtgaagaaagaaggtgcccccgtgtggaacgaggacaaataagattggcctacgagcgttgctgaccattaacgattggcctgcacttagcaacctatccggacagtcaaataatcggtacaaggcttgcacgcactgtatggatgaaactaaaagtacgtatttataacattgtaggaaggttgtttatatgggccgtcatcgattccttattgcaagccaccttgtccggaagaaagcaagcatttcgaatagaaggcagaccaacgtactaagcctaagcatcggaacggaaaaaccgtgtttgctctggtgaaagatctgagagtactatttagaaagggacctggcagccaaccaatagtgagtgaagacggtcacgcggcgatgtagaagaagaagtctattttttagaagataccctgttgggaagtcttgcacctcactaagagcctttacgtcaacctggtaggcttcctaggtttatatgggaagtcgtaagatgcactaaaagcacgtaatgatctcaagcatatgaaacaatgcgacgaccttcattcggaaccgaaggagaaaagaagccattacttgcgtccagccaactacaccctgagcaaggtagagaaggaaagtatgtttgaatgcttgaagagtattaaggtaccgtttggatactccagaacgcaattttgcagaagatcattgatccagacagtttaatagcgtggtgcaatgtcttgtcagctttgagataatctttccaccatcattcttcaatataatgacgcatcttctatgtcaccttgtgaaagagattggtattctcggtcctacatacctacccaacatgtttcctttcaagaggtacatgggcgttcgaaagaagtacattcataatcgttctcgtccggaagcaagcatcgccaaggggtatggaacaggggagggcattgagttttgcgtagaatttattgaagacctttgtccaatcagggtctctgaatcaagtcatgaggggagactgcggggaaatatgactcttggaaggaaaacaataatgaatgtagacaacgatttatttcgtaaagcgcatttcacggttttgcaacaatcttcattggtggctccttaaatcgaggagcacttggcgattgttcgctccaaaaacatcggaaagtccgatgcatgtattacacgccatcacattgatactttccccgcttggcagcgacaacatctcatatgtaacgagacgattgaccaacacctagccttcttggcgagaggactatcttactcaattttgacattgcagggatatgaaatcaatgggtatacgattgaatacattttgcatacggccccttaagagcatctccagcaaagcacctaaactaagcccccaatgagtctaaactaagcccccaatgagttttgagtgaaggaagaaaaataaaggtatagcagggcccctattaaaggcccccaaaataggaaggcacccaaatttctccttcactaaagtatatcaggcactaatcatgtacaagtgtcctaaatttcttcagaatgactaactgtttgtattgagtcgttaatactgcagaaccaatacatatatgctaaataaatacacgttataaacagtataatcttggttgcccacaccatatttacatgtttgaaaactttgatttttaatttgaattgtgcacttcgaaattgtgaatttaagtatggttaaattatatgcgttagaaatattcatgtttaaattattgtggtgttaaacgtagtgtaaatatggattgtattttaaaatacaagagaaacatgaatagaggcttaaaaaataagggctactgctggagttggaggcatttttttgggtctttgaaaaatgggggcagccctcatttaagtggggcttcaaaataaggcctattgttagatatgctctaagagcaaaaatagatttttacatacgggtcacttaaaggagccgcatacgaaaatggagaacgattttagcaagcgattagttacggtctgtctgaaatctattgggcccctcgtatagaaaaatcaaaatcgtttttacagtagtgataagatcagaagactctcaccttgatttaatctgctacgttaatcatcattactcgtgaaggcaagttcgcaagggccaagggcgctagggcaaggtgtggatgcagcgcgcgtgggcgtcagtgtcaccggtttgctgggtcgcgccatcgtcgtccactggtggagaaaccatctttggtcggtcgcccgaaatccacaattgtcccggttccattaacacggacaagcaatatcgtgtttagtcccgttggaggatccggaaggaagatttgatctttagtcccggttggtgttaccaaccgggactaaagatccgtgggatctttagtcccggttggtaacaccaaccgggactaaagatggatctttactcccggttgataatatcaac

SEQ ID NO: 54741 - DNA, 3593 bp, Oryza sativa
ctgcacccctgatctgtgaatgaatctatgaatcgatattgtgaatgaatctgtgatgttgtgaatgagtatgtggctcgatgttgtcaatgaacctttgaatcaatattgtgaatatatttgtgatgttgtgaatgaatatgtgaatggatattgtgaatgaatttgtggtgaatctgtgaatcgtgctgtggagttgtgatgtggatttggggtttgatttgatgatatgcataccactcgattcgggagaaaataaaaaagaaaaaaggactagctgatggactgccgctaccctctctttagtcccggttgatgacaccaaccggacatcaaccgggactaaagatcgatctttagtcccggttttttcacccgggactaaagatagcgatctttagtcccggtttgaaaaccgggactatagggggttacgaaccgggactaaaaagcacttctccaccagtggtcgttcctggtggttcgttggtgagtcctcgtgaagacgtgagataaaacagtctaacagagagcgaggttagaagcgagaagacgaaacgtacgttgcgttacactgcaccctcgacgcctcgatcaactgagtctcgactcgagatcgatgatagccgcggacctccctgacccctgtttctgacatactccctccgtttcaggttacaagacactttagctttagtcaaaatcaaattgttttaaatttggttaagtttgaagaaaaaacaataacattttcaacccaagacaaatttattatgaaaatatattcaattattgatttaatgcaattaacttgatattataaatattactatacttgtctataagtttagtcaaatttaaaatgctttaaatttgaccaaagttaaaaacgtcttaaaaacctaaaacggaaggagtagtaggctagcttgtaaattctgacatagtatgacacaacacgttaatatatattgtaagtacttccaccgatcttgaaatatatatggtaacttttgtgtatgtatatattttggccttttcggtcgattaggacggtgggcagggttgaggtttatagcagctcggcggggggctactagtgcagcacgacgggtgcacggataaggaacgccgatttggagttgtcgcgccgtcttgttggcgaggcatggagaggcaggagagactggagtcgggcaccgccgcctcgttccgggccacgccgtaggcgatcatcaggaggagcaccgccgccagaaccatcgcttccggcgcccgctgctgcgcagccactcctcgtcttttcaacatcgaacgcaggctcaccggcgagaacttgtgaacgaactccggcgtggcgccggccggtcgtccagtctgatttcttggctagaggtgcttattactggctagcactactctctctggtcattagtttgctacttatatatagaccctccggtatacatatataatgccggaccagctgctgcccggtttactggtctcgatccacaccaccatagcgtgacttttcttggttctagaaagattatgaccctgtttagatgggactaaaacttttaagtccctatcacatcagatgtttagacactaattataaatattaaacatgaactattaataaaacacatccataatcttggactaattcgcgagacgaatctattaagtctaattaatttatgattagcctatgtgatgctacagtaaatattctctaattatggattaattaggcttaaaaaatttgtctcgcaaattagctttcatttatgtaattagttctgtaagtagtctatatttaatactcgaaattagtgtcgaaatacagagactaaagttaagtccctagatcgaaacaccaccgtatactccctccatcccataatataaaggattttgagtttttgtttgtactgtttgaccactcgttttattcaaaaaattttggaattattttttttgacttactttattattcaatgtactttaagcacaacttttcgtttttatatttgcataaattttctgaataagacgagtggtcaaaaatgtaagaaaaactcaaaatcccttatattataggaagaagggagtactaataaaatttacctaattataaggtgacgaagaaacatccgcttgattcctttgatgtgataaacatgtacagccaaaacccaaccggtagaattttctacggctagttgtctctttttgtgtgactagcaggctgggtcgaagattgatggaatgtgaggttcatggaaagcccaaggtatacacgccagaacaaatgaacgattgaatggtgtgcatgcacgctatcctctatccattgtgcacctaatataatgcgtagtcatatttaacattatcttcaaaactaatattggacttcttagtttcttaaataatacgatatttgtatgaacaaaactacaacaatagaaaagtaaatttgagtcaattcagtgatattatttattaatattagactaatcattgatcaaaattcagatttaaatattaaaatacgtacacgccttaactatataaaaaagcgagtacattaatctccaatgagagctagtgtctgacgacgacccttcaacgcatcaaattaaatgaatgcaccttttaaatttctttttagtatgcgtgccaatatagtacatatattctaaattttcctttatcttgggaataagaaataccatatttttagggatggttgaaattgcagcatatggcaggccttgacggcggaggctactataaatcggacatccgatctattgcaaaagatcagatgcccacgtcagcatgacgtcatcaagcatgcatgcatgcaaaactattttaaaatatttttttctcttaaattatttatccaaatcatgatccgattacacgattaaattcgttgtaattaaatatttaaaacaagaccacacatggatatattccgatgaaaaaactagcttattattgaatcatttttaaatgttgcacgttgttccactaagtatatcagaattgtttcactaggtagataaaaaatgtttcaatcttttaagtcgagcgttgttttaccttatatgaaaacaatgtttcagcaaatagcgaaagaatgtttcaagtaactgcaatatttcatccatacaaagtgaaacattataagtacactaggtcaaacatttttggtggaacaacaaatgaacgaattcccttaatagagggtttccatcatatgtgggtgatttgttgcaaaaaaaatatttcaattcactgcaacattagatctatacatagtgaaacattgtgagtacactaggtgaaacatttttagtggaacaaaagaaatgaaacgaattcccttaatagagggtttccaaaatatgcaggtggttttcaaaatagcagccaacctcctttcgggcagctgtgagtggcatgcagcttgccagcttaaccggcgaaaaagaatgcaactgaaaggaaaagaaaggaaggagggaagagaaaacgggttttttcgggggggggggggtcatagtgacgctggc

SEQ ID NO: 54742 - DNA, 4340 bp, Oryza sativa
gtgagatcgccctttttgtgagttcggtcgggggaaagagcttgcctctagagatcgcgtatccgcccttaatgctactaagtcacgtatgagcgacaagattatacatgttcgggccgctatggagcgtaatacctactcctgtgtgtgggattaaggttgagtgttacaaaggctcctaaactccggagagggctctcgctcttcttctcctaaagttcaggcttgctgagagtcgtcccttttttcggtgggcaaggtcctccttttatagctcaaggggataccacatgcaccgcctctacctactttttcatgggagggggacccacttcaccttgtccgtgccacgatccgcgccttcgctcggaagctaagcagcagcctgtccttgagcgcgacccagcgccgcccctcgcctgacacgagggacaaccctgccatcccctcataaatgggtgaagacttgtggtggtcctcctctcgtggagggagctccgaatgacgctccgatgggacgggtcatacctacctccactccaccggatacagaggcgacgtgggggcacggccgcctgtccaatcggtcttgaccggcgatgggccggtcacatacttggtcagtcctgactgacgtgcgtcagtcaaatggcactgcaagtctgcccctaccgcattaaatgcggtgaggggcagttggggcgccgcgcgcattgatagcggttcagcctgggtcccctccccgctcgctccccctaccacatggcagttgggcgagggcctcggggcaaggcagcgcgagggcccgaggggcatgacgtggcaccccgagccccccctcctcggccacttctgcaattcgtgaggcgtgggggtagggccaggctgtagggccacgtggctggatgggccactttgcatacccctgggcccatatctccgacaccctttatcctaaattgtactcctatttttttgaatggacatgattgtcgacgtttgatgtctcgactacggtatttggacagtatggggatcgtcggtgctaggatatacgcgagactgaggtaaaagagatggagacaggaatttttatacaggttcgggcccctgagtggtcaggtaataaccctacatcctgttggccggagccggagttgcttttatttaccataaccacaccagtacaatatgtggggtagcctatctaactgttgtcgacatgtcggtctgaaggtctgactcgtagtcgacaacagggtagtcttcctcctcgaatccgtgcccggcgagatcagagatagcgctttcgtatctcctgacggtatccggaggaatcgtaggggaatagccatgcctatcctgaagtcgatatccggcggcatgtcttggcgtatgttggcttgtatgttgtggcttctggtgggcgtgtgttgattgtcatgggtgtcttccatggtctcgtggtggtcatcgatgaggtggtcatcccgatcgtggtgatcgtgttggtcgtctcatggtgagtctgtctgtccccctgtcctcctaggggggcttgtatttatacccataggtattgtcacgccctgaagttttcccccctttgcttgctttaaaaattggctaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttatcaattaaaaatcaccaaagtgcaattttaatcccaggaaaatcctttcttcttttctttttcctttttcctccttttttcctcttcttgggccgtcggcccagtccacccgtcgcccgcgctcggcctccccttgtgggccggcccgttctccttccccctctctccgggacgctgacaggtggggcccacctgtcaggtcgtccccttcctccagccacccgcctccaacggcaaccgccgccgaatccgccacgccgccgcctcctccgctctttccgcgcccacgccgcgccgctcccgcgtcctccccacgtcgccgcctcttcccccgcatctcccggcccgcgcgcgcgctcgagagggcgggattcgagttcgaatcccacccctctttctctctctcctccccacgtcgccggctaaatcgggagggttcccggccacgtcctcccctccctcgcccattaaatcactctcccgagctccctctctcgtttcccccatttgccgtcccctcccgtgcctcctaccgagcccgcgccgctcgccgctagcgccgccgcttgccgccgcctccggccgcacgctgccgtcgctagagccgtcgccacgccgcgcaatcaccgccgctagcttcgccgccgcgagagctacctcggccgccgcttcgttgccgcgaatcaccgccggagcgccgtctccctcgcgccgccggtgagctcgccatggtttccatctccggccatttctcctcgccgtgccgcggctcctctcttctccctaacccggtcatcgcctttcccaggttgtgctcgaccccgtccgccgttgtcggaagcgccggccgccgctcgtctcttcccacgccggtcaccgccatcgcctcggtgaggaatcccctctcctccttcctttcctctctctcccatgagcgccgccgccctccgcgcgtgcgccgtcgccttcgtctgccgccgccggtctgtgcgccgtccgccgccgcctcccgcgccgtcgcttgccgttgccggcgctcgcgcgccgccgccggtcatcgccggtgaccgcgcgtgtcaccaccggccgccatggctgccggtcggctttgaagccgagccgtgcctagccggctcccccgcgccgtccgatcgcctttgaggccgatccggaccgtcggtcctgtggaccggcggtggaccacccgcgtggtcccggtacacggtggaccggccaccttgtgccgctgacccatggggcccgcttgccagccgccccctctccctctcttagtgccgctgaccagtggggcccgcatgtcggtgccgccccaccccttgctgacgtcagccctggggcaatattgcgcaataattaattaaggacttttctttattagtaaaaacacagtttatcttctaaaattcataagtaattcatccgagctccgtttaagtccattcaagtctcagtaaatcaagaaaatgcaaagaatccattaaaaatggttttgtttcctgtttctgtagtcttatagcatgttttgcttgtgtgctttgtttgtcgcgtaggtttcggccgtttcgtcgatccacggtttctcgaagacgttgctgaggtctcgtcagtgcgagagcaaggcaagtcatgcaatacgtttgatcatattgtacccaatttacaaatatcccgcatttctattaaatgttgcatccttttacaatgtcatgtgggatgggtcctaatactcagccatttattgtttaccttatgccattgataacttgggtatcaaaatgactagatgttggtttaggaaatgcttagccatgcttagttcaactagcacacacatggggatcacattattacatagactttgactatgagcatagctttggattggtgccaccgcaatggtgttagttaattaaaatacattgaatggtgggctgtgggtgcatggttttgctggtccacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgattggttaatattgattaattactacagctgttta

SEQ ID NO: 54743 - DNA, 1805 bp, Oryza sativa
  unsure (1)..(1805): unsure at all n locations
tattgattaattactacagctgttttactgctttcaactactgctttgaaatgcctgctttatgcaaaagaacccctagcttcctttggttatatcatgcatcatacctcctcttccggtatgacttgctgagtacagtgggtagtactcagtcttgctctcttttcccccacagcagagctgaagatcttcctagttggagctgttttgtcaaagttggtttcgtcgctgccgtcaaggattgcctgtggagtggagtcgcccgctgctgaagtcaagcctcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaggtatccccttgtccaagtagaactagggcaaccaatatggatacaattcgagtagtccttgtcgtttccatgtagaactctggttgtctttccttatccggaactccctccataactgaagtcagtttccgtataggacatggtatgtggtgggtcctgccgagatttagtcaactactattaggtatgtggtatccataaccatacaatgatcttggagagtagagacaatagcagactataagccagctataaacatattttaaaaagataaaagaaaagagagaaaagcagcaggctagctgcagcacgaacatcaagacgtaatgtttatatgacaggtgagaccagatattaatagtatagtaagcaactattgtatgaattggctatatataatttaaagctagtagttggctattgcgctcgcatgccattcatttatagctctaataacttgaattgttgacaaaatctatgaaaaatatattgatctacaaattatacctttgactttatatatacatgatgctcaaaacacatgcataatccctacaaatcaaagaaaataggtcttatttacgtgtatatatatgtttttctcttacattacataaatctagttgggcggcccgcgcaattgcgcggctagcatcaatttaaaattatctattttttacacatgattttatttaaaattatcattcccgtgattccaacaattttatagattttaaaaggcacgccagtcgctaccccttacttctttgtcacctttttatttgcttgctcgatctaccactacttctatttattctctttggaacattagcccttatagttttagagtttttttgtcttgttgggtttcgttntcataaattttagaagtatcatcaaacatcgccaattttactactctatggcccgtccactgccacctctctttatcgtcattgggattttaaaaatcgataataattattgtttgtgttcttttttactttctataaatctcgccaaatctttagtggctttgccactgtactcccctgcaacgcgcccgctacctcccctccttattgtcattgagattttaaaaatcgaacatgattattattggggtttatttttactctctataagtcccgccaatcttcgtgaccatgctgcttaacggcatgcccatcattactcctcttaatcgtcattgggattctattgaggttttctttatagtttttaaatatcacatcaactattagcactctactcctttataggcctattgcttctcccctctttattatcattcgtcatcgttgtgttctagatggactttttttaaaa

SEQ ID NO: 54744 - DNA, 9756 bp, Oryza sativa
acaggaagcagcaagcctgagagggaaccatgttatagaatggcagaatattttgtcagtcactcttgatcactctagcaacagtcagaaagagtagtatgaatagtgatgtatgaattaaataaaggatgattatgttaccatggaaggataatactatggacaatgtaattaagcaacaaagcaggcaatattgtatccatgaaaagatatgtttacatttgagagctatctaatactgttgcctatcaacttgtctttcagatatttttacaaggaatctagtgtttttcaacttgttgcagatcaaggcgtgcaagtgaacttaatttgtttccttgtttgcatagtttttcacctatggatttattaaaaagagataattgcttatttgacgctcttttgtgttggaaatatagtcattaattggcatgttttaatccaaaaagttaaagcaataatcatggacaatcaaaacaaagacttttctaaactggacagtgggagtacatgtataagtgcaagtagatgtacctgtattttgtgtgccatagatcagtacgtagaaaacaaacccaacccagccgtacgttcttcaacatgcgatctgcttaccatctgatgcctctgctagccatgctactcatcctcgtccttgctgaccatacaagctccacggaagcagtagcaccggctgcgtgcctcccagaccaggcagcggcgctgctccagctgaaacgctccttcaacgccaccatcggtgactactctgccgccttccggtcatgggttgccgttgccggcgcagactgttgcagctgggacggcgtccggtgcggcggcgccggcggccgtgtcacctcgctcgacctgagccaccgtgatttgcaagccgcctcaggtcttgacgacgcactcttcagcctaacctcgctagaataccttgacctctcttccaacgacttcggcaagtcccagatgccagccacagggttcgagaagctcaccgggctcacccatcttgacctctccaacacaaacttcgccggcctggtacctgccggcatcggccgcctcaccagactctcctaccttgacctgtcgacaacattttttgtagaggagttggacgacgagtacagcatcacgtactactactcggacacaatggcacagctctcggagtcgagcttggagaccttgctcgcaaacctcaccaacctggaggagcttcgcctgggcatggtggtggtgaagaacatgtcgagcaacggcactgcacggtggtgcgacgccatggccaggtcctccccgaagctgagggtcattagcatgccgtactgctcactctccggtcccatttgccactcactctcagccttgcgatcacttgcagtgatagagctgcactacaatcatttatctggtccagttcctgggttcttggctactctctccaacctaagtgtccttcagctttcaaacaacaagtttgagggatggttccctcccatcatcttccagcacgagaaattaacaactattaacctcaccaaaaatcttggaatctccggaaatttgcctaatttctcaggtgagagtgtcttacagagtatatctgtcagcaacaccaacttctccggcacaattccaagttctatcagcaacctcaaatctctgaagaagttggctcttggagctagtggtttctctggagtgctgccatcctccatcggtaagatgaaatccttatctttactagaggtgtctgggttagatctagtaggatccataccatcatggatctcaaacctgacttctcttaatgttctcaagttcttcacttgtggattgtctggacccataccatcgtccatagggtacttaacaaaattgacaaaattggcactgtacaattgccagttttcaggcgagataccttcactgatcttaaatttgactaaattggaaaccctcctgctccattcaaacagttttgtcgggatagtggaactaacctcatactcaaaactgcaaaacctgtatgtcctgaatctttcaaacaataaactaattgtgatagatggagaaaataattcttctctagtgtcatatcccagtattagcttcttacgtctcgcatcttgcagcatatctagctttcctaacatcttgaggcatctcccttatattactagtcttgacctttcatataaccagatccaaggtgcaatacctcagtggacatgggagacatggacgatgaactttttcttgttgaacctatcacataataactttacgagtattggatccaatcctttacttcccctttacattgaatactttgatctcagtttcaacaattttgatggagcaataccagtaccacaacaaggaagtatcacacttgattactcaaccaaccgattctcatctatgcctatgcctcttaatttctctacttaccttatgaatacagtaattttcaaggtctccagaaatagcctctctggatacattccaccaacgatttgtgatgcaattaagagtttacaaattattgatctctcttataacaacttgactggatcaataccatcatgtctgatggaggatgtaggtgcactacaagtcttaaatctaaaaggaaataagcttgatggcgagttgcctgataatatcaaagaaggttgtgcattaagtgcattggattttagcgacaatctgattcaaggacagctacccagatctctagttgcttgcaggaatctggagatccttgacattggaaacaatcagattagtgattccttcccttgttggatgagtaaacttcctgtgcttcgagtcctggtcctccagtctaacaagttcattgggcaggtactggatccttcatatactagatacgggaataactgtcaatttacaagtttgcggattgccgacatagcctcaaacaacttcagtggcacgttgccagaagagtggtttaagatgcttaggtctatgatgtccagctctgataatggaacttcagtcatggaacatctctatccccgggagagggtacaagtttactgttgcagtcacatacaaaggcagtcacatgacattttccaagattttaacgtcacttgtactcatcgatgtctcaaacaataaattccatggtaacatccctgccggcattgaagaaacttgtgttacttcatgggctcaacatgtctcataacgtccttacaggaccaattcccactcaatttggcaaattagacaaccttgagacattagacctctcctcgaataagctttctggtgagatcccgcaggagctggcatcattgaacttcctttcaatattgaatttgtcttataatatgttggatggaaaaataccacaatcattacacttctccacattttccaatgactcttttgtggggaatattgggttgtgtggacctccgttgtctaaacaatgcggttatccaactgaaccaaacatgatgtcacacactgctgagaagaattccatagatgttctactctttctcttcacagcattggggtttggtatctgtttcggaattacaattctagtgatatggggaggccacaacaggaaacaaccttgtgagagagcaattttatacattggcagaatagtttggtagtgactcttggtcaacccagcaacatttagtaaactaatattaataatgaggcatgtatgagctaaataaagaagtgatatgttatcactgatatgtggttgttctaatttaagcaacaaagcagacagcattgtatgcatgaaaaagataattatgtctgagagctatgtagttctcaattgcagcatatttcacggcctccaagcacgcttagtatgacaagtgggctgcctagtcaaaaacctcagggtctaatggagttgcaattctctgataattccattcgttattgttgtagctaagtgaaatgtgtcgctaatgttgtagcaagatgatagttgtcattaaaattgcagctttttcaaacttattctttacaggtttcatattttgtatatgctgagctaacaaaaaaagtcacactgcagttcattagtttgggcaaataccctcacacgttctaggccatccgaactttacatatgtggtgtcattattttgaaataatgaatatagaaaaaggcataactactttttccttaaaagaaataaatcatgcagatggctcagtcccttcaacacgatcgttatattgaccatctgaggtaagacacaaactatttgtacatctacaaggttatatggttattaatgtaggagaacagtacctcttcggctctgtcatttcgtcgaacggttggcgggcgaaatcaatcaatgttgcagactacctttacacgcaccgaactaatcacggattcttctctaataaaactaattacatattctgatgctggaagatttctagtcacggggttaattactgcgatcgaactctaactgggattgcatacgaggaagaggaaaaatctggcggaaggcagcaagcaaaaggaattgaggattacctgaatggaaaaatcgctgccggaataccggagacaattcgtcgaggaggagacaaaagaagcgaagtcccgccggccgccgccgccgccgccaccgccaccgccggtcgccgccgccgctggcgttgcgtgtctgctcggttgaaattagttaggctggcacctgtaacgtgcatccaccgcccaagttttagatccaacggttcatgatctgtcacccgaatcaacgttaccaaacaattttgccaatgctatcttatcaaaactttggtagtttcgaaatttttatttcacaaaaataatattaaaatttgaaattgcaacaaactatacacatccagcgctaccaaaaaatggcaacgccaaaattgatttattaagaagttttccattttatattgtgctaaaatataaggatttctaccatccacagtactacttttctcatcaatcaccttatctctttttttctataaagctaatgcctactaaacacctaaatctcaacatacaacatactccctctatcccataatataagacatggtcaaagttgacatggtctccaaaactaatttttagcttataatttttcatatactaccaagtttataacaacaaaattataaccatatgaaagtaaatttaaatctcaatctaatgatataaattttaataaacaaaattcattttatattatactaagtgttggtaaaatgttttagaggttgaatattgaaatatgtgcacgtcttatattataggatggagggagtagtatttattagcattcctaaaatcaacatacgagcatgccacatcaacccactaagcacacaaagtttaacatacaagcaaacataatctacaacttatttaattctaaaactaaacatacacatgctaaatcatcattatcaaattattttcacaatatttcaatccaaaatcatttaatcatttctacaatatctcacatatatcccgcggcagagcacggttaatcatctaatatttaaaattcttctcattttatctctacctaccttcctacccccacatatctcttattaagggatattagagccttttcaaccttcatccatgctctttatattttaaaacaaactgacgtggttacatccatcgtatatccttgggatctgtccagatcggtgctattttaaaccatatattattgtttggtagaattataaatatataaaggcatttagtttgttatcaaatacgctgtccagattcgtagtattagaatacgtcacatcgacccaaaatcccttataatatgggacggatggagtattggtcagtctagagaatttaacaaatcacatttagtctattgtactaaaatttaataatgttggtaatttatcaaaattttggcaatgccaaattttaaaaagatgaaaatatctataaactgaactttcatccactgagaacacgctttcactataggaatatccgaagaattttcagggagatgccaaccgtctcccctttctacaaacacgagacgctttcactagcttttcaatatttgtcacatcaacaagtgtgaacacttagaatatgtaacaataaaccgtggtatcttctggagaatagtaacaaaatcgtttgcctctggagtcaagggctcaaggctgtaacatcgaagtgcttgtcaagaaagaaaaataaaccatagcactgatgatgatgagggcgacggatcggagaccacagctgccggcggatatacgagtgggcgctagaaccctgctccaagacccgaatattcatcgaaattatacttcaaaattttaagaaatagaacataaaatataaattttacgtagattatactatttaaactttagtcttgacaaaattctagctccgctgcacgcgcatgtcctcctccgtatccaactcaatatatgctatggtgcccactacagcatcgttaagtcgctatatatgcttcctatcttattaattttcttgtcagtatagtcgaataaagtattattttttatatgttgtatctaagacactactaaaaaatcctcatagggatcagtcttataggtgccggttcctttaaaaccgatacctataggccttttctcacctccacacgtggaaaaaaaaagaaccggcacctttaagacactataggtgcaggttcattagtaaaaagcggtaccaatactatatgtgtcagttttttaaaagaaccgacacatatgatatattataggtgccggtttattaaaaaaccgacatgtataatatgttataggtgccggttattttaccggcacctatacaaaacgacccgagcagacgagccgagcgccgtatgtcatccttatctactgccacccacgtcgtcgtgtccttatccacttgctctcgcaactcctctccctctcgcgtctctctgactctctccctctcgcgtctctctaaagacggagactacccggcggtggcggcggcctcccgaggcgggcggatgcccggcggaagcagcggctgcggcgccctcccctccgcccgatctagcgggaggggaggtggcggtctcccgcagctgtccggcggtggcggcgtgctcccgaggccagcggctgcccggaggtggtggtggctgccgcaccctcccctctgccagatccggtggaaggggaggcggcagtctcccgcggcccgacaaaggcggcagcggcagcggcgctcctccaccaccgccatcccggtgacccaagggcctcatagccgccgcatcatcctcaaggccgctgtggttcgagtgtgttcttttctctcaagttctcttgttcatatgtgtaccgagaatatgcggatttggatcggatgaatattatagttaaatggatgtaggaattgttgttgttattgacgtgttccttggattttgattttcgatgtgtggatattgttctgggatgtggaggggatcacgggatgtggaggttttttttttttttggctcgtgcagacgtaaaggtgccggttctattttacctattggtgccggtgctagcaataggtgccgaccaattggagccggacgggaaaccggtacctattgccagttcccaaccggcgccaataggttttttttactagcgacataatcagaccaatggaagttatttccgtggttattttcggttgttgccaatacaatacagaatcctctttgatcattattacgtgatatttatgataaaatctaataaaactttagaagcattaaccataatatattcgaattttaaaacaagaaaaatggtatggataaatttgctttgcaaaatacaatcataatatcataaagttttatagattttgtatttttattttaatataaattgatggtcaaagatttaaaagtttagccgaatattatttcaaacatcaaatatttatcaccggatatagtaccgactcataatattcttattgtctaggtctctctaacttgaggaagatcctcaccacagatacagaggtgcgcatcctatatatataccacaagaaaaaaaaatgaaggctaacctcaacttcatttggcagataaaaggaaaaataagtgcttagtaaacactgacaacatcaatgaagttgaggtttactccctccgtttcatattataagtcgctttgactctcttcctagtcaatttatttaaagtttacctaagcttataaaaaacataataacatttccaacataagacatatatatatatatattaccaaaatatattcaatgttatattaataaaattaatttagggttatagatgttgctaaattttatagaaatttagtcttaaaagaagtttgattaggaataaaataaaaatgacttataatatgaaacagatggatagattagttaatttcaaaattttgcatgcacatagagcgagttcacacccctacatccattagagcattgtaaatttctaggcctaatgaaaatatatgaaatttgcaaaacttctactatcatttttttttcatatcagtactagtatcatttaatttgacatgatatatatgacccaatataaaacgctgcagctctggttatggccctcactccgtcgagactcgaggcaaatcatgggaaaatcatgggcttaaagtgaattaaagtgattaaatccggtgaattaagtgaaattgaaagggaaatcatgggaaaaatgatgagagagtagtagggaatcgatttctataatcatttataggagggaatacataacgaggtatatcaacgtggcggcagtgctaaggctcagcccagagacaaaacaaaacaggcagataaacaaatcccttatcgcctgcgagaaaacgtaacataaaaaatagcgacgacagaaaaagatgaaaaaaaatggagaaaaagcaaaaaaattggaccgaagaaaagaaaattatagtggatggaaaaaaaaaggcgacgaaaaaatgtggacggtgaaaaatagaaaaaatggcgaaaaaaaggtggacgaaaaaagggaaaaagcgtacaaaataaagaaaaatggtgaaaaagggacggaaaaaaagaaaaaaaaaggacagacgaaaaaacctgaagccatacttattttttttattaggtatatgacggagctcgtggctcctcaccgggagaccgcgcaggcccccctttgccggttcggccgggggcttagggtgcaatctcaagctctctctgtatgtggaaagattactcgccggcaagacacacgagacacggcgatgtatacaggttcgggccgctgccaagcgtaataccctactcctgtgtttttgtggatttgtgtatgaatgagctacaaagtgtcagcccccttctcccctgttctaagctcttaatctcgaaaagaatcaacccacctttctatgggcaaggtcctccttttatacttcaaggggataccacatgcacccttctctttccaaactggactgttcttttctttatggacggagatcggtatggttgctgtccaaacgacacttcgatgggacagcttacacctaccttcactcccggcggagacgggcgcaacgtgagatcgtggctgcccgttgctgatgcgacca

SEQ ID NO: 54745 - DNA, 16546 bp, Oryza sativa
  unsure (1)..(16546): unsure at all n locations
ccctgctgtactgcgttgtacgcagcgtgacacgcttgaccagactgcaataaatgctgttagtgagcacagctgtgctcacttatcccatatatgtggcgcagacttctttaaggggtcggggtgcctcggccctcggggccggggcaagcgcaacccgaccccccccctcgggggaaatcacgaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatctcccttcccaagggaagcggtcaggtgtgacgccacccctaaagcctagtgacaggtgggaccggtctccgtagttgggcaaaatacccaacggtctcaatccatgcacattggtattggtaactttggttgtccatactgggcggtctattcaagactgccacatcacttgagcagcgcgcgaatctgggtgagcagatttgtttcgctcggagatacggtaacgccgcttcggtcggcgagcgtaattaacgcgcgcacgatacaatccgtttcgattgccacaaccgcatatccacttcacgcgccgtaaacgggcgaatgggattagtggaagcgtgggtgcgggaaacgagggagcgagatagcgagatacgagggagcgaagtagtgggcgcgagaaacgaggagccaggcccagcgatggcaagggtataaaagcatcgagaaaaggatttgctcccttcctttcgccattgttcctcttgcctttgccgcttaagctctaactctttccctgctacgccctactttcgccacacacgctcgttcccaatcatctcttcctccaccgccatggcacggggctctgctctgctcgacggcagtgtgctgccgccttcccgcatcgtgaacgagaggcacgccggactgccgcgccgcttcatgccggagtccgccaccggtcgggagatagtgatgctgggagaggggcgcccggcaccagactacccggggcggtccatcttcttcctccccttcgcgatggctgggctggtcccgccattttctcattttttcatggatgttctggagttctacgatctccagatggcgcacctcacccccaatgcggtgatgacactggccatcttcgcgcacctgtgcgagatgttcattggggtgcgcccctctcttcagctgttccggtggttcttcaccgtgcagtcggtgtctccgccgtcggtggttggcggctgctacttccagccgcgggggccggtgctgaaccgctatatcccctgcgtcctccgcaagaagtgggacgactggaagagcgactggttctacaccccccttgccgacgaagcgcgcctccgccttccaagccagcccccggcgcaggtctccagctggcgggcgccggtagatctgggggaggagtacgacgccgtcctcgaccgcctggcgggcctgcgatcccaggggctcaccggggccatggtgttcggcgattacctccgtcgccggattgcgccgctccaacggcgcgcccggagcgcctgggagtacactgggcctgaagactacatgcggacccaccagggagccagatgggattgggctcctgaggacttcaagatcgtagtccaaagggtgctgaaccttagctccgcggaggcgtctcgccttcctcaggagatcctccccctctgcattgatcccgaccgcgtctccattctatccattatgttgggggtcggggcctcagaggagagagcccctaagggccacgacggcgcgggcgagagccgccgggggaaacaatctgccccaggagggggtcgtgcttctgggcctcgcgtcgggggcccggggagcagccgccctgccgacgcccaggggaagaggaagctgggaggaacacctcccccatctcctccccgagggggcggggcggtgcgtaccagcggtcggcgcccggagggggccgcgccgacgtctcagcccgagggggagcgcaagaagaagcggctccgcaagatgggggagacggaaccagcccggggaaacctaatttcccccccaaggtggtcattcaaccgaccccctcgcaggttcgtctcactctcattgcaaccatctttctccaaaaagaagttttttcttgctcactttgttcgtcttctggctttttcttctgcttcagcgatgtcccgtcgcattcctcccgccaccccaagtccggccagtccgaggccgaagatccagtggccgcagaggagcggaggcgagagtctgaccggcgcgaagccgcagaccgccttcgggaagctgaagaggccgcccgggaggccgcccgggttcgccaagcggaggaagctgctcgggaggaagccgcccgagcccgccaagccgaagaagctgcccgggaggaggccgcccgggctcgccaggctgaggcgacagcgtcacttgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgccttttctccaaggcggcttttctcctcctcttccgtcgccccggtgagcgccgagcccattatgcaggccttggccgccgcaaacaccgcggtgctagatggattagcgcccaggtggaggccttgcgagcggaacgagcggagctcgagnccgcatgggcgcgcgtcgaggaggggcggcgctcggtggacgccatggtggaggtgggccgtaaggctcaccgccgccacatctcggagctcgaagcccgcaaggcggcgctggcggagattgcccgagaggtggaggaggagcgagaggccgccctcgtcgccaccaccgcgatggtcgaggcgcaagacaccctccgtcttcagcacgcaagctgggaggcggagctgaagagcaagctcgacgccgcccaaggggttctcgactccgccgctgcccgagagcggcgggcaacggaagccgaagcggcgtcccggcggcgcgaggaggcccttgaggcccgtgccatggcgctggaagaacatgccggcgccgtggagaggggcttgacggaccgcgaggccgccactgctctccgggaggcgacgctggcggcgcacgaggccgcctgcgccgaggaggagtccgcgctccgccttcgcgaggatgcactcgccgagcgggagcgggctctcgaggaggccgaggctacgaccaaacggctggcggacagcctatcccttcgcgaggcggcgcaggaggagcaggcgcgccgcaatcttgaatgcgtccgcgccgagagagccgcgctggagcagcgggctgctggcctcgaggcgcgggagaaggagctagacgcgagggcgtctatcggcggggcggccgcgggcgaaagcggcttagccgcccgcctcgcagctgccgaacacaccgtcgcggagatgcagcgagcgctggactcctccaccggggaggccgaggcccttcgcttggcgggcgagattgggcccgacatgctttgggatgcggtctcccgcatgaagcgcgccggtcggcaagcgggcctctggggaggccagacgtcggtgccccccaccaatctggaaggcctcgctccgcacctcaacaggatggcttgggttctcgagcaactccccgaggagctcgagaagaccatcaaggcatcctcgagggacctcgcccggggggcggtcgaactcgtgctagcgagttaccaggcccgggaccccaatttctctccctggatggcgctggaggagttccctcccgggaccgaggatgacgcgcgcgcgcgggtcggggatgctgccgaccacattgtcaacggcttcgagggctcggcccctcggctcgcgttcgcccccagttccgacgaggagggcgacgccagcggcgaggacgacggtggcgacgaggccagcgacccgggtgcatttgaatgagcccccaggcccccgccaatctttacttttttttctttttctttcttctaaggccttcatgcctcttttgtgtatagatcaacttaatctgcaatcaaaaatgatgaaaaattttctatgttaactttattttgctatgcatatgagttgaggatgatctgtgccatggtccttttgcgccttagcttgaaataagggctcgcgcccaagtcccggtcctcgaatggctcgggtcggggctagtgcctggggagatccacatgtcgagactggccaggccgggaacgtggtgaccgagggttatgggtgacccgattgtgggtttctgccgattcccccccggagttcaccacgccccggggcacggctcggttctgggcccgtttggcgattttagctgaccgaaccgaacccccgagggcaaggttgagtacaagtgaccttattttaagtcaagatccttcaaaaggaaagaacagcacagacacaacctttaggaaattgaaactgcttttattgaaatgctgaaaggaatatatgtgcatgtgtggtagcccccggctaaccccgcacacccgaggggggtgcggggttggccggagccaaaacctgacacccgaccccccctcttcgcgggtagaagcgagcagggtgttcaatgttccacgggtttggcagctccgtgccgtcgcccgtggccagctgtaccgagcccggccgggggacaccgatcagtcgatacggaccctcccacattggtgagagcttgctcaatccagcgcgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcaaggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacgattaggtactcaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccaggacagcggtatgatctgcagggcctgggccggctgatggatttgcttggcgtggaactgacacgctctgcatcgccggaccagatcgactgcgtcattgagagccgtccggccaataaaatccttgacgaaaggccttgccaaccagggtacgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgtggtcctcaggtagagtcttatctgtgaggtatgtttggatctcagagatccaagcaatcaatctaagggagcttggaacgctctcttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccttgagagttcgtcggctatcatgttatcccttctaggtacatgccgaagttctatcccatcgaaatggcgctccatacgccgcacttggcgtacgtaggcgtccatctgtgggtcagagcaccggtactccttacagacctggttaacgactagctgggagtcgcctaataccaagaggcggcggatccccagtccagctgccactctgagtccggcaaggagtccctcgtactctgccatattgttagtcgctcgaaagtcgagacggaccaagtatctgaggacgtctccgtttggagaggtcaacgtgacccctgcaccggcgccctggagagacagagaaccgtcgaactgcatcacccagtgggcggtttgaggcagctgtgaggggttcgtgctggcctcgggcattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacccttcggtggggccgttcctctctgctaggggccgtacccccggggcgttcttcgtccaagtggcccctcggggcgcagtcgtcttctgtgccgatgacctcggggtcggaggacgacaggagcggccttcccacagtggcctcggggccgtcctgggggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcaaagggcgttaagtgcggccttcccgcagtggcctcggggccttcctgagggtcgggggcacccagcaccgtctgacaagcgggcagagggccgtctccggtcgtcaggggccttaggccaccgtttgactcggggacctttcctccctgcttgctcccgggccaagtcggcacagagtgggggtgcgcagaatgaggattgtcctcatcgcgctccacaaccaacgctgcactaactacttggggggtcgctgctaagtaaagtaacagggactcatttggctccggggcgactagaaccgggggagagctaagatacgcctttaactgagtaagggcatgttcagcttcctccgtccaagtgaacggccccgaacgcttgaggagcttaaacaagggtagcgccttttctcccagccttgatatgaaacgacttagggcggccatgcaaccggtgacgcattgcacatccctaagtttgctggggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaggtttccgctagatctgaaagtaaagtttcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatgataaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccgggtggatgacttcacggatgaatccggcctccagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacatcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtccgcgcgctgctccatacaagcgagcgcgactttaaggtcgccacggacagagatagggccaccggggcccggcatcttcatctggaggtaggcatagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcaatctgccctccccgggcaacacacggtgggtggtcggtctgatcaaaggtgaggaccacctccgaccaccgcgcccgacgtgtcgcctcatgagtaggggccatggccagaagctctcgcttcatagccttgaagctccggcgagagacgtgagcacacgcccctccatcaacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaaatttttgactgcgcgacagtccgctagatcgtggagggaggtgttgtggacggagcaccacctgccggcggggcgctccctgctgggagtaccagcctctttctttttgtcgctcgcaggcctcccctttcgggtggcccgcggagcgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctctttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatggtattgcggacttggcaaaaccgctgaatgtacgagcgaagcgactcatcatcgccccgctgtactgcatgcaagtccgcttcttcgcctgggcgaggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccggccgggggcacggagggctgatcctcacgtccatgtcgaggtgacactctggacgaggaggcgccctccgttgcacggggagtacgccggttattgcgccggcgctcgatgtcgaggcgggcatccggctccccacgctgatcctcccgagtcgacggtgtcgacgagggagtggcagccgaatgacgtgcagccgccgccgctcgccgcgccctccgccttgacgacacggagccggtggtagcggcgccggaggtgttggtggtggcgatccgtccaccagcacccaggcgctgctgtgcagtcatgaccaagttggccacatcttccagccatcgttgggctggagactccgggtcatggacgacaggtgggtgtcgtaggagcgcgccagcagcctgaagcgcaccctgaggcgtgctgccgtcgccgtagacgaggaggcggcgctccccatcttgccgtcctcctgcaccacctgcgactggtgatgccatggacttgtcgaccttctcaagcgcctccccctgcttagggcttcggcgcggaggagatgggggagtacgagctcgacggcgtggattcggctccccgtcgtcgccactcacactcggagagaggtcgtgcgcctttgcttgctcggccattaggctgaacaagggaaacttggcgcctacggaagagtctgagagctcagaaaacacacgctgagcccccctacctggcgcgccagatgacggagctcgtggctcctcaccgggagaccgcgcaggcccccctttgccggttcggccgggggcttagggtgcaatctcaagctctctctgtatgtggaaagattactcgccggcaagacacacgagacacggcgatgtatacaggttcgggccgctgccaagcgtaataccctactcctgtgtttttgtggatttgtgtatgaatgagctacaaagtgtcagcccccttctcccctgttctaagctcttaatctcgaaaagaatcaacccacctttctatgggcaaggtcctccttttatacttcaaggggataccacatgcacccttctctttccaaactagactgttcttttctttatggacggagatcggtatggttgctgtccaaacgacacttcgatgggacagctcacacctaccccactcccggcggagacgggcgcaacgtgagatcgtggctgcccgttgctgatgcgaccagtgtcagatcggtcattcttgtccaccacgcgtcagtttaacaacgtgcatgtttgcccttcttcgtgtaacaccttgcctgtatggttaggatgaagcctggtataaatctaaccagggctaacgtgccatctctaagagataacacgctagctccggcttgagacgagttgccttgaggctttcgtcttgacgggatggggcgaggcgtgcgtcagaccgcagtcgccacctaacccttgatctgaccggtctgtgactggtcacagaccggataaaagagcgtgctgtactgcgttgtacgcagcgtgacacgcttgaccagactgcaataaatgcggttaggtgagcacagctgtgctcacttatcccatatatgtggcgcagacttctttaaggggtcggggtgcctcggccctcggggccggggcaagcgcaacccgaccccccccctcgggggaaatcacgaggagggcggacacctcaccctcgggcccgacgtccccgaaggtgccaggccacgtgggcgattgcgtctgcctcaagcctctggtcatgatactcccggtcccatatcaccgacagtatacataagcgaagagtgatgcctgatttcgtaagcatgttttttaaattactaaacgacgcattccgtacgaaaattttctatatgaaagtcgcttttaaaatatcaaacatatttatctgttaagtttataataattaaaacttaattaattatgtgctaatagttttctcattttacgtgctctaacttaatctttattcttatgagttttaaacaccaccaaatccaaatccaaatggagacttccctgatacgaccgcgacactcgtaatattcttattccctaatacgcattaccgagacttccctcatgttagccgtccaaatcctaatgcgtagtatagtcatacgccttcagacttcaattggttggacttgaaccgacgaattgaaattatccagttggatttcacccctctttgaccatgcgaatatatattgtgcgataaaaaataatactggtaaaagttacgatgagagcgagatgactgcctcaattgaaagaagggttgttatcatacgtgtccgcttaagaacgaagtaggagtaaagtgagattgtgacgtacttgcgcagtttcttattacggagtaagtgaaatcatttacttttgtgataacattgattatttatcgtattaaaaagtttttgttggacttattttatcattaaaaagttttaaacatgacatatattttgaatatttacattatattttaaaataaaataattatcacacgttaggaaaaaacaaaacaacattcaactacatactatacgttcccactggcatccagtgccactggaccagtcgcatcccgtagaagtagaaggtatttataatctttgagactttgacgttgatgccggctataattttcgaaataaaaaaaccgggaaaaaaaatctccgatctgcgatactcgtggagctcggggaggtgccaccaccatcaggtggagctccggtaggaagacaaacatcgccgccccagttcacaccataggagattttctttcgtgggcttcaccacgcccgccgcggcatcgccgagctttcgactgcagcttcaccgtggcatcatcggatctgaagcgccgacctcctccctcccgccgcagccacggcccctctgaagtcgaagatgtcaatacttaaaaaaaaaaatgatggtgaccaaaacacgtttacactgacgggcagatgctccgtctgcattctccggccaatgaaaatcatgtattttcacaagcgagtggacgactgcctgttaaaatcgatcttcacgggtggctaaattatactgctcgccagcgaaaatcgttccagcgctaaaaaaaaacaatcacagcggacggagcggcgttgctccgtctgcatctacagtcgcagccgctcctcgatctgccagatcatatccaatccagtgtaattattctcaaatccacaaatgtgaatcccaaattgctaaatccacatagcaccataatttatagcatttacaagtttcacaaatttacaaatcagtaacagaaaaacgagagacaagacttacaacattcaaaaatttccaagctacattgaggccctgtttagttcaccaaaaagttttcgcaaaaacatcacatcgaatctttggacacatatatggagcattaaatataaagaaaaagaaaaactaattgcacatatagggaggaaatcgcaagacgaatcttttaagcctaattagtccatgattagccataagtgctacagtacccacatgtgctaatgactgcttaattatgctcaaaagattcgtctcacagtttccaggcgagctatgaaattagtttttttattcgtgtccgaaaacccatccgacatccggtcaaacgtctgatgtgacacccaaaaaatttcatttcaccaacaaaacaggacctaaacagcaaacaaagatctgcaagcttcctcagccacagcaacaacgatcttgtcatctcctgtgagatagatcaccaacccatgcatccatgaattggaaacaaaaactaggaaatgaggacgggagggtacatatacttggactggggaagggaagggagatggagtggaggaaccgcgtcgctagatttgatgcttcaccgcgctagagggatcgaggagccaacaatcgtcgattggatccgcttgccgccacctcccacagctagatctagcccttccatggccggatccgtcaccttcaccatcgcagcccatacctttgtcgccgctagtcgccacagcccttacctccccctttaccaccacagcttgccagatctgggagagggaggggacgtgatcgagttgagtggaggagaaccgtgccgccccctctttggtcgccgcccaacttccctctggctagatctaggagagggaggggggtagggagggtcgccgccactatttgttgttgtcaccaccgccgttgctgtcgcgctgctagcgctgccacctacaccgtccttccctctagccaaatctagggaagggaggggagggctaccgctggcttgatttggaggagagtggaggggatcgaggagaggagaggggaggtgagaggggtggcaggctaagagaggtggaggacttgggtgcacagttattaggaccggatcggaccggaaaaaactggaaccagagcctccaccggtctggtccagttaaaagaccgcatgtgcaagtgaactggtaaaaactggttggagctcagagggcaggtgctaggtaggattcgaacccacgatgggttgattggaagcacatcacaccaaccacgaagtcatgcttgtgtttatgtatgaggcaaatcagttatatatttaaacttctaaaccgccttaaaccaacagtccaaccggtcaaaccaatgaaccatcgaactgagggccttgccagttcaacaaccagtctggtctcaataactatgcttgggtggggagaagtcgggtgcactttcttttttaattcttcgagtgcgctcgctcgatgtctgaatttttttaaagcctccttccctttttgcacgcagatgtcttgcttttcgtaggtggggcttgaacttagggaccatttgttatttttacatgtgggatttttgggtccatctagaaaaataaaacccatgtgttatgaaaaatcgtgtgcgtcgtcatcagggttaggcgctttggatgatacaaatcgcactgccgcgacgacgacttgacgggggagagcaggcgttgtagtacatcgacgtcatagtcttgctcgttgttgaggtcttcgtcgtcccccacgccatccataccattgaggtctaaggcacgtataacaagtttaactagaaaaaagttaaagtaaacagacgaagatgaactaaatgattttgactatatatttgcatagctaaatattttatgggagagaaagagagtaccgtttaatgtgaatggaatatattgagccatatatagcgacatataaatacattcaactttgactagtaattaaacaaatataatatgtatgtttagtgtcacatcttatattttggaatatatagagtatatgatttagattttaaaccgttgttactataagatggaaactaatcacatcttatagtaagtcatatataacaatcggaacctataacatttatgccatattttaacatcttccggtagtctagcatttaagcgtgagatatatagacgcttaagactgaagtagaaatcggaaaaagcgctcaatgatgataatccttcctgctgatgtagaagttgtggtcatggctacagctagtcgttcactgcatcatcacggcaagtgcggtatacgacacaccaagcgcgaagagatagcgagagcgggcgtaggttgagaagccaacaagcatgaacgcatgatggtgttctgagtggatgagtgacttgtgacttgtatgtgtgtggtataggggacagcagacacaacatcaaaaataaattataaataaaataaaattaaaaaaaatctacagtgacgagtgccgaagatatgtatgcattgatgtcggatagtgtcgctgatcaactactttctctattccaccaaaaaaaaccctaatatcggacaatactctctctatttcgtaaaaaaaaaatctgatgggacatccagtactagatttgtcttttgaagacggagcgagtagtcaagttaagcacgtcttcaatctcagccttttatgaagttccatcacctcactgaacttctaatcgtcacaagcaactagcaagcaccttacggttggtgctcatgacatcctcttgctctgctgtacttctttcgtcttagaaaaaaaaactacttttgagtttgaatttgaacatagtttatgttcaaattcaataagtttttataacggacggatggaccacacagatgacttcttcagagatccggtta

SEQ ID NO: 54746 - DNA, 3839 bp, Oryza sativa
attcgttgctgtcagttaattttcttcatttttggtggtcagttcaagcctgcagtagtagaattagattggttcatgttgtttagttaagagaaaccaattgtatcatgctgctctgatctgaatagatggttgtgttcaacacctagtcaactaccattagcaatttatcataaatcagcccgtacggtatttgcttttgtaatgcagccagtgggcatcgatgctgattcatgatttgtaccaccagcttctgttaaccttgtattgtgccacgtggaagcctcataaccataggcatattcaactcctgttgttctaattgtctaagagaattaacaaaattaaaatcatgatagagccgcttgttgcttaattcttgcaaatatcttgccttctaagtcatggaataacatgcattttacatcatgaaaattctcagttattcattaccaaaccaatataatgatggcttgctactgttttcttgggagacaaaacaatgccagggcaattttagtttcaatatttctaaataccgtacggtctgattaatttatgataaatatgttgtcccagcagagaccaatgcatagaagttaatgctttttttacttttcggatgttgctttcctctggactaaatttctgagcctcactaatcacactaaatttgctattgcaaatgttccccttgtattgtactgattccattgtacttgttccgtttaattgcacatgctatgttgatatattactttaactagatgacaaaaataaaatgttaacatatggtgcggttctgaaagaaagacatttggaatagatgcaaggtttattgacaagtttctattttctgttgcctctgtatttaatcaattcttgaagcctctggggatgccacggaggcatttgaagatgtggggcacagcacatcagccatcagcatgatgaacaactacttgattggaagcatcaaggactatgtgcctcctagtgcatcagaggctacaaccattggcggcaatgatgtgccgccaaacttcagaaggatgccacagaagaaaggacctcctgctcccaacacctttctggacttcctgctccctctgtttgtgctcggccttgcctttgccgcttggtactacctgaccttcattgccaaggcctagtaaatttggtgaaggtttgaagtattgaacattttactatgccacgtctgcttcagcgacacatggagatatattctggtcagttctaagttttattatgaggtttctggctgtgaattagaaatgtcatcgtattattatttgttaccaaattgttggctttgcttcgaagttggtaccactcttacatgtaaatggcgatggctgcatcagtaaaatgtatggatggggcattttccctttcgctatcaatgtctctacgtatttgcaatgctgttctcaaagtccccagtgatccagttacttttgcctgtacactgaaatcacaaattctcaaggatgtactgactactgagtggctatctggataatcatgtctaacatggaaagaagtactaatgcaagtgaaaataagcaactttgatgaattttgagctgtaggatggtattactgtttttctatatttcaatgcatggattgctatttgaacatattatatatccaaaattttttgctagacaatatgtgaaagagcatctagcaatctataatacttgatttaaattttacaaagtcttgtaagggagatttgaaaagaaggtgagactcatttctctttcacctataaccagattggccataactatatcaaaccaagacatgaattcttccttagtacacaaccatcaaaaaattcataatctaagtagatattaagttttttttaacctatctatcatgttttcgtttgttagttggaacagtagtaactgcattcagaaacaaagaaacttattataaaattctccttgccatttgatttcataggtaccggctgatgactgattgttacttgatgtaccaacgttagagaacaaaactaaatgtccaaactccaaactaacaaaccaatcatctcatttcaacacaaaatcgcaatgcaatgaaattttccccagctgaccttgacacggtcatgtaagtttcttggtttataatacatcaagtggcagggttagctcaaaatataacaccaatgcttccattgcctattttctgttcttttcctaagtagctggatcctgaacgacaggaaaatgatattttataagtgaaccagattctccatgaatttcatgacaccataagcaatctattatcattccctccatatcattcaggtcaaccgtataaattagggagaaacagaacatataaaagatagacatcttatagaacatttgttgttcttttcattaattgcaaactttcaatcaaagtattttcagtaccttatacgctgtcaatgaactgtgctgcttaccttcaaatctagagctgtcaaaatcactattaaataactcgcacataattaaacaacaaactttacatggggatgacactattaaacaaaatcttcttttacataatgattataaaatcatgtactagtatatatgtttcaaataatttgcttgcttaatcttctaaactgggcattagccaatgaaatatatcttgatgtatcacacaatatatacctgaagtccttaaccacacccaaaatttcaagaaacccatttgatatcaaaaatggatgggctcgtccccttgatcttcaaggtgctcaagaagaagaaggccatgaggtactaccgctccctctgttggaattaatgaatgggccttagcccactcgaagattaattctttggaaaatcacaaaagcccacctcatgggatggcatgcatgtggagtttagtaccaccttgcttattctaggagagggggacctccttaaaaggaaggatgccctcctagccacttgaagcatgtgtggtggagagaagaggggaaacacgcgcgcgctcgctcgcctcgcctggccgggcaggcggcgcgcgcgtgcacgatgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcatggagtccggataagttacgcgcgacttatctggttcggttacgcgcagtagagatcgtgcgggcgccctgatcaagcgacccgtctctatataaaccgacctgccgtcttcacgcaacacatgcgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgtttgttcgcgacggctcgccttcctcttcgctcgcgtgtttcgtgccttcgtagacacctgcgaaaagtttcgaccaagcagccggtctttccgtcacctcggtacgtgttcaatatgttgcgcatatttgatttgttcatgttatactgtgtagtttacatgtatagatctaatgatgcgttcatgctagttttcttctgtaatgtcatgatttatttatggaatagattaaatcattatatgtctataatctcaacaatccaaaaaccttattataggcactgtgattttactatggctg

SEQ ID NO: 54747 - DNA, 1089 bp, Oryza sativa
tgagtactggcaaacctgaagagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaaggaactcgaactccttaagtgtgtcttacccgacaaatttgtggccgggtgtattattgcaaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacatcaatcctaatcaggatgagaggacttgctttgtgtgtggccaagttggtcatctggctaggaagtgtctacagtgcaaggggatgaaggcacctgcagggcagacttctaagtctgctaatgtgaccattggcaacactggagatggaagcgggtatggtatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgataggaatcttgttagtggctcccgtctgactagagacggatttaagttggtttttgagtctaataaagtagtcgtgtctaaacatggatattttattggtaaa

SEQ ID NO: 54748 - DNA, 719 bp, Oryza sativa
aggttgtgcattaagtgcattagacttcagcggcaatatgattcaaggacagctaccaagatctttggttgcctgtaggaatctggagatccttgacatcggcaacaatcaaattagtgaccacttcccatgttggatgagtaaacttcctgaacttcaagtcttggtcctcaagtctaacaagttccatgggaaaataatggatcctttgtataccagagatggaaacaactgtcaattttccatgttgcggattgctgacatagcctcaaacaacttcagtggcacattgccagaagagttgtttaagatgctcaagtccatgatgaccaggtcagataacgagactttagtcatggaacatcagtattcccacggccagacataccagtttactgctgcactcacatacaaaggcaatgacataacaatttccaagatcttgagatcacttgtgctcattgatgtctcaaataatgaattcgatggtagcatcccttcaagcattggggaacttgcgttgcttcatggactcaacatgtctcataacatgcttacagggccaattccaactcagtttgacaatttgaacaaccttgagtcgttggacctctcctcaaataagctttctggtgagattccacaagagctagcatcgttgaacttccttgacattgaatttgtcctataatatgttggctggaagaataccacaatcg

SEQ ID NO: 54749 - DNA, 740 bp, Oryza sativa
cgctggccgcctcatcctccgccatggcctccaccaccactcactcgctcctcccgctctccggttcaacctgcgaggttgcggaaggaagaagacgacgctgaggtgagctgaggtgaggcgagtggagtggaggtaggaggaggaaatcttggaggtagaaagagctcacccgagctcagctgagcaggagcacgccaagagagccgccgctggagctgaagctcaggtgtgtggtggttggtcgctggttggtggtggtggtggtcggagacgacgacacgttcggccgtcgcggaaggaatgggccgggcccttcttgggcctcaaacatgggccgccttcttgggcctcaaacattctgttgagcttccatgcttaactcttttttttttattacacgtcatatgcgcgcacacgtatcactacgcatgccaatgaatacaccctcctaaccatgctcaaagagtccgaaatcagcggcatattcttgctctcactaaaacccattgaaagtccatttacatttgcgtaatactcgtgagcattaggatttaaaccatggtgggtggattcatgtatccacaacttcaacacatattactggtgcttccctaagttttttttttattacgttcattctttttctgaatgatcaagttattctgaatccagtaaatattggaggggagtagaaacaactgaatttagtgaaaaagaaacctatcttgcttgtcatt

SEQ ID NO: 54750 - DNA, 10244 bp, Oryza sativa
accaaaaatatgaagaatcattgcttagctcctagaaacaaccacatccgaagtgtataccttctggcttatctcgctctcaaaacaggaggctacagcgtcttcgagccataggtcaaaaagaaaaggaggccgaagatgtggagaataaaatatgtaataatttagagcctcgaacgacacctaagcgagtgtggagacctaaagaagtaaaaagtaagagatcggtgatttcccaaagtagggataaatccaatttgatgagagaagaatcatcggtcattagagataagtctccttcacatgatgcaatggatgttggtgcggtgttcgtcttgcctttgaaatcgtgcaatcaagaaagccgattttgcttggggggcaagacattatatgctcatgagggaaccaagagaagatgaatggcgatggatatgacatcacatctttgagccaccgtttgtcggatgctaaggcaaggtatgggtttattgtgttcaacattatattatatgcctatgccatgttagaacattgcttgctatctagcacatgtgtgttttgcttatcaaattgatattatacatacatgttgcaaatgccagttctaggtagtagaattggtaggttggcatataatttgtttgaagtatgatttggctcatgactctttgatatttatttaaagccaaatcatatgtgtttttatggatcaccatgtaagatatagatttcatatttattgcaccatgaaagttttgcttactcgtaattcggctaatgtcaatggtcaatgtgatgatttgctctagagtggttttctttaggaacattggcattgttaatattttacatacatgctcaagctgattacttacatttgtagtttattggaatctgtacatgtgacacatatgactttggtgattcattattgattatacttcaattggctaagtgttttgatgtcatgatgattattgtttcaaaagccaattgaattagtattcatctagacatattagttgaatgttataatttttcatatgtctagagagaagaagttttggtccaataatttgatgcaccaagcatctggctattatgtgaagaaaaattatatactaaaggccgatgcttgatttcaaaagtttggacgaaattggcaaagtcatagaccaggggtggtctgaccggcattgcacagcggtctgaccggtggtacctgcggtctgaccggctctgcatggccggtctgaccgggcagacagggtggtctgaccggcattgcgtggccggtctgaccaatcccgggcagagagctggggggcacgttacaattgatttaaagaccggattaattgtgaattcggatatttgtgcccataagtcagaaatagattggagaatccctttgaatagaatatttgaaaggtcctagtcttggggttgatcggaagattctgtggtaagcgttcaaatattatatcgccgaaatatagatggagtgctattgatgtgtttagacaatgatcaatctaaagttgctaggggagatgtgcatgaagggatttgtggagttcatcaatcggcccataagatgaattggttgcttagaagagtggaattctattggccgaaagtaattgatgattatttcaagtgctacagagggagtgaaacttgtcaatggatcggcaatgttcatttggcgcatgtcgctatattgaatcctatcatcaaaccatggccgttccgaggtagggctttggttttcattggtcagatttatccatcgttatcaaaagggcattggtttgtgctagttgcaatggattacttcactaagtgggccgaagccgtgccgctcgagaatattacttgtacgaagttgaggtaaatcttggctctcttcggtatttcaagcaagacgacttgtcggttggagattacaagaccttgatgggaattttgaagacgtcatcgacaagcgtttgaagactttgaaggaatgaagatgcttcaagatggtgttttcagagagcaattaatgggaaatacttgaagaaatacttcccgagcatttggcaaaatgcttaggaagtcctatggccggtaattggattatcgccctaagacaacatgttctatgcttttagaatcacgatgttcatcaaaaaggcaggggggcatgtgtttacacccaaatttggcacctatggacgaaatagaggaaaattgccaaagtttggaaagtgctgggtttccttcacagggtcggtcagaccgcaggtgtatgggcggtctgaccggctagtagggccggtctgaccgcaggttcgtcgggtctcgggtttcctttctcgggaaggcatgtttcgtgtttcctttggtttctatcctgagttggacgtggagaagggcctgtagagggcaagaccaacccctatttaagggacaaggccggttcattgtaaaaccccccgaatacaatctacttgaatcgttcttttactatgttttctattttaccctagttttagtccatctttgtcggtttgcgccgtaaaccgtccgccgccgctgcgagagtgcgacacctctttgtaggtttgtcctgaaaaccttccgttttgcccacgagacgggtagttatcctcatatcgatataaatcagcctagaggctgattttgatctctaaatcggctccgctagccgatttagcttttctttttgcaaaatccatcttgatttggccctttggctagatcggggtggttggcgactccatatcaccgcaaggcgtttaggtgttgcggtcgtgcttgtcgacttgtcaaaaaagttgccaacaccagcatctgaatctcatgagcttgttctactacagaacggtcatcgaccatcttgtagtcatagaactgctccatgacatacagctcactaccggcgtcagaaactccgaacttggcctcaagtgcatcccacatgtccttcccagaaggcatgtgcatgtacacgtccactatgttgtcagcgagtacactgatcaatgctccccggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagttagaaccatcaaaagcatgtggtttcagtgcagcagcaaagccaactaccgaaaatggcctatcaggtttttggattgttggaaatatggtcatgaatcggcatattttaatccaaaatgttaagacaataatcatggcataagcagtgtagggtgatctagtgacaacatgtaacataaccagtagcatactaaagacatcatgcgcatcatgaatatcacgaacaagaacatagcagtaacgcaatagcatgctagaggcattattcatgaatatcaggaacaggaacatagcagtaaagcgctaacaacgggaacaggaacaggaacatagcagtaaagcgctaacaacgggaacaggaacaggaacatagcagtaaagcgctaacaacgggaacaggaacaggagaaggatataccccgagaatggccctccgctagattgtgaggcagaattgcctccgttggtgttgttgttcgcgccaccggctccagctcctggcgcaccacctccggctccagctcctggtggcgcaccacctccgccatctcctccagcagcagcagcggcgccggctccaggcgcagacatggtggggcgagaacgagcagtcgtgcggaagcactctgtaacataccgaaaattaaccattttctaattctgcatcatgctgagtcttatgttcttaataacttcctaaacctaggaaaatataattagagggaccttctaaaactaacttgcataaaatctctttctggtattaacttcttttgtgtttttcatttaaaatacatgtggttgaattgaggtatttcttgatttggtttaaaaccttcttttgactaaaatttctttattcaaaattagtttgaaaaccctttctatttttttttatggattatggtccaagaaaccttcctaatttttttcccttgaacctaaaccaaagtaattccaattttattggaattaattattagcccattctttgatcttaaacccatcctttgattctcgatacaaatatccaaattcttccttttgatctagccactgatttaattcctgtggcttcatttcctcttcggcacaagaatagtattattgcaaatattgtgaataattgctcttgtgctaagaaaataccaatttatattctttactcaactttccctattagccacaaataattcttcaaatacttctactatcaaatttaggattcaaatcctatttatctgcctctatttattacccctacctttcatttgagtgcatcaaatttcaatatattttatctccaaattattgcactcaaaataaattgggaaaaatatctcctttgttagctttctccaaatttaaattctcttcaaaccaaaccattcaaattcctttcaaaattgagaaaccaattctacttaaattgggccgaaattctttttctccttcggcccaagccggcccaacacccagccgagccgccaacttgcgccgccgctgacaccgtgccgtgttcgtccttctccgccgctgccgtgccttgccctcctcctccgccgttttctccttctctaagaaaccgtcgctgctgcccttccttcgccgccaagtcgcgccgacgccgtgccgtgtcctcccttcccagccgcccaactccctggcagccgacgtgtgtgcgcgccgccgtcgacatccaatcggagcacagagccgacgccgtcattttcttttccacggcgccgtcacgaagttctccttgatcttcccctctggaaccgccttgcgccaccgccttttgccacctataagtattcggcgaggctgccccttttcccctccacaccatcgagctctccgagctccttctctcctggccattaccggccaccaccatcattggccgatctccctcaccggagtaataccggccaatacctcgcgccatcgagctttcctcgatgagaggattccatttttcccctttcccctctcctttagccaccggcaccacccatcaccgccacccaccattgccggccgaagagagctcttgttgtcgccgttccggcatcctccctctccctctctgccagctaccgacttccctggatgcgcggtactcgggaacactacccgacaccggcgtcgccgtcttcaaactaccgaagagccggcgcccctcctccctctctcccttctgttacccggctggaaggaggagaaagaaaggaacgggaggaagaagaagaaggaaaagaaaaagaaaaagaaaggctgacaggtgggcccctgcacagtaactcttcgtattttctctatttaattcaaatcctaatctttagaagcctatatctcctaaaccgtagatccgattccagtcaaacttggacctaaattcatataaactcaaaatctatattttgataccaaatttgctattttaagattttatttgaatttccttaatttattcaaatactatttgaataaatatttgattaaatcttataattgaatttacaacttaaatttatatttgcttttcaaatattttcttttattccaaattacccctttagccactaaaaagccgccggtggaactttacgtcttccatggggacgttcgcggtttactatccccgacgtcggaccgttggttgtaaagcccggcaaaaaccaaacctaaggtcgaagtgctgctcctggcaccccacgccttgatgcgtatagtggtcggagcttcactattccctcgacctccacagcacgccgcacagttagctcttgggctctgtgtgatcctagccgctccgccgccactcacggttgtcggagtaacacttccgccccactaaacccacacaaacttcataccccactagccgttatgctatttgttgacaccggccagagaagataccaattctagtcgttatactgcccaactctagcaacgactagcaaacacccaaatcccagccgatattcatcctacctcgatatcagctgcttaatcaaatgaaaccccagccagcctactatccaaactccataccaaccatttacccttctactacccatagcctatgcatgaaatacgagccgatatgctatcctatttcagcatcgactcgagaacaactaaatcctagccattctcctaccaaagcccaacctcgaccaatgctagccacatatccacttaaccagttagattattcggtatatcccctattatccaagaaaccaaaaaccacacataaaatataagtgacaattgttacttaatcccctctagcctccaacccttcagaacatacacatattagcccagtaatccctacaccctataaaggagataggttataccctaaaccctagcccttttagttgtttatcgttttcttgttattttatggattttattgaaattggttcttcctctttcttagtagagtctattttattttggatggcaacctgtggtatttcgaggatcggataatcaggttgtctatcttggatttatttgcgttggagcaaggcaagttattattcctcccttgaacataattaccctatattctatatttctattctatgcattagccattcatgattttgaatgcataacctgaatatatagcaaaccagatatgctagcttttgcttagccctgcctagttagactgcataaaaatataatgaacttagattgggacagtacgtaaaatttggttgatttccgggtggctagtattgtctcagtcgatataagtttaccaaatacttatgtcaaacgaacgagtacgaccgcagcttctagaatagggacagacctagatattatgttaattaacaatgtgatacctctgtacagtggttccttttgtatgtcctcgcgtaggaggcaatcttatgccgagcagggcatcttatgatatttaccgaggcgcaggtaaatatactgattttcgctcatgagctatgtgtgtgattttatggaaacctggttgagatgacgtggggtctctcatccagttctctctaaaaaccccgagaacgccagaactcctctcgctgctgataacgttacgttcagagcgcatggggactagagttcatggaacaggtgccacaattattgataacctaatactgggccatgactaagctaatgaatattggcaagtcgtggactgcgggtaaagcgtacatctactgcagtagaatattcatgaaactattcgaatagccgtgctcacggaattgagtatcgggactcatatggtatttggttagaaacttaattccaaattttattaaatactgttgcatcaaacacattgcaggatttatccttctatattctctgcttactgcaagtaatcatagccctactgaaatactactaattcatacattcatattgaatataatagcttgccgagtacattgtactcacccttgcttcaaccccctttttcagagtccatttggatcgagttcttatcaaagccgggagttcaatcacataagttagttccctttaaacctagtcttgaaatctagtattgttagatggtttaactctatagcaaaacattagagttgatttattctatagtttctgctatattagttagccacaagtttgtaaatacccatgtattttataataatatctcccttggagccatgtcaaaatgtatgcaatgaagatccagattgttgaacatgtatcaatctactgatctagggcttgatacagtgtaaacatgtcggtttctgaatcgttaattttgggacccgacacactccccaaaaacttgatcacccgcctacccggtgcagatcgtgggaacgtggacgcgctgttgcggaggcagtcgtgggaacgtgggttagtggctgcaggtttctgaatcgttaattttgggacctgacacactccccaaaaacctgatcacccgcctactcggtgtagatcgtgggaacgtggacgcgctgttgtggaggcagtcgtgggaacgtgggttagtggctgcaaaagagtagcgacgtgacgcatgcacgcacgcccgcctcgacccccacctcaaccagtcaacagggagcctccaataattccctatttaggttgagatattcctcgcttaaatcctaaggtggttttattattcttaacacttattatgggcctttgagatttaataggataagttgggcctagcccaattattctaacatggccgacccggcgtcgcaggggccgctacccccgccgcaccttctaccagctcgtcgacgtcaacctaacttgctctgcctccgcaacaaccccaaactctgcccctccatgacagacgtcacccgagcactcgagcacgtacgtcgcctcccagtcccagccatgggaagacaagcaacgagccacgcctgattgattcagcccacctccttctgaggggcagacccacgatgattcatgggtattcaaatgaatacccaagatttttaaacaacaaatatatatatgaagttccatatgtatatatgaaaaaagaaaaaaagcctacctattcaaaagaagcttaaactaaaaacgtttcctatccctcccaccatttttctccccactatttcaggcccattggtccaataccaaaaaaaaaaaaaaaaaagcccaaacactagtctaagtttctaaccctagctctcaccaccatcccaactctcccggtccagccgcaaggcgccggggcggcagggcggggatgaggtcacattagccgacggtggtcatggtgacgcagaagcaggatttgcaatttcggtggttgctgaaaatttggtgatacccggactaaaattatttgaatttttaatatattttgattgaatttgaataaattttgaccaaatttacaaatatttgacaataaataaaaaattttggagaaatttgtgtttgccagtgggggccgaaattatagaatttcgaatcgaaatttcaaaccatgcttagaagtaaagggcgtcgaggcgcgattgatgcgggtgccgaacatgtggagagaaggaggccgctaatatgcaggacctacgtgggtcccacgcgccacgtctgcttagaccagagagtatactgcctaggatctgcggtgtagcagttttataagttaagggactcgttatatctagtatttcggttcagggatgaatttcagtctcggtgacaaatagagggatctaaagaaaacttgtcctagatccacgggctaacgttatccttagttcctacaatactacatccattttcattttcttttaaatagatggcaccgttgactattgattatgatatttgatggagtaattattgattttattacaaaattatataatactcctatattttaatgtgacctgctttatcattaaagaaattttagtatgaataatatactatgttttaaattagatgaatatggttaaatgttattttcaaaatacgggtgtagtacatgataccgaattattgattaagagaaaatgtttggttccttcgccaagttgtcgagagtgggttttttcttcattcaagcacattgtgacacatggataaaaatgcttccaaaatttaatcagctactgttagaactcggttcattaattagcgtacaaaatggatataaacaactagtaatattttttttatgaaatctggataaatctattttgcaatttgattattcataatatgcctccgatggtactaatttgactaatgaaaaaccatcgttagtaaccccatacaacatctcagagattagatattgtttgacacaacttcagtccaagatgttggaatttcgtattcctagctacatggatctattgatttggatgtgtgattagatggatgagtgtgcgtacattgtaagcgtctgcatttacattgtatttctagaaaaaaatgattgacaatatttagaagaattattttgttcattttttctgcgaggggaaggg

SEQ ID NO: 54751 - DNA, 715 bp, Oryza sativa
cctgcaccccaaacaaccaagcacatgtttagcgcatcaccaacagtctactaataatctatcgccaaaatttaatttttgggattcctaaactgaaaataggtgttgaaaaaaccccttcctccaagagatagcctaaattcaatcccaaaaactaaaagtgggcccttctgttaaactaccaatagaaattctagtttttttcttttcccgtgcgcagaaggagatcgccccgacgggggaaggagaggagaaacgcggaaggaggggagaaacacgcggaaggaggggattgggagtcgttctctcgccctcaaatacacgtaccgagaaaattggagatgggaactttaaaacatcaagagctcttttgggaatctgttggaccagtttttttaaccaaaatcccaaaaatataggattggggatgtaatagctagactgttgatgatgctcttacatatttaatctgaaaaacaacttcttttgaaaaactcaacaatatttatgagtagtttttttaatgaaagatgtacgttgcatattcagaaatatgagtagtactcatttcgtcctagaaaaaaatcaactttttaaaacgaatctagatagatgtttgttcaatttttttattttacttagagcgagaataatattagagctcacttcctactattagcccatcttaagccaacatatattatagattagctat

SEQ ID NO: 54752 - DNA, 2008 bp, Oryza sativa
  unsure (1)..(2008): unsure at all n locations
ttttgcaaatgtctaaaatttatccctgaactttaaaaccgaacaattactatctttaaacaacacttagtcatttttcattctttaaccagattcaaagtgattctggattacatggtattgcgatttaaggttgaaaaatcttttggttcttaaaaatcagtgcatgataaatccataaaattccttaaaagtataacttactttttacgacatgaataacatattttttttaaccatgtaaatataataatttggctgcacaaaatagttttgtaatatatttaaaatcaatttttttcttggaataatatttattttggaatggacataatttatttagatttaaagctagatnnatnaggtccattccaaatgaccaaatgaccggacaaatcacacacatagcaaatctgtcatcctagttcggattgttcttcttcttctttttcttgaagtcagtggtctgttgaactttgaagaatttttctttgttcttgttttgggctttgtgcatcacattagcactagactacctaccatcgcccttagacacaacgtcttttccttaagctttctcctcaacattaagagacattatactatcaagtatcaaccactcaatggagtactcctgtctcctatctcttgtgtttgagacattatactaaaatttctccatgaagaaggtagtttcacaataatgcatgcagccacaaaattgttgagtaaaacacacttggggagtttgagttccttctattaaaaaattataagcaatatgctcccgataagtgtcctgactctataggcaatgctccgaataagtcttatgttttctggaaaaaggtagttttgcaataatacacgcggccacaaatttattaggtaagacacacttgaggagtttggagtttgagttccctcaactgtctcttgtgttagagtgcacaaccgaagctgatttgttaggtaagacacaattgagaagtactagttttcttaactgtctcttgtgtttgagtgcagtaccgaaactttccatgaaaaagataagtttcgcaataatgcaagcagccacaaatttgtcaagtgaattcaagttcccttaactgtctcttgtattttagtgtagtactgaaactttttcatgaaaaaggtactttcgcaataatgcaagcagctaaatttatcaagtaagatacacttgaggagtccgagttcattctgttaaaaatctataggcatttgcttcggataaccatgcaaccacaaatttgttgggtaagacatacttgatgatgcggtggggagcgatgcagtgggaccggcgagcgagatgtgggacggcgcggatgcgggatgcattgtcgatcgaacggttttggaaaaactaatgacgtgggaagcaccaagaagcagagaatttctggtagtggggatgattgtatatgtatatatgatttgagttccttctattagaaatctgtgggcaatgcttcagacttcgcacaccgaattattctttctagttttctccgttacgcatgtctcaagtgactagctaggagatcactctttttttaaggagatcattctttcctaggatggacaaggtgattctaagcatctcatacatatgtcttccataagatagacttgtgtgtttttccaaaaaattaatctccaaataaaccttatctcatctattaattcgaacggatataacgaccaagcgtgtactactgaaaacttgctcgactactggccccagaaaattgacgtcctcgagtaaccaacattgtagaggtcaaactgcatgcgacaatatggatccacgaaattgacagagttggaggcggcagaaacaacagacgaaaatccaacaacatggaccaatttcacagatcgagagatattcagatggagtatatacctctcagtctcagagacggagatgtcaagctgttccagtcaagtctgcacctcatcatctatatattcatct

SEQ ID NO: 54753 - DNA, 1629 bp, Oryza sativa
acggatggagtactaattaacctggctgaattatgcatgcaatatgcagctttccattacaacttgagctgcgccaacctgccaaaatgcacggaacatgcatgcgtagcggattgccaccgcagaggtttccaggttagtgtgggactagtacattgcatatatggacggcccaatcaatgttgctgcgtacatggcggccttcttcatcctgacgacaagttaacgaccaattaattaggcgatataagagcacccacaatggtaaagtaagatgctatctataaaacatgtacatctcatgcaatagactagattaatagtaaaccacctcaatagtatgtcttcatgggtatctatagttctctcatgcattgcctcgtttttctctatagactatctcgaagttagtagatagttttgctctctctcttcatttaatatcttctatgtaggaaaatatgctgacatggatttcttgtagagaacctagctatagataaccattgtgggtgctctaatggatggatttccgatatgagcaataatgtattactgtcaatgattatatatatgtgcaattgctgcaatgagctgatcgatctcttcgatctttttgctctttcatgcatgcatgtgtcgttcgatcgacctagctatatatttgatgccgactcaataaacaaagtttacatgggaagatttggggctctctacccagtaattaattggcttgatatatattgacttataaatatcattgtacattttcatactgttcatgtggagctatagcagcatctgaaagtgagtgaattagtgggtatgaaaaaaacaagacaagtgcagataaagatgactatgtatactttctctctagtcaagttaactattgaatgttgtatagttactctctcctgttaataaatactcttcacgggaataaatgggttgaatgggctagattaggctgggcacatcatgagagtttctagtgtgaactactatgatctcaattttgccttcaaacttttcatacacaagcaagggcacgccgaggactaatatactacttcccttggtgcctctgcactggtgggtttttgcggcccgacagagatgagtatctttaaaaaggtgtttacacgcaaatttggcacctagtatcgaaatagaaagaattgccaaagtttggatttctgctggttttcctccaggaggaccggtctgaccgccgtatgtagtccaaacgggttgcgtatatgtactaacaaatagatacataagatatgagaagggacatggtattctcatttatgttcttttcactgtatacaaaagcctctcctctcctcttttatatagacaattctcatatatggaaaagtagggtgaggcccattagtatattgggatggccttcatgggccaaaagcccaagtttcttgacagatctatttttttatattttctttgatgagacactaatgtcttaaaaccattaaatgaacgacatccaaattctgaagatacagtccaataaatgaaaatttgttttcctgtatagtacctggcaattaaatatcatagaatctataaaagcatttaatgcatatgtttaatttaatt

SEQ ID NO: 54754 - DNA, 1422 bp, Oryza sativa
atttataaaatttatatatctatcttaagatggacagtctttccacagttgattggaccacatgatgtggttaatgttaagataaatctttaaaaattacagagcataaaaaatacataaatccggataataacttttccatatcctatagaataccaaactctgtgccccattaattagaaaactaacaattcatataaattctggaggtttcgatattttttaacccttgcaattaatcaaagaaatgcttaatttcttcaaatcaaaataaaatgaagaccaaagctgaagaaagaagatgtatttacttcttagtctaaaattaaaaaaatctggaaaggaatacagatattgaagaatagggcctccacttcatcttcttcaatcgattaaaactgaagaaaataacaaagatcaaagtgtgaaaaggattaaaaaggaaaggaaataaacaaagaaaaacattcctcgaactaccgatcactacttctcaatggctaccactcccacaacccatgttgttgataatagtgtctttttatgtgcactaaaaacaaggcaaacgagcaataaacataacaagtgggttataaaatttaaagtgccagcgcacctattttctagtgtcttttaaaaacggccatccaatttgcaagatttttaggttttgccacccatattgtgatcttgtcgctccgtgccactcggtgtatctgaccaggccgtcctatagtgcgccaggatggggccaaacaagccggataattgtgttagcttagataattaggatggatcagctaggagcttgtgtcacaatatattcatccaaactcgagtatgtggcttcacttatacacatctttataacaatatataactatagttagtggaagatgattatgccagcgtgggttcgcggtgtcaggactccatcactgaagacgcagagatagccaacgatgctgtgtcctgccggatatgctacagggcaagggccaagtccggactcgacagaaaggagatgggccgagacaaggcaggcacaacccaagagaaccaacgcgtacataggcccaggaacgtgataggtgagtgagtgagcaagaaccggagatagatcggagtagaacacggcggagacggtggcttgatcctgttggatcaagaactctgtatcgggttccttccatttcgaatcaagcaactaccgattctttctcccaaatcccctttcatttcattcgctagagctcacacgcggccatgcgtgatcacggtgcgtcacatatacgtgtttggatgccatgcgcgctgatggtgtggtgctttgtgtttaccaaccgcgatttctaccaatctctgcatacgccggcgacttggcacaatcggctatatggtagatataattttgtcgggaac

SEQ ID NO: 54755 - DNA, 3967 bp, Oryza sativa
caggttgcgtaagtggaccaacaaatggagacacaagatgtgaggaaggacagagtatctttttttttttaaattacacagtgcaatacagacactcacaacgcacgcgcactcacccctatgaacgcacgcacgcaaaccctacccctatgagcatcttcgaagattgagccagcaaatccttgagattgacgaagtcaccacaggtgcctcgctatcgacggatacgtcacctaccactgaaagcacaacgctattaaatcctagaaaattcgctcccatgcggagtcgaacccagggcctcaggtgctactgaagctcttgtaaccactagtctacatgtcttttcgcaaggacagagttttctcattcacgttcttttcaccgtatacaaaagcctcgactctcctccctttatatagccaattctcatatgtggaaagtagggtaaggcctattagtgtgttgggctggtcttcttgggccaaaagcccaagtttctcaacaatccatttttttttatatattcttggatgtgatattaatgtcttaaaaccattaaatgaacgacatccaaattctgaagatgtagtccaataaatgaaaatttgttttcctgtatacgtggcaattgaataccatagagttctattaaagtattgaatgtatatatttaattattatttagtatctgaaaggttcattgtctacttctatataagtaaggacgaatgaaaattgccaatatacttacaagcatactgaaatataagagaaaattagaaacacaagaaaggaaagaaagctataggtatatcgcccgcgatatggcgattttcaagaaggatggtactgctgttctctttgtcatgtctcttatggtcatagctatggtctctcttcctgccaagcaggtaagctcttccattctttaattttatatttgttgtatatatttactaggaatatacacgtgcattgcaaatatccatgcatgcatatgatgcaaaggcccatgtgattgggatgggttgggaataccatccaatcggttctagtctcagcaattaatggaaagtttttttaatttgaaatatggacgcgtctatgtagcgtgcagtagcacgttagtcttaaatcaagacctctcacttttccaatttcatctgttacttttgtcacataccccatctactttctaccatctaaaattcaaataaaattatttatccgatctacaatctaattacactattgtgtttattgtaattaaatatttataataagatcttacatgattatattataataaaaaaatttatgttgtaaattactttgattatatatctaagttacttttatcatatatatataaattacttctagattctattaattactttttagacatacagtgaacagtttactttattggttagttttataatatgtttattaaatttaatttctagatagacttatgtttctagccccacaacagatttacttttaatgtcgtaacaagttactttcttctttttaagttactatatgtaaattacttttaagctttattgaatttatttttatatgtctaagaagtaatttaatgaaatctaaaaataatttagatatattataaaaaaatgtaattttttatctaaaatataatcatgtaaaatcttgttataaagatttaattgttacgaacataacggtgtaatcggatcataaatcgaataagtaatttaggagaaaatttcatttgaagtataagtggtatgaatatattttctacttacttgatggactactactttaaaattcttccgctcatgcgatgtcatcgctggttacgactaaacgagatgctctcggtttagattttaagttgaaatatatatatgtatgtttctcacaagcagaaattaaatggagaaattaatatctgaaacggaagcacatacaaattaggcgtggacaaacatctctacacttgtggaggataaataaagaaattaactagctaattaacttatcagtggtgttcaaggatttaacttttttcctatttaattttctaataagcatataaatatattaatctggctgaattatacatgcaatatgcagctatccatttcaacttgcactgcgccgacctgccaaaatgcactgaacatgaatgcatggcggattgccaccgcagaggtttccaggttggtgtgggactagtggattgcatggatggacggcccgatcaatgttgctgcagacatgggcttcttgatcatcgtgatgacaagttaacgactaattaattaggcgatggattaatttctcacatgagcaatgtattattgtcaatgattaattacatgtgcaattaattgctgcaatgagctgatcgatctcttcgatcttattgctagctcttttcatgtatgtgtcgatcgatccacctagctatttgatgcggactcaataaacaaagtttacatgggaagaatttggctctctataattggcttgatatcttgacttataagcatcattgtacattttcatactgttcatgtggagctatagcagcatctaaattgagtgaattaatgggtatagaaaaataagacaagcagcagataaagacgattatatatacttgactccggtcaagtagctagcacacaattaactattgaacgttgtataggtactctctcatgttaataaatacttcctccgtccaggattataagagattactaggtcataccccgcgttttgctgcagtattcatggatgagtatatgttaaatatttttgaaatgatgaaagttgaaatactgagaaaataatgtgaggaagatgatttgacacatacttgtcaatctctataatataatattgtagatgatatgtgtcatgcttgcatgagatttaaaatatgctagaatagtaattgctagtgagtgaagatgtggtatgcttgcatgggattttaaataagctagaatagtaattgctagtgggtgatgatgtggtatgcttgcatgttgagttttaacttctaataattgttagtgggtaccaactatatggaaattgtagatttcccatttagcaataattaaggaagtgtcactctggtgctgaatgatgaattagcaaattagatatgtaaaagtacacactgctgctgatggggtaatattattccctattgttttgggttgtgtttagttagttagaagttttgggaaagatgaaagtttggaaaaaaaagctagaagtttatatgtgtagtaaagttttggatgtaatgtgatggaaagttagaagtttagggtagttggcggtgaattaaacacggtagggacggtagaagtagtcctagcagtactttttctctatttgttttttagaaccgatggggtaaatgaaaagttgttgctgttgatagtgtcattgttgtccttgcttgcctcgggacaacaaaaataccatatattcttgaacagagggtcatgatcctttatattcaccgaaggagtacgaaccaatgtcatcttaatgtcaatatatatatgctgaataaataagttaaatgggctaaattgggttgggcaggccatgagagtttctagagtttaccttcaaacttttcgtattcgtaattctgtatttggattcaaattccgaactggactacgcttctactgcccaccttctccccttagttaagcaaggtcgaaacaaattgtatttcaaactttatacatattaattttatataatcatgaaaaaactttatatttcaaattttctactacatgcaaactattatttgagctattctctcgtcgatcgaaaaaaatatatgtagtaactatctacataaaaaattacacatagagggtttctacgtagaaatattcgtataaaaaactttttaaattaaatttga

SEQ ID NO: 54756 - DNA, 1436 bp, Oryza sativa
tcctgcaccccgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaaacgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcgtcaacatacaagcacaaaataactccctcacccccaccatagcgatagtacacacatttatctgcctcattgactgcaaagcctgcagatgtcaatgttttgtcaaatttctcatgccattgcttaatagcttgtttcagaccatacaaagacttcaacaatttgcacactttgccttcttgaccttcaactacaaacccatcaggttgatacatatagatctcctcctccagctctccgtttaagaaagctgtcttaacgtccatctgatggacgagaagaccatgagaggctgccagagcaagtgcacacgaatcgtggtcaagcgagcaactggtgagtatatgtcaaagaagtcctcgccttccttttgggtataacccttgggcacaagccttgccttgtacttttcaattgtaccattaggcctaaactttttcttgaaaacccatttgcatcctatgggcttgcagccatatggacgctcaacgacttcccaactaccattagacataatcgggtccatttcactacgtactgcttccttccagtagtcagcgtcaggagatgaatatgcctcttctatggttcttggggtgtcatccacgagtgtcacgcccggaaattcactagtaatttccgaacttatttgtgcataaaaccctcgtccaggaatcagccgaggtacacaaactgactatttaatatacaaatccatcataataataacgttacatacttacaaaagaaaagaaaacagcagcggaataacggtctagcgatggcttctgctccactcccacaggcagctcaactggggtataagccaaacgtcttctcctcctgaatcctttttcttcaactgaggtttgatgattattgcaaga

SEQ ID NO: 54757 - DNA, 6389 bp, Oryza sativa
  unsure (1)..(6389): unsure at all n locations
ctgcaccccctggcttgtggttggcacgataaatgtttcacaacagtagctcgcgaaccggtccttaattgttatgagcacaaccatcaaaaccatatgctcacaacccaccttaaccaggttttaattatcaattaattaacaccacacgattaaccatcgtgagctaccattaattatagccataattaataataacaatataatataatgtatctttaatcccatttagttagctaatgtttctaagcatgactaagcaaacatacatatggcatttagctgaaccaatctaatatataaggtccaagctaatcaaattataacccataggaaaataaagtcatcttcggccattatttaattgggaaaggttcaccacccgatgacattcgaaaataatgcataagttgaaataaaacattagctttaaacgggttcaacatgctcaaagggttgtttgggatctgtgtgacttgccttgaacttccgcaaacgcttccgaaccttcctcaacgaaaacgctctcctccggaacgtcggaaactaaagcgaaagaacaaaattcaacaaaatagtgtaaatctagcataaacagtacatgtggatatttttaacatgtagatctcagttttagaaaaatttagcaacttgaaccactcgaatccgagctacggttatttagttatgattttccgaagtttaatcgatttcatctataaaaaacaactgaaaaagaggagatgatgacatcatgatgacgtcatcgatggcagccacggcacgggtggcgacctcgccggagctaggggggtcggccggacttttggaggacacctacgcgtagaggacaacattgcgaactcaatggtgctcaccgatacgacaaacgacgtcggacgacggacggcgacgagcttgtgcggcggcggtggctcggtcgacggcggcgacgggtctccggcgccgcgacagcggggagaggtcgcccaggcttctactccaccgtgcgcacctacggcggcaacgggaggcggcggcgacgacgcacgcggtggcgcgaggcggctgctcgtcggccggcgacggcggccgcttggacggcgtggcggcggcgctacggagcactagagaacacgggagatggggcaaacgaaagaggacngccaagggggatgctttatataggcatgggtggaggagatcggctcaggaacggatggatttggtgaaagaagttaggatttatccgagttcacccgaatataaacggccaaaattcgtgagatatataacgaatttgatgggggtttcttcgggattaggtagaggagatagagaggaatccgtttttgcaataaattttggaaggggatcaacggatgcgccggatttggtggagattggcgccggtatcgggatgaactcggcctctggacggctggctggtgcttgaagacccactgtagcgagagggacgtagattagactttaggctgggctgaggaagggagagagaagaggaaggaatgggccgaaaagggcccaagctgaggaggaggattttttattacttttccaaataaatcaatcaccaaaatgatctttgaattgttaaaaatacttccaatgctcaaataatttcaagaaaaatcctgaaaatacttggacactcaaagtattcaaaaaaattataatcagaccatttaatgattaatttaatatttgaataattgctgaactgctctttgtataattaaaattaagagttgagctctgaaaaatctgagaaaattccagagagtataattaaccatggagaatttaataaaaattaaatccatccatgctttatatttaggaaatttatttcccacatttaactttactggtaaattaatgaacatttaatataaattctaataataatttattaaataatttataaatcctaagacgaaaatcaggatgtgacaacgaggtatacaatgtagtcatctccaaaggattttgcaaccctttgtctcttactcttgcgagtatctacaatgttgtcctcctcaggatttttcttaggcgtttgatcattgtgttctatcggtgcaaagtgctcatggggcatgacagtttcttgactagaagtgctaggtgtatgtttcatgggaaattcattctcaaagaatatagcatctctggactcaaaaattgtaccaacatgcatgtcgggtactccagagtttactattaagaatctataacccacactgtgaatagcataaccaaggaacacacaatcaacagtatttggtccaagtttccgctttttggctataggtacatttaccttggccaaacagccccatgttcgtaggtatgagagatttaatttcttcctttcccattcctcgaatggtgttactttcttatgcttcatgggaattttattcaggacataacacgcagtcaaaactgcctcaccccaccattccttgcaaagccccgtagtgtctaacatagcattcactatctcagctagagtacggttctttctttcggccaccccatttgattggggtaaatagggaggcgttctctcatgaataattccaaactcttcgcaaaaggatgcaaactcattggaaaaatactccctacctctatcagacctcaaccgtttgattttcctttcaagttggttttctacctcagctttatagattttaaagtaatgcaatgcttcatcctttcttttcaatagatacacatagcaaaatctagtgcaatcatctgtcagtgtcatgaaatatttctttccccctttagtcaacacgctgttcatttcgcacaaatcggaatgaacaagttctagaggtgccaaattcctcgcctcagatgccttgtgaggcttacgaggttgtttcgattgaacacaagtatggcacttggaacctttgaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagcaaagcgaaacaagcctccgctgtcataaccttttccaacaaaagtctcatatttagatacgacacatttattggactcaaacacaagtctaaaaccttctctacacaatagagagccgctaacaagattcttctttatatatgaagggacatgctgcacgttcttcagctgcacggtatttcccgaagtaaacttcagatcgatcgtaccaacaccatgaacagccgcaagcgacccgtttcccatcaacaaggaggaacctctcccgacctgataagaagaaaacagagaaatgtcagcacatacatgaatattagcacagtatccacccaccaatcaggtgagtgaaaaacagagagaactgtaggtaatattttaccgtaccccgatgttcctccgccctcgctaatgaccatgttagcagacttcctgtctttgcgctcaggacaatccttggcccaatgcccagacttgccacacacaaagcagtctccctttgcctttcccttgcctttcttcttaaagttggttgcagccttgggtttgacatcaggcttgactttcttgttgttgtgggatgcttgagtgtcacgcccggaaattcacaagtaatttccgaacttatttgtgcataaaatcctcgtccaagaatcagccgaggtacacaaactgacaatttaatatacagattcatcaaattaactaaaccgataaatacttacttaagaggcacttagtcctcaccaagaagaaaactgcagcggaaagaaaaatctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggattccaaaggatggcataatatagggttcatttgcgaaagcagcatttagcaaagatttaagataagtaaaacagtagagtaattaatcagaaattttaatcaacactgaacagcacacccatgctgcacaggcccaaccaaacctgaacaaccaaccccggtcgtacagatcaaacctccaaaccaggaattatccattccaaaccaggagtcaaattaattatcacattattaccattaatgagtagtgtgggactaatcacgaaaaacattgctcaactcgcccataaccgcgggcacggctattcgaatagttttactctggccagaggtgtaccactgtacccacaagacacgattccacacatgttgccatgccccgaagtaccaccatggcactgcaaaggaggaaatcgtgacaataccctttgcacaacacaactcaaaatagtgcaccgttcctggatcataatctccccctcaaaaccagaggaaatggactccccagcgacccccacggacttctcgccgcttcatagtctggcacaccataatgaatcatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctatcattaaatataaccataagtgatagtgaaacattagttatcccaattgtgtgctaatgtttctaagcatggctaagcaattatatctaatatctagttgaaccaatatataaagctcaactagtcaagttataataacccaaggtatcaaggaataaagtaatcaatgcaaacatgccataacaaaggaataggttcacaccacccagtgacattcgaaaataaatgcacagttgaaataaatagagaatttaaatgtaggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtaaatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttacacaacttttgcaacttgaaccacattaaactgagttaagatgaattagttatgaatttttaaacattaaatcggattaaaacctttatatggattttaattaaattatgacgcaataatgaattatttttgaaaaggaaaagaaggattattgcgtcagcggctagggtttgcggtggaccgggtgcacggcggcggttcacgcgaacggacggccgagatcaaccctatccaaaacggacggccgagatcgatcggtccacgaccggctcacgggagagggcgacgatgacgtcagcgacgacgtcagcaccggcggcggctcggcggctcggcggctcggacggctcggacggcgcatgctcgccggcgaacggcggctctacggcacaaacggagggcaccaagacgtagatcacggcgcggcgaactcaccgatgaccaaaacgtcggcggaagaccaacggacggcggcggcgtcgaggaaaaggcggcggagaagatcaggtcgacggcggcgacggtgctccggcggtcttcggcggcggcgaagcggtggacggggacggcggtgaccttgcgaacccgatggtggcgacggcgaccgacgacggcggctgcaacggcggcgcggcgcggctgaaccgacggcaacgacggcggcgactagggctacgcggaggcggcgctagacacgacggcgggctaaggcaaaggtggcggcgggtagaagagacaccgggggtccttataaaggggctagcgagcggcgacggaggcccacggctgccggcgacgagaaggaaagattggggaaaaacgaatccgaatcaaactcgaatccgcctatttccaaaggaaattgaccggagtttctataagagaaaaggaagaggagatcgaggagattatttcccctcaatcgatttggccgcaaaggaaaggcgcggccggatttggaag

SEQ ID NO: 54758 - DNA, 1271 bp, Oryza sativa
atctttctactagcttccttgatgaagagctggatgaagagaacagtgtattgtactacacctcatactcactctcgcagctctcagagccaagcttggacaccttgctggcaaacctcaccaacctgcaggagcttcgtctgggcatggtggacatgtccagcaatggagcacggtggtgcgacgccattgcccggttttccccaaagcttcagatcattagcatgccttattgctcactttctggtccgatttgtcggtccttctctgccttgaaatcacttgttgtgatagagctgcactacaattatttgtccggtccgattcccgaattcttggccgatctgtccaaccttagtgttcttcagctttcaaacaacaacttcgaaggatggttccctccaatcatcttccagcacaagaaattaagaggtattgacctcagtaagaattttgggatctctggaaatctgcctaatttctctgcagatagtaacatacagagtatatctgtgagcaacaccaacttctccggcacaattccaagttctatcagcaatctcaaatctctgaaggagttggcacttggagctagtggtttctctggagaactgccttcttccattggtaagctgaaatctttagatttactagaagtgtctgggttggagctagtaggatccatgccgtcctggatctcaaacctgacttctcttactgttctcaacttcttccattgtggcttgtccggacgcttaccagcttccatagtgtacttaacaaaattgacaaaactggcattgtacaattgccacttttcaggagaggtagctaatctggtcttaaatttgactcaattagaaaccctcctgctccattcaaacaattttgtcggcaccgcggagctagcttcactcgcaaaactgcaaaatctgtctgtccttaatctctcaaacaataaattagttgtgatcgatggagaaaatagttcttcggaagcgacctaccccagtattagtttcttacgtctatcatcttgcagcatatctagcttccctaacatcttgaggcatctccctgagattactagtcttgacctttcatataaccagatcagaggtgcaatacctcaatgggtatggaagacctcaggctatttttccttgttgaacctatcacataataagtttacgagtactggatctgaccctttacttccacttaacattgaattcttcgacctcagtttcaacaaaattgaaggggtaata

SEQ ID NO: 54759 - DNA, 1508 bp, Oryza sativa
gtagcatcccttcaagcattggggaacttgcgttgcttcacgggctcaacatgtctcgcaacatgcttacagggccaattccaactcagtttggcaacttgaacaaccttgagtctttggacctctcctcaaataagctttccaatgagatcccagagaagctagcatcactgaactttcttgcaacattgaatctgtcctataatatgttggctggaagaataccacaatcgtcacacttctcgacattttccaatgcctcttttgagggaaatattgggctgtgcggagccccattgtctaaacaatgtagctatcgatctgaaccaaacatcatgccacatgcttccaagaaggaccccatagatgttctactttttctcttcactgggttgggatttggtgtctgctttggaattacaattctagtgatatggggaagcaacaaaaggaagcagcaagcttgagagggaaccatattatagaatggcagaatattttgttagtcactcttgatcactctagcaacattcagaaagactagtattaatagtgatgtatgaattaaataaaggataactatgtttataaacctttgattctacattattcatttcagtttaaaaaataaggagctaatgtttgttcaaaaaactatgctgataacagatagtggcatgaatgttaagtgatctattccctgtgagccgcatgtttagttgtttattgtaagaaaaattggtttcgtgatatccaaggatgctaacttcagaaatataccatccaacttctcaagtaccctttagtaccatctaaagtttcccacatatagataatgactatttctgtcaagtagagggcccctatgaagcacctgatgccaacaaggagaaaagatttgcatgtcgggactccatagcaacagaacaacttgcacaaagacatgaacaagaatattacagctgggggtaaaactgaaagaaccgctgcattaactgaagcaattactgggggtggcgaattgttgggcgttcgctgcatccttagttgctgtcacctggtgactaggacatgcactgagatgtccaccaatcttgacaggatacggatcacaacaaaggtgacgaaacgtgaaagcgagcaacgtgaggagattggaatggtagatatacgaaagcgtttagaactttcagatggtactaaagtgtactagagatttctagtggaatgtttctaaacatgggatcttcggatgtcacttaaccaattgtaccttttttgttcgaaatgctcaaattctaccgtgaagttctgctggaagcttgtacaatgaaatttatgatgattggttcataataggtacaattatttaaatatctgctccagcttctgtagcggcgctgctacaatagctggagcagatatgttcattagattcggcagaatacccctcacacgttgtaggcttggagcacatccaaacaattcatttgtggttaggactggaa

SEQ ID NO: 54760 - DNA, 2881 bp, Oryza sativa
aacttctacttaatggattaattacaaagatttctagttgcatacaaggaaggtggaaaaaaatgcgagacagaaagcaaagaagagaaggaatacgaataggatgatgaactgatgattacctggatggataaaaaatcgtcggcggaacacatgagtccatttgcggattagcaggtggggaaaggtggacaggttccggctgacgagggcgcgaagtcccccggcttctcatctcccgccgataatccgtcgccgtcgctgctgccgccgccgcggcgtgtccgcgaggggccgagggcatgttaagagcatcagcttcctaaaattttattcccagatttttgattatgtgaatcctaaccataaaggtgttaaaatttttctctctccaagagatgaggttaaattggaggtgaatagggatctgtcgtccgatcaaaatcttagcgtccgatttacgtgcaaaactactctaaactgatttttctcctaaattacttatccaaatcatgacccgattgcaccattaaattcgttgcaattaaatcttgaaaacaagaccacacttggatatattccggcgaaaaaaattagcttattattaaattatttttaaatattgcacgatgttccaccagttatttcggaattgtttcactgagtaaatcgaaaatgtttcactcgtttaaatcgagtgttgttttaccttatataaaaacaatgtttcagcaaatagcgaaagaatgttttagttcactgcaacattagatctatacatagtgaaacattgtgtgtacactaggtgaaactttttcggtggaacaaaaaataaaccaaattcccttaatagagggtttccaaaatatgtgggtcttttttttgttgcaatggaatgtttcgttcactgcaacattagatctatacatagtgaaacattgtgtgtacactaggtgaaacattttttatggaataaaaaataaaccaaattcccttaatagagagttttcaaaatatgtgggttttttttgttgcaaaagaaaattttaattcattgtgagtacactaggtgaaacatctttagtggaaaaagaggagtgagaagtgggtgggcccaacagatagcacgtgggggaggggcgtgcgggggagcgcccgatccagctcctcccgcgccggtcgccccggtacaagcattatcgggttaaattggtttcctagaaattgaaaagatgggccatgttaaaatctccaccggacaaatctattttgtgctccttcctcccgccagatcgtgtgcgatctcttctcacgcaagaagtgctgggagcccaggtgcatcctaaaaaagagaacgataatcctggtgtagggaatagagaatttttggaatgagattagagaatctgttagagcaaatttataaaaaaaaatcctcatatttttttatagggaatgatatacatatttctgtgggtgatactaggttgccgatcttcggcccagctcagtttgatgtactatgcatccacaacccattttttttcttttagatctaaggaataagttcacttagatccctccattttattgccaggtctgaaattcatcttgtacccagtttgatgtattcgttgtgatggctcgctaatcccagttaggttacagaccgtttgagatgagatgatctgtactagtaataccagatataacgaattttttaacttataaaatcggtgcaccgaaggtcccacgcagtatactcttcggttttagttggcgtggcgagtgggccccacttggccccacatatcagcggtctcctcctctccacatgtccgccgctcgcatctgctgcgccctaggtgaggcggcgcgtgtcttcagccacgccgtgcagagctctatacgcacgcgctgccgatcggagtagcagatgacggcggcggggcgggtggtagtgtggtaccataccatcaagttcagggtagcgcagctgtcggcggccacagacggcttccacgagtccaaccttgtcggcgacggtggcttcggcagggtctacatgggtcggcccattgcctctcattgccagaggcaagagcccccggcccgctgggctgggtcgcgcgtgtgacagtcgcgctcgaagccgccatggggttgcgctacctgcacgaggtggtgacacagcaggtgatctaccgcgatctcaaggcgtccaacgatatcgtgctcgacgcctcgacgacgacatccacgtgtccacgcgcgtcatgggcacctacggctactgtgcgcccgactacacaatgagcggcaagctcaacatctagtccgatgtctacagcttaatttggcgtgctcctcgagctcatcacgcacgcaaggccttcgacgctgcctcctctttgggcgcggccctacctcgtgcggcgaccacaagaggtgcttcgatcgcctggcctgttggaaatatggtcatgaatcggcatattttaatccaaaatgttaagacaataatcatggcataagcagtgtagagtgatctagtgacaacatgtaacataaccagtagcatactaaagacatcatgcgcatcatgaatatcaggaacaaaaacatagcagtaacgcaatagcatgctagaggcatcatgaatatcaggaataggaacatagcagtaaagtgctaacaacgggaacaagaacaggagaaggatataccccgagaatggccctccgctggattgtgaggcagaattgcctccgttggtgttgttgttcacgccaccggctccagctcctggcgcaccacctccggctccagctcctggtggcgcaccacctccaccatctcctccagcagcagcagcagcagc

SEQ ID NO: 54761 - DNA, 1775 bp, Oryza sativa
gcgatcagaacagatcggactcgcggcctccttatctatcaggagaaaggcagtcgtgggaacgtgggaacgtgtacgcgctgttgcggaggcagtcgtgggaacgtgggttagtggctgcaaaagagtagcgacgtgacgcacgcacgcacgcacgcccgccagccacacctcgccccggccaggcccgcgcgcgcgtgtggctttccgacccccacctcaaccagtcaacagggagcctccaataactccctatttaggttgagatattcctcgcttaaatcctgatgtggtattattatacttaacacttattatgggcctttgagatttaataggataagttgggcctagcccaattattctaacaatccccaccaaatttcaaggctcataagaaatgttctcaatgttgtgcctgtttgatataccagggttttggtggagactgttaagttgaacttccacctaggaaatgagctacatcagaccacaactgaacaatggactgtgccttgaattgtcagttttgtgtgatcaggtttcactcagaaccttgactggtactgggctgccgttcgcatcccctctgtttggagcatataagtcaaactccaggcctttcatgagtatctagagatcgcccaaacctcatagactgtgactagcagtcgaactcatataggtgtgttccttctgaaatgttctacaggtcaacatctctgcttggaaaagtcactcggatcacattaaggcatgagccatcctaccatgcaggaaagaagagaagtatatcatgaaaatgagcccttttcaagggtctcttctctcagtcacacaatagtttgtttcgccatccaaattcacgagatctccgatcacaatggacaggtttccactattgtgcaaccttaggtaggtatcatgcccatttccctcgatgcactatctatcacattacgtggtagccccttggtaaactgatctgccagatttctagccgtttggacatagtccaatgctatcactccggagtttttctactttctgacagatttcagtcttctcttgatatgcctagataacttcatgttgtcctttgaactgttcaatttaataatcactgtttgattatcacagttcattaggatagctggcactggtttttcaaccaccgacaaatccatcaggagttcacgaagccactcggcctcaactgtcgcagtatctagtgctgtaagttctacttccattgttgacctcgttaagatggtctgcttgcaagacttccaggaaacagcgccacctccaagtgtgaacacatatccacttgtgacttttatctcatcagcatcagatatccagtttgagtcactatacccttctagtacttttggatacccggtatagtgaattccatagctcatagtgccctttagatagcgcattactctttccagagcctgccaatgatcatctcccggatttgagacaaaccggctcagcttgcttacagcaaatgagatgtcaggcctcgttgcactagccaagtatatcaatgaaccaatgatttgagagtatctcagttgatcccttactattcttcggttttttcttaatagcacgctgggatcataaggagtaggagctggcttgcagtcactatatccaaagcgactcaaaaccttgtccacatagtgggattgcacaagtgtaatcccaccctcatctcctctttgtagtttgatgttaaggataacatcagcctctcccaa

SEQ ID NO: 54762 - DNA, 742 bp, Oryza sativa
tcctgcagccctatctcttctccaggagccaacgctgcccgtctatctttccggcagtgtttatcccgtcatggcctgagatcatcacaacttggtacaatgtcatgggcattgggctggaaggctgaggcttataggcagcctataccaattaagttagagataagattattagttagtaagagataagataagattaagttagttagttagttagttagttagagataagataagattaagttcttacttaggggtcaagttgtatcatccatataaggatgtgattatatctaggtatatctattatcaattaggcaataaatatcaattagtctaatctctccctcccaacaatgtttttcttcctagcctaaatctacatcccttctccaagagccgatgctgcccggctatctttccggcggtgtttatcccgtcatggtctcaggtcatgacaacttggtacaatgtcatgggattgggccggaaggcagaggcctataggcagcccataccaattaagttagagataagattattagttagttggagataatataagattaagttaattagttagttagagataagataagattaagttcttacataggggtcaagttgtactatctatataaggatgggattgtatctattatcaattgggcaatgaatatcaattactctaatctctccctcccaacattggtcttcttcctagcctaaatctacatccctt

SEQ ID NO: 54763 - DNA, 1003 bp, Oryza sativa
atatatgattcaatcctttgtttgaaaagcgttagtagtaatttttttttctttgtaggaatgaaattctataagactttcaaacaatttaaaggggcctaaagtagctatcgttaaacctaattaataatatggcatcttttaccaattataacaacgaatgatttaatactatgccgacgaacctcctataactcatgggatgttagaatggacaacttcattatcatgaagtgtacaccattgacacgacatcaataagcattactgtacattatacgtagcgaacacacgtactataaaacgacactatagatcgaccacgacccttctctaatcaatcaggagtacgtgcgtcgatgatacatgtttccagaaagatcttccctaacaagtccatgatagcagggtgatttttgcccacttaaccacccaagtgttccgctaacatgatcaaccacgtcattttccaaggtgtcaaatgaactacacaccggctgatgtgttgtgtaggcagcaggtatgcaggatcagctcaaccaaaaaactcccaactgcccaactgtccggtggggcccacctccaaccgtcctctcgcggccgcccagcatgtgcgggatattttcctgcgtctttttctttttttttcctaccgtttggtgggttggccgacggccgatcgaattgaagcgcgtgtggtgtgtggggcccgcgggattctgtcggcgaagagggcggcaggcgaagattccgccacgtggcggcccggctgtgcaggtgagtgtggttcctccatttgggtgtttgagcttctggatttttcacattttggtccttttgaaaaacttatttcgcaagtagacccttagaaaaacttatcccaaaaatggtcctttttggggcgccagagtggctggcgccgtcgttcaacaggacggcgccagcctctttggcgccgtccccctgccgacgtggcggggcgatgctgagatggctaggggga

SEQ ID NO: 54764 - DNA, 1742 bp, Oryza sativa
  unsure (1)..(1742): unsure at all n locations
ggcttccgtgccaccgagccaagcgccgagcgccgccgcaccgccccagcctcctcctccccaccgatgccgcccctttctcctctctccttcccccaccgccgccntgcgcaaggccgccatctccggcgcctctctcctctcgggcgcgcgtgaaggagccaaaggcagagaagagaacgagagagaaaacagagaagaaatcgagagagcagaaaaaggaaccgagagaagggaaggataagagagagagaaaaaataaaagaaagagaggaaaagaaagactgtgggatccactggcgggccccaccatcttgactcctctctgtgatcgacctggaaataccaaaaagtctagtttagcatgaaacttaattacaacagtagttatacagtgtcaacataaaagttcttatgcaatgtgccactgtaggacgacgatatagctatgtcaattgatgatgaaataatgaatgatgtttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttatcaatcttattgtcaacttattaatcatcatataacggtgttgtgtggcagcgtaatgatgcaagggtgaaattataaggtcatcttcatacatagttaaatgcgggatgataccacagttcgctgtttccgacatgaattttcgacttccgtccgatatcggtatattcccgttccgacggttccgtttccgagataccgatataaccgatatcgttaccgtttccgagtataccgttccgattccattttcgagaaaataaaatgaaaatggaaatggtagagggtttttccgaccgtttccgaccgttttcatccctaatctcgatgactcgttatctaaaaaaatcttgtgtttgatttgattgaagtgcttgattaaccttggtagtaatgagggtttataattaggattgtgcatttcttaattatttaatgatttttttcttgaaaattcatgtgtgaccactacgatcgaaccaagtacaaatagttacgttagtcctctttgaaaagatgtagaaaatataactccaatgtagtccctcctctttttttttattacgtccaacataaagataaaacaaaggaagtaatttaataaataataatttgacaatttgttgtattgggttgggtgtgcatgaatgaattcatataaaggaggtcactaaaagtctacagcactactccctccggtttcattttaattggcgttttggacaatgacacggtctacaaaatatacatttgactttattttctattataatatatacaataaataaatgcatgtttatttttattatagtgttttgaaatacaaatctatatatgttgttctagtttctttaaagtaaatatttttaaagttattgatggtcaaagttacaaaagtttaacctcaatcttgtctaaaacatcaattattataaaactggagggagtacctatttgaaacaaaaatttgctggaattgttgaggttgattgtttaattgattaacgtaacaatacattagtattttgagaaataaaattcacaaaaaccttgaacaagtgacctacacaatgcaa

SEQ ID NO: 54765 - DNA, 2466 bp, Oryza sativa
taaacggattatcgcggccgcgcatgtttcagcagcgcaatttgttctgagaattaaagtgtctacaaattaacacgacctggagtatatatgcttcttaatttgtcggctagcagacatttctgaaacatctgattatggcatgcatgaccgtgtcagtagaaaagtgttgttattaagcctgtatagtaattaattgagttcaaattaaagcaccaggtacgaattaaaaaaatactacatctacgttctcaaatagtgcttgcagtcaaactttgataccttacataactttcattttgctaaatgatatcaattaaacggtgtatcaatttcataaattggatatagcaataaataaatcagcaaaattcttttattttagatagaagaaacttttcttctatctaaaataaaagaatgtacccttctatccaaatccaatttgcatcgataaaataaatccaaattccagtagtagatgaataattgcaaatttttgtgtgtacgatattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtggtgagggaatttattcatgactaagggagtatagcacaggaaaagcaggtagtaatgagttcttatacctggttcaccatcgtggaggtggtaaataaagcaggtagtagtatcatctcgtaatagcattactgtcaggtcataagaactaaacaaatattaaaatctctatcttccattcattccctatttgtctcatttttctattgtaatatggccccaccttactatccacttctagcaatatatacttataatggtaacttcaactattattacctacatttaaatggtgcaccttacttactactcctacttaggagtaggtaatttcactacgccagatcctcacacctgtgacggcatatctgtgacggacataagtgttggtcagtaatgagggtcacctttgacgggttctacggggtgccgtcatcggtgagccatccggcgacgacccgtcacaggtaactagtcacctgtgacggtccaaaaatagaacccgtcaaaggtgaggtaaagtcacctctgacgagccaaaaatatttagcccgtcacaggtaactagtcacctctgacggtccaaaaatagaacccgtcaaaggtgagctaaagtcaccagtgacggatcaaattttgtgtgcccgtcaaagatcacaaaaaaaaaaaaatcgctctcctcacccttatcctcttcttctccctactgccgagtccatccttatcctcttcttctttctccctttctccctcccctctctctctcccttcttccgggcgcctcccccacagcaacgagagaccgagcgatgagtgttgggcagcgaggcagccgcaggccgctcgtcgccaccggatggcgccctccctcctcacagccgcagccccagatggcgccctccctcctcgacgccgcctcgcccttcctcctctacggcggcggcatcgagcgatgagtgttgagcagcgaggcagccgcaggctgctcgtcgccgcctgatggcgctcaccctcctcgaaaccgcagccccagatggcgccctccctcctcgacgccgcctcgcccttcctcctctacagcgccgccgccgccggtggcagccgcaggccgctcgccgccgccaccaccggtcgccacgccgcctcctctctccgcgtcggcgccctcaagtactgccggatctacaagccctaccaccggatctacaagccccggagctccggtcgctgcctccttcaccctccgccccaaggtcgccggtcgcctcatctccaccatcccgagctcctgggcaccagatccggtctctatgtggttagggaccaccggatctggtcgcccccatgctccggccaccgtctccttcgtctactccgccgccgtcgtctcttcgtctactccgccaccgagctcgggtcgccgtcgccgtagcgctgaccgccgtttcttcgtcttctccgcgcccaagctgatggcaggtggaggcccattgttctgttcatgatgaacgattctgcttgccttccttgtggtgttcatgttgctactgtgattgatgattttgcttcttgttgcgactgttcctgtgatttgtaatcgggacaaatgtaatggagacgagaagaattgcgacgatttttttgatttgtgaatgccagatgtgatttgtgattgtccaaatgaatttgatggcaacctaggaggatggtgtttttttttctttttttcccacttttcacaccagtgacggctcccaattttgaccagtgacatgttaaaatatatacgggctgcaggaat

SEQ ID NO: 54766 - DNA, 1916 bp, Oryza sativa
tggtatgtccatcccgttttctctcgttttgtatttcttgcagattgatcaaggatctctctttctttttcttacagatcgatcgaggtataagccagcatgaaggtcgccagctgcctcgtgatccatcggcgactcgatcgtcatcaatggcggcgattcgatcgtgatcgatggccacggccatgttgcgtcgacaatgcaggcgcgcagcccatcggcaaagccggaggcgacgaccaatctattggctcactgaaatcatacgggaacggaaaaaagcggcgctggagacatcagacagcacagcaccaagccaccaaccgaagatcatggcatccaacgaatgtatacatcagattatagtaatcacagtatatatgtgcacatcagctcatgtatcgatctggttgcctgcatatacatctctcttcttaattatactccattgaatctcttcctgattatatactactacaagatcaactaatttcatattatttgtcactattacatactactgtgaaaagcgcatatatatgcaacagttaggaattaataaacccaacgagtatagtcgagtatggctagttttggaaatacatgccgcttttctgaatctttgaaaaaagcatgtattttatactactgatacttttgcatcatcaaatcatgaatgcagccagtagcccagtagtctgtactgctacagtgtaaaatcaaaatagataacaaagtatataccgctagtaacttaaaaaatatgttaaaaaaggcatataccgatactaactataaaaaacagtatataccgatactaacttaaaaaaaaaaagataccgacactagtttaaaaagtagcatatactactactaactgaaaatgtagtatatacatgatcagtatatactactatactactaacaaaaaaaaacagtacatactactactaacaaaaaaaaggtatattctccttcaatgagtatacttaaaaaatgagatatatacatctctgatgattattgtagtatatatagtacttattaactaaaaaatagcagataatacttatattaactaaaaaaggtatatacttccaaacaaaaaaaatagtatatatcaaacaaaaaaagtatatactgaccaaattaaaaaatagtatgtgcagtatatatcaaaaacttagtatgtctactgaccaaacaaaaaaacagtatatactcattcagtacggacgtaatatatgctggaaagaaaattaaaaatttgaaagcaaatgcataccaacgttctcgtttgagtgagcacaaaatccggtgtcagctgtgcacatgcatacggtggtttcaaattaataatttcactttaatttggatgctaatggatcatccattaacaaggggaagtacatacacctgagtatacagaagagtcgtcctatatatatatatatatatatcctatatatatatatatatatgtagggtgggggccgcaaataatggcccatatgcacgataatatttatagtgcgacaagacctgacagtatagtgagatttgaaagcaagcaagcatgcacacggggctcctgtgatcgatcgttcgattcaagaggcaaacgaaggaggaggtcgatcgctggcctgccgcaattgcaccgtgggtccaacaaaggcattgcaaagcaaccgggcactaaaaaaacaggcaagaaaaagaaagggcttggggtgttgatggcgcagcggcaggcaaggcatgcaggcgcaagcaggcgccccggcatgcatatgaacagcaacgctacagtgttctacagtagcgccgcgcgcgcgtgagaggaggagaagctagctagctaggggaagggggggagagggcccggcctgcaagggaagcgattcattggcttt

SEQ ID NO: 54767 - DNA, 2348 bp, Oryza sativa
tggaaaaacgaaaagggtggaaaatatacaaattagaggagacgatagagagagagagaaagaaatacggagtatagaaagtagtagatcaatcatgcattcatgcctgtatgtaagagacaagatttgaatgcattggagcgagcaccatgccggaagagaggacgacgggcgcgtgcgagcaacaggccctgcatgaggtggtcattgactgactgactgactgactgaccgacctgcagagattgagtggcgattgatcgatcgagcgagggagtgagtgcgcagagcggagtacaagcacgcccacacacacgcacactggccagcatgggtcactagttcactggccatgcagacgcgggagggtagctagaccatgaagcaagctgcacctgggaagaagatagaaagagagggcgcggcagcttggctgcgtgacagtgagggagtgtgcacgtgcggtcagagagacagatcacacgggaggtagcgagctagcgctagcgagggcgcctgccctgccatgccacgggcggccgttgctctctcgatccccatccgtagcctacagtaaccaatcgattcattccgccggggaccagtgtgattgctgatcatatatcgatcccctcactctcctcctcctcctccaccccccgctctttactatttaaagccgcccacgacaaacccctcccgccttcatgcctgcctagccctatctctcctcttcttcctcctcctctctctctctgtccactcaccattagaaaagcttcaagaacagatcgatgcctggagactggagcatccgcatttcaagaacagatcgatctctccctgcagatgtggctatgagcctgtgagtggaaacggatcgaaaaaggtgggagcaaaaggtgggagatgggctggccggacggctggggaagaaggccgcagctggccggagtactgtagggagcgtgaggggcttagggccgtgcgggagtacgttggggagcaccgccatcaatgcaggggcctagctagctagcttgtgcctgtgtcgctctcctcctgcacagttcatcctcctaggagagaaaaaggagatatgcaatttcatcggatgctgcaaaaatatgtttttagacaaggagtgttcccgggtcagatgctgcagatattgaagcaacagggacggagccattctattcttggtgtactatttgtgcccctaaatccaagaaaatatcgaggaattgcagatttgcagtggatgcatgtgagtgagagcttgagatcaatcttacggtgcatcgctagtaagttagtgacaaagctttgcgacggtgatgaaaggaaagggctaagctaggaagccattaatattacctggaatctccatttcttatcagaatatgtatgggatcatgagcaaatagtagcagcgacagcgattagtttattttcccctacaattccttgccatgtactaaacctaattaatttgatcaaggaaaaagaggggaaagaagaaaaaatataaagtggaggagatcaacgaaggaacaagcaaattaaactaaaatataccaaaaaaactcagatcttgcgatgttggatgcgataaacaaattaatggacaaggtttgcaggtttactatactgatcaggaggcgcttggtgcagtgccactccctccaggttgagctgtggtagtagcagctgcaccgccaccgctgcccgcgtctccaccaccggcagctgcagctgcagcagaagacgagccggacggctcgacgccggcgggctgcgccgcctgcgagcgcttgcgcttcttcttctcgtacgggatgccgcgcgccttggcctgcgagtcccgcacctcgcggaggtagatccggacggcgcgcgcggcgaacgggttggactcgggcgtgccgccgctctcctcgtacgcggcgcggaggcggccgatgagcgcgtcgagggatccccacgcctgacgcagcgggcacgggcacggccccggcgggctgggctggccgtagaaggcgcaccccgacgcgtgcaccttggtcttcccgaactggtccaggtacctcaggaactcgatcacgtgcgcgccgctgcaccgcgccagcgtcagcggcggccggtggttccgcaggtactgcaggaacgtgttccagtccctccgcttctgcgactcgtacctgctcagctgcgccgcggctgcggcgccgccccacggccggcgcgccgccagccgccgcagaggacggaccggggccagacggatccatatacccaagcaagaaatcaagctagctgatgacggccacagcgacgacgaccaa

SEQ ID NO: 54768 - DNA, 17370 bp, Oryza sativa
aggggagctgaatgttagtcagtgaagtggagcggagggggtgtgaggttgatggcaattggcagcagctacactggcgggccacccggcccattcacgtggttgccggccggcgcatccggaggtgtacgttatgtatatacgtgcgcgccatacatacgtacttatgaaaaccacgtagagattgcacgtagagagtacgtacataatgcaatgcatacagtacatctcccagttgtggttgtactgtacagtgttgtgtacactgtacagttatacgtgtgctgtgcgcaccctgtgatatatatatatagagagagagagattctgtttatatatggtttctttttatttatgcttggatttctaatatgattttttggatttttacggtttataggttgatggttttttaactttattactcccccgtcctattttaagcgcaaccatgagtttccgtgtctaacttgaatcgtacatcttatttgaaattttttattattagtatttttattattattagatgataaaatatgaatagtattttatgcgtgacttatgttctttattttttttcaagaattaagacagattatcaaaggttgaacacataaactcatggttgtgcttaaaatgtacggaagtagcaagtttaaaggtgaattaactaactccaatcctcatagaccggaaaatttactcaaacctggcttttgacttaatacagtaagagtgccttattgctttacaaaagtctaattaaatagaatcatctacgaaaatataatcattatgaaatttggatatgctgttcatctcatgctcttggcaaagtataaaattaactctcgtgttgaaaaatgcattgtacagccctcctagcagaacatggtctttttacatgggttaacagagtgaaatgaatagaaccccgacagtgatgatatctttgggataagttatgatatctctgggataagttggctcgtataatagaatttcttggaagttgcattcgtcgatgaaacgatgattttttgaaatgaggtatttgtcaatagtatttgttagattttatttttttatatatatacttctaatttatttatgaaataggagtagtgatattaaaacgatgcaaagtaaaagttagcaagcactgaagcaccgtcaaaagtgaattggtgggagtactacagaaggattaacagtgcccttcatacaagtaaattggcgatttgattttaaaaaggttcgtcggcaatttcacaagtaatcacaaaggcagtacccaaatgcatagggaacaacccatccttttcaattttcttctttgtcagttacttccagactttttctgcttacaatacagattcaacagttcagatgtcactttctcatctcgatcttttctaattctaaccttctagtactatctacataaactacggaaagaagctagagttctactccctgaccctttctaggttgagttttttttggatggaatgagtacaaattaatgctaattaataattcatatacactccacgtttgagcagaaaattaaactgccaaaaaatacaagtaattgcaattgagcatatgttcggatgattaatatatttcataatccattgtatccagcgccatcatcaatagctgacacagtgatacgtgtgatcggtaagtgatcgtcggtcggctgctgtactgacggtaggcgtaatcctccagggacatggatcgtcgacagtactgcggagaagcactatagctgtgcccaccacagtttgtttaatgcagtgaatattgagaaaacaccgtagctatagtgtgttgatctcttagtttttttctgttattgttttacattcactgtagtgcagaggatggctaatagatagttacatactattccctgcatctcaaaataaacgaattattataggatctactacgggatgtaatatgtattaatacttatgttcagattttcagtagtatcacatctatagctgtttggtacggcagatgctccctgttccatcctccacgaatttcctttgcctttgaattctaattttttgaataggggaatactagtacgcaaacacccgtattcgtcctctacgtactggtgagcgccttaaattcgccgccgaatcgatcgcgattagccatccgttttaatcaagcttccatcgtctaacgcaccggccgttcttcgccggtggagggacagacaggggatgcggctgcgctacctgcaccgatcgcgttaagtgggacaagcaagagcgcaaagacaagagcgcagcacggtgcgggagcccggtggatcagagctagtactagtatatactccagtttgacggacccagtgccggccgggcgacgcgcgcctgacgcccgcggatcgatcgatcgccgccgcgcgcctggacgagcccaggtgcgctgccctgacacgccacgcgcgtgttcatcgacagcgcctcctccgcacggaggaaaatgacgtcgacagcgcctggctagcaccgtcattacgtcaaccgctgacgtcaggtagttgggcttggtctcaagttcccgactgggagcacatgcattgggccggataccaacaccaccaggagaagaggaatcccggcccgatagcacatatcacacggatttgtgcccaaatttgtaataagaccaatgtagtgggccgactagtagcccgtagctcggtagatgcagtgatgcaccaattcggatagggcaggaaagaacggtgaaagacgagcgccgcgcgaaggccggtgaacttcgtcgccgtgatgcttcgtcttcccactctcctccccctaaaaccctcgcctcccaccaccggcttaaaccccatccacggccgccgccatggccaccaccccagccgcctcctcgcctcctccgccccgccgccgccaccaccacggcctcccaagcccgagccccgtaccagccacgagaacctaggcgacgacacccccgatttccccacaaccaagccccgcaagccgcgccgcgggcgccggagcgaggcggcggcggtggaggacttcgtgcgtggccgcctcgagcaggtcttcgcttccatccgggagcgcgaccccgaagtcctcgaaggcaagggcgacatcttgaagcgaaaggaggagctctccgacgaggagggaaaagaggggactggtgaggaagagggggagctgaaggctgtggttgaggaggaggatccctcctggcctctggacgccgacatcgggtgggggattcgggcgtcggagtactttgacaagcattccatcaagaatgtgacggtggatggtgtggagatcgattgggagagggaggtcgaggagggatgggtcaaagagatcaactgcttggagtgggagagcttcgccttccaccctagccccctcatcgttcttgtcttcgagcgctacaacaggtataaatcactattctacccagactctattcatgtgaacccatagtacctatatgttaggaccaaagtgataaacttcataaacttcaagcttctcactttatattgtcatatctgataattttgaatccattgaatcaaaagttcagaactacccctgaagtaatgcataaaaatgtaaaaatgtactatcgttttgagttgcctcagaaaattaggtgttctacttccatgacaggatgatatgtacgcgtaatgttttgcctttgtttatagggcagctgacaattggaagtttcttcaagaattggaaaaggcggctaaagtttactggaatagtaaagatcggctacctcctcgggtcagtgtgaatcatatttatagttaatacttgatgtattacggtaaggttattgaggtggttggtcatatgctaaatttaattgagttccagacagtgaaggttgatatgaatattgagagagacctggcatttgcacttcaagtaaaagaatgcccacaattattattcctcaggggaaacaagatattatacagggaaaaaggtgagtagttagttccatttttatggtaaatcctgttcacatagttaacaaattgaatggaactttgaattattaaattccttgattgctaatatgcactttcatgttaggcccacctttttcaatggtcaaaattgccactctgacaacacctgattgcctcatttgcttgtttacagaactaagaactgccgacgaactagttcaaatgattgcccatttctactacaatgcaaagagaccatcttgtgttaatcctgaagctattgcacctccgtgctaatctcctgcatttcagcgcttatgtattgagacagtgccttaattctcaactcttggtgagtgtacactgtggtaagcttttcatccaatgataacctgttccccgttagaaaactgtattctatactggtcattgttctctttaatgtcctttctctgtattagtacctggttcaggggagaatattattaattttgctaactttatttgccaggaaaatagtctaaatagaccagtgtggttatgatgcttgtatctgtaataaatgtatcacttgaagaggaaggagagaaacctcttactggctcatctcaagttgggagggggtcaggtatcaactatgtcatatattttggtatgctcatgtttttagctgtacactttcacctttgtactgtactctaacaaaacatacagttcatcaaatttctagatagaacaggagggaatgctagcttaattatctgcgtggccatcctgttaaggaggttgtaaagtcgattgtaaacttttgaggcgtagtgtaatgtcatttcacgccatagatgcaaaatgaaggcaggggggtcaacccatttgtcatcttataactcctctgattatttttcagtgacgtaattgaatttgttggatggagaacgatacaagacataccatacatgcattatagggtcattttggtagaacaatctcatcttgtggaactgctttcagatactcttttctttggttagcccccctttttttatcttgggtggcaaagggggtatagttgtgctccaaattcccatgagaatgggatggcaatgcttcccccggtctcaaaaacaagtcgcttgagaatgcgtccagtcagcataagttaagtttggctataaaataaattaaagtatatgttttgggtgtttccatctataaaaataacttgaactataggttttgggtatatgaaaatgatatatttaagtttgtcataacaagagctttaatagtagactgtccgcataagagagatcatgaacaatctgccactggttttgagtgctccaaaaggaatgcaaaatgcaatttctgatcaaaggtactagtacgaaatggaacacgcgtcatgtcagcctatgaaatcaacaattattaattgttccccatatcgaactataaagaaaggaatccgatgcaaacattcactttgcttaacaagagttactgacaaaaacagaacaatcacctctgtaaactataaaactatacagtacaatactgtcacctagactcctggtacaaattacaaagtataaacaacaactctggattgagcagtggacacaacgaatctacgcacacgatatcgaggaggaagacgaggacgcgatgcacaacgccggcgcggccgcctcgtcggcgccacggcctcgcagcagcagcgcgatggcctcgtaccccatcgtcacggccatctggagcggcgtcgcgccccgcctggtggcggcgtgcacttcggcgcccatgtcgagcagcagctcgacggcctcggcgctgccgccttcgacggcgaggtgcagcgggcggtgcccttccacgtcctcgcactcgatgtccatgcagcctgacccggcgagcagcgcgatcacgtcgcagtgccctttgatggcagcaaggtggagcgccgtcaggccgtactggtcacgtccccggacgccggcgcgcttgctgaggagggactcgaggctctggaggtcgcctcgcctcgccgccgtcatgaccagttcccaccgttccaggacgtccaccacttcttgctacacccaccgaacaacatcgtaactacaccagtataacttaatttgtaataaaaacgcgctgcttagagtacacttcttgcaaaacaatactgataatgctgctcttgaaaagtaacagaagtactgttcaaccatgtcatttcgcagacagaaagtcccatgctggccatttatgcatttctggtggacaataatggaattgcactactgtagcgtcgtcctactcctatcatgattcacgagcgcatcgacaggtcacataagccaagctacctacgtacatcctccagctggtccatgatcctccccgtcggttctgtaacttttgtacgaccagtgatgctttacaagtctacaactaaatcaatgttttcctaatttgacacaaacgtttttacgacctgctagtgcatttaggaccacacagattatggttcacattcacacatggttgcacggttagttaccaggaggaatctttgtcgagttgcaattaaaaagcagcatccgaattccctgagcttaggtacacgacagtaagaaggacagacaggtagattctagtaggagtaaacttacatagcccttctcgcgcgcgacgtccagtggagtcctcccgcgcgcgtcggtcgccgcggcgtcggcgcccatgtccaccagcgccgccgccgcctccgcctccccggccgcggcggcaacgtggagggcggtcctcccctcacggtcgcgcgctcccatcgagtccggccccaggcgcctcacctccccggtgtcccccctcgcggccaccgcgtgcagtggcgcccactgctcggcgccgtcgggcaccgccgcctcgggctccaggagcggcaggaggtgcggctgccggcgcaggatgaggcgcacggccgcggcgtccccggcttccgccgcgaggcggagcaggtacggcccgccgaagaacacgcggaggcggatggcggtggtgccgccggtagcggcgctggaggaggcggaggagtcgaggtgcgcggcggagagggaggagagcacgaggaagcggtcgcctcgggagcgcgggaaggacgcgggagcgtgctgctgcgggcggagcacgacgcggagggaggccgacgagagcggctgcacggcgccgcgcggggggctgacgaggaacttgagaggggaggaggtctggaccttgaaggcgacggggagggacgggtgcagcgagcggaggcggaggtcagcgcggcacttggcgttgggcttgaagtcgatgacgacctcgtcctccgccacctccaggagctgctcgaccgccggcttgtccgcggctgctgcggtattggcggccgggacgacggcggtgctcggcggcggcgagggagaggctggcttcgcggtggccatttcttggaaggcagagagactggtagtagcagggggtggaatcggcaggggaaggcatggaatggtggctggcttcctaggacgccgcttttgatgtcacgctggatgggcatgatgggaatgttgatcgtttgtgcatacggtgtcttgtgtggagtagtttggctttttgatggtttggcctctacatttctacaacttgtccgccacttgatgagtaatgtacaagtgaacagcacacgctgccaaattaacacagccggggtgtattgccgagtatgtaacgttatacaagcagtattacaaccaagtggccgatcgaacatactcactgactatatacaaacaaaagggtgggttttttaaaattttaaaataaatggtagggagtatttagctttggttaggaattttacggagtatttaggctagcatgttcatacacttctcaacaaaagggtgaaattgaaaccactcgtcatgaggtagtacatactcatgctcatacgtccacacacttcttaacaaaatgtagagttgaataagacgataggaagggagagcaacatgggtttatccaaaatgttatacggtaatagagtaaatacctcaccaatatcctacttccttcatcccaaatgataagttgtaaagttgcatagataaaaatcaagttgcttttacggaaggaatacttccaacgttacaaaaatattgataacaccaaagaattcatctcacattggtacaataatcttgatataagaaaaaaaaacgaccatttctggaaacctctttgtcataagtttctagtagtttgaaagtcagtttcggggaaaagtggttcaaacaattcttttatttgattgaataggtttcctctccttgttggaaaggtatatatgtccctactatttgaggataaattttttaattcggttgaactaattagaacaaatatatgcaggtgaaaatgcaaagatttttctgaacattaagagataatagataaaaaatgcccatgcattgcaacgggtgaaagctattctaataatattattattgttatatagtttagttaaggtaaaattcactgtggaaatcagcttggatatatatatagaaaatcattagctataattaggagtccgatcatctcaagttagcaagcgagttttttaagagatttcttatatgactccttctgtgtttctaaaaacgaacgaacttaaaacccgtctcaaatacagatatgtatttattaaagtgaacgaacttaaaaaccgactcatacacgatggcataccaaagtatcggtaaaaacatctttaatttttataatagtagagattaataaaaggtacataataagctaacacgatgagttttatcttatctttttctgaacggttttctttaattattaagaggataagatattatcctcttaacaattgaagaaaaaacattgaggacaaaatataaaggaattcctcgttttgctcttacttaattatgagattaattttggaactcactccatggagaggtatagtaatataatatatgtacctatagttaattcaccaacagattttagtgctaggtagcattacaaacattttaaatttctttattatagaagttacagttggagcgcgcaatctagctcatcaaccatgggccatctctaccacatgctaattgatggatgtggactgccctcaacttttaatactgatgtggactaaactcaccagttacgaacttacagtaaagtaggagatgtgcatgcaccaaatgatacttattttaccaaaatttaccaataacaaaattgaaaattttgacatagtagcagtagataatcagaccaacctaacttaactgggaccactcagggattcatagcgttcagacctataccgttttgcgcagcgaaaacggtgaattcatcctggaagtggatcgagttcaattgccccccaacccagaccgtagatggccacaccatcgccggcaggccgtaccgaccccggcggatccgactgccactcgatcgcatttatctgctgggacctgcaaagaatgatggagccaggctacgatccatccagcacgcacgtcccatcagaacgggtggcaatcggcaaatcacgccgagcaagcgagcgcgctacagttccctcgtgaaggacttcagacgagcacagcctcgcacgcgcgcgacgagaatacggccccggtcgcttggtgaaggtgagaaccccctcaatttcgttggattctagcctgcatgtgcccggctgccctctcctcttccccccatttcccttgccgtttctcgcgcacgaatctgaacaataccggggcttggccgcgtgccccgcggctcggcggcacgcggccgcaaggagacccagtggagtagtagaatactcggcttcaggggatgctgccgctacccaacaattccgtcgccctggacttatcacgcgccgtaggtcatgtgtaagtagtagtacaatcctggtaggtttaaagtttaaacccagacgttgagttccaggtcgatccaccgggcatgctcggatggatggatggccggaataattcacataacctcacgtgatgcgagggaaaggggaatatttagaaatgctaagcctgttgtacacgggaaaatccatagattctaaaagggaaaatttcaagaaccagttactatatcagcctaaagaccagttgccttagcgaattattgtctataaactagttgaatcacgcaactccaataggaccgatcgcatgatacgtgctgtatccaggacatcaattaaacatgtaacttattgttaagttttgaattactgctatcaaagcgtttgtagtccaacggttaggataattgccttccaagcaatagacccgggttcgactcccggcaaacgcatgttttttaattttttgcttataaatttcttgggctcgcgtggatagagactctctttcaccttcctgttgggcccattaggcggtctccaatgggcctaaattacatggacacttccttgccttctcatcgagtttaattagaatccttataccacaatactagacatcttcacccttacctagttataatgtggcatcctagatagtaataaaataaaaaacatgtggggccccactctcacctctcttcctaagtagctcgctagtggggagaggggcgtggctgatgagcccatccacaggaggtgacaacggtggtgggacgctcacctcccttgcacgcagccggacggcgggtggcgctacttcgtcgaggactcaaggtgaacagtaacatctgcagccacgaactcgtttctattgttgtgccacctcgtacgcatgtgctatggagagacgccaggcgccgccattgccgccttccttctcgtgagcgcagggccgagctcaaccttgtgcgaggctcacacggctcacacaaccacaatagcagttgccgccgacgcttcctttctcacgggtgaactcacgctacaccgctttcttcacaactagctctctgctcaatatatcttgagctcgagctccttcatcttctaccgcagcgtagatccggaacaatctcgtagccgccgagagtaggaggccacctgccaccagttgcatccctctttatgcttgcgcgcgaaattcgccgtagccggccatctgtgatcaaaccccgcatcctgggcaccgctccctaacgaatgcagggctggctactttggggatggatgactcaacgtggacggtgacctcctgccaccgccctcagacgacggtggtaccggggtggcaagaccacccaaggcggatggcggcgacgcggaggggactacgagggtagacactaacaagggaggggatgctaagggcatggtttgctagcatgctggaggagggcggtggcttcgatggtgcggatggggatgacacggattgggtggtcggtggcagcttgtctgcatgtaggagtagatgggaagaggtgagaagtattagaaggagaggtggccatttacatgtgggctccacatgttctttaatctttttttctgactaggatgccacattagcgaaaaacaaacacccatattattatgggacctgatttggaccgttttgctaagataatgggtggagatttctagtattgcggtttatggatgttaattagacttgagtactcgacgtaaagatgaggggcagcaagtggacttattccaatggcataaatacagcttaacctggctttcacacctctgaaaagggctagttttgaactggcgcttggcccaatagcaggtgatcaagcgatccctatctaggaattgctatttagcacaactacgttctcaatatgcattttttacttttgtttgcaaaacttttagtagtgcctgcaaacttccatttgtaagtctttcactagaaactttgttgtgggccttatggaccaaaaggctaaaacatgtgtgcaactgtgctaattagccttcgtgcctctcttactaaaattgctcaatattatttgaacataaataaatatatatttgtgttttttttcacgctgataaaaatatagttgtgttaagaggtacatctcctaagggagaccggctctagagaaaaaaatatgtgaagactggctcgaaaggaagcctgtgcttatctacttccaatacatggtatatgtttttagtcagtgagatccagggcgtgatgaaggaggccagggatatgaagctgaagaaggcgaacagggactgcaatcgtattagccatattttagctaataaagcccggtgtaagtcccctacgaacttttggccggacggaagttgtaattttatttcccaccttgtgtgctatggctaagtaataaagttcatgtttttccccgaaaaaaaagaataaactaaacaaacctatagccttatttctatctatctatggtaaatctatggtaagaaaatctagtggagtttccaataattctaacaccaatggtgaaggctcgagcccccgtcatctcatggttgatgcgcccctgcacaacatgtgtccatccataggatccaccggctttaaaggtggacgacggaagcgacgaaggtgtattttttccatatcctacggtcataagatcccatcaccctcatgtaccgagaaaaagcaaagcctagtcagcatttcgctttgtagcgatactcctacactcgcaaatagcaaactacagtactaaacggtgcgtttcgctttacactcatgaagatataaattttatctcggtttccgttagcacgcttttcaaactactaaacggtactccctccattccaaaatatagggcataaccacccttgacccaaagaccaagaaacaattattatcacctatttgtcaatccaactaatacaatacatgcacccaatagaattaagcatcttgtgagtgtatgatttaaataataataatttaggagagaagagatgctaattaattgccatacatgtatgcacgccttatattatgaaacaactttaaaaagtagttgtgccctatattttggaatggagggagtatattccatgcgaaaactttttatatataagttactttaaaataccaaatatgttcatttatcagatttataataattgaaacttaattaatcatgtgctaatagctttctcgttttacgtacatcaacttaatatttatcttcatgagtttcaaacatcaccataatgtaatcaagggaatgattatggaaggttatccaaagtttgagaaaaaaaaaacatcattggacgagaacactcctttatcctttcttggagtagttttttgatatctcattagcattctaagatttcgggatcgttcaaggtaaccgtggttagccaggtccgtgacagttgctaagggtaaccgtggacgtcacatggcatcgccaggtttagtaggtctgcagaatcagagatagatcgcgagtcaacctctccacttctccaactctcgccgcatggttccggtaccaaaataaaacttcagcccatctgatggtgacggggccgtgccacatgcatgctaggggtcgaagcagaggcatttggctgtgtttagtttcttctaaagttagaagtttaggttaaaattgatacgatgtgactgaatgtgtgtgtatgacaggttgatgtgatggaaaaagttgaaagtttggatccaaaatttagatgtaaacacagcctttgaaatgcggcatttccactgtccttgaagctttcgcagcctttcgctctcttccccggcacccaccacccgtcacgtgaacggagcacgccgcgggcatattctcgacccctcgatgcgttggtgaattggtggtgttgctgatggcgctaggttatctaattctctgagtaccgagtgataccgctggactgctggcaggtacagtacaatatattttccgaacatcagtcggtggtcaatgcagcttactcctaaaccgagctgtcagcactactttccacctgctaattaaaacttgtatcccgagacagagcagtcaagattcttgtatgattattttaggaagcaagaatgtaaaacctgtctccaagttgtatttactctgtaactaaaggagtactagtactacttttgtatgtgcaacactagaaatacagtaacaactttagagcgaagctttgctgagaaagagggcaatacagttaggccattcacagtgcaccctgctggtattcagcccgagcggtccacataggcgagccgccaaaaatcgccgccacgtcctagcgttggcccacaaatcgcgagcgcgtgtgaccaaacttggtcacccgttcttcggcgctatcgaggcggggcagcgtggagaaacaagggcatggcgcattgctgaggcgtggctttgccgcgcggttcctcccggcgcgcttcatccccaaatcgccctccctgcgcgcgcgtttcttctcctcccgcgctcgcctgaatcaagcacaagacatgaacagctgcattagtcattgactgattgacatactgcactgatcgactgttcatctattggaaaatcaacatccaactactgaaatttcataatcacaaagaccaaaaaaaactaaaccaattcaaagcatgaacccagatgagaacctggaacaggttagcacacactgaactgattgatggcttcaacacctgaagcgtatacatgaacgcaaggccaatctagaatcgatgctttagtactaatcaataaaaaagacatcgagaacaaacatcaaatcacgctggaaagaacttgccttcctcaacagaaaaccgatctaaaaaattctatctgaaagagcagtccaagaagaaagaaaaaacaggagatcagtctctgcaacaaagcaacccaagaaactaacctcccagagatcgcggctcgtcgcgccgacgacggggagggaggggcgccggcgacgttgatggggatgggaaggaggggcgccagcgacagggatagggatgggagagagggcgccgacgatggggagggaggggcgccggcgatggggatggggatgggacgcggtgagggggagaagaagtggcagctccagccttatctgattggggagaaatctatacgtattatctgacttttggggtgcaaagtgtaaaatttggatttctttgttaatagaaagatagcaagggactgaaatagaaaatacgaggggctgaaacgaaaaaaccaaagctacgcatgaagacccttgcactgtgggagagaaatttttttagggcgtggtttcagcgcacatggcagctgtggctcctcaaaactgttgggcgcattgtaaatgccgttatggtggcatcccctgcaacgcacgagcctgatgttggttatcactcactcacctgtcaatatgccattgctttgaagcacggttttccaatactggcactccgagaggcaggttcggtagttgccaggtgacagtcgttgcctgagacagtttgggggtgcagaggaggagtactagcagaaagaaggcatccattttgttgtgaaagatctttacatttccttgttgcttcaccgaccgtgctacaggagggaaaagccggcatgcaataattcgacgtcgcaaaccaaactgcaatgcttgcagataaagccaatcgtatcagttaccgtcatactcctactgttcttgagtaccctgcctggacaagcatactatcatggtactcgtgcatggtacatgggcctttcattagctttacacaacgggattatatagtctgttatcttcttatgatactactaatgcattatttttagaaactctcatagtgtcatctcctgaacaatattaatttcttcatagttttgatctttgatccactgggcaggagtgtactgacatgcagataagtggcccactgggcagtgttgtggggttgggttcaataatgaaggataggaggaggtgagaaaagctaagctcatagtatagtcacatgtttgtcattaagtaacagaaggggcacaggaagaaacataaacaagagaaaaaagacacccacacgttgggccatccattttccacaaatcagcaccggccaccgcgtcctcttgcattaaggctaaataaaccatccattgactgctaggaaaaaccctccatttcaaccaaattgaacattttccataatgttactgtgcggagatatgatcaccggtctttaccattacatagtttttgtccattatataaacatggcagttctttgtgctggtcagaaaacgccatgcagtttttccatccccttctcactgtaactaagttaatcaaagagtacatcgacatcactagggccattttcggtgaaatgactctatgggagaaaacgacgtcttgcaaccttcacgtgccatgacaccaacaactcaaaatcctggctccgcccgtgtttgtgtgtctttctcaattgcaaactatcgtatataggggaacatgatagattcatgttgctgagttcttcttcttcttcttcttcttcttcttcttcttcttcttcttccgtaactgtgtgaattcctacttagtatataagtgggttgtttacattatttaatgaaacattatgttacctaaaaacataaataacatatgactatctttcttgagaaaatcctactagtctagtactgataatcgaaaaaagacattttttagaaagttctctctccatctcaaaataaaccaatctaagatgtaatgggacatcacccaatatgataaatctggatagagacatgtctaaattcgttatactaggtgacatctcatctaatatttgtttattttggaacgaaggggtacttcggtacataagaaaacacaccctacaaactttgaggggcgtttttctgaaggatcaaacttttaagggctagaaaggaaaagaagagcgctcctcttcgaggcttcaaaccccaaccaaacctaacaacttcgaaaacttgaacccaaaaccaaaacgaaagcgagccaaaaaagctgtagtaggcctaccataacacaaaagcccaaaacacacgcttccccgcaactccaaaaccggaaaacgaacaaatcccctcgcctcctcccccctcccatctccgcccccgtcttcccctcgcctcatccatctcccccatgtggctgcctgggtgaagacgcgcccctcctgcccttcctccgc

SEQ ID NO: 54769 - DNA, 2629 bp, Oryza sativa
gcgcgctccgcaccctccaggcgccgcacgccgccgtggccgaggccgaccgccgggtggtgctctacttcacctccctccacgtcgtccgctccacgtatgaggactgccgcgccgtgcgcgccatcctgcgcggcctccgggcctccgtcgacgagcgggacctcgccatggacccccgctacctccaggagctcggcgcgctcctcccccgcgcgcgcggtgtcaccctccctcaggtcttcgtcggcggccgccacctcggcggcgccgaggaggtccgccgcctccacgagtccggcgagctccgacgcgtcgtagccggcgccggcgcaaccgccttcgccgcctgcagccggtgcggcggcgagcgctacgtgctctgcggcagctgcaacggcagccacaagcggtacagcctcaagggcggcggcggcttccgcacctgcgccggctgcaacgagaatggcctcgtccggtgcccggactgctccccgccggccgtctgatccagatccaaaggtcacaatctcatgactactagattttaatgtttttttagctcaaacttgagatatgaaatgagctgtgtgtgtagctgttactcctactacttgttattattgtagtggtgtttttgtgtgtgacagtgcccaattgaaacttccaagttcttagcatttgctaaccaacgtttctaatgtttgattaggatttagtaaaagagttgttgtttccttacttcttggctatagtaccaagtaccgcttttttaccctctcttagctcagccttgaatggcagattgtcagtctgaatcggtttgttctatactcttattttaacttttgagtaaatgattgataaatgccactagatgactagagtagcagttaagaaagatatataaatctctagtagatgcgtgaattctactgctgttaattctcacttcctctgcaatatttggcctgatttcaaaactgttcaccgctctgatcactgagctcgaatggctggtgcgatgttgcttgtttctttactgttgaagtttctagaaagctgctactcctgcttgccagtcgccatacacgccaacggttgctggcgatatctatggtgggctgctgctacgctgaaaaagcaagcgccttgctcagaagtcagaaagcttttctttcaaggctgctattcattccgaaaatggaaagggtgcggcccgggtttgaatgcaatccgatcggtgaagtgtccgttgcataggacaggtttcagaggctcagcgtactaacctccaaagtatcatcgaactgaaaacttatgtgaaggcttaacgagtcgccagcccagccaaccctttttccataaccatgaggtagtagtaccttttcaggtttaagagcttcaaaacagccggtacgagcacctccaacaaccatttcaaatctagctctccaaatccaaatattaataatggcagtgtttagttcccttcaaacttctaaaaattcagtcacatcaaatgtttggacacataaatagagcattaaatgtgaacgaaaaaataattgcacagtttgcatgtaaattgcaagacgaatcttttgagcctaattacgccatgatttgacaatgtgatgctatagtaaatatttgctaatgacggattaattaggcttaataaattcgtctcgcagtgtataggcggaatctgtaatttgttttgttattagtccacgtttaatacttcaaatgtgtgtctatatacttaaaagaaatttggcacatgaactaaacacgaccaatatctctttgatcagcttgtaaaaaattaaagagccaaatttacttttcagtcattccaacatgactgaggatttcacatgtcaatctctatacttcttcctttctccatatctttcccctcctcacccccctcgggggtctaggcagaggtgttgacgacgatagtgtgtggaggcggtggagccagcgggaggaagttgggacgacgtaggccaaggtcgaccaacggtggggatgctacctccggtgacaacctacaacacgtagatctggacgtctatagtggagtaaggcaaggaagctggtctcgagacgacgatggcgacaacatgcttctcatcgacgccgaggggagacgaaggaaggaagagttgattggccacctcattctccgcgccagttgccggttggccctcccacattgctagcgctagggggcgggctccggcatggccgttgcctcatctcaaccaccacaccaccccggatttgcccaatggctgccatcgacgcttcctctcctctggcacaagagggaagaggggagtagccatgcgaagaggctgttggatcacaattttttttgctagacttatcaaaatttaacttagagaactgttcggagagaccgttgaatatgttctaaggtacaattcaaagtctcagattgatcctaagttcctaatcttctctttccttttcttccacttccatacatgctcggaaaccttaaataccagcgagcgtgtgactcaagatgcagcgatacaaaagtgctgttcttctcttctctctcaccggctccaaaccccaatttgttgaa

SEQ ID NO: 54770 - DNA, 17002 bp, Oryza sativa
  unsure (1)..(17002): unsure at all n locations
cattgccatctcgtgccctgtgcccgcaatgcacacttgcacagtgctagctgctagttagcgcaaccgtgctccgtgcaaagcgcgcaacgcgttgatggcggcgcacggcatggtaccgtgcatcagtcaccacaccagtcagagtcgcacaactcacgccagtggccggccgctcggcgtgttgcgcgtggaagtggaaccttgcggcggttacgcttggcgtcaagggctaccggagcttggagccgcgaggggcgcaagtcccccacggcacgtggtggtgggactcggtgatccccttccccctccggcttcccaagtcccatccatccacccagtcgcgcaccgcgcacacgcagcggtaacgtgcctccgcgagggccccgcgccttgacagccttgttgattgcggctccgctccgtgcgtgctccatcattgtggatcaagtggccgcttcacagcaagtgtagactagttgtagtaccctgctagtatgtcctaatcctgctgccctatatgatgcctctctttccatgactttcacgatccactgtttgtcggcgatgagggttagagtgaccacctagccgtcaccagcggtggccgctgctattgtccttcagagcttgaggtgaaggtgttttaaatgctggctcattagcgcttgaacctcatgaatgggccggcagcctctgcgtgtggaagcattattaagtgtaccgtgcatatgtgcatgcaacacgtcgtcctgccacgtatgtacgttcacgcacgcatgaatggctgcctttacggtttgctagcctgtggtaccagaaaggcaagaactttgaatcgagtaaatttctctgttctaaaaaaagagtagtaaatttctcaggctatcgtcaataactgaacaggaaaaggagcactgcagagccggccatttactctaggcaccctttgtcccttttcctgcccttacgcttgtaattttgccactgatcaccaccggtaatggtacaactggaacactgtaggagtaacaaaggacacatataaggacgcacggatgcagtaacttgccggaaggacgcctaggattattggaagtttggaggcaggcactcgcagatgggccacaggtgggagcagccccatttgcagcggccgtcgacgttgccgtgatcctggcatgtctccctgcacttgtgggtgtgggtgcatacgaggtagcggacgttgtccacgttccagcagtcctcaccctgaacagaccacacctcgcctgacatttaaaaaagaaacagattaagcagcagcgcattgaggatggaggtggcgctgatgggcaaggggtgatgctcattgctcactggaagcaacgatgagcagcacaagtgcacagcggagcacaaggcagtctttctccaagcgaaatgcagatgaattggtgaccaactcgaagggtaatgcagcaagccagcaacattgtagtgtgttcatgtatagaagttgtgactcgtaggccgagagaaaactgaaggctcagatcactggaggtcaagcgggttatccgagacaattataggaacaagaaaactgaatattgatgatatagagatcagttctagatttatactaatagttggtattaccaatgatttggctttaatccaaatatacactatcaatattcaaattaccaaattgatatgacatattttgacatcaaaccagaatgacccataaatttcacaacttttatatggctctacccaataagcaagggatacagtccaagcaaatcgggtgtattcggatgccacttttcccaacctctctcattcgttttccacgtacacgctttttaaattgtttaacggtgtggtatggtttcaaatttgagagaatgacatatgggttcctaggctaagaaattgtagtacgacatagttgcggcattgaaataaacacatatctaagaaagtgtagcttggtaatgtgaggcaactaaccaaacacctccttgctgtctcaccacaatgccactttacattggctatgtaagaagaagaagaagaaccaagttatacatagaaacacaattccctcactagatcgccacagtaacacaaaacatccattacaatcctaaaaagatcatatcaatagttgcaaagataaataccataattactttataggcataacaccatgattaacatgtttataggcacatctgatttattctagctgtcaggagatgagagcagtcctacataaatgcatagatatacatgctccacgcgcagttgttcttgcaactaccgatcaatctgaatgatctgaccttagtttctgctagtcctgagctgcgtcagcttggtggccatggccggcatcgtcgacgaggggtcctgcttgccgcacttcctctccctgctgccaactctcgggctgccactgccactgccgctgtccgttcctaacccgatggacagcttgctcagagccttccgtgcgtcggtgcagtacttcttgctcgcgtcgagcagcgacgacacgccccatccacggcttgcggcctgccattcctcgcggctcctcttctcgccacgcggccgcggcaagtctcggccgccgctgccggtcttgttctcctcctgcattgcgtcgcgtagggtgacgaacctgcggctctgtgaggacgaagggttgctggcgccggcgagaggggacggcgcgtactgcgccggcgggctcctgaacccgcaaacggcgggcttggcgctccaggggaagaacaccatgagcccgcaggctctcggtgacatctgctcgtcgcggccgttgatgttgatgcgcggcaaaagctgcacctggacggggtggtcgttgctttgcctggccgtcggctgctgcccgtcgtgatcgcggcgcgtggtgcgtcgccgccagtgtttcgggcctctgcccgaggacgaggacggcgtggcgagggaggcttccgctggtgcacggcgggaggaccggtcattgacgaagctcgtggcgcggccgaggaagatgtcctcgaagcgcttggacgtgatccggtcgaacgagccgacccgctgatcgggcgtggagaccctgtccagggcgtcggagaacgacgcatcgtcgtcgtcgctgctcgcggcggtcgagttgccgtagccgcaccagttgctgccggggcactgcttccagcgcccaggcggcggcttcggcggcggcatgatctcctgcgccatgtgcatgcacgcgctgctcctcttgggcaccccaggggagctctcccaggaaaacggcacctgcgtgcgcagcggggaggcttcgcggcggcaccgcacgctggccgcgtccgccgaagcgcacgaccggcgcggcgtggggagcggcgagtcgagcagctgcgggagcttctcgccgtcggcgccattgcaccgcagcccctccttgtcccgcctggtgacgatttccatgggcattgcgccgactgactgtgtcggcagcatgcatcgtctcgggcgttcaacgtgtggaggggacgacgtataagagtacacgcgaagactgtaggtagaggtgcttttcccgcgaaaagtggcagtagcggcggttggacagtaaccttcgtgtatggttgtgtgttcatctcacgtactgttcttttgcctctcgctagctcgttcccgtgatcaaggtgcatgctcgatggccttaatggtggaggttgccgaaaggtagcagaggaaatcaggctaaaacttgcacacattacataggctaaaagcttgtgatgtgaaacgtacgcgtgtctgcattggccttgccatgtgtatagggtggttggtggccgccttggggattcgtccgcggactcgggatgcactgttcaagtgtccagggcatgtttgttcggcgatggaatcccggtgatcgccgtggcttgaggggaaggtgagagagacgccacaacgggtttagctctgttccgctattcggcccattaacatttgcttatgggccacctatcttgtggcgtgggccagcaggttagtttggtgcacgacacgactccacgcaccgttccacctagcaactgacgtcgtagtcagtagatgggtcggggactctcggagagcggttcgagggggccgtcgtttgcgaggccgcaagtcgccgtcggcggccgtcgccatcgccgcaacataaaaaaagcgagcaaacccgttgctgcgcgctctgcgcttctgcccttttacgaccgaagaggtagccaacccacgcatcccccccctgacctgccccctccacagccgccgccgccgccgccgctacggctcacgagagtaccgaacgatctgctgccacccccaacccaagtgaccaaccgaaggcggagggtagcaacttcggtctgctcatcccaaggtactagactgtttagtcgattggaggatctcccatgcccgtatttgtgtcgattgctggtggtttgggacgagatctttgcattgggcggatctgttttgtgtatcgttgttgcttgtccgcgcaggtggtgggttcctactttcgtgttgcttccttggtcctgatctgttcgcgttggtgcggtttgggttgcagcgtagttcttagttctagcgtgaagctttgcggattggtgttgtctgtagatttgtgagatttacaaaggattggcgccggctgtgctggatcagtagattgtgaccgagcagaattgagcgggctgcaacggcgtactagagaaaagaggaaccgggacaactaaagattctggtatactggtattctctggatgctgatggattggaggaagacgatcgtagtattttttttttttttgatgtagaaaggcatcaacaccttagttactttaggatggatatagataccttgtggggaaacggtatggaagatactttagcacccccaattttctcatcttgctcataagttttgtaacttggatgtcaggtgatgataatgctagaatttagcttcagattatatcatctcatgcttctcgtgggctcatttcttctgaaccttttgtttgttatgaccaatatttaaatgataatcatcagcttgtagataattttcatactaaaagtttttagaaaatttctaagaaattcacaagctagtaatttattgaagttctgaaggatccagcttttgtgtcatgtcatcagttgtttcactgctatttgcaagaagacatttcatcatgtagtccaaaagataaagaatcgctttaatatgtattaccattacttgtcagtgttttagatgcacttccctaatgatatacaaatgattcatgtcacgacctgtctattttctattcggcatctcctcaatataaatctaatggaactgttcctgcagttaggcatggcatcaactgttgccatcaatttgattggtgctcaggctggcattatctcaaagttaaggaattgcgacatcacaagctacagtggcttaaaggcaagatcatctattagttttgagtcaaggtcatcattcctgggtcagaatgcatctcttcgatcatctatctctccaaggattgtaccaaaggcaaactctggatctcacatttctcctgaggcatcttacaaagtggcagttctcggtgctgctggtggcattggtcaaccgttgggcttgttaattaagatgtctcctctggtctctgcactacatctgtatgatattgcaaatgtcaaaggagttgctgctgatctgagccactgcaacacaccttctcaggttctggactttactgggccctcggaattagccaactgcttgaaaggtgtggatgttgttgtcatccctgctggagtcccaaggaagccaggaatgactcgtgatgatctttttaacatcaatgcgagcattgtcaagacacttgttgaggctgttgcagacaattgtccagaagcctttatccatatcattagcaaccagtaaactcaacagtgcccattgctgctgaggttctgaaacagaagggtgtctataaccccaagaagcttttcggagttaccaccctagatgttgtcagagctaacacatttatagctcagaagaagaacctgaagctcattgatgttgatgtcccagttgttggtggtcatgctgggattactatcctaccattgctgtcaaaaaccagaccatctgtcaccttcacaaatgaggaaactgaagagctgacaaggaggatacagaatgctgggacagaggtggtggaggcgaaagctggtgctggatctgctaccctgtcgatggcctatgcagctgccagatttgttgagtcatccctccgtgcattggctggtgatccagatgtttacgagtgcacatttgttcaatctgaattaactgagctgctgttctttgcatctagggttaagcttggtaagaatggtgttgagtccatcatttcttccgaccttgagggagtgactgaatatgaggccaaggcccttgagtcattgaagcctgagttgaaggccagcattgagaagggcatcgagttcgtccacaaacagcaggctgccgctacttcttgaagtgtggagaatgactatcggcatgagagaagataataaatgcagaaatggttctcaatagcttttagttttgaaggcggaatttttcgtgtctagttgttgcttgtttagtctcttctgatcacatgagggcgtggatgcccaaactgttgcctgttttcatgagctatttgacccttgtgcctgcatcttgatgagatacacaaactaaggaataaagtagtttttgattgttgcctgatttatgttattatatataccttctgggtagtgcaacatggcattgcgccattgcctttggcaaaatagcaacctcattgatatcatctctcactgtgtcactacttaccaatttcatgccaaaattttctgaacagctagggcgaggagctgctgctgcaatgccatggcacgtctgtttctactgaatccgctacaagcctacaactctggtaagaaaacaaggcaaaccatgttgaatttatttcggctgccatagtatgttcgttggattgaaatctcaactgtttgaaaagcacaaaaagtccatttcgctctacatgaaaagatcagttctatcactaaataatctacaggtgttggaagaaaaagaacggaataaacaattgtgcccacttcttcctcgatcaagaattcaggatcatccagctttagccttactcgccaagaaagcgtccagcttgtcgttctgcacccggccgaggaacctgatgcagatgggcggcgtgacgtcgtacctcgcgagcagcgcgtacggtatggagaagaggccgtcgccgcagatgagcccggacgccagcaccggcccgaacacctgcgatcccagcttgtcgttgcggttccacaggaacacgatcaggctgccgatgcacatgtcgatggacaccgccggcaccagcaggaacgacacggccatgccggtgacgctcgggatgtacggctcggcgcgccacttgccgtgcgcggccacctcccgcatcgcgcagacggccagcgccagcacgaagaaggtggcgctgatggcgaggcagtacttgggcagctcgaggccgccggcgccgagcacggcgatgccccggtagatcttggccagcggcgcctggtacgtcttgttggggttcatctcgtagaagtggtggaagacggtgaacacggccgggttgacgacgcaccccatcgccgtgccgatcacctggctcaccagcgtggcccgcggcgaggtgagcgtcaggtagctcgtcttgaagtccgacatgaagtcggaggcggtggagacgatggacgacacgatgccgcagatgacgaggctcccgacgatcccgccgttcttgatcccgatccacgacgcgaacatgaggatcaccagcttgttgtactgcgccgagaagttggtctccgcgacgcccgtgccgtaggcgttgcagaaggccaggacgggcgcgaacgcgtacgcggcggcgacgtggtagtacctcacctggccgtacatgagcgggatgacgacggtggagacggtggccaggacgacgtacccgctgatggcgaaggtgctcgggatgtgctccctgaggaacacctgcgtcctgcggcggtcgtcgaagctcatcaccggccgcggcatggcgtcgacgtcggagaaggacctgagcgtctccgccgctacctggtggtggcgcaccgtgtgtatcgtcctcagcgagatcgcgacgagctggaagatgccgtcgccgaggatcattgctatggcgcaaaacaccttctcgatcacaacaaagtgaagtctgactgattcttgatgcacatcatcgacgtcgtcttttttttttttttgtctaacaacaaatattcgatcattggtagtaccttgtatccactgaagctcttcaagttcgtctcctggagatcggcgtcgtaccagattcctcttttgctccggatgtacggccgcatgatcccccaggagatgatggacccgaagagcatcgagacgtttatcaggtgaggactgatcatcccgattcccacataagttccgttcaaactgatgtagaaactgcaacgcaacaaacaacgaaacacaagtcactcaagccgatgatcgattaatttctccagcccgaataaaaactttgcatgaattcagtgttcgaattcgtcggtttcctcggttcgttgcctagctcaggctcggctcagcttacccgcgattgaaggcgctgagcccaaacgttgggaaggaagtgaagccgcagtttggacctccggtgtagaaccactggaagatggaccagaacaagctcgccaacgacgaccggagaacgagcgagacttgcctcctgtgatcacaagtagacgtagatattaccgtaaatcatgtgacaacatggctataactcaccaagctagtgataatctgctcacttcgcttgtctagcgccgtgaggggtatggaagctgttgatgaggtgagccgtcgccgagccgcttgggaacgtcagccggtggcggatgatcattgtctacggacggatgaaccagtaaatcggcgaagaatcagggagctatgatctcttcttcttctttttttttttgtatttttaggtgcgttcgtggatcgtaccttcctcatggggacaatggcgaggagaccgacgaagctaacgaggaagaagaaggccatcatccgaccgaactccggctcactgacgctcgcgctggagtcgtccccggtgctcgtcttctccgccgtcttccgatccatggccagcagatacgatccaaacccacctaagaacaggccagccgccagcgacgtcggcgttacgacggcgagatcaatggaagaggcaatgcaggaagaggcaagagcgcggcgtcgtgtcgcgcgcggtggcgtaccgctgtatgtcatgctggcgcaggcgacgacgcaggtctggacgacggcgttctcctggcgggtgaaggggcggcccggcgagccgagctggtcgagcaggcgcgtccaggccttgaggaggaagaagccgaggaggccggcggagatgttgagcgacgggatgatccccgacgtgaacaccaggttcatcatcacgctgctcagggccacgcccagcgccacgctcgccaccacggcgcgcagcgtcacctgctccgtccacggcgggacgggctgcccctcgaacgcgcgctccgtcgacggcccatcccgcgggtcgccgaccgactccatcccggccacttttcctcctcctccttacgccgcgctttgcctcgccggagtatcgtcggtgcggatcgagctggcagccaatgcatctactgcgttcgatcgtgcctgcgcatgcatgcaagtgatggtcgatctggaggagggcaaggggaagaggagaacggaggaagaggaccgaacgagtgaacacgagaggcaggaaggctacatatgctttggctattcttggcagagcccaagaggcaagagatggtaatgcaaccgcgaaatgttagatttggaggtgtcactgctccttcgcaccctcttggctcttgccatgcatgaagccagaagcagaatctcgattagccggtaaaattcgagctccaatcattttttcgctgatttcaatcaatttttgataaatttcgaacgaagttcaacagttgaacagaccattcgaaatgatggctcgagatggtcgaaattcgtggagatcgtgacccttggctagaagttactcaaataccaacagcgcaacgttcttgccatgcaaataagtagttcaattaccagcggtgcaatgcgagggatgatagtcccaaaaatcagtgaatcgtcgtcatcttggttgttttgaggaatggtactcaggaaaagggaatcgtaactattgtgactttcatggatcctcagaccaaacaactctagacattaaaacaaaatgtttctataagcaatcatgcatgctcaggtggcgctcacacagatacaatgcaaataagtctaaaaaagcagattccatttcttgtgtagcttttttggagacatttctagtgtggctacgcattctaataagggtttgtttacaacagaagaaacagaaacaaaaagggataaaacagtagataagtaacagaattttctttgttgccaaggacatccctagtggtagacaaggctaggaaaacgtccattgctcatgcaatttattcttctcatacttctgtacaaaggacatctaaataattgttgtgttgtactgcaaagacattttgctccatctaattaaccaactgatccctcaagcttcaggttcataagtgcatccatctcatgtgcaaactcgtaaggaagattctcgaaaacagccctgcagaatccaccaatcatcgctgcaacagccttttcatggtctatccccctttgttggaaataaaatagctggtcctcccctatttttgaagtgcttgcctcatgctcaacacgactagaaatgcaacccacctgttatcacgcaagttggaacagaatgttagtgtaaatgtaatttcagccatattagataaagaaatagatgatacgcattttaggcataagtatagtactggaggctcattagttacacatctgtattcaaaactgcaaatacatgtaattgcagattatggaagtgcttgtgcataggacatgcgtgcacagagataactcatgtctagctcaagatcacaatgggccatcaagaataccatgagaaacattaactgctggaactaagcgagtagcctagaggtgatggtaagcaacttaaaggtacagtgatattgcagaaagaatgcatgacactattagacaaacgaggtcaacccagcggcttctatgaggaaggcagcgcaaaggaggcccgagcgcttgttaggaaggccgaaggcggctagggtgctgaagggcggaaagctaaaaggtcatctaaaggtgtatttgaatgggagcatgatgaaacctgaagcggtactaaagttgtgctggctatacgccatcagtgtcatataaatgttccagatgaataagtatgagatttttcctgcttttgaacatgaaaacgtgcatggcaggagattttctaaccataagataaattggactaaaccaatagtttgactcttatagtttttagccagcataaaagttaaattcagtaatatggaatcaacggcgaccatatttcttctaatatatggaacagtgtgtattcccaaaaagggtgtcattaccatttactttgcatgtcaatatattgaaacttaaatggagaagactgattgtaaccaaggactacgaagattaatatgaaaccctccaacttgcaaaattatcaaagcccctattaatttatacatgctctattgcttttgtaaaacagaaactgaaaaatgacatacagaacaaaggattaacaacctactcttaatagtttgcattataaaaatgcaattggcccttcatgccaggcaaatcaagaacagcagagcagttacctgaatagtcggataggtgttggcagcagcgttatccccaatcagcaaagaatcacactgtgaagaattataagcattttctgcgcctgagtttatctggaccaacccacggtagcaattccgtgacttcccagctgagatacctttggatataatccgactccgcgaattctttcccttgtggatcatttttgtccctgtgtctgcctgctggtaatccttcgtcagtgcaactgagtagaactctccaacagtatcatccccaagaagctccacacttgggtacttccatgtaattgctgaacctgtctcaacctgtgtccatgagatcttagagccccgccctttgcaccgtcctctcttagtaacaaagttgtaaatgccccccttcccctcctcatcaccagagtaccaattctgcaccgtagagtacttgatctctgcctgctcctcacacacaagctccacaaccgccgcatggagctggttggagtcataagctggagcagtacacccttccagatagctaaccgtgctcctctcatcagccacaattagagtcctctcaaattgcccggtctccttgtcgttgatcctaaagtatgtcgatatctccattgggcaaaccgtatccttgggcacatagcagaacgacccatcgctgaacacggccgaattgagggcagcatagtagttatctgccggcggcacgacgctgccaaggtagcgcttgacaaggtccgggtactcgcggatggcctcggaaatggagcaaaagatgacgcccttcttcatgagctcctcccggtgggtggtggcgatggaggtggagtcgatgacggcatcgacggcgacgttggcgaggcgcttctgctcgctgagcgggatcccgaggcgatcgaaggtgttgagaagctccgggtcgacctcgtcgaggctgttgagcttgggcttggtcttgggcgcggagtagtagcagatggactggagatccaccggctcgtacacgttgtcgctccaggtgggctgcaccatggtcaggaaccggcggtaggcggcgaggcggaagtcgagcatccacgccggctccgccttgagctccgagatgcggcggaccgtggcctcggagagccccttggggatggagaaggactcgaaatcagacacgaacccatacttgtactccctcttcagcaggttctgcagcgtctccgattccgtccccgcctgggacgacgacgacggcgatggcttctgcgggcccgtctgcacggccaccaccgagaggcgtccacggcgcgtgcacggcctccgccgggatccgtacgacgacgggcacgccgccccgagcttggcggtcgcggcggcgcagcagggcgagaagaggggcgtggacgacgcggcggctgcggccatggtgcggcggcgtggcgaggccgaggcgaaattagggatgcggatgggatggagagcgcaggaggggtgggttgttgttcggtggtgtggacccgtgctacgtgagcctcagccgcgcgtgaggccggcgcgggtgggcgcggtccacgggaagcccggcgcgatgggggcacggtcgtgtggcggccgagaggcgtggcgcggcagtggatgtggttcgcgccgcgtggcgggccatgcggaaaacgccgtggttttgtgcgatttctccccgtttcttggcctcgccactccgccaccgcaaaaaattccaccgcacacgcgacgacgaaaccgcctctggctgggggctttagaccttcaacggtgcccgttcacccgcgatccgacggtgggggagcccctcgccgtccagatctcagcctctcggatcggacggagcgtgaggtcgtcgggtcacccaacattttctccacacgcggcgactttctagcaaaaacgcagttcgtttaacgagagtcgctcacttctcgttcaggttcagcaatcgcaatctcgtctcatcgtcgccggccatggcggcgtcgtccttgctccggtcgctctcccgcatctcgcgccgcggctgcgtgggaggcgcggggccgagcccgttccaccacagccgcctcccgtactcgccgttctccaccgcggcggcggatgcggtggagaggagggggttcgcggggctggggccgacggcgaagggggagaaggcgcgggtggtggtgctggggaccgggtgggcggggtcgcggctgatgaaggacatcgacacgaccgggtacgaggtggtgtgcgtctccccgcgcaaccacatggtgttcacgccgctcctcgcctccacctgcgtcggcacgctcgagttccgctccgtcgccgagcctctcgcgcgcatccagcccgccgtgtccaagtcccccggctcctacttcctcctcgcccgctgcaccgccgtcgaccccgacgctcacacggtgagacccccatagcagctctgggttggtgtgtgcggccaaatggccactggttttacagacgtgcctgcgtggggaatgcctgtttccaacattcttggaggagtgatcaaaatgtgggaatgatcgaagctcgatcctttctatttttcctcgtgcagaatcgatacttttgacctttttgaataggggagaggagtgaatcggatttctgggctttgctggaggaatcttgactttactcatctgcatcgtgatccatccacagcatgtgctgcgtgtctcttaagtagttgattgagtagttggtgagctgccttttggtcacatcgaaggagaagaaagttagaccaataataatggggaaaatagctagagaacgctgctgaacttgcgtatattcacgaattcatctatggttcgtcagattctatgtgatactgtatttattgtttagtactccatccggcccaaaatgtagcaacctatctagtagagtactaggttgctatattttaggacgaaatagcttttgcctggaaaagaggcatggtacttcgtgaatattcaccatctagtgcatatttagggtgcagttttcatttaaactttacaaacccactggatggttaatacatgaatttcctataccaatttttctctgaaaagttgtttcacctatttattcatcgtcctttgacctttagattgattgcgagacagttactgaaggtgagaaagataccttgaaaccttggaaattcaaggtagcgtatgataagctggtctttgcgtgtggagctgaggcctcaacttttgggatacgtggtgttactgaccatgcaatatttctccgggaagttcaccatgctcaagaaattcgcagaaagctccttctgaacctgatgctatctgatgtacctggtatgccacagaaacacaaaacaactcaaatcaagatatttgtgttacttaggtaatttgtcacattgacaactatcacacactcacacttcactggcacaaaggaatcagtaattactcgttacttttacattttgtttgtctcttgatgaaatttgcaactacattaacctgggctcttattgctgtttcttgtttttctctgtttgattgagcagaatttagaatagaactattacattttaggtatacttgttttttacaaaataccttgtgtgctgaaatctaattttgtttatatcctccttattataaccaattggccaatgttatttgttaaaacaggaatatcggaggaagaaaagcgcagacttttgcattgcgttgttgttggaggtggtccaacaggtgtcgaatttagtggtgaacttagtgattttatcatcagagatgttaaacagcgttattcacatgttaaagattatatccatgttaccttgattgaggttagagctgttggcatctctccctctctctaaactttgaccacacttaacaaattttgtttcattttattatttcaggcaaatgagatattgtcatcttttgatgttcgcctcaggcaatatgctacaaatcaactaactaaggtatgtaatctctgtctaatctagtgttgtactgttgtgccattttaagccatcatgtaccaagactccaagacctaaaaatatgtgtggatcgtataagaaagctggcagtgaaatactaaaaataacttgtgatcatccaacagtcaggtgttaggcttgtgagaggcattgtgaaggatgtacaacccaacaaattaatcctggacaatggagaagaggttccttatggtttgctggtatggtctactggagttggtccttcatcattcgttaagtcgttgccatttccaaagtcaccaggtggaaggtattgtaaattggcttgaccgtatggagtttcatgtatatgcatcatatactgaatgggatttgattatatgcacctgcgcaccttctgtactttgaggaatagggatatatatatatatcttctacatgtagttcatttgtgaatcaggtttcaccatgcactataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54771 - DNA, 1376 bp, Oryza sativa
attcctgcagcccgtattaaggaaaacaagaaccaataaagaaaaggccacaccaaaaaggaaaattaaaaccaatttgacaaagactttttctccaccacatcgcaactatgatcactctatgttattccacatccacataaattctaacgcaagtgaaagagaggacaaacagagaactaagaaaaacctagatgaaccccaattgcatagtgaccttttaaaatcgcaatagacgtatgtcccgaaagatagatctacaaggccgctgaagaaacattggcaaggacacactcgatcccgaattatatttgctcatgtactaccatctgtcaacatgaagcggggagagagagagagagattgttattccaaagaacaccgtcacccccctctctccgcacacaccccaccacatgtccacatgcatgcaatgacgccatggacatgaagcccagacccaatcacacccttatggaaaaaaaatcaccgaggtaagatggctaggggacaacaatagtagatccgtcataaccactgccattgaagacgataagggaaaacaaaatctttatttggaggaaaacctaaacaaactactagatccactagagggtcagatccccttttccttctataatagcaggaagggggcaccagggagacgctagggtttctgggttcggcagtgaaaaaagagagcaaatttcaagtgaaatagtcagcgtcatgttacttttcgcctgtatttttcccccttccgaaatgtagttgagtttaatttggacttgtgttttggtggtaatgtaattcatgccgatatctttgtatagtaattttttcatgaaattagtaaacttttagatcccttttttttttacagatttttcacttatttgatggttttctttagacatttccacttgtcatcataatctattatccaacattgtattttaaaactaagggcctcttcggattacagtattttcaaaggattttttgaggaatactgttgacagggattttttttcctttcctatcattcggaaggcacaaacaggttataggaaaaatctaaggaaagattcctttgctgctgattacaaaggaaaaacacaggaaaaataacatccactccgacctcatttttcttttccttcgcgtaagaccgaggtaatcaagcagtaaacaagaacttttacgaatacagacaaagcaactaagcaagaactctgaaggataggaataagaagcaatccaattagaagaaaaaaaaataaggggaaaaagcaactcgaggttgccagccgctcgagcttgtgatggccatggcggcagctcgcccctgccgcgcggccgtgcgagctccgtct

SEQ ID NO: 54772 - DNA, 3286 bp, Oryza sativa
aactctgctttcgcccttcctgcattataggaataacttggagtgaaaagcttggaccccacatgatggtcccttgtggtggcggtacaacacaatgattgagaaatcaattgaacatatgatggtcatgcctgtgcggtcaaagcgtgggctcatgttctactcccaccatctcctcaactacattgcttccccatctttgtcgaacctcttcactgttgggcctcaccaatgcccagcgacaccgaccagtttgcctcccattgtgagtatctccgcactcaacaccgtcgtcttaaatgtcacgtaggcctacccgacaccacccgcatggcctccgtcggcgtatgggtcaccgtcaatggccacttcaagcttccagtcaccaagcacttccttgagaacgtattattcaaattatcatatggatcgtttttcaaattcagtgtttgtttggtcatgacttcatgtagaacgaatccatgtttatactagatgggtacgccgcgcgttgctgcgagagaattatgtgataatatagtagatatgagttctaaaattttatttcttacctactatacgatttgtttcatgtgtttatatatttttgtacttttatcaattatccaaaaaaaaacagttatgattgggttgtatagtatgctttttaggggaaagagatgcaatttacacccttgatgaatcattcaaatgctaaaaacaattgaggtgatgtggcttcatgagaaaagagagaattggcattacctatacttagtggagatgatttatagatatataggattcaaaagtcataggttcgctgcagagtagacctactttaattaattattaattttgatttcctaattattatgggtccacatgtcatatggataatggggcttgttactattatatatttgttctattaatgactcggttatttcctaattgacaagttggtgatcctttgacatcgtttaaattgtagacttactggtggagcaaaagcaaaacatgatatgatttatggttgtgcgcttggcatgggaaggcaaatcggatgtgctgcgtgtgtggagcttattggattccgacgtgtgggatgcttgatcgtcgatgtggaagcggtgaatttggtttggaagtgatcgatcaggctcacacgtgctgctagggcgccaatgcagaaacacgaaaaccgtcgatgtacgctagacaacgacgaataacagaaacagtaaaaatattttaaatatgtaaagataaagataaagaaaaaaacgagaccatgaggaaataaagcatgaacggggtgtggtgagatatatttttgtcctttttttattatagatcactgtccttttgtgattagcaatttaagttgtttgtttattttttagaaacaaaaaagaaaaaaaaaagatcggaagggggagaagcaagcgcggggtgggggtgggacgtattttcgtctttttacgattagatcttttgttcttttgtgattaggaatttaggtccgattattttccctttttttccacgtccgaatttttttatgccatgaaggaaatcacacctttttctattatatataaacggataacggaaacattttaaatttattaagtactccctacgtcccataatataagggattttaagtttttgcttgtactgtttgaccactcgtcttctttaaaaaaatttaaaattattattttttttacttaccttatttttttttacttaccttattatccaaagtattttaagcataactttttattttttatatttgtacaatttttttaataagatgagtggtcaaacaatgcaaacaaaaactcaaaatttcattatgggagagagagagagtagtagagatagagataggaataagagatagagattggccagggtacataagtatccagcgtttctgttttttttccactcccaaatcttttcccgatttcattttttttaatttatgatctttttctaactgacttcttttataggaactactgcacgaaccaatttaacggaattttagctccgtttggatttttttaacggacttggaaaaagtacaccgaaggtcccttcacttgccatcgagttacaaaattatcccccaaccgcaaaaccaaatatatgatatccctcaacttagaaaaattgttcacttaacatttaacgtcctttagtggttttgacccgcttttatccgacgtggcggctgagtcagcgtaggacccacatgggccctatatatcaagatgccacatcatcaccctctctccccatcctctcccttcctcctcttctctcactctctcttcctctctcacttttctcctctcaggtaggcaggctggtgggtggggaggaggtcgccggggtaaggcgggggaggaggtccaacggttggcgatagcggcgcctgccggtacgaatcctgctgccgcgccgccatgtcctcctcccgtgggccgtaggaggtctgacggccggcgatgggggagaaggggagggcagcgcctgcgggtatgaatcccgctgccacgccgccatgtcctcctcccgcgggttgtcgtctcctccgtcccaccagaaccctaacgatcccttcgccgcggcgaagacggaggcggaaggggaggcggcgccgcccggaaaccctatcatgcccagtgaccctccctcaccgcagatggaggccacttcagagacactcacccaagaggagatgttgcgtcggcggaagagctgtaggcgcaacaccggcgtctcgtcgacatgtatcggcggctctactggacgctcgggaaggagcgtcgggcgcggcaccagtagtacgcctgggagcttgggcggagctcgcttgaggccgagcagtgtcacgccccgaaccagttccggctggaactagcccgtgacgctccaaattaacctgttaatcgataccagtcccaggaaacagtgctggtatcacagggagacagaatatcatagcaacagaggtctctttattatagagtaggagtacagtcatgttgggctacggacagatcccgagctcacaactgcattacaaaagcgaaacggaagccaggacttggaccaatcatcacaggcgcgacttgggaactaggccgaaaccctaaaactcatcgtagccggcttgctcctggaagaactcctcatcagcaggatccacttcatcttctttcgcaactgggggggggattatttatatagagcaagggtgagt

SEQ ID NO: 54773 - DNA, 9917 bp, Oryza sativa
taggtcccagaccatactgtgccaggaagcccaggggtcctctccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggatttggaaattcatttagttcgcaagcaccgacccaggtgtcgggttttccaaggcttttgtaaaactccagttttacccaagttgttacttcagattttaaatttgaaggcgaccgtcgatattcgcacagagtgcacgagtatcgagtcgcatctgggtggttacaaggggacatggtgtaacaattaacaacggatggatcaaatgcaacaagttaggtaggtccgccaatctgccttgcagacgggacaacagattaagtgtgatcctatcaatgcataatattttgcaagcaatataattaaatttcaaatataggctcaagttgttcaaaggtggcttgccttgctcgagatctggagcttgatccttgaaatcctcgcactgcgggtcttcgggctccgaaactacacgcgaaacgggacaactcaacaaacggcgaaaataaagccctattaatgacccctaagcgtgccattaggtagatctcgagatttgggaaattttggaagttgaacggagtcaagcggagttatggttggaaagatattgaatttctaaggttattggattttttttggtctaaaggaaaaaggatttaattaaatcccttttggaaaaagaaaaaggaaatgatgaagggagggactctagactttcctcgggcggctagggcgcggcccaaaggtattcggctcggtccggccgagctaaacgggccggacggcccaaagcggcccatttacgcgcgcgcgcgggagaggagagagagagagccggtggaccgggctcacctcgcgcggccccgggtgggacccgcttgtcagcggctcggcccaccgtgcggagggagcacgcggcgcatgcgcgcggctcgcggtgagggcggaggcggcgggcccacgtgcagcctcacggcttaccgcggaccacgcgcacggggagaaacggagggagcggctggccgggtcggcttatctggtcgcggccgaggtggcgccgacgtggcgcctacgtggcagccacgcgggtcggcggaaggtagacgaaggcccagccgaaacggacggcgggcggcggcggcgatcggcggagcgggccacggcgatacaagcgacagcgagtacaccgggcggtagtacgggacgagaggagacgagccaacggctcggattcgccggaggtagctcggcggcggcggattgcggcggcggcaaccggcggcggaagaagagggaaacggcgatgaggccacgagaggtcgatttccggcggtgagagcatctacaaggccacgggaactcgatgctagggttggattggacggagctatgccgagctgggctggcgacgtgcggctacttcggagctcgagcggcgacggcggcgagcacaaggcgagcaacggcatcggtcggggcggcgccggccaactatgggaggtctactcgagctaaaaccgaagtctaagggggggagacggagcgaggagggagaacgaagcgaaacatcaccgcggggagggagaggcgctgtgacgagaggccgacggcgcgggagtgacctctccggcctcgggccggggaagaggaagaagaggcgcggccggagtcctcttcggcgtccttgctcgtgccggctcctccgacacgcgcggcgatgattggggacggcgaaaaaaagagacggcagtggaggaggcgaaaatggggaggaaaggagaaggggaggccgggggtttaaggaggcggcaatgtcggtttggggaaccgacttgcgcggtcaagagcgcgagctggcgctcggctagcggccaaagcggtggcagacgggatgacgccggcgggagaggaaaaaggaggaaggggaaaaggaggaggagaaaggaattctctcctttgccgattcgggaaaaagagggtgggcgcggggcgacgacgcggcagagggaggtgaggcgcggcctccgggccttggcggctagcgcgcggagtggcgggggccggtgatgacgacggcgggcggtttggagcggagcggcgacagcggcgactggcgcgggcagagctgacggcggcggcgaccgggcggtcggccactcggcttgcgcgggcgcgagcggctcacgcgcgcacgcgcgcggcgcgcgggcaaagcggcgggatcgggagagagcgagggagcgcgagggagagagagagagaggaaaaaggaaaagggccggggaggcaaagcagactttgcggaggaaaaagattcggaagatttggattcggaaattggaacttgacgatagatcggggattgagatcttgagatggcacggacactagacaacaagcaaggaaacaaaatttcgcaattagggtttttgagagataattttcccgctaggcgccacgacggaacgggcgctacagaccaacccccctaacaaggatctcgaccccgagatccagcacctaagggagcagctccggaaactcggcgcggagaagatcttctcgttcccaggttgcctcatcttcagaatgattgctccattggaccttgtagaacttgatggtctttcttcgagtctgacgttctgcttcctcaagaaccttgatcggtctttccttgtaggtcagattcttttccagctcgatgttacccaggggaacttgctcttctggaactcgaagacatttctttaactgggatacgtggaacacgttgtgcacatctgcgagaccttcaggtagctcaagctgataagccacttcgccacgtctggcggttatgaggtaggggccgatatagcggggtgctaacttgccggacatcccaaaccttctcattcctcggagtggtgatacccgtaggtacacatgatctcctttttcgaactcaaggtcacgcctccgattgtcagcgtaattcttctgacggttctgtgctgtcttcaaacgttctcgtatcagcttaacttgttcttctgctgacttgagtatgtcaggaccgaataccaaggcttcgcccacctcattccagcacaagggagtgcggcaccttcttccgaacattgcctcattcggcgacatctgaatgctggcctgataactgttgttgtatgagaactcggcatacggcaaacaacgatcccaagtgccttcgaaatccaaggcacatgctcgcagcatgtcttctaggatctggtttactctttctgtctgaccatcggtctgcgggtggtaggccgtactaaaattcagatcagttccgagtgcttcatgcaattgcttccagaaccttgaggtgaactgagtgcctcgatccgacactattttcttgggacagccaaatctacatacgacatgagtcatgtagagttctgctagtttctttccatcataggtggtcttcactggcacgaaatgtgctgacttcgtgagtcggtccacgattacccaaatggagtcgtatccgctgggggttcttggcaaaccggtgatgaaatccattccgatctcttcccatttccactcgggaatcggtaagggttgtagcagtccagctggcctttggtgttctgccttgactctttggcaaatgtcacacagggctacgtattctgcgacatctcgtttcattccagcccaccagaagtatgccttgatatcttggtacatcttcgtacttcctgggtgaatggagtaggcggactcatgagcttcctttaggatgaggtctcttaactccttcttggccggtacacagatgcgtggaccgtaccaaactgtgccttgatcgtctatggagaagttggtgtctttcttctcctgtattctttctattaactcttttatcccttcgtcttctttctgtgcctcccgaatttgcgattctagggtaggctgtactgtcaagctggcagggactcctgactgtaccacggtcagccttaacttctccaattctctgcacagttgaccttggtcaggccgtatttgagctatattgcaataggccttgcgacttagcgcatcagcgaccacgttggctttaccaggatgatagtggattccaagatcgtaatccttgattagttccaaccatcttctctgtctcatatttaactcggtctgagtgaagatatacttaagacttttgtgatcggtgtatacttcacatctgttcccgattaaatagtgcctccagatcttaagagcatgaatcacggctgccaactcgagatcatgggtggggtaattgacttcatgaggcctgagctgcctggatgcataggccacaacctttcgttcttgcattaggacacatcctaagccctgtcttgatgcatcacagaagatctcgaagtcttttcggatatctggcaaggtgagaactggggcagtggtcaatcttttcttcatttcttgaaagctgtcttcacaggctgtggaccattgaaatttcttctccttctttaacagctcggtcataggtctggctagcttagagaatccttcaatgaatcttcgataatatccagctaagccgaggaagctgcgaatctctgacacattcttgggcgggttccacgcaagtacagcttcaactttgctgggatctacttcgacaccgttggaggagatcacgtgaccaagaaaagctactcggtccaaccagaattcgcatttcgagaatttagcgaatagttgatgatctctgagcttttccattatcagcctcaggtgttcagcatgttcttcctcgttcttagagtatatcaggatgtcatcgatgaataccacgacaaactggtccaggtattccataaagattttgttcattaagttcatgaagaatgctggagcattggtgagtccgaaggacattactgtaaactcatatagaccataacgcgtcgagaaagcggtcttcggaatatcttcagatctgattttcagttggtggtaacctgacctcaagtcaatttttgagaagactcttgctcctttaagttgatcgaataagtcgtcaatccgaggcaacgggtacttgttctttatagttacttcattcagggctctatagtcaattaccattctctcagagccatcctttttcttaaccagaagcactggggctccccaaggggatgagctaggtcgcacataacctttactttccagttcttcgatttgtcttttaacttctgctaattcattagcggccattcggtagggtctttttgcaattggagctgtgcctggtgccagttctatggcgaactcaatctctctatctggtggcattcttgttaattcttccggaaatacgtcgggatattcacagactatgggcaccgactccaaggaggtgcttgcaaacaggttaggatagaccgacttgcggtaggggtgttaggggtaaagcggacttgctttcctccaggtccttgcaaggtgatggacttttcggcacaatctatctgtcctttgtgcttagccaaccaatccatccctagaatgatgtccaagctttgcgagtctaggactatcggtttggctaggaagtcaacttcctcaattctaaggttaacttccgggcatatttgagttgcccttatatttcttccaggggaatgtactatcattggtacacgcaaattttgggttttccaaccatttcttttcacaaaagcttgcgatatgaaagaatgggaagctcctgaatcaaacagaactattgcgggtacggagttgacagagaacatacccatcacaacgtctggagcatcctgagcggtttcagcttgaatgtgattcacacgtcctcgaccaaagtggttggaagcacgggaaccttgtccacttgcctgagagctaggacgagactgagctgccgctggagtaggagttctggcggtgctgccattagcatgccctgagttggtgttggtaggattctgaggacactgtctagcatagtgacccatctggttgcaccggaaacactgaactgctgacggtccctgtggtgacttgaaggaggtaacactgtttggcgcagtgttgccactagggcatgcttctgtggctgaggtgccggacggtttatctgaggacgaggggcgtagcctggctggcggttagtctgagtgaccgactgatggtattgcatgggttgaccgtagcgagggcgaggtgcgcctcgggaagaatttccctgatggttagacttgcgtttcttgtattcttcggtggcctcttttctggcatcctcaagtagaagtgctttgttgatcatatgttgaaaagtggggaagtcatgagcaagcaactggagtctcattccaactgcgattcctttcaagaatttcctgatctttttcttatcggtgtctacttcctcaggggcgtaccgagccaacttgttgaactgacttaggtactcattgacactgctgtggccttgcttaagtctgttaaattcttctttcttcatgtcaatagtgctttcaggcacatgagctgcacggaaggcagctgcaaactcatcccaagcaatgttagtgggttcaggatgtgcattgcagtaattctcccaccaatctgcggcaggtcctcttagctggtgagaggcgtagagcgtcttctcaacaggagtacactgcactaagttgagttttctatcaacatctttcaaccaatcgtcagcctcgacgggctcgacggtctgagagaactctggcggtcgagacctcagaaagtccgtcagcttggatctgttgttgcccacgtgagggtggccatttccatgcgcattatgctgaaagctggctatggctgtggttagaccttgcaggatttgtgtctgaactgccattatgtgttgcatgttgttttccacatgaggtggggaagggaggcgttctcctccagaattgtgactggcagtgtggtgagagcggtgagactgctccaactctgcttcacgggaaactgtgcgatgcgagcggttgctgcggcgaggttgctcaacctctgcgtcgcgggaaacagtacggtgcgaacggttgctgtggtgagaatgctcattagctggttcgtgatttgcttctgcttcaactctaccatcatcaaaaccaaagcggactggtgcacgagctgtacgacgggggcggctagccatctaaactcccagaaaagggcggggtaagagtcagataagcacttaggagggcaaggagcaaagcaaatagcaactcagatagcacacactaggcataaactggatttttcaaatcataaaaacacctgatacaacgggtgtggactagtcacagagctacgccgagcttgactgtgcgcacacctcctaggagaaccagactaccaaacaacacccacaacaatcacacgcacgcactacctcgccacgactccaaaagagttggcggcggaacaaaagggcctaacacacggacggctgctgaagactgcctcctctactcctcgtcggccgggctgcctcctgtggtcggctcctcagtcgaagaaacgtcgatcggctggcgcgaagggaccggcgggacctgtcgagggccggcagcagcacgggccgctggcggtgggggagctgggtggcggaaacggaacacggtggaagaaccaacaacacgcttccgcgcagtgcggataaagcgtgggccacggcgggaggaagcgactggagtgtgtccgggggtgtaggaagggctaactgggtgtgggtagggggagtacactggtgagtacggtgcacgcgagctgggggagcgcgggccactgggtgtgcgagcagagccgcgggagctgtgggaggacaggtggctggcgtggcagagacggcctgagtcccaagagatagtgtcaactgaggtgacaccctcctcggccagacgggcctccaaggcggcgtagcggcgggcaagggaacggtaagcctcaaggagtaggtcgtgctgagtggcctgagcctccgaaagctcgaccatgcgagtcagcactggctgagactcgctgtacggacaagggtacctggcgtctgagtggccagaaggaagacgtggaagctgccggaaggcggagcctccgagacggtggccgtagtcgtgggccaggcggcgaagcgcagtccaggagaggtcctggtacgcgatctggagagtgggcctggccacagtgaagtggtgagggcgaaggccaactccgtgtatacctccacgagggtaaaggtacacagagagctcacagtgagggggaacacggtccacggagtaccccgtgtactcgggacacgagaagccaaggaaacgggcgaggtcacgaagctgggcgacgtggtgaccctcaccaaaaccgtgggaactgaagctggcgttcactgccatctacaattttgaaagagggagaaagatcagtaacccttttttgaaacaaactatggaaaataaagaaaacagaagaaaccctagtttttcgcaagtagttttgaatctagtatccttagggtcgtcctaagcgtcgggtttcgccctagggccaagcctgtgctctgataccatctcttgtcacgccccgaaccagttccggctggaactagcccgtgacgctccaaattaacctgttaatcgataccagtcccaggaaacagtgctggtatcacagggagacagaatatcatagcaacagaggtctctttattatagagtaggagtacagtcatgttgggctacggacagatcccgagctcacaactgcattacaaaagcgaaacggaagccaggacttggaccaatcatcacaggcgcgacttgggaactaggccgaaaccctaaaactcatcgtagccggcttgctcctggaagaactcctcatcagcaggatccacttcatcttcttccgcaactgggggggggattatttatatagagcaagggtgagtacgggagtactcagcaagccaggggaaaataagtgtttaatgcaggcttcaaggaaaggctgttgtttttgcaattgattttatttgaactcttttctaaaagcaactaagtgagtgcttctcaaacgacacggacgaggcagtgcgtctcgtccggtcggagtatgtgcaatgtatcagtctttagattttgaaacaaggttggcacccggccaaaagctttttaaacggccacccgggccaacacctttcaaatggccacccgggcctagctgatcccatcagctgcaggtttcttttcaaacatcgaacccgatttcacaacagcaaatttcacaagcagtagtcaaacaaaactacgctaggaatcacctcacatccgcccatgaccgtgggcacggctgttcgaacagtttgttaacctctgcagagggggtacactttacccacacgacattactaacccgggtcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctctccgacaccaccccggcgaatccacatgtctctcggcatcaaggctcccctgataagctagttactcagccagggg

SEQ ID NO: 54774 - DNA, 2245 bp, Oryza sativa
ttgacgatagatcggggattgagatcttgagatggcacggacactagacaacaagcaaggaaacaaaatttcgcaattagggtttttgagagataattttcccgctaggcgccacgacggaacgggcgctacaagcagccaccgccgccgcccttcgtgtccgggcttggcggggacctggtggtggttaagctagtgtccgcgacggtgccgaggtggaagaagtacgacttcgccaggtgtaaggtgcagatcatggcgatggccaggttttgccacccccgcatcctcttcgatgaccatcgcgatggcgtgtccctccctgccgcgctcttgacaaacagtgttggtgatgatgtggcatcctgacatgtggggtccacgtgggtcccacgctaactcaacctccacgtcggataaaaccggggtcaaaaacaccaaaggatctaaaatgaacggttttgtaagttgagagatgtcatatatctagttttgtggttggggacgatttttgtaactcgatgacaagttgagggaccttcggtgtactttttacaacggactttgacccctcggcccggtagaaccaatttaactgacgattgcggctcataggccataacccatacatgtctccgtacccatgcggcccacgttcacggtttgttctcctgtgatctgctgggtccgcacgacgcgggcctaccacagacgaacacgaacatagcgtgcgcggccgaacgtggtgtgtcctcgtctccgctgcgacgggcgtgggcgagcaccaccgctcgtctacgcgctcgagcatcagatctcatcagatctcgtgagccaccgtcgcccggcggcaatggtcaagccaaaggtaaggatagtatgggtggctatcaaacacccgatcatagtgctgccctaataaattagggtaatatgatattatctattatcttacattgacagttttggaatcaaactaaacctaacctttttcatgagcttctagcattgatgtgtagtcagcgtgttgcactggaccagttttttgaaattttagaatctgatttttaggattaattttaggtggtttcttccgcagttttgttgcccaactcttttttattttttcatgtttgctattcctaagtaaacaagtaaaagaaaccagctaaatttattcttaaaatcaacatttcaaattaaaattagcttcgtcttaaaagccgaagaagctatgccaaatactggcttcttaaattgcatgaacaaaataataatagagaggaaacacatcacttacacaatgctttcttcacctctgaagcgcttcgaaaaaaataaactaaaggtaagtttcagcacgccaacgtacgcccctctctggcggattcaggtccggcctgtccattctacacccattgctggggacaatatcatagtatttgatgggtgttcaatccaaacagacgagtcaactgtgaagcatgcaaagaaataatatacccgagacaacacaaaaagcaccggtaacaaaatagcttgggagtttactgttgttactttgcaagaaggcatgaaaacatcattgctaaatatacgaaggtaaataccaatgaataatcaagacatgctttcaaaatccacaatctgttattgctaacctattggctattgctgtagccataagttctttaatttgtacacaacaaaacggaaacaaaagaatcaactcagtaagcccgatggttaatatggactgctaactacaaacagagggaatgaactcaccgttgatatggggctaatttgtgtcatctatgctatgcgaagaatccatgtaattagaatttaaagaatcaaatcagttgtttgatttttactaacagcaacagaagacgaagcatgaatcatcttgactcagaacctgcactgtatgggcgccagaagccctttgtagcgacaagaaattgttgcttcacaattgcagtcctgtagtgcaaagagcgaagaactggatccatttttctaatcacttgctcagtatcttgcaacacgaaccattttccaggtctaagtatcctatcaatttctgctgctacttcaatgatatcacacctaaaatacaaaagcattaataccaagcttgcttgattctgtacgttggtagaagagaataatgatatttaaacagaacagttctcaaagaatcaagacatgatttttcacctatttgtgaggccctgaa

SEQ ID NO: 54775 - DNA, 1824 bp, Oryza sativa
tatgtattaaaagattcacaccagtcatgatataccccaatcaaacctctgttgaaaatgataggcaaggcttctggatgatcaaaaggtacaacgttcataacccacaaaggtttgtggatgagtgacgccgcaaatctggtagaagaaagaaaaccaggtaattttatctcaccatcaaacaaactatatagctagactgctcatcgttataagaaaaagaaggatccttgaaacatactgtaaacagcaattggaatcgtgtgaacagaacatctgcttttgaagattacatagaatgatagatccttaacacaacaagctactattagactacaatctgggacatttcagaaattcaagaagttcaagcctatacgtgtaaagattggctgctgaaatccactaaacaaaatgaaatgtactcttcaatagaaaagctaccatataaggaatagtgaacactagaacactgggaccaatatataaactctcaaaaccaacaaccggactaaaccaaatgaacagtctaactattcaggaaaacaaaggacagaaaatttcatgggatcaaaacaaagcattcaaacattgaaagacatggtcataacttgtgaaatatcaacaagcccattgaagaaaattaagaatcaaagttttctcaccctccaaaaccagcattcatatccatgacattgcgaacggtagaccaattaactgcaaactcattgaaatatacttctgaaacaaggtccttccagtgctttgtgtcagaatcaaatttttcttgagaaaactgagtagaagcgttgtcagatatagttgagtatttgatgttaagcctttctggccaggaaatgggccagctgtttccttcacctgaacttgacacagcaggtaacaagaggcaactatcaagtggtgcatacctaaagagggcaacaaaaaaataacattagtttatctagtacaataaaacttctacaaagcttagacaccagtagcaagaactactagcagatgacacaaaacttaagtgcctacatcagtgcagcaatcagcccaaacatgcactagtgatgtaaggacttgcacaaattgtgtaagtctcaactgtatgtgaaataaaacaaaggaaatgactcatcaataagatgtaccaaggggaatgtgatccttccctactagggcataggggtggttcattctgttttctctcaaagtagcaagaatttgaggttggcttctgatatataacaacaccaatcctattaacatccttagattttactactgtcctccagcaaattgacttggtcagagtaaccatcgctgcaataagtggaacacaaactccagttagcaagaatacattgatccctacaatcatatgtaaactatattgatccgtgcctttaaggaaaagtaacaggtagtaacatatataaacccatcacaggtcaaacaacagtgaaatattctgtaatcatacacgcataatgagaacactatcatatgaatttgttaaattcatgttcttaactgcagactgtgttacacaccaatattgttaaaaatgtcaacataactgagacgatactttttatattcttaaaatgtgatgctatctcaactgcctgggaacttagtgtgccaagcctctgaagctttcactcgttctaacaagactttgtaatttcccttctagtacacaccccttcattatacagaggtaccaaatttacagtcttttttttattctacttaatataagccagcatggaacttgctattatatagggtcacaataagggctgcaggaat

SEQ ID NO: 54776 - DNA, 1388 bp, Oryza sativa
ccattccacgttcgagagcaaactgtatctgagcttcatgctcatctttgggtgcaacagacatagtaatgacattcctgtcagcaagtatccaccaaagctggcaacaccgcatccaacatccagaacagttcttgtatgggtcccccattcaatgtttggcatgatctattaaatcaacaaggctggaagtaaacaattataacaagggataacatcatatcggatactttgaagcaatatattttaactttgcatgattatcctaggaatatatgtccatgtttgcttttgaaccaccaggatccatattaattttaggaatatgccacttaaacactgaacttaggctgtgaagttgtttcacagacaagcataaatttattgtcttaatattatgaaacttatctacgacttaacaacttctaaagtatatacctgttgaataaatcgaatgtatttagtcacaccagctttaaattgagttccacctccagggaaaacaaaataattgccagacttcctaacccagttctggtccttcttgtattccactaactttggatgagggacattattgtaccaaatctgaaatttgcagaggaaatatgtcatcacaagatatagccacaattggcttttataaaacagaattctagttgatgaacatcttgtggacgatgccacaattggcttttataaaacagaattctagttgatgaacatcttgtggacgatagttgcacagataaaatgcacgggtctttctgatttgacaaaaaaaaaatcctactacctagtggatatgcacaattctcaacctggcaacatacattagacggggacgttgaagccacgtccctaagaccctaacagtgttctccattatggtttccaggttcatttgtacatataagttcataacagtagctagtttagtaacaaaatactgaagaaactgcaatgtttgctttgtttacttggatgcttaaacatgctagtttgggttgagtatcaccgatcacggcacagccaaaccacacggcacacaacagactctttgtcaggtactcctatgggacaagatttagcaatatcaaattaccattactaccatttcaccattgtggaatgaacaaggtaaaaccgcttcctcgcttaccgaagaaggcaagcagtcatgctcaccatgtcacggctgcgcggccacggcaagggtgaccggtaccccgtgggcagcggcacgaggcacctcggcctcggcgccgtcgggcagtggcgctcccggtgctccatgtgacgcagcgacttcaacgccttcaccgccttcacgttgtccaggcacggtatgtagtccgcggccaccactcccttccccacctcgcaca

SEQ ID NO: 54777 - DNA, 16946 bp, Oryza sativa
cagctagatatttataagttacttttcagaatctctagctccttaaccttacactttgttcaggaccaatctttaaataactagtcatacggtgatacatacgcaaaagtttcttttaaatgagtattgcagagcctgagctgataaggataaaccggggaaggtattagcagtctctgtttcagaaaagagcatgttctggaatctggagtgtcagatgattgtaccattagtgcttaataaaccatcttcgccatccttctgaaaatggggcccactctactttggaatgctatttacaagcacaaacgtgccacccatgtgattagtgagaatcaggagagccgggaaggttgtttattactgcaacagccaggaaggcagaaagaagtacaattgccaacgaggctgtcttaaaaagagtccttcagctccaccggtttgctgtttacagttttatttacacttgatctgtataacaacaggcctaatagaacaatcaagcgtgagcgtgactagtctccttatctgagacagtcaatgatactgaactcgctgttagagaaaagagagaaattttttttgcagaggcaaagaaagggggaaaaaattcgcaactttatgtgctacacaatgccttgtttgcgaatgttgtttacttctactccgtatttgttagtctacttggttagcttcatctgatcttgaactgtttgagttttctcgacgaaatggcgctccagagaggtcagaaccacaccgcgatgcagaaggcaagtagaacggccaacttttgtggatccctctgcattacaagaacatggacatcgatcaggcttgtgtatctgaacaaaatgatgtgaactgaaatgtgcaaaacaaatctgtgcatgttcttattagtcccacaaatgccaataaccataacactagttgcatgacggaaacgctggctcaatcaactgcaaaatacatctagaccaagcagagtagtatagattccagaacagcttgaaacaaaacattttgttgcctcatgcctgtttctaaggtttatttgaactgacagttttgctagctaagcacaccttgcctcctcggcttgctcttgtctgttgagcaatggcgaggtgtttccccctgcatgcctcaggaagttcaccatcataagctctgcagatgtaggcttcaaaatttgtgtaatcctgcagatcagtgacataatgtgctagttctcctgacagatttaagtaatggtgtataatatgactagaattttcagaaaagaaatggaacttacatcaccaagggggcgcccgtttacggtcacccagggtacaaactgatgaggaggctgaagggcattcgtctctgcagcatactggagttgaagctgcacattcaattgatttattattagatgatcaaaattcaacgtacatagaaatatgctgctgagctgttctgaacaaatctgaagaatagcgcaagaatcagatccattatcttgtgaatgcatattactccctccgtcccaaaatttagcattttttttgtggatgggacgtatcctagtagaatctggacagaccttctatccagattcgtagtaataaattatgtcctatccagctaaaagttgctatattttaggacggatggagtatatggtggtcttcagaaaaaaaatcatttaggatgtactttcattgttactaaacacaactataccagaactacttattttatttttctaaataaaaaaaacaagctgagtactttcttagctcaacatatatcaactgcaaatctgaaagtaaaagacaatggaaataggaagccaataactgaacctacctgtgtgccgtaccctgagttatagcagtccataacaggttgagaggctagaccagtttcttgaaagcaagattgccacgcgttccatttttgagtcagcgctaaatgctcaatgcaattaatgaaagggaaatgctgttcctgcattcagaagaacagatactggtggcacttcagtgcattgtctcaaattctatcgatgtgagcaatagatgagcttggcagatctaccatatgctcattcatacagtacatcatactactactatatagatggattaaatgccagcatgttttgtcacataattacactacaggacactgaactattgagttcagaaacttttttttttgttctgttaatgtaaggcattaccgcgtcaggccaaagtctgatcacgcaagcttctatcgcattgagttggcattcctcctctccatgctgcaaaaccaagcaattagagtaggcaatcggaaaccatggtgagcgcggggcgaggatgacgaacagattaataacgagatgggtgaggaacggaggctagcgatcgaggcggacctggcaggtaatcgatccgtcgggcgagacgcggccattgccgaaggggacgaggcggaggtcaacgacgggggagaggccgtcccggaagatcctcgcgagatcgttgacgacgaagccggagcagaacgggcacagcgtctcgtaatagaccgacatcgtgaccctcccagcggcgcatggcgccgtggcgaaggagaacagtacgagggacaagatgaggattcgaggaagaattcgcgaggaggaagaacaagaacaacaagccatggggcaagcggggagaggaaaagagagctaaaggcgccgcctttttttttttttggtgcagggggctagccaatgtacgcgtcgtcgatcgaatcgatcgatcgcgagatcgatatgctttagctccttttggaggcgaaaggaaggagacggaggaggagatgctcttggatcatctcctctcctggaaggcagccttttcccaggtcaggttgcgcgggagacaggttttcaagaagcgagcgtggcttcatgtcaggccggcgaatcgaatcgagtgagaagaaccagctttgccgcttgctactgtagcctttgctttcgatggtgtggcgacctgtggctgtggggttcaacgtacgattacatgttcgaactccacacaagagcaccgagtgactttatgctggatgccgcagatatcgacgatcaggttcctatggggctatggggcatgggctacgtcactagaaactccgatgactgcacatatgagggaaactgttttaacggctcgagtggactcacccgtttattacatgtcatctaaataaaatgacaaagatttttaactgtaagctggagtcggttcgaaaaataaaatgacaaagatttttgagttgtaggatgacctagttggttatcttattgctgcaggtaaaagagaacaagtaaagggagggacctggaagagatctcagagctagatttcttctgctttccttttcctgttctttactctgttccttttttattttgaatgattttgtttctcttctatccacttcatttcttagcctttttccactttctactttatgatgtttgctcccttattcttctttcgctttttgatcagttttaagtccagaaccaccaaatgatgcaatttaaaacatatccatttctgaagttaaaaaaagtgtattattgatggggaggaaatgcctacgcattccgacagtttattcaaccgtgaaacctgaaatacagcagtttctgaacctgagtacgaaatatatgttcacaggcttatatataacctttgcttctcaagcaatccacagagtccctgatggttttttcgaacggaatgaaatgcacaccaagatcaattagcttcttcgaggcagcctttgatctcaccacccacccttgtttatcctcctggattctgatgcagaaaagaaaaagaaagaaattagcaagagaagaacactgcatctgatttaagagatgttgatgcccatagatgcatcacctgtggatcgggaattcagggtaaagctcagcaagtttatcatggaaatcaatcagacgctctatggactcgatgcataagtggcgtccctgtgccgatgtgttctcatagatcactaccgcggactgtgccacatctctgacatcgacacagccaatgtagaagtcatcgatgtcaaacctctggcctgtgcatgacaagcgatcttagaagctacttacatcaattaaacattgtaacactgaagagagttgagagactgacctccgagaatctgaagcagcatatggagactagaagtaggggatggcatcaacattgggcccaataccaagcctggattgagggcgaccagctgcaagccttcctttgcggcgaagtcccaggcagccttctctgccagcgttttagatacgttgtaccaatgctgcactgagtaaaattagcacagcttgaagaaaaaaaaaaggtacagtgcactacatatttccacaatgtgaagttgatttaattccgttgccattacagcacatgcatatagaagcaaaatatagtaacttttcggattgcgtgtctggatgatgtagatattcccatctgacatgcactgtgctttttccaaataaggaaaaagcacagcaagtctgcaacaaccaacagattgcacaactcacaccaagcgtaacatcatatatcagcacatatgattgtgatttgtgacttgttaattagtgccagcaccctgattacccccaagtcccccaacacatcgcagactcccggtgcggctagtgcagttgcaaattgggaagttgtgtacctgatgtttcttgaggagctcgacgtcggcccagctgtcgtcgtcgatgaccttatcagcaggccactcaggattgggcactatggcaacctgcgacgccatcagcattacacgggcgacaccgcagtccttcgcggcacggaggacgttgagagtgccactcaccgctggcttcagcagctcaccctgcagggcaggcacagcagcagaaaacgtcgtaaattaggcgatgagttgaccgaaagaactgcattcgtgcaagtgtgcaggcagtactgcagctgcagctgtgcgattgtgaagggagaatttgttgcctcggggtcttgagtcgggtgaagtgtgagaggggaagccaggtggaagacgccgtgggcgccgtccaccgccggcgtgatggaggccgggtcgaggaggtccatctggaacagccggagccgcgtgtcggcgccgtccagagcctgcaggtgcctcgtctcgccgtcgtcctctacgagagaagaaaaaaccggagatcttgagctgcccgcgtatggttcggtgtagtcatgatctcgtggagatgagcagagagaatctagagcgcgtgttacatacggaggttcttgacggtggcgtggacggtgtagccgcggtcgaggaggaggcggacgagccacgagccgatgaagccgctgccgcccgtcacgcagacgagggcgccgctgctgtccccggtcgccgccatctcgccgctccgctctccgcaatccgctcgactcggcgcgctcggacggacacgggcaccgtggtggaaagagaccgggtggcccgtgtttggcacgttgcgtgaactaggcgggttagctagcgtggtgcacgagggccacatgaatagccatatgaatccgaaaacacttaccctcggtcgtccggcgcgggggagccggatcgggcgctccccccacgcccctctccccacgtgtgcacctataggtccacttacttctctttcttttttcataaaagatattttacctagtgtatttacaatgtttcactatttatacacctaatattgtagtgaattaaaatactctttaaaaaaaccatatattttggaaactctctattaagggaatttggtttattttttgttttaccaaagatgtttcaactagtgtactcacaatgtttcactatgtatagatctaatgttgcattgaacggaacatttcattgcaacaaaaaaaacccacatattttggaaaccccctattaagggaatttggtttattttttgttctaccgaaaaatgtttcatctagtgtactcacaatgtttctatgtatagatctaatgttgcactgaactgaaacattctttcgctatttactgaaacattgtttttatataaggtgaagcaacacctgatttgaaagagtgaaacatttccgatctacatagtgaaacaattccggtggaacatcgtgcaacatttaaaataattcaataataagctaaattttttttcatcggaatatatccatgtgtggtcttgttttgaagatttaattgcaacaaatttaatagtgcaatcggatcatgatttgaatgagtaatttaagagaaaaatcagtttaaaatagttttgcacgtaaacgattttcccggccccggatcgggcgaccgaccgtagccgcgtccatatgaatccatcgtttccattcgtcgttgagatggacagcgctgagccggtgagtggcccagtttgctctctgagctagtagtactccttccatcccatcctataatataagaaattattcccttttgaataagtataaggatagcatgaaaatactataatacctctattaaatgatatttgcttataggtgagtgggtagttaagggttaaaatgggtaaaaatttgaattgtaattgatggatgtgacaagtagtacaccaaaatcccttatattgtgggacaactaaaaaatggtaaaatcccttatattatgggacggagggagtattacattacaaattaaggtcagcaacgatgttgacgtgattccgcattgcaacaatttaatcaaaatactattatcttcttaaaaaaatataagaagtttagattagatacgagtataacgaaagttaacgaattaaataaaaagtgattgtgattggtcaagaaaagaaaataggtaaggaatttgaatagtgagaagttgtgattgtttaagaaaaaaatatgagtgaagaaattgttactccattcatcctataataagttaattttatatgggatgtggcatttctcagcgaattgtcagcctcagtatgaattctctgcttgtaccgttgtatggtggagccaaccgaacatccaatgcgagatattcaactatttattacttttagatttagcaattaattatttaccattagattgatacatcattcatatatatgaatcgtaaatagttaaacatcaaatttaaaatttaaaagtaacaaataattaaatgccccgcacaacacccgggcgggtggtggttcagacttcagagaggcgagtgcaccagaggcattgaagtaaatcgcaatccttagttggatgctagttggattggtttggatcgacatgggctggaggttttcagactttcactttgggccaactgggaagatgtccatttgttccgttggctggcctgagccctgagccttccaaggatttcttactccctccgtttgatctttttaattaaacttatttgaatttaataaattttataaaaatatcataatattttaaatataaaaaaatgtgttattaaaatatattcaatgctaaatttaatgaaattaatttagtgttttagatgctaaatttttctataaatttggtcaaccttaaaaaggtttgacttgaaaaaaaagttaaaatgacttgaaatttgaaacggagagaccagtttgttccttaccatttcccactgcagtttatctccagtaccatatctctttcccctcaaaacagggcaaaatatcatctctctccgaattacgttttttccgatgggtatcatcaaaaacagttcgatgacggatttgatgtagcccgtggaatctggagttctggacaagaaaaataatttcagaccaccgaacgatgatttgtttttaataaaaatgaagatcgaagcatcctcggtatctaccgtggaaaaataaacgaatcaataaagataatttatgatatatctgtagtcttaacggttaaaaagtaggaaaaagtacgaattatccaaccgaattatcgcggtcgtccgaattatcccaaaaccataaaaccggacattcttcacccccaactatgtaaattggacaaattaccccctcgacccaatccgcggtagttttggtccacatggcgtacgcgtggcagtccagtcagcactctatttataaaaaaaaatgtgggacccacccgtcatctcctcatcctctcttcatctctcttctctctctctcactcttcctctctctgtcaaacgggtcggcggcggcgtgcgggggaggacgcggcggcagcgggcggtaccgaccagggggggtgaggaggatggagcgcacggcggcggcagtggcgggtgacgcggaggcggcggcagcagcgatggggaatgaggaggatgacgacgacgaggatggcgacggaggagtggaggacgacggcgaggacgttggctgcggtggccatggcggagaggcggagcgcggggaggacgcggctgtggtgggcggtgctgaggaggtggcggagcgccggggtgcgcccgagctttgtcaccgcccccgctgtgcccgctgtcccgacggctccacagagagagagagagagagagggaggggggaagctgcgccgagcggccgcctccttatcccccgcccctggtgctctgctacctcctcggcgccgcccccgccgccgcgtcctccccgcgctccacctctccgccatgaccgccgcagccagcgtcctcgtcctcgtcctccactccgccatcgccatccttgtcgtcctcctcctcatcccccgccaccgtgcacgccatcctcgtcgtagtcctcctcatctcctctcgtcggcgccgcccgccgccgccgcgtcctccccggcgctccgccactgcccgcacgccgctaccgcgtcctcccccgcacgccaccgccaacccgtttgagagagagaggaagagtgagagagagagaagagagaggatgaggagatgataggtgggtcccacattttttttatataaatagagtgctgactggactgccacgcgtacgccacgtggaccaaaaccaccgcggattgggtcgaggggggtaatttgtccggtttgcatagttgggagtgaagaatgcccggttttgtggttctggggtaattcgaacgaccacgatagttcgggagggtaattcgtactttttccttataaaatatggttgaaaaattgactttgataaaaaaagagagactaaattaagttttaaaatttagattttcaatgcagttgatgagcaaataaacaggaaggacatgtttgcacaagtgatgcaaaatttatctcctcgatgacttcacgtgtcctatcggagagatttgataatttaacacttcttaaaatggctttcgattatttgatatcttggcccactttcattcactcagatggtcccacatatcatcctcacaggtttcaatgaaaataactggaaaaaaatgtgttaaattatcaatttttttgtcctatcgatgccggtcggacacaataatcgtccaacgtgcatggtgaggcaaatcgccactcccggtctacaaaagtatcatcctagctactactacaccatgcaactggccgcgcaatttgccaagtcgacctcctgctttggatgcttacatggtcacatataatctctatcctttctctgttccttgtcctagttgggtctttcgcaaaccagtacatgcggcgagcaattaaagtggccgacagtgtaagcacacaatcatggcgccaaaccctcgataccaattcgccggatggcgagttgttctacctcattagtcattagttttccttgtcactcaaccccctcatgtcctgcacaaacctcgatttcaattcgctgtttactgcttcttccacagtcgatgcgacttccatgacaatttaaccacgcaaactgcacaggagtatttcaatagctgggccaatcttttttgtaagcagagtaagacaaacttgaaactagtgctaattgtccaagcttgctggtaactactgatgcgtagtgctcaagccactaatttagctgacaaccagcaaaggagcttgtgacactgacatgcggcaatgtttctctgcgtatgtcgagaagaaagacttgtagatggagtatgatttgtgaaccacttgcagctcaagtgtgcgctacatgacctacatcacaatgcaactcggctcaagtttacgtggtacatttgcaagatggagtaggccaaggaaaggcatcgccggacagggggctgcctccgatttttcttggctagattttgaatggagacacaggcacacagctctcgtttgaaatgtatgcgcgcgcgcgcggcagcaagttggcttcgctgcaggattcctccagattgagacttggaaatgtgggatgattgtctgtttacggcacaagttgttaatttgtttattttagtccctgttaatttgtccatttagcacgcgtgtcttttacaagttttatgtgcttttgacgtatttcattttagttgtgtgttattgaattatattccacctgtttaaaaatatttgatattcagaaaaatattgggttaaacttttaaattccgaccatcaaccataaatgcgtagtttaaaaacaaaagaaatgataaatgcagttttgtcttgaaaagtatactttcataatatcaataatcttgttagattttatatacttattttaatataaaactgatcgtgaaaattttaaaagtttaaccgaatcttgttatcgtaaacataaaatatttagggtgtagctatatttatggcgtcatatttttcatcaaaaaatagtcggcatgtatttacattgtaagtccctaaattacatatgtaattttagtgtatttacaatgtaagtctcaaaattacatatgtaagtactaaaattacatactaattacatatgtaagtggggtgtaaatgaggtgtaactactgtgtaagtggctgaaaaaaaatcgactgtagcatatggcgccatatttctagcaactccgaatatttatgattggagggagtctatattgcagacctttctccaccttaaatcattttaggcctacgagattcgatctaatccacaattaacctgcaggagtttgcagtattccatcccactggtcctacatatatatatccttttccaattttcttaattagaattgcatctatatatgagctgagaaagaaataccttaattagaaatttagaatataatatcgaataaccttcgagtcgcagtgaatcaaatcataattatgctcaagagcgatagaaaacaatggctatggggccaggataagcagttgacaacttggcagttggcacacgaaatttcatatgcaaagaaaggagcaacacttgtagtaccaagttgcatcaatgttaaaatgcacgctgaaagaactcgtagagaaaaaaaagaaataaaataataagaaccgtatagcaaacaacgaatctggacatacctttgtctagattcattgtactaggagaatgtaaccctacatcccttcctagattacggagggaataagtaattttctcatcatttgatattgttggcttattagatgcaaaatttaaaatttgaaactaaattcggagttaatatttgggtttatcttcgtacttgcataatataaaagttttacctttaaattatttttattattccatttatatttctacgatttattgtgttcttttaaaaaaaatgggggcatggcctagtttggtgcctctaaagaataaggattgagataagaagcttatcaaatattgccatcaagcctatgtaagcgtacctttttttaaggggcaattgcaaatttaccactactttgaatcgttattgcaagattgccactagaaaattacaaaaataccactagaactgtcattcaagtggtatccttgcaatattaaaaaaaccgatggcaaatttgcaaatgcccctttttttaacggtgagttgcttaccgtaggaagaataagatcaggtgatactctagtagttttgatacgacgtgctaaagagtatcactacttaaacagagcccggccaaaacaacgggtcatgcccccccccccccaaggcatgtggcgaatgagtcggcaggttatctctttgcccactgtacacgaagaatctaaagtctaattgcgccctaggttatcataccaacagctggaccattgagatccaaatcaaagcgttcaagaatggtggaaatattggccaacaaatcctattggtcgtgtggaaaatctggaaggaaagaaaccggtcttcgagcacaggagaccatgacccctagactcatggtgaaaataaagaagcaagcaagaacatgggtcttggcaggtgcaaaacggctacgagagattttaccaaacacttaggtccagtacagctctatacagtttttcctttccatctctagaggttgtatttttctaccactatatgtctatattcaatgaaatagcaaaatctcgtactaattccgttaaaaaaaaagaagcgtccggcgagataactacttgaaaagctactctcatcacatcaaaattatttaaagttcgtgcacatgtagtcaattaatgagactatatattaactgggacgtagcataatgttatgcctcttgttgactaaaaatgttcgggtataaatgggatcgataattgatatattttataggctaaattacgtcagagagtttataaccatcaaacggcttgccgagtcactttgtaagtaggtgataataggatgtcactacaaacgatttaaaatgagaccctttaacagaccgtccaaaatgaaacatgaccaatatagtcagctatcaaaagtggcttaaatacaaaccatctttgctaaggtgctctgaaatttgataactcatgagagtttttactgcccttaaagtgatacccccagatacttgatactggcaggtaccatttgaaatcaaaccactaaatcaacaaggtcatgatcggaaataatttttccatgggaaacgctccaccaggcccacatgtcaggaatgacatgctcatgcctctctctctctctctctcccattgcttgtgtctctcgcgcgaccacgaccgcatctcggtcttttgaccatcgtcacgttctcatccaactcctttgacaacgcgtgagtgagttgccttccccaacaaggcctgaccagcaactcacctcatcgaattctagcttgcctcctcctagtttcgatgatggcgcatatgcgccgcctcggcctcccataacctgccttcgagagttgcttgcttcgtccccgacaccggtatactagtactattaggtaggagggaggaggacagtgatcattgagccaacacccttagccggcccattaccatcaccactgcccccggagggcaccactgagttggaggatcggaggcctccttaccattgccctcggccaaatataatggactagagacgctggtgagaggggagggtgtgagaaagggcaagtgatggtggggaaggaggagaaagaggagccgttgaggtgagagcagaatgacaattgatgatccgtcgaggaaggatgaacacgatgccttggggaattacataaatggaaaaaagacgaccattttacttttataatttacatggtgttttgaggcttggtgtggtgggatgagtgccggtgttggtaagtagcaaagatcctcagccctccgatgatgatcgatgagtggctatgatttggtacctctttccggcagtaccaaagatcctcagccatccgatgagatgatcaattagtggctacgatttgatacctccctcccccgaacaagggtaagaactacgaactctcttactacgggtactatttcctccgtttcaggtgataagatgttttggctttgatcaaagccaaactattttaagtttgaccaagtttataaaaaatatagtaatattttcgatcaaaggtaaatttattataaaaatatatttaattattaatttaataaaactaatttggtaatgtaaatattattatatttgtctataaacttagtcaaacttgaagcagtttgactttgaccaaagttaaaacatcgtacaacctgagacggagggagtatcacacaagatttatactatactccctatatataactcaaaccatcaacgatgatgatacaccataaactatcctaattgtcaattattgtcattaattagacgaatttaggtacaaatttaatagatgcgtcaaagatcaaacataaataattgtgtcacccatagaatgtacttatgtacgtactgatcagaatcatttcgatgaaaatactccgaagacaaataaagctagcttcttactttgcaatacgacagtatatataaattgctcagcctgtggcagctggctagctagtcgtctcgaaatctcagtgaaaaaaaaatgaacatgattatgagcaggttaatcttgacgtacggtacacattacaccgtacttaatttgtcaaaacaagaaattaaaccagtctaaatcaaaactaattaagctagcactatctaattaattaccctacatagataagtatgaaaaataaagagcccggccggcggctggctcgccaggcaggcatatgcatgcatcatgcatgatcgatcgatccgttggcgcgcggcgcttccggcgcgagccgctcgaccgttcgcgcaagcgactggaggttgcagcgcacgatcgtgtccacgaacacgcgcgtctcctcccaggtgttccccggcggcacgtccaccacgtacgactcgaccaccacggccatcgccggcgccgccgcctcgtggacggtggtcaccgagcggtagttggcgaggcggtgctcgccgccgacgatccggaagctgagcacgcggcggtcgtcgtccaggacctcgagccgctcgcggctgctcgtggccggcagcccggacacgacgcgcacctcccgcaccgacccgacctcgccgccgtcgccgtccacgaggcggcagctcttgatgaacttcttgtacgcctgcggccggtcgaacctccgcaccaccgaccacaccgcgtccgccggcgccgcgatcgcctgcaccacggtggagaagcactgccccgcgcccaccgcgtgctcgtggtaccgcgccacctcgcacggcaccgccgggcacgccttaccgccgccggctccggagccgatcggccggctgagctgcggcggtggcgaaggacgtacggcggcgtacggcattgtatcaagcgctcgtcgttgccttctttttcctctgtaaagtaagaatgagacagacaggggtgggtcaggattaacgacgaaagttctcgtccctgagattttatatgcgtcatttgtgaggcaagaggtggatggttgcatgttaaataggtgtgcttgctttcgttactgtggtggttagttgagcaagttgatgcgctccttcaggggttactgacgagggtaatcaggggacgatagagttttgacttttttgaggtttgtttctaatggagtagtagtaaaaagggctggaagtaactagtttgaacaagtcattaggtagaaaaagcgaagattaaactggctatagtggtttccctcttggtcttactagagtaggtgataaaatagtaaccttgttgttacggatagacctatctataaatagcaacttgcagaatctttcgtctatgtgaacctaattaatatgacgtcaaaatagattaatgcaaagtttctttagcatgtggtacatggaccggagaattagtactaaaccaattactccttagccacttgccagtacaaaatggactagcaacctgcgcgtcacgaacggaagaatccatggaatccttgtctacttccctagtacgtctttctagaagtgacattctgagtagtatatagatagaacctaattcaaagcctaatgttatgttctcccctgttgtttaatcagctaagaaatccatactccatatgcctctgtgcccattgggttcaactaactcatcattgtccaatagaaaaagagatggtgataaattatcaagtgtgggaaaaattgaaaataaaatccttgttagctgactcatctaacaagtgtgctgtgtgcaagaggtgcaacttgtgctccacttggtactgacgtgctgtgatggattgggaatctgtgatctcatcttttttgaatggcctgggctccactaatagcccacagaggcacagagaggtgatagccttgattaggccagtgccgtggcgcgactggatagagaagcccaagccaacccggcacgcaaaaggctcgcaaaactcggcccaactcgaggaaagtggcctcgttgatgctcctcggcataatcagccaagaggggttgctagttggcgcgtgccagctgctcccgacccaaggcgcatcaacccttttttttcgcgatttgttttttctttttttttgcgatttttttcggtttttttttcgtttttttctgataactttttaaaatctttagcacacttattttttaaaaaatgttttgagttgaaagtttttaaatcttaacttgaaaatttttaaatctgatttgaaagtattcaaatctcgagttgaaatttttcgaatctgagttgaaagttttcaaatctcgagttgaaagttttcgaatcggagtcgaaagttttcaattctcgagttgaaagtttttaaatctgagtcgaaagttttcatatttttt

SEQ ID NO: 54778 - DNA, 2251 bp, Oryza sativa
aaaaaaaaaactaaccgtgtcttgtcgtctattgggccgggtgggccggcgcgtactcgccaattaggattcctgtcagccaagccccggtgaaaacaaatgtcccgcgagtctgagaatgctaattcgcggcgcggcgttgtcggcgtgtacttccggcccacacggcccacgcatacacgcacgattttttttcttttttttcgcaaccgtttctttctttttcttttttttttcttttttcgtagttcgcttccgtacggataggagaaaaaattgttattagtttactagtcattatttttatatttttattagtgattagtttacttagtaatttttaaattttaacttaatttttttttaaatttggactttggacttgaaagtttttaaatctcgagttggaagtttttaaatctcgagttgaaaattttcaaatctcaagttgaaagttttcaaaattttcaaatctggacttgaaagtttttgaatctcgagttaaaaattttcaaatctcaagttgaaagttttcaaaattttcgaatctcgagttgaaaattttcgaatctgagttgaaagttttcaaattttaactttaaaatttaaatcttaaatcaaaagttttcaaatctaacttaaaaaattttcaatctattagtaaaaatatctcaaaaaaatcttcagaatctttcctaattactccatcaatctacttatgatagtcatatgtctaaatctaaaaaagttatttttgatagccatatttcaatccaacaacttatcatcttaatggcttttttggatttaatgtgtgattcttcattcttccacgcaagattggctacatggacatcgaggaatataaatattaatgaatcgcttgtttacgaggaatgactagtagcatatttaaatggataataagtagaatcacttatccttaatttatgtgtcaaagataaaatattactatcaaaaatagatggagagagtattatcattagtgttaagtgttaaataaaggtagttgaggccttaagttaagggggtgtgcacgctagcgcgccagctagccacccccaccgcgagtccgcaactacccaaccccacagcaccgcgtgcccgcgtgcgatggcattcgcgccgcgcgtaggccgcgcgggctgatcagctgatggtccgcgcggggctacgattctgctacgacttcatacgagtctacgaaccagtcgccgcagcccggtaacgatcttggggcaggcttgcacacaggtgcaaagatacgtgtggcagacatccgctcgacggcaaccgcctggcagtggagccaccgtgtcactgtcacctaccaaagctctgcaaggattctaactttccaatagcccgtgagtttacgttttgtcctgatgcatgatgaacagcccatcatcaacgggagaagccaaccaatctatcatggacatgtcgtcctgtgtcgtatggcgtgcagtttgtactttggattacaggtaatattgatctgtacatatactacttttaataatactccagaaactaaatactactagaaaggattttgttcgccttttagtacgtgagggataattatcccttgatgttattggtcggagtaccattgcatcaccatgaatgagaaataataaagaaatgaaaagaggattgcaaaccaaactgggatgctccccgcatatgggttctgcatttagcagcataacatctaaaaagcagataccacaaatattttcaggggactactccaggaccaataggaactagagattactaccatgaagggcacatgcttgcatcgcatgctaaccatctactgtagagtagtaaatacaaaatctccagttctgccaaaaacaaccaactcgagtcaagaaaaaggacagcagtttcatgcaaaagaaaacattaaatagtacatatccgggagatatgcattacttactgcgaatcagctaaatatttccccaatttattaggcatgtattacccccctggaaatataacaaagaaccaactggagtctggagagtattaaaaccaaggcaaggggttccttctcatggcgcacaccattctactcctagtagtgctcctcctttcctccaccaccaccatttccacctccaagagaactcagccaaagttctcggctatcttctactttggcgactccgttctcgacaccggcaacaacaattatatcccaacattggct

SEQ ID NO: 54779 - DNA, 2628 bp, Oryza sativa
attcctgcagccctggctgtgggaaaccatgctccttacggcaggaacttcccaggaagaaagccacagggaggttctccaatggccggcttgttccagacctcctcaatgagaagctgcagctcaaagaattctcaccaccattcctggagaaggacctgtccaacaatgacatcatgaccggggtgaacttcgcgtcggctggttcaggatttgaagaccagacgtcacgcttgtccaataccctgccaatgtcgaaacaggtgaacctcttcaaggagtacctcctccggctcaggaacatcgtcggagaggaggaggcttccaggatcatagagaactccctgatatttatcagctcaggaaccaatgacttcacacgttattatcgttccttaaagaggaagaagatgaacataggtgaataccaggatagtgtactccggatagcacaggcttctgtcaaggtaaaagatcataagcatttcctgagttgtttgtactcagctagattgaagctgattgtttcaattctgaagcagtagagactagatatatgactcttctttcacttactggaatgcaggaactgtttagcctgggtgggaggcagttctgcttggcaggtcttccaccatttggctgcacaccatttcagattacgttaagtggagatcctgacagagcatgtgtggatgagcagaacagggatgcccaggcctacaactctaaacttgaaaagctacttccagcattgcaaggctcactccatggaagcaaaattgtctacttggatgcctatcaagctttcaaggagatcctcgacaatcccgctaaatatggtatggttgtccaataatggcgtgagttgtaacttactacattacaaatacacgcattcatttgtaatatcatataaagttgtgaagcataataccacaacagatttggtaaacactaaaaacaccacaatgctaaacttgggaattaacagctagaagctgacaggaaaccaaacaactaactagctaacaatttaatggcaagagacagaaatatcatttcttagttacttattccatgtactgttttttttttgtaactatagcagctctcaccaaagtttgccatgataacaggatttatagagataacacgaggatgttgtgggactgggctcagagaagtcggactgttgtgcaatgcattgagccctatctgcaggaacgagtcatcatttgtattttacgatgctgtgcacccaacagagagggtctataggataacaactgattacatactgaaaaatgctattccacagttcagttaaatcaaattatcaaataatatttcattccttatgttgatgcattctgcccgttctttttgctgtgcagtgtgcactaagtccatataacaagaaagaaccctttgaacatttaccattaatcgtgttatgcttatgtatgacacactgtaatccttggcagtcccaataatgggtttaaactgtttacaaggtgaaatatagaatgaagaacataaaactttgactggataagaaaaaaatgagatgactatagagacaaaacgactacagggttatccctttgtaagagtgatgaaaggagttttctataaatcttccatactgtgaaatcaacattttggttgaagcaagggttccgctaaataaaaggtcgagaggtctgcaaattccatcaaaataaacaaacaaactaagctaccatatggatccagaacgaactggcacatattgtgcattttttatgcctctgttttataaatgggatagattcagtgttgaataaaaaatgtcttagattatagaaaaacacatcaacatctaaaacatcaaattagtttcattaaaatctaccaggaaatatgtcttgatagtgtgtttttctataaacttggtcaaagtttaagaagtctgacttagaaaactaaaatgtcttacaatatggagcagagggagaagaagataaatcctgggtaaaacagtgcagtagtatattagcattagttgctctaggactccagagttcacatgatcccaattagtaaagcatcaaccactacagcacatactgtgaaaataatacaagtggctaaaacaaggatgctacacaccttaggctggtctccctgagaaacattataacacagattagcacaacgcacccagaagaagcacttcacctggtcattgctttgaacaactgctgaattcgtgatctcacatcctcaagtcgcatatatgactctcctgcagatcctgttgccttcaacatctcagccatatccctgtaggctggaattaccagctcctccactaaaatgctaaaatccactccttgctgcttatccaccaagacccaccgtgactgcacttggcaaattgcttctacaaagttgttaaaacggctcagcttctctgtaataacattcacgttgctgcaaaaccttttgtccatctcaagtatcatgatagccttaccccaggtagcccgtcggtattccaaaatccattggttaacctttgaatgtattaccttgatccaatcctcacccagcaagaccttagttcacaaccattgactt

SEQ ID NO: 54780 - DNA, 1223 bp, Oryza sativa
ttcctgcagcctcacttcttccaagtatggcgagaaacacatgctgtcacaaggtagttcatcacatacctttcattggatgcactccaccatctagtggacaagactcacttggatcacgtcgtactaggttttcaagagccattaagatggccttaattgacaatccgaggcattcacgaagagcagctacttcaggattaaaagcatcatcaagaacaggaagtatatcacgtacagcatcatacatatcaactatgcggaatagacattctggattttttccagcagcggcaataaaatttccgaaggataggagttggagaaatggatgacacgcagtgacaaaagcaacgtcactgtaggatgtgaaaccctcaaaaatgctatcacacaggtgtctttcacttgggatcaagatgtgaaacacaacacgaattgcagggatccagcacatgatttgaatctcaagctcctcccacgatgctgacttgaacatctctgccatgtgagcatgaaccccaaggcgtgcaatgctctcatcaatgaagttgaggcgtgaagaagcataggtctcagcacatgaatcaccaaaaccagcggcaaccatcctctttgcaattcggtttgcctcaaagattacgccctcaggtaaagcatcaacaatgatgtcgaagttgctaactggctgggctacaagggtgtgcctatcatcatcatcatcatggcttttcctggtgttggggtagctgcagttggtatcgaagccagatgcatcaatcaggtgctgcaactcttctccaagcctcaaggaacaacgctctagaagatggtcaaaactctcaaggaggatatggtccgctgacatgctttcaaggctgtggatggtggaagttagttcatccacagcttctaagaaggcatcagcatcatcagaactagaccagaggggccgattcaagcagagaaattgggaaatcaggtcgttaagtgcctgcagagtatcctccatgccagccatcaccctttcttagattaaattccttcagatctgcaactttggatatatgaacttcttgagtcttcagtgcaagccatggaagaggatggtgcagtccagtccaaagatctgcagctgacaaaattgactaggatgaatgaaattgcgaacatacctcagtgaagacgaattttgaaattggtgatgcaagggctgcaggaat

SEQ ID NO: 54781 - DNA, 2321 bp, Oryza sativa
  unsure (1)..(2321): unsure at all n locations
tacttggctggtccatactgtctcacctaagagcatctttccaccagaaacctcaattctacatttgagcaatgaacgtcagtcaacctttagatcatgcttcaatgtatccaccacaatcattcatgatcttatttcaaccgtgttaataaaaaatactctaggtcaacaaaactcattgttgaaatagaacacaattatcaacaactttaacatgagagctaatttcacaatggcatttaatatcagtataaaggcaataaaggaatacataaagatttatgtttgaaccacttcatcaggaaaacaaacccaaaagaggaaaaggctaattagcttgccatgcttattatgaaagagttcttaccactctaaccatcataaaagccgggcaatataaattggctaaaatctagtggatctgaatgatataggtgcttatcacttgaatgcagtaagcatttgaaataaacaaaccatcacacttcatttgtgaaaacttaaggagcaaataagccaaaaaaggaaatatcaataacatcataaattagattgcattaccaattgataattaaacagacacctaggataatttacaaagtttaagaaacccataattttctcatctaagatgaaaagtaaaccttatggaacaatgccaccaaacacataatggcatcaccagtgttcagatatccaccatagcagcaacaatgacaccaaaatcacagctatagaagcatagtgactataatgaactaataatcacttggacactccttcaaacaggtgctggattcgtgcttcgacatcttctggggaatgcttgatgaacaagtcctgtgcagcttccgcagatgatttcaaccttgaaatcaagcccatatatgcagacttcacagaatctggnatgctgccctaacatcctcgcgcagctgctcatctgcaatcacccattctgactggatagcacatatctcttccaagtagccattaaanannngnagtttttgtagcaaggccgtgcagggagactaccaatgccaggaccacccgtctgcaacactgacatgacctttgcccaagccccacgctggtactccaaactccaacggcgcactctactcatcatctgcttcatccactatcaccaagcaaaaccccaagctcactgtcattcaccttgtgaataatgtacttcccgttgttcatcaagaatatggatgcaagtggcgggtccctatatatcttagatttggtctccaaattcttgtgaagcacatccatgatccatgcaatgtgcactgcaagtgacgaagtggggcgatcgggatcaacagcaatagctgccccgccaacagcacctaagtcaccttccatcacctcttccagtgtctgtcttgatccacacgcagcacggagatagttcatcacataccgggtgattgggtgtatgccaccaccaggaacagaaacacgggcaggatcacgtcggatgagattttccaattccatgaatatacctttgatagaggaaccaagggtgttgcaaacagcagagacctcggcacgaagtgcagcagagtagggatcagcaaagacagggtcgaggtcaggaaggaggtctcgcacggcctcatacatgtcaatgacacggaagaggcgctctggagcacgactagcagcagaaactgcgtcgccgaaggagataagctgcagcacctgggtacgaactgcagcaacaaaagcgaggtcgccataaggggcgaggccgtcaaagacacggtcgcagaggcggcgctcgctggggatcaggatgcggaacaccatcttgaaggccgggatccatcgggcaatgtcgaactcgagctcctcccacggcaaggagtgaacctcgtcgatagtgcgggcacggatgccgaggcgggcgacgctctcgtcgataaatccgcggcgtgcggccgcgtacgcctcggcacactcgcggccgaagccagcgtccaccatccgcctcgcgatctggtgcacgtcggagaccgatcccggggggagggcgtcgatgaccacgtcgaagtccgagaccggcttggcgattgggattggctcatcgccgtagccgtcgtccgcgtcgtagtcctcctcctcgctctcatcagaagcgaacccgccgggcgctggcggcgccacgtcgtcggggcgctctatgagcgcccggaattcatcctccagccgggccatacaccggctgagcagctcatcggcacggtcgagcagcccgcggttggtcccagctgcgtccagctcctgcacggtgccgatta

SEQ ID NO: 54782 - DNA, 4073 bp, Oryza sativa
ctcactggggtgtcgccgtgtcgccgtgcttaatcgccagcgttggttccagaacttaccgcgccgtcgggccggtaaatcccggcgggcggtggatgtgagccgtagcttgtcgtatggacggtcagatgaggcccgtggagatgggggcaagataaagtaaaaggcgcggtgaccacggcagacttgcggtggatggggcggtggggaaagcataaatgcggatagcggtgggttagacgagggttttaattactcactgacatgtagggtcacggggttttgagtgtcacgtcgtggcggaaaggcgccggtgggctagcgtgattgacgcggaacccgaggtggacggactatggaaatcgcacttgggctgccttcccgcaacatccgcttgggcttggcaaagtacatcgaggcataaaactacatgggctgccaaaaagggacggtccattaagggcccaagattccaaaagagttaggtctcggcccactcaggaagatattgttaatcgtggtagggtgagattcaaatcacgggttaaacaacggaaagaaaaggctgacgcgtgggtcccaagtttgccccgagtccactgtgaaacgaggttggttcatgggagagtggaggcggcacagatccacccatcgacgggcataaatttgggctaatcccgaatctattcgctcccagaacaaacgccatggcctccgccgccgcaccgacgccgcagccgttgctccccgtgaccaaccccgcggccgccggtggctccgcgccgtcctccggctcggcgctcaccgacgcgccgctcgccacgccggcgttccggctcttcgtgagtaggttctccgacacggcgcggcgctcgctcgccgaccgacggccctggacggagctggtcgaccggtcggccatctcaagccggactagctctccgaggccacctcgcggctgcgccgcaacctcgcctacttccgcgtcaactacgccgccgtggtggcgttctccctcgcggcctcgctgctggcgcaccccttctccctcctcgtcctcctcgccatcctcggcggctggtgcttcctctacgtcttccgagccgccgaccagcccgtcgttctcttcggccgcaccttcaccgaccgcgagacgctgctcggcctcgtcgtcgcgtccgtgctggccttcttcatgacctccgtggcgtcgctcatcatctccgggctgctcgtcggcggcgcgatcgttgccgtgcacggcgcattccgcgtgcctgaggacctcttccttgacgacccgagcgttggctccaatggcaacactaccagcaggctgctctccttcctcggggcgcccggatctggggtttgatgcggcgcaggatctggtaggattcttgggctcgtggaatttattttgagtacgaattggcatggatctggttcgtcggctgtagctaattggttgccgctctgcttgtgcttaattgtgagtagttatgaatatgcagatcatattttgccttctaatatgtggttcgaattatgcaaagatctgctagatttgtacttcacttgttagtttgaatctgagtggtgactggtaagaattgttagatgtcagcaactcagtatgtcttgtgctctgttctttcaagtaactgtacaccgactccttagcaagtttatggtccttcaattacttactgcgttgtttggatcattttatttactgcactatttggagcatttatctgctttattatattcactgctttatctgaatgttttggtgttgtactgcaatatttgcttttcatgtcttactacatagtattttggagaaccagtgcattgtaatacagcaaggatgtatatctgtgattcttaaactgtaggactctataggtttgttatgttgtcaataagtatggacacttgagagtatcacttatcagtttgttgtgttggttagaatgtccagaacttcaataccattttacagtgaatgccttcaatatttgagtagttatgcaaagttttaagttattccagttatgttgcatgtaggatagagaaacttacagttttcttgcattggtcaaatatgttggtaaaccttctttgatatcttattgacttgctgccagagcatcccagtaacatgtttttgctgtatatacatggcaattaatattttaactggtgttttacgatccttgagtaatgagtaggcccctgagatatgtagtggtacctttcatctgcagaattaccataaattaacactacaaagtgtgatacctctgcattacccttctaaggatcaatggtgaatcctagactgtcttatggtacgagtccaggcaagtctctcgttgatatatcactgcataactttctcataagatgctgcagattaaaagtctaacctttgaaggtgcttcatcattcttgcctgtttgaactacctttggatattggattatgataaagacatatggcagttttttttttcaatttgacttactcaacaccttgattgacttcttatgttgaatatatgtgagaatggttgactttgtaaattggaagctagaacagcaccagcgacaatgagacagatgttaacgttgactaattgtcagtactcaatagtacgaattttgcttctctatggaagttttgcattaatgttgcagtatggagttagtcacttttcgatatcacatgggtcttccagttatttactcttttccaggtaagtattggctaatgattggggttgaatattcttaggacttcctcattttcgaagatgttttctcggctattctctgagttggagtatatgtttaacggatttcctaaatttatggcgtcatattctgttgctcgtcatattctgtttaacggatttcacagtcgaatattttggccatcagttcatcagtgcacgaatctcactgaatattttgtgcacgaatatgtggggaaggaattatgggttgtgaaatatgactcctgacagaagaaagctaaggataagctttgtcaataacactagtagtaccatacagaagtgcaaaagcggacaacagaatgcgatatggaaagtttgggccgttttggtttgctaccaaaactgagccataccaatattttggttatcagaacagtaacactaagagtttggattgtgaccaaatcactggtagtgcctagacttaatttggtagcaaggcattggctggaattggtagccatccgtcgcccgccggaagcgcccagaagcaggtcacacagcccaaactagttcacaaactagttcacgcacttccgttcaaaaaaaaaggctagggcttcatcttttctctacttcaataaatacccagccactactcgtctcctcggctggccgcctcaccgctctgcttatttgtgcttattctacagcaaatagtaccaaatctattacaccacaaaaaaaattggtaacccttcattggtaccaatccaaatggaaattgacccataaaaatttggcacttcattggcactaatccaaacactcataattactgtgctatactaccaaaatcttggtagtgccaaaacttgcctaggaataagagcaagttcaatagtatagcccactactagctctaattcatctatagcaaatctaataatcaattcatacaatagttgcttactatactattaatatatggtcccacctgtcatacacacattgcgtcttggagtctgtgctgcagctggctacaaatctgtagcccgctgctcttctctctcatcgtttatttcattaaaatatgtttatagctgactactctaagccccatagtaactggtagtacttcctactccagcagaaatgaaatgatgactacttgactatcctttgacatttctttcctccttcgatggacgcatttcagtactatgttgcatatttgcaatggtgatctgagtaacacttgctacaaaaaggatttattccaaaataatgcatagaaatcacataaaaactcttaactttacagggg

SEQ ID NO: 54783 - DNA, 15297 bp, Oryza sativa
tcctgcagcccagtcggtggcgcagccgcagtcgtactcgatgacggccgtggtggtggtgttgtcaaaggccacgccctgcgcggagtcgtaggcgcgcgcggcgaggtagtaccgggtgggcgcctggtccatggtgacgaggacgtcggtggtctggcccggcgcgatcatgagcaccgaggtggtgaacggcttggtgtaggacgcgtcgacgccgaccacggtcatcttgtgctgcgcgatcgagacgaacagctcctggttgagtgccgcgttgatgaaccgcagcagcgccgtctcgccgggcttcaccgggacagccgtggtctctgcatgcatgttatcatgtctctgtaaatttgccacgcactgacgcacacacactggctggtagaacacgcatactagagtgagtgattttctaccttccttggagcagttgtacagatcaccaggctgaccgttgatggtgtacgcgtcggagatgttcggcgcggcgccggtcctctgagcctccctgatgacttggatcgggtccgcgtcccaccattcccctgtccatcgtgccaagtgccaacattttcagtgtcagttcagacgactgatctgatagttaatatgcagatctgtgtacaaaagtaggaaggatcaagactgaccgagaataagggggacttctcgcgcgggcttctcgaaggggtaggtcttgttctccctggggcggatgatgagcgcgccgtagacggtggccctgagccaggagctgtgcgcgtgccaccacagcgtgccctcctgcccctcgatggtgaaccggtacttgtagctgccgcccggcttgatcgggcactgtgtcacgaactccggcccgtccgcccaccccgtcctgaactgccggatgccgtgcctgcacgcgcgcgttgatcaccatgtgttagctagctagatctcgaccggcggcgcagaaaacaacaatcgtcgccgttgacgaccaggagcggaagtcgttagctgtttgattggtgtacgtagttgggtcgacgacacgtaccaatggatggtgacgttgtactgcgcgtggttgacgacgttgatcaccacggtgtcgccctcccggacctccagcgtcggccccggcagctgcccgttcaccgtgatcacgttgtgtgtcttgcacagcctcttcaccggcgtctcttgaaccttcaataatccatacacaaaaagcagtaccagtacattaattacacgtacagaaaacggtgcatcgagatatacaggcaataatagtgtgctcgtagctagtaagatgacacaagaggaaaatatatggcacgtacaatgaattcatgatggtgcacttcggcgccggcgagcagcgcgagcacgctgcacgagaggaggaagagcagccgggacgacgaggacgacgccatgccggctaagcgcaaacgttgcggcgcgtgtgctggcgtcggctcaccgatcgaacgggtgacacagtagcttagctatagctcttgccctgaaggtttctgtgtggcgatgagaaacttcccacagtgatggcgcggtatatatagcgtttcaaaaaggacatggttctacgatcgatttctcgttgtgtttcgtcatgcatgttgcttctctggttggttggttaggttttgattcttgcgtggtagagggaaaactttcgcaaacacatgctcattcacgcatgcatgcctcgaggtcgagttcgtgtcaccaaggttcaactatgcagatagtttggtgcacccactggcctgcccaggccagcagcggctgcccccgttggcgccctggtttcacagaacaaagcttaagcactttcttcgcacgcgccaacgcgtcaagttgtgtttggacaatggttctgagatttttgtgtgctgtgtcatctgattaggttgttactttacttagcttttgcttcgagtttgaaagacagacattccatttcgtaccgctaccaatccgttaatccgtcaattgaatgggacaaagtcgttgcggttaatccatttttaccccatggtttgagaagcaaaactatctcatgcaaacgataattaagggtggattggtgttttgcagtctagctactgatttgctttgtgatttagttctattcatccttttgaaccttgtctgatttcagacgaaacctatagctagagactgtttgttgaccatctctgtcgtatcagttagtctgccgttatcaatagctgagtagggagtaatacttgtgccttttcatgtcaattgcgtctttgctaaaacttgtgggcaaagcgaacttagtttggaattataatgattaggagttaactgtcacattttatattattaattcctcactgctcagctgtgagccttttgtgtttccactgctgaatctgattggagtcatattgtattgaccttagtactggggagttggaactggtagctagcctataatatcaagtgtcaatatttgttccaacaatcctccaaatcaatcttctgataataacacattggcaccaaatctgattgcagcccattttctagacggcgggtgtgcatgcatggcttgcaaatgagcttggaagctaagacttaacactttacatgcatccatcaatcgtcgtaaaacgaatttccatttcttcatatgaactgctcgtaaaacgaatttccatttcttcatatgaactgctccaacatattggcatcgattccagatataaatcgcattagcgtcacctaaacaatgaagttcttgctgatgcaatattgaattgagggggaaatgataatgaaatgtctcttgtttctgcagttgacatcaacaccttgttctgaaagtctgaacaatgacactagaaaagcaccaagctccaactttagaaaaacgtttgcatttttgccgtcgtggacggaccaaggggggtagtaggttgttaacttggcgcgccggcgtgttgccgtcgtccacgacgaccagtcgaccaccctgcaaagcgtcagcgtatctatcttggtgagtcatcttcttctctgagttaggagggggcaggtgagaacaacaaaaatgttcaagcaaagcaaccaaactccgatccactctcaaagcctccaaggctccaaccaatctgagaagaatttcggacatgccgtttgacttcaatcattagtgagatcatcacttgatgatagtggcgttgtctctggccatgccagggggatttcttttttgttttgacagagcagctttggactttgcaggttggagagaaaaatgccatggctgaattctgcgccttattataatcggggttggatgaggcgtccgcgtcctcttgtcatccgggtacgactgaatatacaatgtgattagtattttggatcaatgacgaggtggatgcagtgacaaagcagttgttgatgagaagtactactacattatctggaaactctgcaacatgtagttagtcaaaaaaaaaaaaactctgcaacatgttatgcagcattttcgatcgctagttttgtaacaaaatttaatcaatggctgcagcaaaatattcacatcttccgtagtactcccccgttacacaatataagtcattctagcatttctcacatttatattgatgttaatgaatcaagatagatatatatgtttagattcattaacatcaatatgaatgtgaaaaatgttagaatgacttatattgtgaaacggaagaagtacctatcctctgtccgcagggtatgaccctgaacttctttagttatgatcgttttgctatgtggattgatcgtttgctgtgttcgttggagctgggaacatattctctccacacagaaaatggagcgacgcattttcttataattaattaagtatttgctattttttttaaaaaaatgattaatataattttttaaagcaacttcgcatataaatttcttttaaaaaatacaccgcttagcggtttgaaaagtgttgaattcagcctaaattgttcagaaattttcgagcaatcaaaactgcagttcagcctcagtaaagcgcaaaaatggccatctttcgtagtgaaggtctgaagcagaacaaatgcttgcctgggccccatctggcattgagtgtacgatacgaaaatgcgtggcgttgctcgcggcgtaccagacgctcgccttccccggctttgactcacagactccacgtctccaccccgaatctcacttcccgtctcgcccccgcccccaatcctcaccgccgccgcccgggccagccatggtgggcgccgacgccgagtcctcggcggtggtcgacgccggcgagggccacggagacctggccctcgattcctcctccgctgcctccaccgaccctctgctccacccgccgccgtccccttcctccaccccctcctctcccaccgcgatcgccgaccacgacgcgttcatcgaggaagacggcgaggatgactccgcgccccacgtcccatccgcttccgacgaggcggccccggagttcgtccagatcaccgtctccgagcctaagaagcacgcggagccggccgcgggggcagcgggggtcattcctggctccgggagctacttctcctacctcatcaccaccagggcggccgacggcggcctgttccgcgtgaggcggcgcttccgcgacgtcgtcgccctcgcggaccgcctcgcggcggcctaccgggggctcttcgtcccggcgcgaccagacaagagcatcgtcgaggggcaggtcatgcagcggcatgagttcgtgaaccagcgctgcgccgcgctccagcgctacctcggccgccttgccgcgcaccccaccatcggccgcagcgccgaactccatgacttcctgactgagccaagcggcattcccacctccgcgggcgagtcacccagatcggatcccgcgttgagtgctgccatgtccgcggccgccgttaccgctccaacggcgcctgcaaagcctgggagagatatttttgggatgtttaaggacctgaagcagacggtggcgaatggattggtggcagtgaggccgcctccagtggaggaggaaactgatgcaaagttcgtcatgcacaaggccaagctggagtacttcgagcagcatctcacgacggcatctcagcaggtactgtgcttgttttgtactggtttagctggatgctagagcacatacaaacacagagtttacccttctgcataattagtacattatcatcgctgatagacaggataaatgaagcaagtgacatagagagttcctcatgcatgcttataatttgcgagttgagcaacaaatagatatgttgtggcacaaattttcagtgatgtgaataagcacagcaactgatcttctcgtttgtgcggtttgtaggtagaggctcttcttaaagcttatgatgatcttaaagcaactacaggtcaactgggaatgacattcattaagctggcaaagtttgaaaaggagcaggatacatgtaattctcagagaaaaagagctgttgatatgagcaatttcgcaaatgctgttatcaacatgagcagatcacagacaaaactaaatgctaaaattgaaatacatctggtatgttggaaattgtaatagaaagaatgtttgcttcttatgatttcttttcatgaatcataatattatttttgctttgacagggcactatctatgaatacttggagacaatgacttctgttcgtaatgcatttactgatcgcgcaaatgctttgcttcgtgtgcaaagtctgtcaggagatttatttctcttgcatactcaggcagcaaaacttgagtccgtatcatccagaggaatgggcaggaaagattaagataccaaaagattgaagaactgaaagaaacaataagaaaaacagaagatgcaaaaggcaatgcacgccaggaatatgagcttatcaaggtaattcacttgaacttgtggattaaattgagtgtacaatttgtgcattgtacttatcattcttcccagttaaatgttgacttattgttcataactgttgtatatttaactgcattatgcaaggttgtcactgtataagttcagatgacaaaatcaactacagtacggtttgttgtatttctttgttttggtccttttggaagagaaatacaatcaattgtcatgcagatcgatgcataacctgactgtagtatgttcagtttacgtttgtaacagagtgctgtttttttaacacagtaccttgcaatacttaaatggcttgaaacatcacacatactctacatgtgcatcacttgttcattctaattttagctcattagggaacataatgtttctaaagaggtcacaatgaatttagaactgtgctgtcaacactagcagcaggggtacgattgtttcgaaatgaacaagagtcaagagtgttggttccaaaatggtcatgttagaggctttgagctgtggtgaatgcattcagagtgcatccattgtttctgatgtcaaatgagttgctacgtacgtactgatctttaagttttcacgatgtaactttctgcaatttagaagatgatgatatgatatctgacttggttgtgctatgctgtgtactgggacctggtttcttctggaaaacctgtatgaggtttattttccaggtggaacctgtatgtcatgacaatactggagtatggttgagcctgtcattcaactcattaactatatatatcggggtagtttccttttgggttattgtcaaaatattggagtttactttttaacattttcttataatgcaggaaaacaacatgaatgagatcataaggtttaacaaagaaaaacgccatggtttggttgagatgctgaaaggctttgtaagaaatcaggtagaatcactaaaattcaattgcaatgttattcttttgtctgctgttgtggatcctttcaatctattaatgataagcaaatgataaatatgcacttacttctgtattccaacaaaattccaagagtattagctagtgctgagatggaatgagagttactgtgatcatatggtgtatgtagtatctggtttaaattaaattcagtggatgatatctagttgcttcctttctgtcaatctgcaaagctaacactttgaaatctgttgtggcaactggtaaccatgatggtatgaaatttacctcgcacaactttgaagtctgcatctctatccatttaagattggttgtttcatttcatcgcagtctcagctttggttgcatttgtcaatttaaacctattcttctttttgacttcgctggtgatcctattcctagagcaacaactagacatttcccaaactatgcacacctagtgacctcagatgatggagaggaggggtcaaattggcattgttgatattacagcataatttgttccatagtggtcactatgcttaaaaatgatttagtgggctactgtgtttttttctctagaagagagtttgcaatttcattgccatcaggttcaccgttcatgttctctctctttttctttttttctttttcaaaatttccttctatactattgacatcaatagcacatttcatattttcagtaaatgcagtaaccacaaagctattaaaacttgcatcattgttcttctgcgatgcaggtttcatactcagagcatatttctagtatatggacaaaggtagcagaagaaaccacaggatatacaggcaagggcagctgaagtaggatgtaaatatgcatgtgaattttagccttttatctgcagatcaacatcagttacagaattcgaaatcgtcttatagctcaacacagtggtatagagtatagactataaacagagatgtcacacttccctccatccaaagggcgtcggatctgtgatttttctggagatggtatctccggctgtttaggcgtatagcagaattttctaggaaagagaatcaaatgatcagcaaaccaacacaactgtttttttttcccagtcctttttttttccaccctgggctttacagtaatgtaatgttgagtttctgtacacgaaactagattagctggaattttctggttcctgagagaaccacatacatgaagatttctttttggtctccgaacatatttgtacgcatgcacttacctgccagctactccagttgccatatccacttctttttgtttcctctacgtaggagagtactggatggtttttgtgatgtgcaacggtttggctcgatattatgctgggcattcaccaggcagaacgagccacgtttctgcagaaggtgagccacccattccagcaggctgctgactgggcatgctcgcgacgactcagcctgtggatgtgcggctcgtgatcgtggcgatgacctgacgactccttttgggcccatagccatcggcatcagctgcttatccccctacacgtaagtatcattttgtcagtttctaccggtggttccgaacctgtaattcgatgaaagatttcttcccagccttccttgtgtcattattttttttgaaggaaaggcaaaaagcattgccttgtatatattaatagagcaggagaaaattatagcgtggtatatacagggttagacgaaaaaagaataacccgtaaaagaagaggcaaaaagcagggattaggtgatatcttccaagattccaaactcttgtaagattgcagcccctgctttgacgcatgctctgccttcctccttgatttttgctaaaattgaggacggcgcagacgcattgttgcggaagattcttatgttttgttcgcaccagatttcccacgagattagaatcaccagagtcctgagaggcttgcgtggggtgcttggggactccgctacgagagtccaccattgctcgaccgagtgacaattttcccaattgtccatttggaggtcagtcccggtccatctttgaatttccgtccatatcctctttgtgagtctgcatttggctaggagatgtaaggccgattcatcgacggtgtagcagagtgggcaagtcttttggttttgccatcctcttttttccagtctatccgccgtccatactctattttgagtgaccagccaggagaagaatttgcatttcggaggtgcccatgccttccaaattgactgatagaagatggatttcgcagccccgaggaactgcagccgataggccgattttgcggagtactgtccatttgctgtgagattccaacggatgctaccatggctttcgttgagcggccgcatggttctgatcattatccaaaggtggacatattgctggagttgattcgcctcagcgatacgggagatgtcaatatctcggatccagttgttttccgaaatggcatcttgcacggttctgttttttcttttggagaccatgaaaatctctagggcgatcagttgcggcgtttgattatctaaccatttcgagctccaaaagcgcgcagtttgccgtctcccaccgttattgttgttgcggccgcgaagaggtctttatctagctgattgcatgggagcacagttcccacccaaggtttgtctggcgccacccattcgttccaaagccatctaagtctgagggctgatgcgaagcgttgcaggtccagaacacccaggccaccccaatctttaggcctgcagactcttttccagttgactttgcatttttcccctgagatattttcgcctcccgcccataggaattttttccttattttgtccaactcctctaaggtcccgtctggcagttttagagatgttaggtggtagatgggttgtgccgtgaggactgattttgtcagacagattctagcggcggtcgacatcattttcccttgccacggggcgagacgcgatcgacatttgtccctcaggggctggatgtggattttcttgagtcttccaaccacgagaggtagaccaaggtacttcattgggaagtttgtgagtcccgctgggaagatcctagttatgctggagagatcaatgttatcacaccggattggggcaatttggcttttgctcatgtttgttcagaggtcggtcacatgcccaaagtcacttaagatgttggtgagagctgtcatatcttggacacttgggttcacgaatatggccgcatcatccgcatagagggaggttctgaacctgggggctcttcctcgaaggggggatagatgccctagctccgttgctttctctagaaggtggtgaagtgggtcaattgctagaatgaagagcagcggtgaaagggggtcgccctgtctgagacctcttccgtgttttataggcgatcctgggcatccattgaggaggatctttgttgtcgaggaggctaagatgtttgagacccagttagtccatctggatgtgaagcctttcctctgtataaggtcgattaggtaatcccatctaaccaaatcgaaagctttggttatgtctagtttcagcaggagggttggcgttcttgtctgatggaattttctcgtcaggtttctcacatacataaagttgtcgtgtatgtatcttttctttatgaaggcgctctgggtgtggctgatcagggtccccatgtggggttgcaaacgcaaggtgagcacttttgaaattagctttcctattccatgtatgagactgattggcctgtagtctccagcgcattttgccccttcttttttttggtatgagcaccacatttgccgaattgaggatcgggaggttgttgcttcgcagctggtcaaaggaatggatgaccgccatgatgtctccttttatcgtttcccaacaagctttgtagaaggctccggtgaagccgtccgagcctggcgctttatcgctaggggactgctttagcgcagcatggacttcctcttcagtaatgggaccactgattgcagagcagttgaaagtcggtagctgcaggacgtcccagtcgagatcttttgaacgtgggcctgggcgcgccatgaaggtctggaagtgctcttttagagcggcaactttttcgttgtgttttaatttccacatgtttcccactcgtagcctctggatgaaattttttctcttccttgcattcatcttcaaatggaagaattttgtgtttgcatccccctctctgagattggtgattcgtgctgcctgccttctgcgagctctttcaacgatcgctaggcctatcaccctatctttgaggtttcttcttagcgcgagttcagcttggctgagttgccttgactcttgagctatatcgaattggagaataatctcgagcgccatatggaggtgcagtctcccgtgcgatattagtttcttactccacgctcttagtcttattgccgtatttcctagcttgtggaagagtatgtgatgtgcttcatggtgtggttggggggctgaccaggcttctgtcaccacctcctggaaacctgggagctggatccagaagttttcgaagcggaaagttttcacgcgtggggcctctccttgttcagttagcatcagcgggcaatggtctgagagcgaggtggagagggcatgcagtaggtgcttctcaaaggttgtgtcccaactagcgttgcaaaagaaacgatttagtttgacaagggtcaggctgtcttgctcgttactccaggtgtaacgcctgttttgaagtgcaatctccttgagctcgcaagcgttgagagtttctttgaaaatgcgcatttgtctgcggttgaggtttgcgttatttttgtctgaagctttgtaaattatgtgaaagtctccgagcaccagccattttgaattgtcagatggcttgatgcctcatagttctctcaagaaggtttgctttgcactctccctggttggcccgtaaacaaccgtgatgaggaaggtagtctgacattcttttagggagactgtggccgaaagtgagtaggttctctgcacgaagtctttgatatcaacaaaatcctcattccaaaggattaggataccgccccttgttcctagtggtcctgtcgccggcttgaattgaaaagaccataagcatcccccgccaagggagtttaccagcctagcgtctatgttgctcatttttgtttcttgaagacatgtgatgtggggtttagcctcttagagcgtctctcttactgtcgctcttctagccggtctgttcaaaccacgaacgttccaggagaggatatcgatgagcggatatgtccttgtgtcattattgtgtgtacagaaactacatattgctctctacaatgacaggtacactagtttgcactgtagtagttcaaaaccgtaccacaaggggaaaatgggagcgacagataccactccatctctgccatgaaaaatcgaaaattagacccgttctccaccacgagaaattccctaaaaaatctagattttaagttcaattctctgtacaacttctgctgcatctgcagctgcatggtggtgtcaagcaagtgcagccatttctgttccactcaacctgttccttctattcttttcctgtgaaaaaattttcctgggtaatttctgggataggtttatcagaattgcaaaattgtgcaccgagacagagaggctccgcgaggggaaacgggcgtcttcgcgtctgttttactctaccccaacgaccacaagctgctccgtgctccctctctggactcgccccatttcctctcgccgccggcgcgtcggcgccgcgcctccggctgaggagaatgctgccccccgcgcccacccgaaacccgggagcctgcaggttcatacccctcctcccaccaaaaccgcttctctctcccgccgccgccgccgcctcctcccgcggtggcctctgcgtcgccgccgcatcccgccgcgatttcctcctcctagtcccctccatcgccgcggcctccaccgtgctccagtccctcccgctatccgcctccgccgcggacgatgagaagcaggccgcgtcgcccgcgccgggccctgcagcggctccggctccaacctccgcgggagagcccgaggcggaggcgctgtcgagggtgtacgacgcgacggtcatcggggagccgcaggccgtggggaaggacgcgcggcggagggtgtgggagaagctgatggccgcgcgggtggtgtacctcggcgaggccgagctcgtgcccgaccgcgacgacagggtgctcgagctcgaggtcgtgaggaagctggcggcacggtgcgccgaggccggaaggagcatctcgcttgcgctcgaagccttcccgtgcaacctccaggagcagctcaaccagttcatggacaggaggtctttgttctacacttctacagttgtacttattagtctagtttatctagctgactgactgactgactatatacaggatgggctcttgttgtgatttatctgtagctttgagtttttagagatttgagtcctaatcgtttcaaattcaagtgcagttagtacttgtcagtctgtagtttgtgttgagctctgagattacttaggctctattagattgtagcgttaaaggctctattagattgtagcgttaaactttgtggaaaccttgccacaatactagctaaaattgccttgcagcaacatcaccaaacaaatgttgtactgtaaaagttccaaccggccaccccaaatggattttctagaattgatatgtacctactacattgcaagcatgatggcggatggccatgaattaatgtctgaatgctgcttatgataatatcaagtgcacttaccttatgaaaattcattctttgctcagaattgatggcaacaacttaaggttgtacacttctcactgggcaccagagcgctggcaggagtatgaaccccttttgaactactgtcgtgataatggagtcaaacttgttgcctgtggaactccacttgaggtaatccatatgttacattgcccccaaatagtgcatgtgatcaattcagttgtattgccataacagtattttttattgatcattcttattttgtagacaagttgcaatttagtcattttatattgatattacaccattccaactggcaagttttttcttgcattttatagttagtctagtgtttttaccaactgaatatgggcctgttctacaccttttttttttggcccatgtccagaaaatgactcctattataaccccctccaccctccttttctcccatgcccaagtaaatgttctatatgcattatgctaaatatatggtttacttttcatcatttacaatatttggttgaaatacaattatatagtccattttctggctaggtgtcaagaactgtccaagcagaaggaattagaggcctttcaaaagcacaaagaaagctgtacgctcctccagctggctcaggcttcatttctggttttacatccatctcaggccgatcattgatagacaagatttcagcaattcatggctctccatttggcccaagctcgtacctatctgcacaggcaagagtagttgatgactataccatgtcccaaaaaataatgaaagaaattactaatggatatccttcagggatgcttgttgttgtaactggttcaagccatgttatatatggttcacgtggaattggagtccctgctagaatatctaaaaagatgcaaaagaagaaacaagttgtagtacttcttaatcctgagaggcaaggtattaggagagaaggtgaaatccctgtagctgatttcttgtggtactctgctgccaagccatgcagtcgaaattgctttgaccgtgctgaaattgctagagttatgaatgcggctggtaggaggcgagaagcattaccccaggtatcactcgctcttgctcaaatatctgtggtgttacataacctaataattgtaaatgctgtgcatagaggtgttaagtccaatggaaaagtatagctattggcagagagacatatatttgatgaagagtctgtaaaaacaagtgattttttcatcgaatagtcaattgaactcctttaaaagtaattagtgtaaaagatcttggtatagttaatcagtttttgtttactaatacagccttttccccctcttatctctaagaatttgagctaatggtacattctgctttaaatttatgacaggatcttcagaaaggaatagatcttggcgtggtttctcctgagatactgcaaaacttttttgaccttgagaaatatcctgttatggctgaactgatt

SEQ ID NO: 54784 - DNA, 1144 bp, Oryza sativa
acttgtctagcgttctacaagacctaatgaaatggtttgccttgtcattacaggtaactaaatgccggctaatcggctaatcccaatggacagacttatgtctatactccctccgtcccctaatcccctaatataagggattttgagtttttatgtctatactcccttgagtttttatgtctatactccctccatcccctaatataagggattttgagtttttggttaaactgtttaaccactcgtcttatttaaaaatttgtgcaaatataaaaaacaaaaagttgtgcttaaaatactttagataataaagcaagtaaaaaaaaataaataataattctaaaattttttgaataagacgagtggtcaaacaattcaaacaaacactcaaaatcctttatattaagacggagggaatcctttatattaagacggagggagtaccgtttttaattggagtctattgacaagatagataacacatagcataacacagagaagcagttataaaacgctttgcttcatgtcacatgatatatagagcaaagtcaagatcgaaaacggactaaaatcatggatagtctgggcttgtttcatgccgggtaacggagaagttaccagatgtaaaaaacaaacaaaaataagtcatggatagcgcatccttacgcatgcatagagacatttgagggcaaaataaacagcacgtcaacagttactgtccaacgcaagaagcccagaagcacagcaagcaaaacaaagcagcagcagaagcagcgcatcagcagtttaccttgagtgatttcaaacagagctaatggaataaaaacagacatttaaaacacctccattgtcatctcaacataacataactagaagtagtaccttgagtgatgtttacgttattacaccacatctatgaaaaagaacagaagaaaaagaaaacccagtcattgtgtattgttctggaatttgatgcttgagcaggtgatgaccattcaggtgagccggttcatcactaaaagactgcaaactgaagctcgaaggacgtaaattaattagccctgcttgttggcataattgtcaggctcgtcatccttgaagaggtcatccatgagctcatcgttcttgcggcttccaaagctgt

SEQ ID NO: 54785 - DNA, 1333 bp, Oryza sativa
aagattcagttttttgcatgtttgggtgtacctagaactacagccagacttgagcagatgatgtttgtcacagacagaccgacaaatgcccacgcatactgcgagatcaaatgtccgatgctgagagcaatgccaccggccatcgcaaataggactgaaggccagttatcctgcattgatcaatggctgcaaatcatggaagaattcactgaagttgattatccacataaaagctgaacactctaacgacagtgacacgatgcaaccaacatacagttgggacaagtctctcatgcttgttttgcgtccacagataccatccaaattccaaagtcacactgtcaacttgaagcaattctgaatttccagttatcaaattcagctattcacttccaaattactctcattaacaggtactaactcacacagcttcttatgaaatcaccactgcattcttgatggctaagatattctagtcctagattgcatgacacaagaacaaccaactgaaccaagaaaccttaaaaaaagcactgacctgagtgagctgagtgaagaagcttggcatgcaggcctggtctctccaacctgcccaaatgtgatggaatcacagcagcagcaaggagatttgtgacagagtagtccaggtatgtgtgctgaggcagccgtcctctacgctccaggagagtcaggagagcaggccaggtgcccaggaagaggagggaggccaccatcaaggcgacggcgccgccccggtcctcgacgacgaacatgtcgacgccgggaagcggaacggagagcctggggtgtgatctccggggaggatttcaggctagatctttcatctcaagtctcaattggacgaattgctcatgtccatgtgaactagtctcactctaacccccatttccctggcatgttgtcctcatctagttcatgttttggcctgaaaaaggtaaagagataatcaaggatgtggtcatgatgagcccgctacggcgctctctactcttagtagaaatcaatatgaaccctatatcttatttgattaaagagtttaaatttatttatactatcaccttagttagcgggagtagaatatgaaggggtattattataaaaaaaatacaaaggggtataatagttatttatcagtgactaaacctttttttcttgttttagtgttttcgatgaaatatgagtgatgctagtacaatgaatgatcgatgtagccgggaaaaaaataaataataaagttactcctaatcattatattattagtaaattactgattaacagttgtattatactacagtaaaaagcaccagagcat

SEQ ID NO: 54786 - DNA, 1232 bp, Oryza sativa
tctgaggtttctcgtcactttttgaatggtcttgacatgtctatttgggagatgaaaattacatcaattcaggagtctgttgatatgtctacttcgactttggattcactttacacaaaactgaaaacacatgagatgaatattctctctcgtaaaattgattctaagtcaagtgctgtggttccttcctcgacttctttggatgttggcgcttcttcatcgaagtcttctgtgcttgctttatttgatgccatgtccgatgagcaactcgaacagttcgaggaggaggacttggctcctgcatctaacacatttgctcaagctgtgaataatgtcacgttcaagaaaagaggtggaccgaatcgttgctttgaatgtggttctccggatcacctttgttcgcgttgtcccaagcttgggagaggcaagaaggaatacaatggtagagtcaaggaagatgacgtggacaagaagaacacgaaggagaagaagaagaattgcatgcagtggttaatccaagaactcatagcaacttttgatgaatcggaagataaagatgagagcaaaggtaagcaagttgttgatctagcttttattgctcgtaatgcaagttctgatgttgatgaatctgatgatgataatgaagaaaagcttagttatgatcgactagaatatgctgcttacaaatttgctaagaaacttcaaacatgttatattgtgcttgatgagaaggatcatactattgagattcttaatgttgaaattgctagattaaaatctttgattcctaatgatgataattgtcaatcttgtgaagttttattttctgaaattaatgctttgcgagatgtcaattctgttaattgcaagaaattggaatttgagattgaaaaatctaaaaagttggagtcttcttttgctcttggatttgctttacatgctcgtgttgttaatgtgatttggacaaagaacatgttgaaaaatacaaagttgctttttgtgcaagttctttggtcaatgcttcatgtgcaaataatgtaaaacaaaacaatgttgttttgatttctcaagattgttcaaagtgtgttttaaatgagttgaagttgaaagatgctttagagcatgttaaacacatggaagaaattgttaacaagatgaggtgttttcctgctcaacttgtagaaaacaaaaaggtcttttggatgcttgcaaaaattgtgctattcttactt

SEQ ID NO: 54787 - DNA, 746 bp, Oryza sativa
taacattctgcacgctatccggtaaccaagttggaggccaaatggctcgtttgttaacaaattaagcaaatgattcggtctttctaatagcgacgagactccttatgtgggaaaggacgatgatgctgtaattgtgcccccaaacgctatggcaatcaaagggggtaggggaatggaggcatgttccgaacaaatcattctccagggcctacgcaacaggcccggactccagatctcatcattcctggtcactcgcttcaataatgctggcagggcagcagcagctagggcacacacacgccacaccaggcaacagagacggtacccctggttgtatgctagtggctcccctcctgtccatggctttcattaaacgccatgtctccaagaagagcattgctaagaagcaacggcgcaatgcagtcatggctcaaatgagtattatcactctcgtgagtgactaatatgatttttatagtaatatatacgtgatgagaacatcggcgttgcctgttcactgtgcaggactgcatgaatttgcaagatcagtgcaaggaacctttttaactgacgatcgagcagctgacaatctgaacttgaactgtcgaactgaaccgatcagttaatgaacatagctgacagaacagaagcaagcattcaagtagatgcgttaaatgttttaattgtttctaggactatcatgttcatgaggttttaatgcaaagtaggagtacgtggtatagtag

SEQ ID NO: 54788 - DNA, 784 bp, Oryza sativa
tctcctctcaacacaagtgattgagattggagtcgatgttcctgatgcttccatgatggttgtcatgaatgctgagagatttggaatgtctcagctgcaccagttaaggggtcgggtagggcgtggcgaaaggaaatccagatgtgtgttcctatgctccactcctagcgcgctgccaaggttgaaggtgcttgagaagtcatccgatggattctacttggctaacgccgacctgctactgcgtggccctggtgatctactcggcaagaaacagtcagggcatcttccagagtttccaatagctagactggagattgatggcagtattctacaagaagctcatcttgctgcacttgtaagttcatttgctaaaccccaattcgtgttgctattaatgatcagacaactcttctatcactgtagtatataacttatttgttcatgtttttaaaagtagcttttttgtggcagaacgttttgggaacaagcaacgaccttgcacaatttccaggactaaaagttgagctcagcatgagacaaccgctgtgcattcttggagattgacctgtgatctttactgagcagacagtgcagtgagagtgtgacactgaacagcgttgtagtgctcattgggcaaagcttttgcattctggcttgtgcggtgcgtatgttctccgacaatacatggtggattgggcataccttgtttggagaagttctcacgatcgctgaggctacgttggctctggtatgagtggacaagcccggaaaaaaacatggatag

SEQ ID NO: 54789 - DNA, 733 bp, Oryza sativa
tttgtggagtgatatatcacatgttaatatatcatctcttttttttcaaattttttatatttatctaaatgacatgcaaacaataacctctcgaggaataaaaataattttccattgtaattcacgtagtgctgcttactccccgtaggatgaaagtgtgaaatggtgccacatgcaactcttccaatgactcgcttaccgtccaaaagtgaacgaaacgaacattgccaccacgtacgctattaaggctccaagtatgtgggtactgaaaagtcttctcactaaatctaccatatacagccaaaacactgtcaatactccctgcaaaagcatgcaaaaaatatccaattagaattgttctaaacagatggaaaggattgttgaattctactcctggcagtaggggctgtagaacggtaattagattcctggctaaatcaagctagatgaactagaacaatgagaacattccaaactgatcgtagatagggtatatcgggtgaaaagtattaaataaataaaaattcagggaaatgatcagatataacttttttgtaaattcataaaaaaattattagaaatagatatataggcatgaaatatattcttacaaaatcttaagttcggattcaattttctttaggggtaaaattttttttagggaaatatatatagaaacatgactattcatctaaaatttgtctttatcgttccactcaaagtaagttaagtt

SEQ ID NO: 54790 - DNA, 717 bp, Oryza sativa
atgaaccgatggattttgcagtgggtacatggcgccggagtacgcgatggagggcgtcttctcggtgaagtctgacgtgttcagcctcggcgttcttgtgctcgagatcctcagcggccaacgcaatggcgcaatgtaccttcagaataaccagcaaaccctgatccaagatgtaaaaaaaaaattcagaaactttttgcatcaaactctttctggtaaaaaaaaaagcagagtcttttttttttaacttgtttgtgttcatatgaacgtgtgcaggcatggaagctgtggaacgaggacaaggcggcggagttcatggacgcgtcgctcgccggcgactactcgaaggaggaggcgtggcggtgcttccacgtcgggctgctgtgcgtgcaggagagccccgagctccggccgaccatgtccaacgtggtgctcatgctcatcagcgaccagatgcagctgccggagcccgcgcagccgccgctgttcgcggcgcgggagatgaagaaggtctcggcgtcggagttctcgctggcgatgaagacggagaccaccaagacgcagtccgtcaacgacgtgtccatctccatgatcgagccacgataaaaaagaagaaagaaaaaaaaacgtcgttttttttcttctttttttatttctctctctctctctctcaaactgtgtttattacgagagttttgataagctagtggtgatgga

SEQ ID NO: 54791 - DNA, 2026 bp, Oryza sativa
  unsure (1)..(2026): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaatcatcatctcacataattcgcataatatttcaatgtctcttgatcatttttataatatcatatacttatatagttcatcctaactcctaacttagttaaaatgtgctctctctctctcattaaatcatatcacctcaattgtttttagcccttagatgattaatctatgatccaaactatctccctcattttcttctctcgtaaagccacatcaacttagggtctgttcagctgcagcaacactgcagcatgtaggaacagtgaagcaagcacaaaaaaaaaagcagcggccggccacgactggctacaggcagctgttgtacctgcaagccaaacatgcccttacttttcatttgaatcatcattctacatactatttgaatttgaattatcataaaccatatcaatttacgtaagtttatagtatctagctatcttacacattatttttactcagtgttatcatactaaactcccgcatcaacacacagggtccacctattataatgaaaacttgaaaattattgtagaatatgaaaatagatgtaaggcattatgagtgctcttaaacaaatctcaaatgttcatttttatattatatggtagttttcagatttacattaaatatttttctactcgcctaggaggctacagtgcgacacaagattttttttttttacgtcttgcaaggttggagtagtagtttaccgctcttctagtattttcctagcgaaaatggccaaatacctgaacctgataatgccacgaaaatggtccacgaggaacagatgaaatggcttgcctagttgcctgcctgctaggtcagtaccagcgaacagtggttatgcggcgactttatgcggccggatagcgttgcgaggagcaaataattcccccggaaaacgacggcgccaccacccaccccggccaacgccgccgtgaggagggatcgcgcatcgcgtcgcgcggcaaccgtcccgtctcgctctcgcgcgcccgtacgacaacgcgaaccacgttaattgaatgagccgctacctaactaacatttcacgcacaaaatcatctcgttaacaagaaaaatctggaataattaatcaggttgtcagaggaggcagtaggggatactagtcactgtcacaagtcgcaaaccaaaccatatgcgctgagttcactgccacaagcacacagaaatgcagagatcgccattttcacctaggctgtgtctagttcacgctgaagtttgaaaaattgattgaaattgaaacgatgtgattgaaaagttatgtgtgtatgaaaggtttgatgcgatggaaagttagaagtttagaaaaaaactttggaactaaacaggcccaatttatattttgtacaagtgcactcatgcgccatactggcacggcaattccaatggcgaaaggacaagatttttgacgggtaggcttgacatgtactactacaggctcgtgtcgtgcgggtgactcaacgcgacgcgacgcgggcacacgagccggcgcgcgccgcggcctcggcggtgtcacggccagaagcggcagcacactggcttgtcgtcgccggccgccttgccgttgccggcgtgccgcttcttgcccttccgcttcggcacggtcaccgtgagcaccccg

SEQ ID NO: 54792 - DNA, 5616 bp, Oryza sativa
ttcctgcagcccgtgttcgtcatcatttttatagatgcgagcacggtggcgcgcgagaatgatcgagaacgcgtgtacggacatttctttgcggtttttctccccgtctggttgcatccggatgcgggaagtgtttgcagactcgcagggaggagcgcgcgaacacgcgatttttctggtagtttctcgcgttttcttcagcgtgttcttcgcaggggaagaaaacgggttaggggaacacagcgatgcagagggatcaatagatccgtgttatcgacggctcagatgattccacgcaggcatgcagacggcaactctgtaggcatggaactgaaggaatttgtgctaattgggagatttgacagattattggtgctgatttattccgttttctgtaaatgacactgcaaaaatcttgctctttttacacattttgcaacaaagaaataacgaatattgccatacgatcagacccagtacgtctaaataagacttaacttaccgatttattataacagtttgggtctcttctgacagattttacacaactgctggtccgcactgctaccggatggtaacaatgaggttcctgtcgacgaacttggcgccaccaactttgccctgcatcgccggcggcagctttacgacgcgcctctggtcgccggcttctatcagtagttctgatccacctctatactgcatttttcagacaaaacaacagattgtcgaaaacagccaatagagatgagtagtactgagatgatgtgctcctttgaatcaagaaagagtactggtaactgccttacttgatatagtttgatttcagacttatcaaagcccggcatgaaaagggtcaccgatttctgaacagaatcaaaactaactgaagggtatactttgttgcttgtattcctcagtaaatcttttgcattttggctcaaagaattcagcactctgctccaatctgctgaagaatcagttggcagaaatggcagaaacgagaaagtcatcggcaaaaacttctctgcaactccttggtgaatttcgaaacgctgttcggtataaccaaatgctccacatatatttccaccagcttgagttgtacatccccagtatcgcaatgcagaagatacagagattgatcttctagggtccatgatgaggaagcatgcaaattttgagggatcggcaaaccaaaccgatattctctaaaagaaaaaaaaaagcagatttcagctaactagttgaacacatatctactaggttgctgcacaaaagaactaaatcgggaaaattaacctgaataagttgttcaatatcattccataactctgaactcagtcttccttcactagttttaccatttggccttgcagaatcgtatattagtctcatcgcggaaggagaagccagtcttcctatgtcagtcttttctgctagatccttcacatacctcaagtaagacctgtcttttgtgtagcaccagcattaagtttagagactatctcctgtgggaagctaaggtgaagttggagcaaggaaaacctataccttgctctctcagtagcaccaattagccgtagaatttcctctgtattgttgcaatcatacactaccacatcaaattcctcttgtgaactattcctttgagttgaaaagaagttaagcagcttctgaagagctaacactgaacagaccgagtccattccgggtaagactccaagctcctcccctacaacctatcccatgaaaaatcatcaatccaaatgactgctttatcctcatgtcccataatacagcaaagttaaattgcctaccgcctcaaggactccttgagtaagattgatctgcgagtccactttctttagccggtcaaggggttcaagcagcatctacaatgtaaccatacaacattcttcagcatcatgaatcagaatatcattccagtttatgatataactatagctaaaacatagaggatatcactttcaagatagtagtttactttactagtctccagcttcatggtggaaagattggcagcgcactcggtcagcgagttaccgatcttacaacccatcaattgctctgcggtgggatcttgggactgtatgaccaagcatgtcttcaagccttcacttgcataatactaaaacgtggaaaagaacaagttaaaggcaattctttcatgaaccaactaaccaggaattgatacaaccatcagaacatattcagtatttcggcaatatgaactcgccatttaattttacctaatgtcatgctacattgtactcggttcaattcatggagcatcccggctaatgatcgataaatgatactacaataaatctaagtaatgtacagcgagctcacaccaaactagtacaattttccatcaagataacgacgaacgcaatcgatggagagaaagttttcacctgagcggcgacggcggccgcggtggtcttcccggagccgcccttcccgaggaaagtcaccagcttgggaggagcaccggcaccggcggagcaggcgatgaccagacgccgccggccgcggcctccccggcggggagcggcgaggatttggctcgccgccgaggcgagcaaggagggagccatccacactctctcagtggctttcctcgcgatccgattgggattccggggtctccggccgcgcgtgtgggcgagccccctcggcctcccgctgcttcagccgtttataaagaaaagaaagtttcttttctttgggatagggcaaaaaccccacctctggactttggccacctctctcctcccccaattccaccactagccctcgtgtccccggcgcggcggcggcggcggcgatgcctgaccagcggccaaagcggccgtccgactcggtcgccgccgcctcgccggcggcgaagcgcgcccgcgacccgtccgcgccggcgttccccacctacagggacgcccccgacctgcccccgaagatccgtctcctatgcgagatcctggcgtcctcggcacccgacgtcgacgcggcgctcgacgacgccgacgtccgcgtcacctcctccgacgtcgagcaggtgctccggttctcctacgcccacccgcgcgccgccgtcgccttcttccgatgggcggggcaccggcacctccgccaccagcactccccctactcgtggaacctcgtcgtcgacctcctcggcaagaaccgcctgttcgagcccatgtgggacaccgtctcctccatgcggacccagggcctgctctccctggccaccttcgcctccgtgttctcctccctggcggccaacccggccagctccccactcagggcgttcgtggagctgccgatgtacggcatggaccgcgacacgccggcgctcaactccctcctctccgcgctctgccgcgcctcccgcctggacgacgcccgcgccgcgatccccgtggcgcgcgccgaggccggcacccgccccgacgccgactcctacgccatccttctggagggctgcgaggctgccggcgaccctcacgttgcacgcgaggtgttcgacgagatgcggcacgtcatcggattcgatcctgccaatgttcctgcctatgattctttcctcactacactgatttcaagtggttcctccacagcgttaatggatgcgatggactatcttgctatcttgcaccggcagaggtgctcacctggggagaagttcttccgcgccgcactggccgcacacctcaaggcgcgtgaattgcgcggcgcggtggtgctctggaacgactttgtcgtaaggcggggactcatcccagataaggaaatgtatagcacaatgatcatgctgcagggcactcttgggcatcctgaggtgattgttgagtaccttgatgagatgacctttgatggagtgtttccagatgcggacacatacaatatggttttccagttcttgctgaaggggaggaaactccgggaggcgtcggcaatatttagtgagatggtcaagaacgagttctggcccaatgaggcaaattgttcgctcgcgcttcgtatgttcttggatacacgagactgggattcagggatcaagttgtggaaatgcatggtggagaatgggcttccaccattggaggagagtgggaacatgctcgtatcaaagctaaaggatgagaggttacccgaggcatgtaaatatgcagaagacatgattgatcgatgtatcaagttgagctcttccacaatgtcaaagctgaagcaatgtctgatgaaggtttataaaggacatatccacgatcacctacttagaaaatggaaggcgcactaggtatttttacctcttctttgtggttaaatataacaggggaagaaaagctaacattttgcccccaagtagctgagtagcggttgatggtgattttctggttgcaactgcaactataggaacattatgcgcatagcatcagtaaaagttgcaaagcattggctcaaagctaggtgtacaatgtagtgacatatttggtaaggtagtttggtaaattaaacttgactctcctaatgtttttcttttgcatgcgtttcttgcgtagaaattccagtgttttctttgagttttgttctccctttcgacatgatgtggcgttgggaaatgaacatgacatcctggtgacaaggattttctttttggtttgtttgagaaagagagggatcctctcccatttctactaggtaaaatttgctctatgacacccagttttgtggcattggccttgtggttttctccatcggctgtaatagggaaacacactttcagctaactctatcaaatccaacttgagactgataaaagaagaacccatcttgaatctgacaaaaccatctccaccgtcatgcaaatggagctgagcacactccaaagttctctagtttctttccaactttccaggttctgataaatggtgacaaggaagtgtcataatttatcagtaagtaggaagtttactctatggttagattgccgtacattgtggcaagaaatgcacactcgtagtttcttctgggaacgacgtgtaccgactgaaggaagtgcaaagagaattcacattaaatattttgcaaatgatttcctgcatggttggcaagaagctactcacctgtagtagcatcgaagtgcttaattcattaccaaaagacagctaatacagaggctgacatttagtcttcactgtgacactgtatttgacagtgcgtactgctcagaatatgaaccgatatgacacgatatcagcttgaacaactttacaattgttgatctactcagcttattatgtcctgtggctacgaaatttgcaagaacctttcaacaaagtaaataataagcgacgatgagtcgatgatgaatggctgcatgtttgggtgcatcggcggagattgagcccccaaacaccccaaccaaaaaaacaggaccaaagtacccaaagaaaataaaatcaatgtggtaaatttttagttttacctacactatggtaaagaacaaatttatattatttgattatattagtttgaatcaaatgaagaaacgatttgattatattatttttattggtagtgggctgcaggaat

SEQ ID NO: 54793 - DNA, 4531 bp, Oryza sativa
attgaaaaaaaattgtctcgaacaacgctacttgaaattgatataataaaacaagaagaaaatacatatgtttttttagattatattgtacttgcatgttacttttgggaaaagagtgttatttgttttagtgttggctggagcgtaattgctattatggaaggaaacaccttaaagaaaaggtagttttcctttaattctacactaatcaagttaactagatgaataccctgccgcgttgctgcggggaattaagttacataatatgtacaaataggattcaatataattattaaaactaaaacaaattgatacttatgaattttgagtctaaaaataattaagattgcatggtgttatgagagaagaaagaagagacaatttgaaccatagatctatcatcaaaaggctagaaataattgggacgatgtggcttaatgggagaagagagaaatagcattaactacatttagtggggatgaactatgtaagtataggattaggtgcgatgagtgccttaattgatctcattcgcacaagaagaatgactataaatttgccaaatcctcgtgtaagttgtcaaatgggccatgtattttcgtgttggcccgggcatgtatgtaacaatctattctcaaaatcacatcaacaaatatttaacaaatatttaggaacgagcttacctgtaaatttaattgtcaggcgcgagctctaacgattggaccttgcatagtaacttgagaagtattgtgtgtatccaaatgagtatgattcccgacggggaatttaactatttggtgcttttacggaccgtcactcgtgatatgccattcttctagataaacttacaaaatgcctagttattaaacagaatcggtccgctcgtttaaccagaaaaaaaaatcaaaaccaatgcctagttcaatgatataattgacccgcgaaaaattggttaaactagacaattttctacataaccgaatgaaaaccgggatggtcagaccggcaagcactttttactgaaaaacatgaagagacgcttggccgccgtttgcccgtaggaggggtaaatagttaaatttccctttcggaccctcgtcactcatcgtcgtttgcccggcgccgcccggccgccgccgatccccatccattccgctagcgagcaggggcgccgtcgttcgtcctgctgcttccgccgcatccatccctggtgagcacatcctccgccaccgccgcctgcgccgatccccatccatcccgcgagcgagcaggggcgcccctcgttcgtcccgctgcttccgccgcatccgttgcgcacatcctctttcccatatctctctctacccacgcacttttttctttatcgaatttgcgttaaccctagcttctgttctggaaatttgccttaaccttgatactgataacagtttgtttgttcccaaaaagtttcccatgttagacccgcccatggaccggttctagcgttggtatggagagcttccgtgatgatcagcgcgctggtcctcaatccgagcaacactctgatcatgtgtctgattctgctgaggatgcaatatctgatgaggtgctgcatctgctgatgttgctacagcatgtgaaatgtgatatgttatgctgctgtacctttttttttcgcccgcaaatttcattaacaccacttcaggttggcaggacatgcacttatgtcttcaatgaaattagagagattccaaatttctttttttttctcttggcaccagaccactttataagatgtacaacaagaagtttgttttatttttggtcttttttctaacaaatgtatttggcatctattaacaaaagtttgttttaactactaatagtgtatttccacttgtagcagtggcgtatgagtgcttgctgaacatgtgcctttatatattaacaggatgttcttgcaccaacaagactgtcattagcttgtgctgcttcaaaagaaagagagaaggaaaacaaaatggtggtgccagatgaatcaaccatctgggatgaagttctggaagaagccgatgagctagcctatgtgcacaaagttcctcctagtatatcattcctatctgctggaacaggcaaaagtacgttgccataaatcctatttatctactgcatagatatgtatattcttgtttgccttacggataaaggaggaattcggttttaggagctttcgtacataacaatttctgtttttttacactgtgagttgtttatcgtttcttcattgatacagggagaaaaggtgaacacaggctcaaattctcaatacgtggatccagttctgtttcactgaatgtgaagactgaaaacccatacattggggagcaagaagtttcatcagtaatgccaacaaacagagctcctgaaaccatgatggctgagcagttggaaaatatcaaggaggaaactgaagatttgccctcagagtttgcttgttcaaccaagaaagcaaatgtttcaatttctgaacttcttgacagtttacaggatagaagtgcctcctctgctgggacaccatttttggttagtgtttagttgcgctattttgttatttggagttcttagacaacgattagcttgtctctaaatattatctcaacgcagttgcatcaacacaccagacctaaggaagaaaagccaaaggtccctacttctgtgaagagaacacttgcacttctaggtcagaggaatcttgagaccgagaatcccttggagcatgtaattggtgaaacatctagcgaggaggaagtaggttgttaacataaccaatgatataaatacttactctattatgatcttcaaaatgatatgtttatcctgcaataggacgatgctcaaaacaacctggctttgatcaacaaagatgtcaaggggcaaactatggctgacatatttcaacaagtatttaatgcaacaagcatggactgttttacactgcccgtgagatcatatgggtataaccgtcctgataattatcttccgaatgatcacttaaatatctctggttgttcacatttatttgttttatgtatctctgtggcagatctggttattatggaaggatgcaacaaattctgcagatggagaaagataggcatgctgagttcctaagacagtataacagagagcaagattatttaggtgcgccttaatcatctgtagctctgtactaccacgtacatgttcataaataagcttcactagtgcatatacacattgctgaagtagctactcgttgtatttccaggcgatccaaagggggttacagttcagattttgtcaaggtctctggaaggaaagctaacaatctgccgctgcttgttcatggagaagagcaatgtatgtggttcatctctcaaaaagaactgtttggtttttgttcattttgaccaattgtgaagcactcaaatcctgcattaccagcattttgtgctactgatgtttccatggtacttgtgtttcagttggccacaacaggggaagtgtcaacagatcttgacatggataatagcagcgtgaaaaggaccatcatcttcagtcccaagatatgtgacaacgtggatcttctagcaggaaacattattcacatcttcccaccatggtttgctttttataatctgtttctgcatttatttttgccgatttctggttgagaaactaacaactgcgctacctcaacaggaaagaagttaaggtgaaagaagagacggtgattctttgcacctacttctcgcatcgtggagtttgatactacttgagatgcttcttttttagatgaatttatcatgagtaagaggaagcaacgattatgcatgaccgtgtcctgtgtatgttggcgctcccgagtcccgagtcactgcacgacctgctgacctgatagtttagaagttagaaccctcctgatgaccacatgatgtagccgagtttgtacacagcgtactttgacacaaccagtatataatgctaatacatcattgccttttttattctggaggagaatgttttttttttaacacaaccagcagcattgccttctttttttggagggagaatgattttcttttctgaggtatactctctgtattcaaatatatgaccgctgttgactttatttggttagatttttaatactttcaaattcaatagtacctttcaaggtatttagtttggaaacgtgaaaatcatatgggtggatttttctttataagtacttataccatataatagaatagattagatattatttttacaattgttgtaaaaattgcatgccaaaaaataactaaattcaccggtgtcacgtatttaaacacaatatataatgatagacatgacgcaaaccagcacacattcaactggaagctctcaaaaacaacagaaatgataagactgctaatcgatgtaaaatttctatagctcagcaatatcaaacaaattagttcgatacaaacaatgcaactacaaagtcgtgaagtcgaagcctttgaggcat

SEQ ID NO: 54794 - DNA, 1925 bp, Oryza sativa
ttccgtggattcagcttctttggattcagattccgaagagtcagttttctctttgttagcagactcttcttccttgggaggtttcttttctatcttgggttttggtttaggtatcctattgacactagaaacctgcagacaaagatgaatccccaatgttttgagagcggtgaaacatgtgcatattattctagaatcttaatatgaacttcctaaccttatcttgtaggtccagaactttttcgtagacttcttcagatgtgaaagcaggtggactgtagacaggggtgctgcaatatgataaatgggagttagacacatatacacatttaaatgtagaactcgcgaaattgtgttggctctagactcagcataccttttctgtatggcttccttctcctccaaccaagtttttactttctctgcttcacttacaacctagacccagatagcatcacaaccaataaaatgagaatcacatcataaccagaatgaatttatcgaacttcattaagctcactggtttacctcatctaccctcttttttggaagccacggtttgttcgagtcccagttcttaacaatctgcaagaccagaaagtgttacagatgagaatagagtagcacaacaatcatgaagttgagcagcaacaaaaacattgtttggtcttctgtatagataccttttgcaactcagcaagatacaatctagcattttcacaagccgttggccgggcttttagctcactcaatctgggcaataaagaaaaaaaaaatcaatgtcagtcaatgacctatatgaacctaagtggatacagagcaagttacctgaaaagaattgggtcaccgatggccttaagttggtcaaggcgttccttgaattcatttgcttgagcatcttcaccatccatatacaaccaatcttgtacctgcacttaaacaatctcagcatgaggattcaacagacaaatgaaacccaccagaagattattattgaacagacctcattaagtttctctgcaaaagattccctctcctgttcagttgagacggtcaaaatttctgtgttctcttccagctgtgatgtgccaaataacagaaaacaagtagtcaacaaacataagtatagcacctagtaaataataactgtgctaaacgttatgaaacttttctgtgtttttctagatttatgtagacaatggagttcctattatcagtgcaaagctgaagttctgaggaatataataccctcaaagatttcagatatatcaagaaacaagaggggtcatgtgaatggcagtaacatgttttatgctattaacactgaaggtagaagagaacagaaggtaccttctccttcatagagtatatgtaagactccaggttatttttcagttcagcagttctcctcctttcagcatccttcttatcaagcgcctctaacctagtttttgcttcagaatacaactccttcgaaagaattgatccagcaccagccatcttttccacaacctgccattggacaacatatttattaagtcatgttctgtcaatattaacaccagatttatgaccttctatctttacctttaacgggaccctgaatgttcttttcttgagcaccttctctgtaacaatatcttgtgcattactctcatctattggagcactggacttatttgcatccccatcagaactcacattctccttactgtcagatgtgtcattagctgctcctccttccgaagacaaagtctgactggtggaattactctctagagttaaattcttctttggaacttcaacccattcagttatctcaatcactgcttctgccctatcaagagaaataattccgctcctactcaaagaaaaatgtagatttgccttgatgggtgcagataaattgcggctactgtacctgt

SEQ ID NO: 54795 - DNA, 10667 bp, Oryza sativa
tttgaaataaccacatggttaaatcatgcagtgaaattaaacacatacaaattgccaatggcaatggtgttgagatattatttagaaatagaataaacatatgtactgcagcctcgaagatggaatgttccgcccccaaaaaaatagcagttgaaataaaggtactctatgttcagcttgttataagcagtaccatgacacaaaaaaagtacataagatgatatgcattatgcatgcttacttttcgcttgcatctgtcaggcctgatacagaatactccacaaatttgtgtgatgtaacacctggaggcagttcagaagctttttcatagctgatagaaacatcgaagtctttagtatgtctaatggacctgaacatctgtagacaacaaaacaattgcaagctagattattttttaaaaaaaacttttttttttgcatataatcaaaaggaaacaagaaaggtgcattataaccttaattcccaattttttcatccttggcaccagtaattgatcagtgctttcatctttgacataatctgggccatttatttcaaacacaaaaccataagtagaaccatcaatcatccctaacttacggttcaacttaattccatcacttaagttagctgcatgcagtgaggcacccagaacaattgcttcatctgcatcaagatgcttatccaggtcacttcttcccaggaattcctgcagcttagcctgtaccaggagaatggaattttattacaaaaataacaaggtgaatgatggaagcacaactgtttcagaagtacagttaagtcatctgcatagtaggttaccgtggttaacaaatgcctttgagatatgatagcaaatttttaagatgttaactaaaagtaatggattgtattaaacttatgatgagaatcaagtgacaagagagaaataaaaacatggcagtcatgtgcctgaatgccattagagccccacaatacaaggtcaaacataaaaacgagttcagtttaatcacctgcaattttggtactcgagtagctcctcctattaattctacagcatagatatcatcaatcttcattccagaatgtgcaagcacttctttaactggagttagagcctgctcccataattcttcacaaagttcttcaaatttttcacgtgtaatggtactcctgtaacaagaagcgaccattaattcaacaagtagaacctagaaaattgtcctgactcctgatcatgatttaaaactagaaaaagtttactttgtacagaaagaaatcaagaaaagatgaaaggaaggcagaacatcaaccattatagaacaatacagtaaggaagaagggtcgactatgcttgcaaagtattaatattggcaactactgtatagattaagaagccagtgtgtttcactatcttccaggttccgatgttccgtgcaatcaatggatatgcaaagtattaatattggtacctactgtatagattaagaagccagtgtgtttcactatcttccaggttccgatgttctgtacaatcaatggatatgcaaagtattaatattggcaactactgtatagattaagaagccagtgtgtttcactatcttccaggttccgacgttccgtacaatcaatggatatgcaacaaaggccaatgcagaacatcaatggagtagctacacttcaggccacagtaaacaacctttgtagctcttaacgaatttgttctaatggaattgcattcatgtaattcaaagataacaaggtgattgatttaattgaaacaccggtcaggtcattttagcagataagagacaaagcaccagccacctagcatgcatgctactccagcatagtaagttgctatgcaagaatttgccaggctgacaagcatctctaattttcaacaaagtttcaattgttcataaccaattaaactcgagagcgttatcttgaaggcttgaacagagaatccaaaaatgttaagtaaatttccatttatgaatttataaatatcggtccatattacatgtgtgaagattatgcaagtggtgaggacgcacctgaaatcgagatcattatatagtgattcaactgaaattggagcagcagtatttgcactcagaatttctttggtacgcttaacttgcttcttcaacttagccatcgccttgggagactggcggatatcaactccattaccgagttgtttattaaattgatcagcaaaatagtttaccaggcgcatttccatttcaaggcctccaagtttggagtcccatctaacatccttaacctgtagataattagctgaagaaattagtaatagattctggcattctgtatctctgtaatgtaggcatttagcaagctcaatttttcatatatttgtcagatcttccatcgcttaggcatgtgaaagatgatgtaaaaaaaggggttttcagtggacttttgagtaagcatacgacggacaaaattgaacaactaaaagaccttgggcaagatcgaattgtacctggaactggttcaccgataccgtcttcccaaactccttggccttgtaagctgagtagtacaccagcgcggcgtaggtactacctgcgcccatgtcatagaagataacatgcctcgactcgttcgagaaatccttgtcgatcccgtactgcaacgctgccccggcgtgctcattgatgagcgcgaggacgttaactccggcaagctgcgccgcctgcgtcaaggcccggcgttcggcctgcccaaagtagggcggaacggcgacgacggcgtcacgcacaggagcgccgacgtgcgcatccgcgagcccagcggcgtagtggagcaccatcgcgacgatctcctcgacggtgtagacctgcccgtcgtccgcgcggaccgcggcggcgccgcgcgcgtcggggacgaggtcgtaggggaggaagagcgcctccgcgacggaccgcacgtaggggaagggcttcgcgaggaggtcccgcgcgcgggcgaacaccttggacgggtggcgcgcggtgatgccggacgcctcctcgccggcgagccggttgccgtcggcgagcgcggcgagcgccggggacttgcgcttcgacatctcgttgatggccaccgcgatcgggacgcgtccgggggcgaggtgcacggcggccaccttgagccactccgaccccaggtcgatgctcgccaccgccgcctccgccggcgggacgaggacgacggcggcggccgcgacgaccgcggcgaggaggaggaggagacccgatgtgcggggcggcgccatgacgagcggcggctagtagaatggcatgcggggtgggggggttagggtttggagatctgggactagtgtggcggatgcagcacacacggtggaaggggagaggagagagcagcgaaggaggggagggggagaacgatctcgacggggaggaggaggaggagaagggcgtgtgctatatttgcaatttttgtgattgtttttcttgcgttcggagttttttcgattatgaccctgaaaggttttttctgatttcgagttgtgcgttgctgctgaaggtgctttggattcttggtgaatatgtagaaaaaattgagggctcatgtgaaaaaggtgagaagaagaccgtggcaggaacgtcacgaattgagtcaccagtccaatgaaaatacgacacgtggaaaaagatccacatggcacgccttggctagcgtggtgcgctggaagagcgagaggagcgtgtgctagaccgcacgtggaagtctcgtgcggcgactaccgagtttatcgagcgtcacgtcacatcaaacatgccagtaccgtcatggcgggaagcttgtacagtaaaaacgtaggagtagtgctagtgtgtttgtgcagtttaaactgtgccatgataaataaggaaatcattcaaattggcgaaagcatttttgggatgataatgaaattatgttactgatttttttttcatctatcactggtcaggtattgctaaaaaaagtgtttgataaaatactactagtagtaacttgcaatcttgccagcatctgaaaaaggattgttcacctgcaccgcacaagccagaatgcaaaagctttgcccaatgagcactacaacgctgttcagtgtcacactctcactgcactgtctgctcagtaaagatcacaggtcaatctccaagaatgcacagcggttgtctcatgctgagctcaacttttagtcctggaaattgtgcaaggtcgttgcttgttcccaaaacgttctgccacaaaaaagctacttttaaaaacatgaacaaataagttatatactacagtgatagaagagttgtctgatcattaatagcaacacgaattggggtttagcaaatgaacttacaagtgcagcaagatgagcttcttgtagaatactgccatcaatctccagtctagctattggaaactctggaagatgccctgactgtttcttgccgagtagatcaccagggccacgcagtagcaggtcggcgttagccaagtagaatccatcggatgacttctcaagcaccttcaaccttggcagcgcgctaggagtggagcataggaacacacatctggatttcctttcgccacgccctacccgaccccttaactggtgcagctgagacattccaaatctctcagcattcatgacaaccatcatggaagcatcaggaacatcgactccaatctcaatcacttgtgttgagaggagaatacgtgtttccccggatctaaaactgctgagggctccatccttctcatcgctcctcatgcgaccgtgcaacagcccacagggataaccttcaaatttttgctttatggaatcaaactcggcttttgctgcatgaagttgtggtagctgctctgattcttctatgataggatatacgaggtagaccttgcctccatcaaccagttcatcactcatcatcttcaagccataagtatttaaaaatgataagcaaattgatcccaaccatatccaagtgcagattgggacagaaaaggaaaacaacaaagatctgaaacaaaaagaaaaaatattgaatgaagtcatgtcatcacctggaagacagattcaaaaccagcatcatttccttcaagagcaagagtttctataggttgtcttcctggaggcaagtccgtgatctataagaaacgtggatcacaattgtaaagatttgaaatagctgtgaaaaatgaaagaccctactagttgttaaagtaacaggtcctggaacatgaaaaatgaaaaatgcaagaacatttttgcactatatcctatccaatatgtgaagtcataaagtagcggatcctggaaaacaacagggtggactactagttgttaaagatataattgtgctagcctagaattagtccctcgatgtatgtagttttcaccctgtgccccacatagtacgcgatatgacattttacttccaatgagtaagtatttggaatactcaatttaggctatgttcttttcttcaactcaaaacttcaacttcctcgttttctgttagcatgttttttaaactattaaatgctgtgtttttataaaagttttctatataggagttgtttaaaaaatcaaagaaaaccatttttcaagtttataatagttaaaacttaattaatcatgtactaatgagctttctcgtttggcgtgtgcagaaaatcaactaccaaacagaagaaacgaacgaagccttatatgccataagcctgtaaaatacctgtgtaagggacatgtccccatacagagcaagagccaacgttcttgggattggagtagcggacatagcaagaacatggggagccataaatatttcagaagcggaattctcgtctgagattgtatcatcatcactcgatttcgtggaaggggtatatagctgtaatgaatggcagtaatttgtattaacaaacaaatgttaactatgttaaatttgaaaccaaaataagaaagacatgaattatgcaacgaggtttggatatcaaatactcaagtgtaagtaccagatacattatcttttgttttggacaattaggcagccttgagaactacagcacactccttgaaggctttcaccatagcattttatataatcactagcatattacccattgaattgggatttttattaaataaaattatcattaacccgttattaccatcattttctgcaatgatatgctagctattgtaataacagcaagaatagcaaattgtaatgatgggtcattttctgcagtgatatgctagtttgtaagaacagaaagaagaaaaaagtcagtaggaacgctctggcccatcttaccacaaaataagatacacgaacatggaaatccagaggcatacttcttactccctaagccccaaaatataagcacttctagagtttttcatggagattaaggagagaggtgaaattaaatgagagatggttaggattggttttgatgaggaagtaggtggggaaattaaatgagagatggttgtgattggttcagatgatgaagtacatggagaagttgctatgttttgggacaaattttgaacgctaaaagctgctatgttttaggatggaaggagtagtaattagcaattttctttctaagtttgccaacaaagtttacagaatgggtgacaatcctggagcaaagtaagtaaacgaaggatgtgtgtgattttattcaacaacaaggtttacagaatgagtgacaatgcaggagcaaagtaacagtcaaaaagtccccgcaaaaaaagtaacagtcaaaaaggacgtgtatggtttttattcaatgtaaatagcaaatgctcagcaaattaccttactattaaaccttcctctttgaacaacaccaaagcgctgctgctcatctataacagagatgcgcaaagctgagaattcggttttatcaccaattaagctgtgtgttccaatgaccattgctatttctcctgtcttgagaccctgccatagaataacaataacacataaatatatgaatctatgcgtatgggaacttgagagtctagaaagaatgcttgcatttcgaataatccttgattccctcgtggaagttgaaccagttagtaaagcaatgtttggtttgcattcatctccatcaaacttctccagcaatgaagttagatgttcataatgctggagggcaagaacctccgttggaaccatgaaagcagcctagaaataattttacaaggtatatgttagactaacatctcattaatgaagaactgaagagtacaactaggaggaagataatcatttttcgtgtatatcctatttggattaagcatctagtttgcttcagtaagctgtccttttagttgataaaatccttttatatacagtacataaggcaaggatgttggtttgtagtatagatacctgaaatcctgagctaatgacctccatgcatgcaaggaaagcaactacggttttaccacaaccaacatcaccctgtcaaagaaagaaggctttcaagtcttcagcaagatgcatataagccccaatagttgttatttgaagaacaccaattatatataaaaaggaaaacagaatcattaattcactatgtaataccacagccagaacctgtaacttggtacttaagattttcttcccccatatgaggtatacccccatgttccatttccccaagaaaaatggaatgctacatccagtcaattgcaagtttcttgtccacgaacttggtgcttaagaatggtagaaaatagtttggttcaaatatttttgcttaagatcgaaacatttgaaataaactggccaaaataaaacaacgcaatagtagaccagtgatattagagccaagatatactagagttgattacagaggagcatcaagcaactgactggtaaacaagtccagactccagaaacaagagcaagaaagttaatgaaccaagaaatgtgcaattaatagttacttgcaagagtctgttcataggaactggtcttctgagatcccatataatctctttaacagcattcaattgactaggagtaagcaaataaggaagaacttttaacaatttccttgcaagaggagaccactcgtcagcaccaacagcatttagctcatgatttttgcacttcaataacaattcttccttctcaacccgtgtaccaacagcttcaagcatttgaaacagtcttcccaactgaaaaacgatgataaatgtttccatcattgcatatgcttaattgcacacttaaaaacaagatgcgataatatgaacttgaaggacatgacatttgcgcaaatcgatatccatgtttaagcaaaacaaaaatattgcttgctgacaagcatataaatgataacaaaaataatacccaggaaatgcactcctgtatagatgccatcaccgttggagttgtactttgaagattgctaaaaatgctgaaacccccaccccactgccacacatgcgagtgcccgcccatccattcaccccccccccacacacccacacacacccacacacaacaaaattaaatacacagcactgaaaaggaagaccatctgaagggagaggggtggtgatatatactgttactgactcatatgactgtgctacttctactgttatgtcaagaaagaaatatatggtaatacctgaagataaaagaaatcatcgaaaataagccttctccgagcaaaatcggcttcatctcgattcttaggcttgtggattcccatgtaagcctaacaaccaaaacgaatattgaggacagcatttaggagggcatacagatcacatgatgatgacatcatataacagaaattcaaacagatagaatgaagctatatcttgtaatagtcaacaaagagtacatgaacatgttggcacgtatatccagtgattttaatatattagcacacacgtgtgattaccacacagatatccaatagcaagaagaaaaaatccgacagtccatccatctctaggttccacttgtatgagtagcatttagtaagggaactataattagatggtttgctcacatcaaagagattgggcaagttgaattcacaagaacttcatgaggcatagggtcaatgtctggcgtcagcatcttcaaggccctgtgcacaattgtaaactattattactcctacatattcagatggaaaataataatatcgaactacatgcatttcatattaagttaaggtgatttactctttatcctttgggctttgcagtcatcccttaagtatcatcataatttaaattacttaggtacaatttagctgaatcatattttaggaatggggaatcggcatctttcaactatgatcactttaaaatagctgtgaacttagaggaacatcacttagggcccaccgactcagctttcatttagaaactagaaaagcacacaagctttgcactgaccttgagatggagaggctcagcaaacttggtttcaatcctgcttttgatgggtatataggatatggtttcctgtcaagcagggtgcattgttgttcctcttcttcaagcatgtcaatagtgtactctctcaaatcataatggtctttagtaagcgccttcttgatctgtgcaaacaaaatcagctaagcttaataatcacatataggctgtgaggctacaaagtgcagtccattacatgcataagtgaaaacatctgtatagcagagctacttttatgtcattgtaaagcaaatgtgcggctgcaccaacacaaattttaggattacaattattttgtagtgaagcatcaccaacaaataaagacaaattgaaaggtctgacaagcagcatgtaacaggaaaaggtatgttagttcaccaaccttaccgctgacataagcaagatccccctctttgtacttcgatgatatacacttaagaaaagatggagaagagaagcgtgtgccgctgaaaaatttcttgaggtgcaaatgaattgtcttcttttgttctgcttgagagttacaactcttaactgaagagcttaactcactctcgattattgaacaactaacaacaacctcaaggtaacctaaagtgtgcttaagtctggctcccctgagaaaacaaacgataattattgtttagagtacaggtttttggcgtatgaaaatgacctagccaagtttgttatacgaaaatttttcataatatacatttatgtaactacatttgggtttatgcaaaagaattaagtggtcaaagttacatcttactgactttgaaaattccaatatggcaatcttttgtgactggagggagtaccatttcaattggactcatagtgcttaattatgtttttcagtaatcagtctttctttgcagggaataatcagccaatctatgaattgaatatttttaactaataattttgaacctaaccatttcgctcacacacatgaacataacttttctatgtgttcacaacatccacagtaaaacgtccttttaatagcatcgaaaattgtaccacaatatactgaatgccaccacatgagcaagatcaaagaaatgggggaaacttttacaaacatgctataacacaagcactgtcatatcacagcagtcaagagagtgaaaag

SEQ ID NO: 54796 - DNA, 4764 bp, Oryza sativa
aactaacaaatgtcaccaaattttctaaaaaatatatatacatgtacctccaatagtatttcatatacctgtaaagtataaagttcaaattcattatattctagccataacgaaaagaaaagaaaaatctgatagttttaagagtatatatctgtcagaattttgtcttttatgttacggctaaaatatattgaatttgaagatgagactttgcatataggtgtaatactattggaagtacgtgcacatttttttccagaagttttggtgacatttgttagttggtgtgcacggcgcagtatacataggatatgttcccttggactggagcaagactaattgaaatattaacttatactccccaaatgatcccagcaggggcatcggtcacatgaatatttagaaataataataagatcatcttaaaagatccatgattttaacagaatcttcttgtcccccagcagactcaaatttactctataaactcatttctgactaattcccctacaaactccagaaattgtagtaatggtaggtcttcatttaaattttacagggttaagagaattgactatataaatacccattccactcctccaaactatactgcccttctgtacaaatttcatggattattatgaccaaacgttgagtgtggccctagtgtcattgtgataggatggcacatcccatatcaattcttctttattatcggattaagaattttactcaacaagaatgatctgatattaaataccactaacaatccgagggcatcaattcaaataaggaaatgatatccttcacatgccaaaagatttttatggaaagactaagctcgggagatgccacataattaacatatggcaagtttaatgccgaagaagaagacagtggaaaacatcatatttctgattattcaattacctggaagatacaacggttccaaacagcatgatgtactgcccctcttctattgaaccttgaggattttgtagatctgcataggtccggggaaaatgctgcaacaatttccgtacctgcagagaagaaatatattgcatgctaagaattctatcaaatcaaaagaaaaaaaaaatactgaagcgtatctgctgctagtaccgtatggaaaccaccatcctctagctggcgatattgcctactagttgttccgggaaaacatcttatacttctgtccaagatgctagaatcagaaactgtagcatctgccactgccaatgactctgacaagcatcggtatcaactgccggttcaagagaaacaaactgtgctgtgagagaactctcttcactgattgataggtgatcgacgtttgtaagggttggatctaatggatggcatttgtcagaaaactcataagctgccccaaaatttccaccggactctcgcatgaaattcgtgaggttttcagaaagcacagtttctttctgactcatgctagcagcagcagcatatagttcaataggtgatgaatcaccaatttttatgcatggaaactttgcacacatttctgggaactcaatttctttgcatacactgatcaattctgtagcagatcctctgcgggctctttcttgctcaattaattcttgtgtattactataacccatcaaaacagacacctgcaatcataaataatccagacaatgttcactgttcacagcaagtacagatgaatagttgtgtgacattattagtgaagagtggcatcaagcagagagccgtgcaaatcaaatccagacgtcattaagtagagctattgcataggcttaaactataaaggtcataacatcaaggaagttaatgtacaagtatatgcgcattgtatttaaacaaggttactatgcactagtttgaactcacaacaataattagaggacttgggaaatataaatagctttcacttggtagagcccaaatggtggaacgattgaacagatgaaacatacagaactaaactcattactgatgcctgcaaaatcgaaggctaacactaacaagtgaacacaaccagttgctggcagggcacatactttgttcaggagttttgatctctctgacgtgccatccacctccaacagcttcctgacggacgtgtgattctcgcgcgaacaccaccggaagagcttagagccaagagcattgctagacctgcaacctgaacagttcagtgctagttgctaactcgctattctagccacaagcacaaattgcccacaaggggaggggaacctaacaaaatcaatacctcattctggaaggaatccttctagagcgccctctgcgaaaatccaaagaaaacaccctcgctaattgattggtgtgaccctgaagaagtgaagcgacctcatttcagataaggaagggggatagtatgtgaagagaaacgacatacgcccataccttaatccatgattgcgctgaggaggaggcgatcatgggtgcggccagcgaggagagaaccttcccgattcgccgcagcgctcagttcatccaccgcggagacgaacaccatcaaacaccaccagagcacgagcaggtgcccaacactaatggagcgctccgggttaccaatggaaggcggcggcgaaggggcgggagtgggagggaggcggggtagaggcaaggcagcgggagagagagagagagagagacgaagcgcgagaacctaacgtggagcggggacacgcgagagcctcgccggaccgcgcgcgccttccggggacggcagcggcggaggtgaggtcgtctttcccccctctcgtggaggcgagtggagtggaggccctcaccggcggcgcgggcggtgcagtgccgtcgccgtcgccggaaaaggggacggaggccgtacgtggtgggggtttgggtaggggacaagaggggagcgcagaagagtcggagacgatggaatggagtttccgcaagttgggctggctcctgctggcccaggataaggtggtcgagttccggttaggcccataggaatccaggcccattcatagatggattggttgcgacccaaagaggcccacaaaaatttgttgagaaaatccaaaaaaaatatcgggcctgttcagattgtagccaaaataaacattacctaattttggtataattttggcatgatttcttatgtatttagcaaatttggcaacaaactaaacatagacatttttttggcaatttttttaaaaaaatgatatggttaaaaatggcaacaaagtgaacaggcccatcattgacaaacttctaattgcaagaaatataatcgacatgtgctagttccatgaaatgtcatcgtacaagtgactttatcttagaaataccattatctgtatggtttcattagcaaacctccattaagtgctataggatgaattgtgcattaaacgggatggaattgatggaaccctagcaaagaaggtatttctaagaaatgtcacttgcacgatgttattttgtgaaattcgcactactcgatgacattttttagatttggatatttgccagtggcattatttttgtttttgtcatatttgattggttgcagccctacattcaagttgggcatccgattttggatgcaatatatcgaatttggatttttctggcaacctggttgctgaatcatgacagccattgtgtcttcagactttcaaactcgattcaaatagattgtttcttgtggatttcgaatagacagtatattggctaaagtttacactgacttgtggatttcgaatagacagtatattggctaaagtttacactgagtaaaacggactgatttttgtgctgttgatcgattctgattctgcaatgtgccacagaacagaagttctgacgatactgttatatagatccaagtgaccgggctacaggatagaccatttgacaaaaaaataaatccaatcacaagtgctacagggcgtaggcaacaacaccgaacaacgcgacaagcagcagcaacacgtagaggcgtgacacggccggcgggccgccggcgtcgctgaacctcgcgtactcggccgcgagcggcatgtcgtcgacggggagcgagcacgccgccggcccatccgccgccgccgcgacgcccgcggcggacgcctcgtcggcggccatcagcgcctggatcacggcggtggccgccgcgccgtaccgcgtggcgttccgctgcagcagccacatgatccccatcagctggcactctcgttcgcccgtcacgccggcgccgccctgctgctgcttcttcttcgccgccgctgccgccgccgcggcggcgccgccagagccggcctttatctgcggcatcaccaggctcgcgtcagacagaatgaacagtaatggcatttactagttccgtggtactgttaacccacaattaatggacaccaaccggacgaagtaaaacaacaaaaaaaaattactacagtaaaatttaccttacgctacagacattcttgaagtcatgaacacagaattatgacaagtgacagcccgagcctgagctctctgctttctactgttggcacacatggccttctacgtgccatgcatgttacgacgcattaagatctttggaagaacctatcagtaccaatccatatagagcactgccccaaacaaaaaaaaaagacaaattttgtacgtacactagtaacactactataccattttagatgatatagtatacgctagtagagttctagtggagtatcactactatactaagggggt

SEQ ID NO: 54797 - DNA, 3148 bp, Oryza sativa
acggggacggggtcagcgggcacgtcgacgacgtcccagacgcggcgtccgactgctccgggaacgccgggatcgtggcgctccctggctgcgccggggtcgccgaggggaagatcagcgccgggtcgagcggcgccgggtccggcaatgccgccgccgtggagcacggcgcgaggcgggacgccgcggccacgtagaggcagaggaggaggagacggcggcgaagcggaggcatcgtctctctctcgtctcgcgtctcgcgcgcgcgcgcgtgcgtgcgtgcgtcgtgcgcggcgggcgcacgcgcgtggtggtttttctggttggatggattgagagagtgagagtgggagtgggcgagtgaagtgaaagcgtggagagtgaatgagtgatcggctatatgcctatatggacgaaatgatgagagaaagctttgtgctttgctggtctagagccaaagaacgcatgattagattggttcttgtataatgttcttccagagagcaaaaccagccgcagccttttgcaaagggagctcctttcatctgtggatcatttttatcgttttacagagagagctatcttctttctttctaccttgtcaaactttgtggggctgtgcattttcgagtgttgtttcagggaagctgcggaaggcgggttaaagtgacctcgctactcaattcagcttaaaaccagcagctttgttgtaatcctgtgtttgctttcagttcatttgctatccacttcaatgttcaaattaaccgtctgatcgagtgctactctagctagtatggcgtatagcacattgccactcgatgtttgctcatgcgtgaaggctgaaggcatcacatacgccctccttgtgtcacggtcatggctagtgttttgtttatgtgagacagagcagcatctcgcagcctacgtatagcctttgcagctgaggtaatactactactcgtatgctgccatgaatcattctggagagagcacagagtatcatgtgttactgctggcgtaatagtttacgactcgtggtaaggtaggtggatattcgttttgttttcagtgcgtgtattatactactccatcccgttctaaaatacttttcgttctaaaatatttaaccacttatcttatttaattaaaaaattataaaattattatttattttatttataacttgctttatcgtcaaaaagtattttaattataacttatctgtttttacatttgcactagttttttaaataagaccagaccaaacgttagaatcaaaaaatcaaacaacatctaatttgggaattgggacggaggtggaggtagtaccagtagtagtatacgaagctacagtgcatgcaccaggctaggatagatgctagtatgctacacatgctgataggagtgccaaactaagggcttattcgtttcaaatgaattgcaaagaaatattataggaatagaaatgagttttaaactatcattcattttataggaatgcactataggaaaactataggaaagttttctattcctccatttttgaaggaaaagcataggaaaaaataatccacttcaacctaatatttgcgtttcttgggttggtttgctcaataacataggaaaaatttctgagtttttcaatccataggtttacacatatatttctatagtattcctacgtttttcctattcatacgttttgaaaatcctgtgaaccgaatgagctctaagcaaatactccctccgtctcattttaaaggcagccatttttttccacgtccaactttgatcgtccgtcttgtttaatttttttttaaaaaaattaaaaacataagtcacgagtaaagtattattcatattttatcatctcataacaacaaatatactaattataaaaaaatttaaataagacgggcaatcaaagttgggtgcggaaactcataattgcacttaaaatggaacggagggtgtaggttattacaacgacatcacatctcacttgctgataatggtaccagtatttagttactacctccgtcccaaaataagtgcagccgtggatatccgtgcccaacatttgaccgtccgtcttatttgaaaattttgaaaatatttagtcacacataaagtactatttatgttttatcatctaatagcaataaaaatactaatcataaaaaaatttcaaataagacgaacggtcaaacgttgaacgtgaatagtgcaaaactgcatttattttgggacggagggagtaataactacgtcgtctgttcatctgtttttagccaaacacacgtagtatccacctagtaaatgtttacagattacaaagtcacagtatgacggaatgttttggaacaggagtcgctggcagagtgaacgagaaatgcgaaacggagagaacgtaatactagtaattcagacaacagaacgcatcgtccaaggagataaaacggatggtggcacacgccgtccgagcgcacgggatcgtcactcactgcacgcctacagcacacttacgacgtacggctattgctggcctgcacgccctgcagccaggagccattaacaaaagcgaaacactgtcgcctaccgcattccaccgcacggcagggaccgcaacacagcagcgccacgcggcggaagcgacgacgacgacacgccaagagcgcgactgcgattctgcgaaagccgagaggcgcctagccttgtgaggcggcgacagcctcgctttcaccgtctcacgcaccgggcggcggacgacggacgcgcggttgattgcctctcatccgcggcgcgtgagcggctgagcgcgtggaagcgaggcgcgcgcgacgtatttcttgctcgccttgaaggcgccacgaccagcggcgtgtggcgtcgcgcgtgcgcgggtggttgtggtttcactggctcggttttaatcccgtgcgtggcgcctgcggcggctgtcggtcacgggcgccaccagcgtccagcgagcgtgtcaagcgagacgtactactactactactactgaacctgaacggatggaatgttttgttggctctcgatcgtccttgttctctcgctcgctcccggagattccttcgagtttacacgcatgctgatgcacgcgctggttttttgggctgaggct

SEQ ID NO: 54798 - DNA, 2813 bp, Oryza sativa
acaaaagttcacttttactcccttaagtagtggctggatccaattcatacccttcaaccgcaaaatcgggtataatcactttgccaagcccgactatttataaaccatgaaaaataaaacccttggttgttttgagagtggttttcgctaacatagtttctacatggcagccaactcataaaaaagaatttaaaaactaaagtgggatccacatgtaatcccctctctctccttccctctctgctcgtacctctctccccattgtcttctcagcacaaacagggtggctgctgggtggtagcaggcgatggcagcgaaggaattggggtgtgcacacggcggcgatggcatcccctaagcctaatccgtgcgacaatcgtcttcatcctttaaagccaagtgatcgtggtagctcatcgacgacgtctccaacatcgctatccttgctaagaagaagaccaagtggaagcggtattgcttccacgagcgggagaggccctttccgtcctcttcgccctctcctagttggctcaccgccctacggtggtcgtccccagctattcatggttggatatgatcgcgcatggtcccaccaacgaacatggtcaagaaagacaaaggggtggtcgatcacaatgacggcggtgaggcggagtcagagtcgggcatagtggtgcccccgcacaagtgcagcaacttctcattagctgtgatgttgacggcgcggcaggtgtgcccggtggtggagggccacgatgctgctggatctgcctccctcaccgagctcgggcctccagagttggtgcgcagaggtgacgacgatgaaccttcgaaattcccatggaatcaatccagcagcaaagggtgggggggcagcaaggacaacgtcaatctcccttcctcctttctcctccatctcctcgagccttatagagctcccgcttcgccgtcgagctcctcatcgcctgtagcggcaccactacaaaaaaatatatcctgcattcaaccctcagtgcgccccgagttgttcgccattgccgcgttgtcactaaccggtcgccaccgccgtcgccaccaccaacttccgaccgcagtgctgcacacctgcctcaccgtcggcctaactcgtacccggctcgccactcacgaggagaaagagggccgtggtggtggtggtgaccggtgagcgacaacgcagcgatgggccatgtttagggccagaccatagcctctctcggcccacttcattctacttgggccgaacttctcccacgagaaaggccatcgcccatcgctactgaactacgagtaccatcggattccgactttgcaggctacgacttcgacgaaccatgtacccaacatgccacaaaaccacaatatccaggcgagttttcttcgcttggccctcctgtcgaatcgagcagtcatacgtcgtgccgtcgtatcgtcgactcgtcgtcgtccaactccaaccttgcgcggcaaccgggtttccggtttccttctcctgcttacaaatcgtcgggcccgggcacctcgtgactactccctccgttccaataaaaaaaagacaaacactggtttcgtgtccaacgtttgaccatccgttttatttgaaaaaattatgaaaaaaattaaaaagataagtcacgcataaaatattaatcatgttttatcatctaacaacaacgcaagtacgaattaaaaaaaatttcatataagacgaacagtcaaagttggatacgaaaacccatacgaaaacccatagcttgtggacggagagagtacgtgagaacggagggaaaaaaaaaagaaacagcctgatatgcggccgtcaatcgcggcgcactccatcgtatctcatcatctcctctcccccaccgcgcgcgcgcgcagcccgcgtggttagatcccgtttctaccagcgcatatgatgtgcaaggcactccaagccagaaaaaaatataaatcgcgtggctcgcgagtacatgtatatacatatactgccgtagtgccatggatgggtgtacggaaaatcacaataatttctctctcttcttctaccttgtcatggccatcgccgtcaggccggacaatcaggtagaaacgccagcacgcacgccggcgatgaaagctcttttctttttctttcgccgggcgcttaaaacaaatctcttgtacatggacaacgactcaacatttcataagtttaccgcagtctcaacgatcgtacaattctagagcaaatgatggcgccgttgatcactcgggtcgctctcacaattaaacagaaaagttggcatcttgttcggttcgggcaagtgtggacaggccgctagttggagtaggtgtacgtggggtatgtgccgcggcgatggcgtcatgaggtcgtaggatgccgcgaggttagctcaacgacgaggcgctagtgcgcgcgcgtgcttggatgcttgcgggatttctttgacctcgggaggaagaggaggccaggtcggcaccggattgcgccttttgagtccatatttttcaggcctctgtttctttcagaagggtccatgtcaatcaaaggtcccattgctggttcgctaatgatggatggatcgatcggagatttcgcttttatcgttccgttgttaatttgaagagcatcttctagttgcggaatatgtcaggtttgcaagattttccacacccaaaagttcactttctgatgggttaaaaattaaaacaagaaaaggaagaacagagatgtcactagtaacagtgttcacaagtactttttctttcagtgaactgatggctgcaggaat

SEQ ID NO: 54799 - DNA, 8964 bp, Oryza sativa
caaagagagaggaagcagacgaaccgaagaggaaggcatcgaggcttctgttagggaggtactcgtagatgagcatcttctcctccttctccacgcagcagccaagcagcctgaccaggttcctgtgctgcagcttggcgatcagctccacctcgttcctgaactccgccgcgccctgccgcgacctcgccgacagccgcttcaccgcgatctccgcgccaccgcccagaacaccctgatcatcacatccaagaacccaaacttcagtcgatgcaaattggcatatatcaggagtagtgctatttccaggacaaaatctagaaaaatttgctggtgttcataccctgtagacagggccgaagccgccttcgccgagcttgttctccttggagaattggttggtggcgtcgtacatggaggagaggtccatgagaggcaggtccgagttggacagtggcctcaggctctctatctgcgccctcctgacggctgcaaaggaaccaagaaaaccaaatgtaacaattcacaaatttgcagcgtttgcggattgatcatggctgaataatcgatcgatcgatcgatcttaccgttgcgcttcctccatctccagcagtacacgcagtagaagagggtgcagatgatgaccaccaccagaatcgacaccattatcggcatcccattgtggctcgagtgccctggtgcaacaaaccaagaacgcgtaccctgacgccagttcagtcaccttcttccaactcaagaacacgaacatacacacactgcaatatcttcagcaagaaagaaaactgcgcgtacgtacctcctgaatcagtcgcgggtgttgtatccatcagccggcgatgtcgaaaacggtacaacgacgatccagcctcgccttcttctccccggctcttcatcaaaaccagttctctgatgagagaaagccttgggaaattttgcactgcttctctgcaggaatatatacctctcgtcactattgggttgttggagagaggttgcaggctagctagctagcttagccttaatctgaagattggctcgttagtggcttagtgcttactgttgtgctggcaccaatgtgtacagactacagagcatataagtacagctcaggtgagaggagaataaaatggatatgctgctgcctgctgcaggtatggggatggagagggagggggcgttgatggctgcaggatgaactggtttttcaaatgttgctgcaaatatttcatgcttgtccttttaggactgcaaattgtgctgcttgaccattgtgtggaacatgaacacctacgggtacagcgacccctctctctgttattctggttgttttctgatattggacggcagtggatgctgatcatccaaatttttgtccactgcttttgttcagttgttcttatcatcatcgcttgatttgctgatcaatcctgactgactcattctctcgcaaattaatccagctgtactataatctaatcctgccactacaacttgtgatgtgaacccaaacagtaggagtaagtaatcaacgctaacttttcacatgtgctgattcaggattaggtgactgtcaagggggcggtgtgcaagacaaccaccaaaaaggaattagtatctttttcctgccatgtttgagacgtgagcgtgtgaactaattaaagggcactgaaaccagggtaaggcttgtacagctataatgaaatgaaacggggaagtattaaagggttggaagtgtgtttgatttgattcccttttgacaaacgaggacacacgccatgaaaattatttctcggtgtggtgtgggtgcggtgcgtgtgcgtgtgggagcatgacaagctgggccacctcatcggcgtaggagcttgttgccttgtgcgtcaaatggtcaaaacgatttggcattttgtactggttggtagggcggatccggtggtggagatgcacgtttcgcctttttattttgcaaagaggagctaattaaggctatgtttgattcagctattataatctaaattattaggagtaagctgaaacaaatagatagcttattatgatagattgttataatctataagtcagattactataatctggtaagccactctaaaggtgcttttgctttttttaattattgggtggctaacagctaacaaacagataataatcagaaacaaacagctagcagcttattctatatcggcttattataatccagcttatagtaatctagttctataatctatattagaataatcttaagctgaaagaaacagggcctaagactgagttcttttattcactttcctaacttatctcccattttccacgtacatatttatcaaactattaaacggtacaaattttataaaactttttatacaaaagttattttaaaaaaatcatattaatcatttttaagttattttagctaatgcttaattaattatacattaataaaccatcatgttttccgtgcaaggagatggagttccaaactctacctctcaaacacatcctaaggatagtgatgatgcgagcgatgcctacatctctaacatgtgggtctaatgtattgacatcaatggagggagggtccgcgtgccagtcagccagtgtatgtattaatagcatgacggcagtgtctagttattagaatattaaggagctaatgacctctcaattatcatggttagttggtaattttatatggcttacagtttaagcgagcattttaatacgcatcctgcaacggattgagcgagacaggggagtagggggattaagcccccccatgatctaatcaaacgatattcatgggggtgatacatataatagggtggaagataagatggaataagaaatgtcttgcggtggagcatttaggtgggtaagttaagttgacgatcaagacccgataactctccatcagtccaaatcgcagactcttgttgtcatgcgaagaaaagaattctagcgtgacaatgcaatcagggagtagcctccaaatgagaccagtcatggcctagaatttgaatggatgaatgggccaaaattttagtcaccaaacaagttcacctgacgtccctcaattgtatgccgagtctgaccgcaattcaagaaatatgtacctctaaactatgtaaaactgttcaaaacatgtcccaaggcaatatagatgtttggtttcgctgacatggcttcctagtcagcaaaaaataaaaaaaataaatatgtgagacccacctgtaagtaagaaggaaaaatgtgaggtccacgtgtcagcatcatcttcttcatttttcttatcttctcttttgccgccgatggcagatggggagaggcggccaccgtcgactccacgctgcttggccacgtcaacggtggcggcgaccaacccctgcaccctaggccccggcgtgctgctcagcctcgcgctccgaaccacccgacccagccatggatgagagggagatggcggcgaggagagcaccaagcctagctcgtcgtgccatgggtggcgtgcggcattgcgggggatggggttcaaggacgacgacgatgtggacgatgcggtcggcgaagtcgtggacgatggcgatggattcgcacggccgccgctcggaccccaggctgagtgccttcttcaccttcgagaacccgagatggcataccagaaccgccatgcggaatgtgttggtgaaactgccgctggcaatggagccgtcgtcgacctccgcgcgagcgtcgtcgtcaccgccgtccccacgccctcgggagtggcggcgaataaggggacaggcgccgccgacgagcagatctagccgccctcgccctcgacagcagcagaggcggagatgaaggcggtgggcgagagcagcggcctcttctttccccctctcccaccagcctcatctcgccccctctctggctggcaccagttgctgccgccgccgcctctcatccttttgccgttgacgggtgaagaagataagagaagacaaaacaaaaaaaaggaaaagagagaggaggaaaaaaagagatgttaactaggatgtgcgcccccacatacttttttatttttatttttgattactagaatgtcacgttagtgaaaccgggcatctatattgccttgggaatttttttagacggttttacatagtttagggtatacatttctggtattgcagttaggaccttaaatagactcggcgtacaattgagggacgtcaggtgaacttattccatgagacgtacaagccttagtagcattatagttcttgccagagtcatttgggcttggaagttgtattcacctagtaggctattacgtccttcaactataagctttcaacgagttttttttccttaactttgaaaaccagatcaaattagatgaataccccgccgttttgctataggaaattaagttacataatatatacagataggatacaatatgattattaaaaccaaaacaaattgatacttataaattttaagcctataaataattaagattgtatggtgctttgagagaaaaaagaagaaacaatttcaaccatacatctataatctaatggctagaaataattagtgtgatatgacttaatgagaaaagagagaaatagcttaacggggggatgaactatataagtataagtataaatgatacctcctcggcttaattgccgtcgagagtgggaggtgctaatggacgggtggttgctgtgagcgatcacccgtccctcccctaagacggctcccctcccccttccacatccccttcttctctttctactacgccataatttttttaaaaaaaattaaaaaaaaagttagaaaattttatgtatagaaatactatataaaaaatatttgaattcaaattaaaatttaaatcaggtatataaacttttgacttataaactttgggtgtataaactttatatgtatagaaatactatattaaaaaatatttgaatttaaatttaaatttaaatttgaattagatatataaacttttgacttataaactgtgggtctctaaactttaggtgtataagctttagatgtatagaaatagtatatataaaatatatttgaattcaaattcaaatttgaatcggatatataaatttttgacttataaactttggatctctaaattttagatgtgtaaacttaaggtgtacaaactttaggtgcataaatttactaaaatagaaaagtgatacggtgctaaaaaaaaagaaaatcatctggggagagggactgatcgctcctagcgaccgatcgctccttatgactttcggtcgagagtcgtagtctcgtagagtcgagaggatggagcgagacggccgaggaggtccggtgattggcccagtgccgactttacggcccaataattacatagcccaagtggactattttgggggttggagatttgtccgccgacccctccaccgtactccatacacggtgccctcgcttattcccgaagaacaactaccacgaaaccacgcactgtgcggcgacgccattgcaagattgtgaaaactgaaaaccacatttcttctggcgtctctccttgatctggaaactgatgattcagacatcttggacgcataaggtgagtgactgagtgcagaatatttttgtcctggcattgtttggctttatgcttaccccgtcaggagaacggcctatgtgcaaatcatgttgagagattagcccaagaattttgcgtcagagctgtgtaattcttgaatcttgatttcataagcacttcgcagaaattgagattagtcccaagaaattaagatggatcggaagttctttctttggtaaggaaaaaaaaaaagaacgaacatcttccgatctgttctccgttgttacttgttttgatttggttttcgatggagaggatgaagatagtcggctaggagggccggtgattggcgcagttctgactaaacgggccaataactgcatagcccaactgtcacatcgggggtcggagatttattccccgaaacccccagcaggttggagattcatcttccgaacccgctccgccgttacggtgcccctcctactacctcacaagtcacaactccgatgaaccacgcgtacgtgttcctccttggtccccgacgtatttgcgagatcatcgtgaaaccttcaattcttccggcgtttctccttgatctggaaactggacggttcattcaatcatcgtgaaaccctcatttcttccggcatttctcctttttttaatacgcaaggagcgcattttttccattaagagaaataaaagttatttacaaggataaaaggaaaacaagcaggggaccgatacagaacgctatggaaaactataaaaatatctcgcgttaaatttgactaccacgacctcgtaaaggccaaacagcggggaccccgtgattagctgacttccaaagcatggcctcctccgccattgctttcgccacttcggtccaagacctttgttgttgattgaagattcggttgttccgttccttccaaattgtccaagccaccaatgtcacgacagtgttgaagcctcgacgataccgcgccccaattttcattcggctatcacagagccaattgtggaaggatggctcgttgacaggtaagcagttcggactccttatcgcctgaagcgttcaccaccataattgtctcgattcagggcatgctactaagatgtgatcaatgctttcgtcctgttgatcgcaaagaacacaacgatccgggtgtggcaaccctcgactgcgcagacggtcagcggtccagcatctgttcattgtaaccaaccacaagaagaagcggcatcgaggcggagcgagtgacttccaaattggggtggaaaggaaggtgactataggcggattttgagctgtattggcccgaactctctcatttccagatgattgaaccaggagtagtaggatcaagatccaccatttggacaagcgaccaaagctgtagatattctagaataggttggatcccaagtgctcctcggatgtctttgatccattggcgacctgttagtgcctcagccaccgtccgacgccggcgcacgcgtggtggaattttatcatagatgttcggagcaatggaccgaatgcaaccctcttgcaaccagctatcttcccagaagagaatagtttgtccgtctcttaattgacagacggtagaggatgcaacgaagttcctttctttttgcgaccccggaatagctagcccctgccaaggtttgcttgaggaggtccgttgcaaccatgtccacctggaacgaagagctatacccataagctccagattcggtacacccaaaccgccgtagtttttaggggcgcaaactttggaccaagcaaccctgcaacaccctccattagcttgcgctttacctgcccaaaggaacccgcgacggatcttgtcgatgcccttgaccacccacttgggtgcatcaatcacaaccagcagatagatcgggatagcgctgagaacagcgttaaccatagtagcacgaccaattgaagacatttggttggacttccaagtgccggcatttctccttgatcgggaaactggacgtacgattgattcatacatcttggaagacatctgtactaggtgagtgctgcagatttgtcctggaattgtttgtctgtataattctggatttcataagcactttgcagaaattgagattagtccctacaaattaagatggatcagaagttctttctttggcaggcaaaaaggaacgaacatcttccgatccgttctccagcagtgcaacttgacacctgactaaccactgttacatgttttgatctgactaaaacttacatgatggaacgatccatatcatgaagagagaaaagggggttgtatttagtcgcagtacacaagaacatgaccacaaggtttagcaaaatgttaaacctccctgtacgtgtgtcacgctaattaactcccctaaaaaaaggtacattgatagcgctaatgatcagtggcgagagaaaaaaaacaaaagttttgtgcctgcgtacgtatgcatatgcctcccttgattatttatcttcgaacgaggtggttcgttattgattaataatttctatcgtagtttcttcttctacagtagtagttcagttcatgagttgtcccatcagcggcgacgacgacgacaagatggcgtcgagcgcctccttcacctgggatatctccggcgccttccctccctgcgccggccagaactcgtccgtcgcaagaacctgcagttcatcgtcagaaacacagttaattagaacctccaaattctaattctaaccgcgtaatcgcgtgcacattgcgagagatgtgtgcataccttgacttgaagctggaggaacttgacgtagctgatggccttctcgagcatggtgacgaggtcgaccttggtgccgttgggcacgagctcctgcaggatccgcagccgctcgctgatcctctcgcgccgattctgccgccggcaagaacaattcgagttcagttcggtacatggattggtcggagtagcagtaggattttggcgcggaattcagtaaaagtttaattaccttggccgcgaggctttgcgggtccttggttggggtggtcggcgccgacttggccttgcccgccttcctgccggcgccgcactgcttcttgctagggctcatggcctgcgacgactccgcgtgggcccgcttctgcgagccgcggggcgccggcgccggcgcggcgcgttcgggggagacgccgccgcccgacgtgctcgggaacagcagcccgaactgccgcccacccgcgccgccgccgccgccggtggctctctccgtcaggctgaagcagccggtggccgcgtcgaaggcgacggccgtcgtc

SEQ ID NO: 54800 - DNA, 5038 bp, Oryza sativa
tcaagcgtggaggcgcgagtgcacgcgggcgcattaaatgctggaggtgggctcgctgatcgcggctgccgacgccgtgttcccggagccattcgccgtgccgctcacacgcacgcgggcgcgcgtcggggtgggaggatgacggcgtgcgctacagctaacgggagcgtggagcgcggcggagcgagcgggggagtcccacgtctcaagattcccgactcgtctccatgtcacgtggcccatgccatgcaagcagctggctgcggctgcggctcgctctcgccgctttgccgggccggccgcaatacgaccggcatattgtgcaagcccgcacgcacgcacgcacgctggggttgcggggtgagatgagaggtactagaccggtggggagatgagatgggatcggtgactgttttttttttctcttttgctgtgcctccgctcaacttactgtattctggccgtcaatcaatcatgcatgtcagtgacactaaacagggtgcgaggtgatcgatcgcgtaatttattgggtcaggttagcctggctggaattttctacataccctaagctattagatgtgtgcatgcttagctacacctgatttattgcaccgtgccaacacacgacctaattttctataaaatgctactacgtgtgtgtaactccaagttgatagcggtacatgtttctttagaatgtttatgggtattttagttattaacgttgttcggctgtcatttacagcacctaagccagttttcttgttctaggatataagtagttgcattggttgcgatactgtcaatagcagcggagcagcctcattaagttacctacgctaactaatttaacacaaaagcttaaagtgttgagaaaaggtttagactagagatctttagctctattatcgaaagtcacatgcatcgatcactgtcttcaagcaatttgtttacactccaacactaagtaactaggaaatgttttcttttacccgatttgtatgtttagtgcgaattctcagttctgtcgtgctgaattgatcatctgacttgggatttaaccgagtataatcaaggagccgtgatcgatctgaactccctacagttggcaccttccgatcgtaatctcagccgtcgattcttaatccgacggccatcgaccctcacatccagcgacgttcgtgcaccgtggagtacagatcgagcagggaatgttattggcatatcttaagcaggatcctgatgacgtcccacacacagcaaggaggagggacaagatgcttcggattccgttaatacctgtcattgctgctcgctaatcaagcgccctggagtgtaattatattctctgctgctgttgccctgcctgtacttagctaagcttgtccctgacatgattaagaaactcgctgctgtccccccagcttgccttagtttttcttttattacatgtacacgagtctgtgattaatgcacttgtgttgtgacgactataattaataaacttgatattagcagtagtaatttctctccacacatccatggttgcttggtcattaatgccgttgattagcatgctgcttgcatcgatcctctgccacagtttcagcgaggaaaaagtatagtagcaagttggtgatcaagtagcgagtcaaggatgtctatctcgtttctacgtgcatgcacgtctacgtgtcgatcggttactacagtggacacatcgatcggtttaattttgatcaagctgatcgatatgattcacgcggattaattcagctagatatatagcccatgcacacgtcggtctccatcatccgattccgtgctgggtttaattcgcattgatgtcgcagaatcaagcaccacatgcccctccttaatttgccatatttacaggcttctcaatcgtgtgcaattcgtgtggttcctatatagcgaccactagatcgatcaaaaaaatccaggaaaagaaattaagtaaaaacctcgtgcatgcgtgatgcattagctagctatctgagtatatctactcttgatatgacgatcatcagtgattctgaatttctgatgatgaacctctgttactctgttagtacttacttggggcttggtgatcagtaattctgatgatgaacctctgttactctgttagcactggcctgcaccctacagggagaggtcaaagtctggagttttgagttgtaaatgatgacttttacggcgatgaagcgtgtgggatggagtagtaataatctggaggtcaacttggcaaaatcccatcgctgatgtgggaggattaggggcaattaatggcgttcgtgttcctcaattgatcccggcatgtggagctcattaaatgacggcgaccaatctggctggccaactaaccctgctcctcctccgattcccccttacctcttcgcgtaatcctaccggttaatcccagcatcaatcaagatcgagcaactgatccgattaggttatctactcttttccatgcgtcttgccatctcggcaactcctctcggattctcgcatcgaatgcttctgcaggcttcagcagcagatggagatcgatcgatcaagccggcgacgaaccgaccaccatctgacagtgagttcgttcgcgctagctagctgggagcacgcgtgcgtcgctgacatttcgcgggattttattcagacccacgcgtgcgcgtgcgcgatggccatccgatccgaaagaggggaaaaaagtatatttttactggctactctactgctacgaagaactcattccttaaaaaaaataatctagaaggatatgtgacccctcctaatataacgagattcgttatatctttttaggacggagggagtaatcatgtttgatgctgtgttgagttgatctgtaattgctgtgctcggtatgagacagttgttatttgttaagggtttcagttgagctaaggaaagacaggaggcaaagtgttaggttagctagtggctatctattcttgtgtgctatgaatgatagaatgatttatgataattattttatagtcaaacgaatgaattaaacagtgtaaagttgaaaattaatttaaaaccgtttatataagaaatttgtatattataaagtttttatatgatttgcaccatttagaggctcggaaaatattatttttattattccatttcattacaggaaaaacaacacacctctacctcaatttttaatatatggtgcattgatttttccttctgaaagtttgatcaacaatgtttattcagttacttagttaagtgaaatgaaaataatacaactagatctattatatatcaaaagcattttaaacatacctatagtatatttgtctatttgcacaaatatttgtcaagtgaattaagcaagtactagtaccttttgcacaataatattcatatactagtacttgcttaataatttctgtcttaattattgtattgttggggaaaagttcgatcgtaacatgccggatatgtgatattgtacttgcgataagatttacaattagtaagttgagagtagagtgggtagttcattacccgaattggcgcctagtgagagtattccaatcacgattatgtacttgtgataagatttataattagtacgttgccatagttggatatctatatatgtatggagtactcctagttcattgccgaaattaataaaagtgtacgtatacatatgcacctattcaaagtatttcaagtactcgacttgtcctctacataccaagctgtctggagtatctccgctgcttcgcctgtacaataattgtcgtttattatgagtatattaactaattatgattacaacgtactcgtacatgcacggcgtacgtgaaacatttacttcaataattatttttactggtgtaacttcctcttttacattgtttggttctgtgactctaatcatatatactccattcaaatccatctctctcggcgtgaataccgtcaaatgtgtactctgctttgaattggatttaagtataatcaggagaaatttaaaattgtaaagtttgattctcatgaataatgttaggcagatttttacttgttttaattagttctcaaattcaaaatcaacttaaaattaggtcaaccacacaggcaaggtaactcaacatagcatggctacaataatgataggccatcgaactaaatatgctattcttcttatgtgcaagacttttatgagttaaaaaaaactaaatattcacacacatgcacacaaaaaaaaatacctttactcatagcatatctataatttcttattttcgataaatatctgataataagaaactcgtatatttggggtcatgtttaagtgttgcatctctgcaaggaagatatcagttaaattaaagagagatttttatatatgttcgaacccttcttagagtaataagtatacatcttgtcagtcgggttatcggttttattaataccaaaagagtatggttacaaggatatatatggacctagtcaaggtttatatgctagtcttgttggggattccaacgagtttttattgatcagtgggtgcaccggctcgatggatcttgaggcttgatctctgactcaacgacatatcgacttgcggtggcatatgattgttgtgtcttggcttgcagagtatagatagttggataccagatacccatatggcctgcatatcgactaagatagaaggtaggccggatccatatgatatgagatggaataacatctgtttgccatattgccttgtatcctaaaatagcgtacagagaatcccaaccgaacaatgctatggatagataaggtaaccgaaggcgtgttcggctaggtttcctaacttgtaacactaccccctaacatatataagacatgcagggatcccctcgagggcaacagagaataagaaacaccaaatcgacacaatatcaatacatcaggcataatacaatccatcaaaataggagtaggatattacctcacatcgagagcctaaagctatata

SEQ ID NO: 54801 - DNA, 8628 bp, Oryza sativa
ctctctcttcttcttcttcttcttcttcttctcgtcgtcgtcgtttgatttgttcatgacaaacagctacttaaagattctactagtatgtgtatatatgtactgtacaacacaaaagtgttaagccttatcttaaagctataggcagtaacttaacagaaataacggacagattgtcgcgtatgtaactacgctagtaggtactgtactagctacttagagcaaatttaatagtatagccaactactaactctaattaatctatagccaatctaatagctcattcatacaatagttacatactacactattaatacctggccccacctgtcatatacacactgcgtcttggagttcgtgctacagctggctataaatttgtagcccgctgctcttctctctccttatttattttcttaaaatatgtttgtagctggcttatagcctgctattgtacctgctcttagcattggatatctccaagtccattcgtgtgcgtgcagaattttattactgcacccgttaggatctatcgatgcacgcatggcttccagcagacagtgcaaaccgacgaccgatcgatcgcacgtgtgatccgcagttgcattcactgcaatagaaagcactcaagcgtgcgaagaggatcgattcatgccgtcgaaactgtgtgggtatagttactgaaggcagactgaatttagtagtgtttgtgtttcagtttcctgtacctgcatatgacagattatactataccgtgaatcgatcccggagtggcataattgatttgggggtttgagacaaaaccattgttaatttttccattaattgtaggagtaaacccggttgccattaatttcctccacgtgcattaagagtttaacaatctatggctcattaaagtgctgagcactgttcactgaaatcttattgggggcccactagcaggattctaaaccaatcagattgatgttattactgtgttgtgaatattctgatgatccagtaactgcattttgtttttccccaaaggttgttctagaagcattgctcgtgcagcgcccagagcccaagacaaattaaaacctgtcgtcccgttattttcgtgatgaggattctatctcagattttattagcatgttttttaaatagctaacgtaaaaaaaaatatatatataaaaagttcctaaaaaatatcagctaaattaatttttaaaatttgacataattaataattaattaatcatactctaataattttctcattcgtatgtccatatttaatctttatcttcatcttttcgaacgggccttctctgcaattcatatactaatactcatgtataggggcatatcatcatgtattgtcatgactgaggttagttgaggtttaagctggctgaggtttctatagcaaatgtcagatgctaatcataagttgattagccatgaaaagcttcacaatgcacttaagaaatcagcagactagtagtgcaagaaaatggcacaagaaaacaaaaggactcattaattattgtagtcggctattagggtagtcccaaccctccacctaggatgatgtatatagcattaagtacattgccatgtaggacttttaacttatgtgtcactatattaattaagagagagagagtgaagagaggaagaaaccgggtctcatgcaagacacagcttcaacacgagaacctatgcactagacactatcaagttttgcattgcgagagaatagtgtcttcataatagatatagaataaatatgattggtagagaagagagatgatgtatttattaatggcccattttaagaaaccatgggttgtggagtatagtttctattgtgatgtcttattgacacggcaccatagacactacttatggacactatgggttgggactgcccttaggcagccattagacaattcaccatttttttcaagactttgcaattcattcatgtctcttccaagacacaaggctagcagtgaccactcagggtgtgttagttccatggacaatgagtgagatagcacatcgttttccgcgcccacgtttcccaaactattaaacggtgtgtttttttaaaaaaatttctatagaaaaattgctttaaaaaatcatattaatccatttttacaatttaaaatagttaatactcaattaatcacatgctaatgactcatctcgttttgcgtatcttcccaatcttttcaatcccctattcctcaaactcaccctcagtgatcaatttggtcagaaaaacaaaagagagctagagaaacattaatgactggtacatcagtaataacatatatactacacattattgcattatgggtttgaggaacaaataaattgattcataagcagattccatctgatgattcagtctgacgaatatacagtatattcatataacctgatcattttgtgagcacttcgaagcgcaagaaaaagatactgcaatttggtgtggatcctgtagactatatagttaagaaacataagttaattgcaagtattcagagtagtaattacacgtacatgcatgcgcgcaacttaacgacatacatattactataagatcaacctaatcaattaggaatcacacagctcaaaggttctggatcatatcataaatcaactggagtaggtaataatgtcctgattgtcttctccagccctactggggacaagttacaattgagaaagaaaaacaattattggctatttggctgtatcccatgcagtagataaccatttcatgaacactttgactgcagggaccaatgaactcctaccagtcaggctatatatcagattatgcagctctctcctggtacactgcacactgttcaagttcattcgtcccctcaaatgtctgctagtaacttagtaagtatattatttccacttacatgcaactaattaaggcgaggttaccattgatatacgcactaagtacgatgtagagctgccccaagcctggtatcaggagacagccggctgctagatgcaatgttctgcagtcacaaaaacaaaagatgcaccctagaaagtaaaatggataactaccttgcgtgcagggtgatgcttggtgaagaaccgcatgaccagtcaagaggatgaacagaaagtttgattaagtatgatcatgggggtgtgtagctgtgttgttttgacttcatgtaattatgctccgtgattggttttaatacctgtaatacagagctttgtgtttggatgtcctcgttgtatgggacataatacgtactaggattccattacatcgattttgaagaagttttatggggtaaacgaaaaaaaatgcgtatctatacgatcctaggagcatgtttcataatatttttgaacgattgagtagcattgtttttcattaaatagaaggggtattgttcatttttagcccctacaacctttctgaaagttcattttacatatctgaactacaaattggttatttttcaacccctacttttaaaatcgtaaaaataacaaccttaaacatgtgtttagtggttttgtttgaaatagttgcgaatcttagaaatttttatgagttttagcaagcctaacaataaattataaagtatacccaattctatacaaatctataaattattttgggctgagcatttgctttgttagtttgctctaagcatgttaattaagcatgtacaatacactactgattttgccaatgacgactaagtaagataattagcaatagtaaggtaattatgattaatttactgaggtatggctgcatgcaagccggcggagcccggacaagtggccaccaggcgccggctccgccgctggtttgaaatggacatactttgagaactaaataaagataaacatcaaacaaaatccaaagcctaagtggctaagtccatgcatgaacaatgctttgaatgcggtggtatatataatctcttcacggtacaggttaactatatacagataactcgtacattaggttgcatgcgttataattaataatttattacctccatattttaatatatgacgccgttaaattttgtccaacgtttgaccattcgtcttattcaaaaaatttatgtaattattatttattttattgtgacttgattcatcatcaaatgttctttaagcatgacataaatattttcatatttgcataaatttttttttgaataaaacgaattgtcaaacgttggtcaaagagtcaacggcgtcgtacattaaagttacagagggagtaattctctacaagtgtaaatatatggactatatgtacaacattaagcagcatgcatttgtactatgtttctaaaagaaagaaaaatactaagcagcctgctgcacatttgcacgtacggttcgaccatcaaacagacaacaccccttctatttctcttgcattgtctccactctctcgacagtgtgagcgtctcttaaggcctaagcatccaaaatctgaagatttcttcgtgcatgggccaccgtcggtaggcctcacctgcctcctgtgccctcgtgggccgtcgccggtgtctcgcgttgcaccggcaggcggcagcgtcgctctcgcccccattgaacgtacgcgtcaaggcctccatggctccgccgaggagtctgacagttttttatttaacttcttttttatcactttcatgtggcctcatgtttacacgtcagcgagtctaatcacgatttgttctgactgctgccacgccagcagatgcaggcatgcagcttcccaaaccactggaaaaatcgattcgcacatgttttcaaagttggagatgggatatacccgaatttagggttgaaggatgcgattcgaacaaaggcaataggtaagggatgcaaaatagacttatattaaaaaaggaaaatatccattttacctctattaactaccgatagaccgagtttgattcacatctcttaattgtaaaatcaattaagatcggatgtataggctcgtttaatgttagaattgaaataatttattttctcatacggtttagatgagagtcttgttctacgtatcattttgatctggtcttttatacgacacgatgcctacggaatacatagtattctaacatctattattttaaaaattaaagatgtttttaccgatattttggtacgtcatccgtgtataagttggtttttaagttcgtttgcttttggaaatacatatccatatttgagtcggcttttaagatcattcacttttggtaatacaaaatgaatcatataataaatccgtttaaaaaaaacttgcatgctaacttagagtcgatagtcccctaactgcaactcatgattttctaaaaatatatatccaagcgaactcccacagtgaatttcatcttaactaaaccatataacaataataagattaaaataaactttatccgttgcaacgtacgggtattttttccagcagttgaaaatttttaaaaagaagacaagacccacaaacgtgaaggtcccttggaaaaaaagtaaaataccaatggctccacgtgtcatcctctcccattatttctctcctctctttctctctctctccacgaaccccaaggtacaagcttttactgtgcaagtcttttttccccaggtacgtacaaactttgagaccttatagtaggagatcgaggtattatatagttggagaccgaagctgactgcaacccccttcaacgtacaggccaccatgcacatatgcgtaggtgcaatccgtgaccactgaaaacccacggatcgatcgatcgatcagccaacctacgtacgtacgtacgtacgcgttccgcccgttagtgctcatcgccggcccggccgcgcgccgtccgtacgtcgtcgcatcatatcacacgtactgacgtacccatgccgccgccgtgttgcaagtcgtgcggtcgcgccggcggcgtcatcggcgtcgagatatcgagcttcccgggcacgccgccactgcagcgtcgtcgtcggctccgccgccaccgtcacctttggacgactaccatgcgcgattgaagacgaggttttccgctaggacattgctcttcatcttccgggtacgtacgcgttcgtaactcgtagtaagtgtgtatatatactaatatcagacagatcgatgctagctgcatgcacgcagagttcgttaaattcgtctgacgccatatagtacatgacgcgcttgattaattactttctcacggatcaaagcttaataacttgatcgatctatgcctcttaactttctgaatcttcgtaacgaaattctgcctagctcggtttgattttctatgcgtttccaagaaaaaatacacgcgatagcggagccaaattttctaatcctagggcttaaataaaactcagttaataggatattggctttctaaaaagaaattgtatgatggtttaaaaatatttacatataattaattgattatgaaggcaaacctaggtcggcttgccctaggcttgcctccacccttgaaaacacacgtacatgtaagtaaatgtaacatgtacaaacgatgctacaagtagttaactctggactaattctattatacaaattagggcatttaatttgttcagcaaattccttatatgtggacagtcagacacttcctaaagcaaaattcactttcgatcatagttttttattaccagtgtttcactttgtattatattttaagcaatgtttttacttaatcaagtaattttacctttatttcgccttgaaccatcctaactcccttctcaagcatataaacgatttcgagtacactagcttttactcgttaattaagtcccactgttatactaaaactatcgttttgacatatgataagttgatggaaatttataaaatagtcaagggtggtgtactgttgtaaagtgtcacaaaggtaaatccactctgttcaaagtgaaaatatttgttaaaagaggatttaaaccgaaacaatggcaataaaatgtgacgaaaattgaaatttactcagttttttataagtgagacacttgctaactgattttttttattttgctggttgaattgatgcagggtctgatgctcttgctgtggctgtatttgttcgattgcatgagaacatacgtgaccgactacgttggcgacggagactcgtggtttactaagtttgttttgtttgttgtagccgtgcccatggctgacctttttagcatcttcgcgtggctatgccttcggctccctttgcccggatgcagcccacttgaacgtccaagagatttttaagtggtaaattttgaggtcaattataagtaggagttatttacgcaattgtacacgctatgcaccaacctcactttcatgtctatagagtaattaatataagatgtagaagttacatttttgtcttttctttatgggtccatattttcttttctcgaagcgatcgacatgttcatctacttcgatacatcgatgctatatgcgaacttgctaggcccctctgaataaaaaaaattatggaggaatttcataatgtagaaattctataggcaattttcctatgtagatctttgattcaaagaattggagttttccaaattctataaaatttctatgaaatagctcgttgcacgtagattttgaagaaaacttagtaaaaggtttaacctcttgaaaaattcctttgagtctatctctcttatcagattcctgtgtttttcctgcagtctaatcaaatgaccagccatttttgtgtttttaataattatctactttatatttgtatttatgttagaattctatattttttctattcctcgtattttccttcctactattgaaagggaccctaaattttatttggccagcaggcattattaattctgcgtttctgaacaatctataaatcaaaacttgtatatagttacaattaaactcaagaaataaatacggccgaggagaaggagaacacttaaatattataggttacaataaacttaattatattgtaccctcgatactaagagcatgacgaaagcgatcactaatagagctcctcaaataccataagatgagatcgtttgctcattgtcagggagtcaacctgggatgctcatcctcgccacttacattatcatgaacgttccatactatcaccagcgagaaaatttgtcattatattatattatgctaccgttggaaacggttttctctagaatttcatctcgcgtgtagaaattaaatgccacccttgaacggtggcaccgccgcgaccttcttcaacaggagcctcatgtcatttggtcgagaagttcagatctatttatactaccacatcaacgccaccgttgagagggcgccgtcgccgtcgaggccgttagggggagggacggctgtcaccgccgtctccgccgcaccccgccgtcactgcgccgtgccggcgagacaggaaggagagcgggagagggaacgcggacgccgccgtcgtcgccgttgacgctgccacacccgccgtcgccgcaccatgccggcgagaagggagggagaagggaaggaaagtggcgccggtggtgggagagacg

SEQ ID NO: 54802 - DNA, 9441 bp, Oryza sativa
aacaacgagagaatatcctctcgagggatcaaaattaatccactctcaactaatagctatagaattcgcaatctcattattgtgcaacgttgaagccattctacgtgtaagtacatattgcatatctcttctctatctctacttatctctaatgttataaaaattaaagatgtttttgctggtactttggtacgtcatccgtatatgagtcggtttttaagtttgtttgcttttgaaaaaatatatatgtatttgagtcaggttttaagtttgttcgtttttggaaatacagaaggagtcatataaaaaatctttttaaaaaactcgcatgctaatttgagatgagtggactcctaattacagctcatgaattcatgatcttttagagaaatatatatccaagcaaatttcgacagtgattttcaccttaattaaaccatatatcaataataaaattaaaataaccttcacctgttgcaacgtatgggctttttttaagtatataataaaagacaaattgcatatataataatagtccggcagcttctctattttattactccactacggctacatgcacaattggggtttccacacagtcgttattgtttccgttgcaatgcaggtgcagacagtttgcgctgcgttcggttggaacatttgggacctttgccacgcatataaaacggaacgagttattagcactaattaagtattaattaaaaattaaaaatatattagtattattttttaaagtaacttttttgagatttttaacaatgagttgttcagaagttcaggaagtgtttgtgtaaaaataaaggagcagaaattggaaaagttcaggaagtgtttgtgtaaaaataagggagtaaacgttggaaagagcaggaaacgaatgcacccttcagagcaaatagctactagtactattaaagagcacctcaatttatctctagaagtttgaccaaatgcatttgtgaaatatcccatacgttggcaatgtcaatggcttcaacgaatgatgtggctcatcctgattgcactttgtgattcacttttactaggtaagatatggatgtatttagtttgttaccaaatattggtaatgcttagagaattttggcaacaatacatttggcctattctaaaagaatgacaatattaccaacttgtttgttaaattttgaaaatgtttatttaacagtaatcctaacaggcccaactagaaagtctctcacgctgggccttgttgaccggccagttagccatgcgttctgggccaccgttgcctttcctcgtcgccaactcacctgcccggtggctcgcaacgtcactctcgccgccttgaactcgtccgtcaaggcctcccacctccacgcacggacccaacaagaattcgaacaagctcaactgaacaaagcccagtgcaacaagaattcatgcactcgcctcgtgagggctgtcaaaaatgctcaaaactcgcgagctgctcgagctcggctcgtctaggctcgattcaagctcggctcgagcttcagacaaactaagcctgagcctctccttaagctcgcgagttttatcgagccaagcttgagcttccaacgagtctagtaatatatatttttttgttatttaataaattatgagatcaaatatgttatttgtatgccttatattaatatcatatatttattttattcttttttcctcttctattaatacgatgcactagaaattaattgttttttaaaagattatatttgaaatatatattgttttacttaaaaattaagctcggtagtcgagcttgtcagaaagctcgaatattttatagactcggctggagcttgtatcgagttcgagcctagacaaacgagctcgagcgagctcgttgacagcccttgccctcgtctgcgtctggccgtctggtacacatgtaggagtagtactgtttcacaggaagacaacacaaataagtactacaggctacagagttgctgagactgacgatggcctcaggattggtagcagtaaatcgtgcgtgcattttgtaccttctaggagtaaaaaaggagtactactcctagcagatggtataaacttgatgtcttgtactgtacttaagtgatcgagtgaaatacagtaatctaggtctagatacccctacattaaccatgaacaacagtacatcttggatgtcacccaagggactgattcacatcatcaaatgacgctactatctggcatctgcagcaaaacacaggggacccaacttaacccaaagcattcaagcccccatcatcaatctgaagcaagccaaaaagaacagaaacaatcaaacgagagcagtagtagcacaaccaaaaaaaccaggaggcatcaaagagtggcaggcaagtactatcagattgatccatttattattttctcccatttgctgacaaccttgtatcgagataccattattctgattccacgtcgtaaagcattttctctgctttttgtagacagcctgttgaacatgatgttcgcgctgtcgtacagttcgaaaaggttcgtcatccttcccttttttttcgttctttctttctttcttttcttcacctgaattttataaatgttgtcacggggatcgccgtggccaacatggagcagggatcctttcctttctcgtttgcaacgtaccaacagctagtgtaactagacaaccgagtcatctggagaaaaagattgagagccaaataagtgagacaggcttgtaaaaagctcatgtcatttggctgctcgctcagcggtttttgcatctctctgacgtttggctatgcatctgtcggcgttgttcgatagcgcatcctagaaagaaaaaggtttcttgtacagttgtactcaaaaggacagggtttgttggttctgtttgtgtgatttttattcacgctgtatacaaacaaattataatactccatagtgactatggctgtgttcggatgcctgagttcccaactctaatagtgcgcacgaaaaacggagcgatccattagcacgtgattaattaagtattagctaatttatttttcaaaaatagatcaatatgttttttaggcaacttacgtatagaaactttttataaaaaaacgatccgtttaacagtttgaaaaacatgcacgcgaaaaacgagaggagagtgttgggaacttagagttccgaacacagcctatgtttttttaagtgtagtacgtatgctggtactggcaccaaacttacatgttactctatttgttgatgtattccaagcagggctcataaaactgatgaaaacctcccggttttggcacaatttttaggtttagagccaccttgagctgataaaccgctctgataagaaaaattcaaagtgcatttcaatttttttttacaggacttacttgaaattcatcagatttcaatgcttttcatgaaaacaggtaaaaccgcttaggagcattttcttattagataaaacctgatttcaagttggtcattggacctcaaatccttcagtggtgaattttgtgctcccaacttatgagcttaggaattaaggatttaatgtgtgcacacgcacgtgcgggtgagggttcaaaaatcatttgctcgccaaatactgcactagcctccacagcaattttgacggtttttgtgaatagtatctaacaaatttgtcgaagattgaatttcagcttatttttttaaaaaaagaatcgtcagtttatcagtttgtttcttgatgcgagctgaagcgaacttgttctttatttccacgtattagaccatcatggaattatctctgctattataaaaattgaagatgtttccgcggtccgtcattcatgtttaagtcggttataaaaattgaagatgtttccgcggttcgtcatccgtgtttgagtcggttttaatttttatgatttggttttaatctatatctcttctctactgttataaaaattgaagatgtttttgccggtattttggtacgtgtcatccgtgtatgagtcggtttttaagttcgtttgcttttggaaatacatatccgtatttgagtcagtttttaagattgtttacttttggtaatacagaaggaatcatataagaaatatgtttgaaaaactcgcatgctaacttgagatgatcaggctcctaactgcagctcatgattttctatatatatatatatatatatatatatatatatatatatatatatactagaaaaaatgcccgtgcgttgcaacgggtaaactaaaattataccaaatataaaagtattagatgattagggtttagttttacatgatatgagctttttaagaaaatctattcctaatgaaataaaaacaattcaacttaagggacctcaagtgaacttattctgtgcgtgcacgcggcccatgaggcgggctacagtgtgggcggcctgagaacatattcggggacgactttagggacataaagtaaatgtattctctgaggagattacaagcggcccaatagtgtgggcagcctgggaacgctggagaagctgagccgtccgatctgatggacggtcttgattgatcacgacctatataaaagttcaatgatccaaaccctaaccctaaaaacatttcccctccctccctctccctctccctcagtggcggcgcctctccccctccccggcggcgcctctcctccctccccggtggtgccgctccccctcgcctccctcgcgtgacagatccggcgacggtggtgtcggcgacgaccgtgggtggatccagccgcggtggtggcggccgaggacagatccggcggcggcggctccctccgactcctctcgcctccctcccgcgacggatcttacggcggtggtagcgtcgacggcgaccgcatgtgggctcggtggctgttgctccccctccccggtgtggcgacgtggccaggagcggtggtgggctcgggagcggcggcgggcttgggaaccggtcacagtggaaggctacgatgccgacaacggcggcgacggcggcggacgacggacgacggcgacgaccacgaggagggtggctctgggagatggctagggttaggatttggattttatttttgatttggaatgttgattttgtggggattcttggttttgatttgggattgcaattgagtgattctgtgattcttgggaattgggggcaaaggggttgggaggctgatctgctcggggattttttttaaaaaagacggacttggacttacacgacgatgacggacgaaacggacgatcggaggccttacatgttttgaagtaggtatagagttataaaaccaaacgagaccattatgtcgcatgcatgaccgtaaatgcattaggtggtatgttttaacttaacgaagagaacaaaaaagaaatcaatggaagagcatcttttaacttaactaccgtaatagagagaaaaaaaattaacgggagggaaggctactcccatggaacagaatgggaaacaacgtttgaaacgcatgcgtccaaatgcgaaacggaaagggacgacgtaccaaaaacccatggtaaaaataagttaaacttttataatagtagagatatatccaagcgagctctcacagtgaatttcatcttaactaaaccatctaacaataataagattaaaatatacttcacccgttgcaacgcacgggtattttttctaatcaattaaaaaagtctaagtctaacttatttttaagctttctcattgtctgctaattagtttatcagatgcaacttaattttaaatattttaaatttaattttaaatttatagccgattttatgtttttctgtatttttcccagcaatgaattttaaaccgctaataacataatataaaagtttttataaaatatgtgttggttgttttgctccttttctatggcttatcaaatatcagccgtaacttaaacgatgagagcattagtttgagcgattgggtctagttgcctgtcatcaaaccatctcacaagctaactttacatgccttttcaagtttaaaaataaaactccacatgccttttgaaagcctgatcaaagcgagcgaaatatgctgcaaattttaatctctcaaacaaacacaagacattaaacaaaaccaaatggaggaaaaaatgtctggcagagaatgattgatgaacatgaagcgagatcgacaaaacaagttgcattttctttttctttcttttctagtaataacaaagagagaatagagagagaagagatacccatatcgaggagacacgatgcgcatacggtacgccgtgtacagtgtacagcctcccgagacaaaattcccaacacaccctggcgcctcggcgtactacgctgtaaagaagagagaacgggaactcccgttctcttgtccaacaaaagttggataaaaattaacaaaagttggataaaaattaacatttttatggcacgttttttaaactgctaaacgatgtgtttcgtgtgaacactttctatatgaaagctgctctaaaatatcatattaatctattttttaagtttgtaataaattaaactcaatcaatcatatgttttgcgtaaaaaacttaatctttattttcatctttattttcagtagaaaataactccaccgtaagagagaacgaaagaaaacgagaggccgcgccgccgccgcgcgccatacatgtggccattaattcccgggtggccccatacgtcagccacgtacatcgcggtggggactggggagcggggtgcatttagcatattttatcccgtcgcgctacgcatagcgaatattcgaaaccccccaatcccaacaggcgacagctcgtcccatgacgaaactctggcacgcgattttacgtaactgccctcgcctggacaaagcatttcaccggaattatctgcaaagctgcgtcatcactcgattgggtgaaagcttatgttacgtttaactgcttcatgttttcttgggcaactgaaagccaaaaactgatttggtcgaccagccaaggtcgtgacaaacaagacgtctttgtatatatcttgtgtgtttgcttaacctacttttagtgttctcctgcatatcttaattcaatcaaacttttcttgctttagtcaacttataatctagtaaatcggcaatgaggtgttagagacttagagttggttacctaagattgtgacatggaaaaacttttgtatggcttcgcctgggggcttaaataaagacaggacggcgtacaaaccaagcaagtcagccattgtacttgcttataagtattcggtattttgtttgccaggtagaagggtaatgtttgtttggtacgtaaacctgaggattgaaaatgacgcgactggtcacggtgtcactataaatttatagaccttctattaaaaaataaaataaccttgtttcgtgacattacatatgtatagatttgttatactccactagataatatcacacaccattatagattcgtttatttcggagacagataaggtataggtttactctcttcaatttgttaagaaaacaactgttatcaactagtattaaattagtattatgtaagtgtgagcgtctatgtatatctcggcacataaaaatataaaatgtgagtataatatttgtttatcttcgagaggagagaagaccatcacacaaaatcgactatactagtgtataatagattgttttctctgattacatatgctgatacacatcatcacatacgggcaatacacacaataccgatgataataaaatgcactcacatatgtacaagtagggttcaaatctattaacagataaacgactaggggcggaggatcaagtaagactagcatgaggggctaaacaatctgtccaaagttatagcctcctttttttaagtaaatactccctccgtttcagactataagatattttaacttttgtcaaaatcaaactgttttaaatttaactaagtttgtagacaaatatagtaatatttataatattaaaataatttcatcaaatcaataattgaatatattttcataataaaattgtcttgggttgaaaatgtttctactttttttcaataaacttggtcaaacgtaaagcagtttaactttgaccaaagttaaaacgtcttataacctgaaacgagggagtatatggcaaaaaaaaaagatagacggtttaatggaaactcctataattttaacgctgataataagggcttgagacccgtggtctccatggcatgcagatccactattgtagacaacccacatttttttagcttgtacccgatcattttggttccattagaggaagtaaaaaaacagtgttgtgcagaaactgaagaactaaaaaagacataccaccttgttaacacgttcctaaagtttcctgattttctagcaacgcccagaatcaaccaataataaagctcctttaacacggattattttgcacacgtagaaagtttaggccctccagtgccagccactcaggctgctgcattgcatagtgtactactagtcgttaaacctataaaatggccaatgctagtccagtactacctctggttctataataattaacgctttggacaagtttcaggtcaaatttttataaatttgatcatcaataactttaaaaatatttagtttaaagaaactagaacaacatatatatatttatctttaaagcactataataaaagtaaacatatatttatttattgtatatattataatagaaaaataagatcaaagatatattttgtagaccgtgttattgtccaaaacataaattaaaataaaaccggagggagtatctctgtcaaaataatagtccaatgagaggagaccagttcggacactcaaaatgatcatcacgtcatcaaaaagcggccgtccagggacgagggggggtaccgtggtcatttgccgcaccgcacgctcccctcgcgaagcgccaccgcttttcagccagccgccccacgtgaaattacccctctaccccccacgctccctctctcctcctcttcccctctctctctctcctcccccgctgtcccgcagcctttcccaaatctagccgcacgacgcaccaacccacgcccgagccagagccaggtcgccgcgccacctcttcggcttcgccgcgccgccgcgagcgggcggggagactccccacccccggtgagtgcccgcccgcgcagatccgcgcggttctttttttgtggggagaggcgggctgtttttttcttgcggtttggtttgggatttctgaggagagggggtttctgccttgggtggggggggggggaggatttcaaattcgggagcttttcggtgggaggtttcttggttcttggtaatgcggggggggggggggg

SEQ ID NO: 54803 - DNA, 10612 bp, Oryza sativa
agactccccccccccggtgagtgaccgcccgcgcatatccgcgcggttctttttttgtgggaacaggccggcggggggtttcttgcggttcttggggttggcgggaattagggtttcgttggtggggttttttcatggtggctagggtttttggtcagatggagcttcggttggtgatttgggtgtttctttgttcggaattgcagggagggagagggcggttcgtttattggatgagccgtgaggaaattgggaggaagaaggcgtgatgtttactccgcaggggaaggggtggaccgggtggtcgacgccggctccggcgaaccagcggagcggtggcggcgctcccgccgcgtcggcgccccttggcaaggggaaagggactactctgcgggtcgccgaactggaacaagaggtgtttttttttaacccaaatcctggcttttctttctgttcgtggatgtagcttttgaattccaatctagggccatgtttctttgctcaccaaatgcaatgtgcggtttttcatggcatgctatcagtcgatgagaagtggaagcagtgaaattgagtgaaaaaaaatattagtgtgcctcgtgatttcattttgaaccgtaaatcatttgaacattccaattttcatttatttgtgcgaggccatttctgcacttgctaatgatttaaataacgtggtttcttatgaactgcttaagaaacagagcgctgcctagggtgctacattacattggtgtcattcttatgtccttttaataactcttcagtcatgttaatctattatttgaatataaaataggcttgtagaaactactgtaacaagtagttaggcatgcaaatacctacggaaggtggaatgttttatgtgattgacttctatgttccattataagcattcgatctaatatatatttttcttcagttcttatctctctcacgctggcttcctaaatcatatttactacagttgcacatccattttcttgtttgatcataccattagtagttattttcttttgtgttcatgtccgcagttacatgaatatcagtacaatatggggctgcttttgattgagaaaaaagagtggacagccaaacttgatgaaatcaatcaagcgctgacacagaaagaagagattttaaagcgggaacaagctgcccatttgaatgccatatcagaatacgaaaggcgggaggaaagcatgcggaaagcattgggtgttgagaagcaatgcgtaacagatgtatgttattctctaataatttcttactcttgctgtttatcagtatttcctaatattcgtaatgctgttaactgttgatgactaagcagttttttgaatactatactgcatatactggtgatatcatatactggtgatatgtaaattttatcacagtcatgaatcatgatgtaataatatctaatggtcaaatgaattggttgaataatttctaggttatggtttctccagccaatagtttttaacactgcattgtccttatgtttatgtttaacaaaagttctatgtatctgagcacacagcacttgtcatctgcagtcctttagccttcggaccatgtacttttgaacgcttcattcttgtttcttatcacttcatatttctgaactttgcagctcgaaaaggcactgcgtgaaattcgtggagagatagccgaggttaagtttatgtctgagaaaaagataactgatgctcaatcccttgaggctagtttggaggaaaaaaggttggagatcgagggtaagcttcatgctgcagatgcgaagcttgctgaggcaaaccgtaagaaatctcaggctgacagggatttagaggaggtagaagctcgtcagcgtaggctggagaaggagaagctatattttgaaaatgagtatggcattcttgcccgttttcctttgtctgtgtgctctctactgtgccaagcaattgattattgtatgtcattgatatgtttaggaggaaggcaggggaggaccggatcaagcgtcaggaggattcattacgtgactgggacaaaaagcttaaggaaagtcagaatagaattcttgatttgcagagatccctaaatgatcgagaggagagagcaaacgagaatgacaaacttttcaagataaagcaagaagagttggaggaagcaaaaaaagctctggagcatactaaagctacactcaaaattaaagaggacgacattaacaaacgactagctgaattacatttacaagaaaaggtaatccatatatcactgaatgccttttcctttatcctcatttcacattattacaaattgatagtggaattaaaatacatatcctgtttctattcgattataggaagctgaatcaaagaacaggaaattagaagaaagagagaaaaaaatagctgaaagggaagaaaaagtcagtgcaagggaaaaagtaagtatgataggctaatattgtgtttcttcttcaatatagttatacacttgatagcaatgtctagaccatgttggattgttggttgtgttttgttctaggtaccgtttggtaaactcgattttgtgttaaatatgtgggtttgatgttttatgttctctgttattcagcttgttccctgttttatgcattcactattgcataaagttgcttatcaattggtgcttttatctcttttgtgatctcttctttcaatataagtagcatcatgtccgtgtgttgcaatgactcctaaataaatatactatactctttcatataattgtaccaccaattctgttgcaggttgggcttcagaagcttcttgaagatcataatgtgaagcttgaatccaaaagacgagattttgatttacaactggagaatgagaagaaacatttgatgcaatgttggtacagaaggaagctgatttggtgcagagggaaaaagatgtcagatcttcggaggagaagctttcgaaaaaagaacaagtattaaatgaaagtaagaaaaaattggaagaatggcaaaatgatcttgatacaaaatcgaatgctctgaagaagtgggaggaatcactacaaaatgatgagaaacagttatcggaacaaaagctgcagattgaaaatgaaagaaagcaggctgagatgtacaaattggagcttgagagtttgaaagccacagtggttgctgaaaaggagaaaatattgcaagagcagaacaatttgaaacttacagaggaagagaggcaagagcacatcatgcttacagcacaactgaagaaagagattgatgaatacagaatgcgaagcaactctctttctgaggaaactgaagatttgaggaagcagcgtcagaaatttgaagaagagtgggagcagctggatgaaaaaagaactcacttggaagaggaagccaagaaactgaacaatgaaaagaagaatctagaaaggtggcatgacaatgaagaaaaaaggctaaaggatagagaggatgagttggacataaaatacaaggagcagggggaaaatctcgcacttaaggaaaaatccttgatcgataatatagaccatcagcgtttggaaaatgaggaattgctaaagagagagcgtgctgatcttcaacgaaatttgcagctccatcggcatgaattggagatggagatggagaaaaaacaagcgagcaaagagagagaacttgaagagaaggaaaatgagttaaataggaagatggactttgtagaaaatgagctcaaacgtgcagccgaattgaatgaatcaaagattcagaagatactattggagaaaaaacagctgcagaaggaaaaggaagttcttgtggaggataggcaaaaactggaaactgacaaggcagatatcagaagggacattgatagtctgaacactctcagcaagagtctgaaagagcgtagagaagcatataacagggacaggaataacctcatcgatatatttgaaaagtacaaggtgtgcaaaaattgcggggttattatttttgagggcttggatgccctagctcttaaagatagcactgatatagaatatcctagtcttgctgttgaggcggatgatcgttcccccaatcctgacaccttgcccaagagaccggagcacttgttaattcaggtggccgtttatcattgttgcagaagtgttcaaggattttcaagttttctcctaggaagaaggctgagcaatcatctgaacagcaagcagtgaagaacacagactttggtgcaagactagaggaagcatcgcagagcgatgatgattatgagccaactcctgtctatcaggtagcctataactcatttgatgctgaggatctcccatctgagagtggggcatttgagaatgaagaatctgaaaggcaagatatagcagatgacgtccagatggagtcttctcttggagttgcagataattgtgtagatattcatggaactcaatcatttgatggcaacacggacatggtggtggacacaactattgtggatgttgaccaaaacgggaaggactcggcagtgcttcccgttgtagatttggagcctgaaacatcaaaacaaggacggcgccaacaaaacaggaagggtagagcaaaaggtggtgtaaaacggacacggtctgttcttgcggtagttgaagatgctaaagaaatacttggtgagaatttagaagtaaaaaaggatgatggccagggagattcagttactgtgggtggtacacggaagcggcgctttgctggagccacaatcagtgagcaagatgaggacagtgaagctcattctgaaagtgtttcacttggagggcagcgccgcaagaggcgccaaacagctgcagcagttacgcaagccccaggagaaaaacgctacaacctcaggcgcaccacagtgtaagtttctgtatttatcccacgtttaatttctactcaaggttatcatcctttttttaactgacttgtggagtaaattgatttcctttttgctttattttgttggaaagtgcaaatgcggcaactgcagcccaaaccaacaaaaagaaagctgcgaaaaagggaagtaaacagacagtagaggctaccgcagatgacacagaaggaacctcaaaggctgaggaacctgccactgggagcaaaggggcctcccaatcagctgatgatgcatctcaattacccgagtactcgcaggtaagatccattctgcattgtttgctattctgtattttatgtaatactttgaaaggctttcagtatcttggatgcatgcctttctgggttgaggccaagctttctttttgggtttgtgtggcatatacattcaggatcacagctaactcgaaacttgctcttgttaggctgaagctggtgacacacatggccctgtagaggtcactagtgcagagggggtagatattgtggatggtatagatgcagcaccagatgcgatgcctatgacaccatcaggaagtgaacttggagctgaacaggatgatgaggaggacgatgactccgaaaggcggaaccaatcaattgggaaaaagctatggtctttcttcactacatgacaattgcagagggctactgaataggttatttctagcgtttctgttttcgattcatgacatgccattcttggaactctaggttgtgtgcttggtgatgatgatgatgtactagtagattttcccacttcaattatgttctccccctgtaattgaaatatatttgtagtagacatagctttgatgggcgctcacagaagttagcttttgagaatgtacaatggcgcgatgcctgtaactgtcaagggttgaggcttgtaattgttgttcattttgttccaggatcagtttacgtggttgaccaccttgcgaagtttgtggcatttgtcaacgcgggaagcttttttttttctcgtccagacgaccagattgtcttccatgtctttgtgcatcttgaattataggactttgttgactggcagttcttcagcttgtgaaatagggggctcaacagtggcatccaggatcagttacatgcaaagtttgtggcatttgttgacgctggaagcatttcctttttctcgtccagatgaccggattgtctagcatgttcttgtgcctcttgaattagaaggcccttctgttgactggtagttgtgcagcttgtgcaatgtcttatcagtgctacctccatccctcccagtaatacctctattccagatttttaggggtaaacatgattattaaaaaaatatatgtagatttaaatggagatgttgtgattggatgagaagtataatagatagaattaaatagagtaagtttgtgattgtatgcgaaatggaaatatatggtgtaattgaacggcgtagagccacgagttgggaagagaatgttagtgaaaaaaatattatattttaaaataaattttaaagattaaaaattgctatatttggcaggagtagtgtatttttggcttgtatatacgtcagctgtctgggccttccaatggacgtctgcttcgatgcaagcaatcgccggtcttctggcttacgcggctaaggaatatctatgctggactctttgcctttgtccctaaggcatgctgttctgttctgttgtgatattttctttttctttcgagacggtttgtttgcagcatgtgctcactttcatttggcgtatctacgctagcctaaagcaaatgcatgtatgtcatacccacaagtaactacaaattctcttgacttcaccttgcagtatactaaataaaaaaaattgtctgtatttccagccataaattttgcataaacaaatcatatttaccttctaaaaaagaatagtatttccagaaggaaagcacatagtacttcaccaatcttttgcccaaaaaaaaaacaattgagagcaactcggtgtcccagtctagtagctttgtttcttgtggctactttggaacgcaaaaaatctcacaaaaaaatatttttcatataaatcagtttaatacctaaagaaccccagggggaattcctcaggagtacgcctaaaaatacatatgcattgttccaatatttatacgtgttaataaaataaaataaaataaaaatacgtgttaaatatctcattatcccatgattcttaccaggttataggactccgtatagcactttcgtatggtgttgtaatcgcttcattgtccaattttatttagacgtaagcaggcagtactacttatgtacaggtgcggagagttgcatcgggagaaaaagcctactatatgataattcgacggatttgctgttaaatccgagttaaccaaacagaagccgatcagagaccctaccctccgccgatgcgtcgagaagaagcctccgccgccgccgccgccgccgaggctgggaccccgcgctcaccggacctccacgacctctccgacgactccgactacgccgccgccgccgccgcgtcctccagtcactcggtgcgcctctctcccccaccactcgtgtgcttcctgccgttccccgttcgcctcgcctcgcttgctcccgacgcgagcgcgcgattcggtcgcggcgcgagcgaattcgctcgattaggtcgatgatttttgttgggaggttttggggggatttgggatcccgctgctcatcagatgttgttggggcatcggggttcgggggtagtgctctagttccgcacgtaactagttcggcagctgtcacctcttcctccgtacattgattggttttattggttgggtgggtgtgtgcgtgctatggatggcgatgaatgatagcctatgttgagttcccaatttggattgaattgacgttcgtttggttgggtgaactgaatttggtgtttgtttggtgatcgaaggcgatgcggagcgatctggtggatcaagggtcgggcgagacggcgaaggtggatgtggtgtacgagaaggagcgtgtgacgatccacccgacgcagtatggctccggccggatcagcgggaagctgcgcctctacttgcagcagggctccctgttcctggtgagttagaaccccagttagtctgaattgttgattgttcatgaatttgtggtaggttttgatattattgttaccacatttgctgtgaggattgaaccatggtccttttggcttgatggccagggcattcgtgttgctacttgaattatatgttggttggcttatatatctttgcttatcattgtactccatatatgctaatgatacaatatgctactattcctgcatagacgtccttccacattttctgctaaatgtctgatattagaacaagagaactgaaattgaaaatccatatgattgttgttggttggcacctgaatatggttttgttacacatgacatgttatcatattggtacccaagttgcttaattttcttcttcatttgcttatgtctttgttcaaatctgtgtgacagagttgggagccaaatgagggagttgattctttatcaagcaattcagctaccatggaaatagaaaaatgtaggaacaacacaatatatttcttttgtcatacttggtaattgaagtgcagcagtgattacacttgactctttctttacttgcctgactatgtacagatagaaacctgtacactataaaggccttgccattaagtgatgtacgcttcatccgtaagcacaccccgacatttggattcgagtacataatcattgttctctcatcaggtgaagtgctcttctagttgtttgctttcttgtggttagtttgaaactttttggaatttctatagtcacggtgatcactgatcacattagcttttaggtactttatcttacaggctcattgcatttctgcttcttctagctacataatacacatgctgacaaaaatgaaaaaaaatgatttattgtattgatgtatcttttcaagttttgcaggattggcttttcctccattctatttctacaatggtgggcttcgtgaattgtttgcgacactaaagaagcatgtttttattatcaggttttctttctgggttcactctaattaaataattagtcaagctgtcccttgtttgttagtgcctaaattgctcattcctggaaatgcaaaaattgctatctggattatgagtggactataagtgaaatctacatacaacaaatctaccaagtatatccataactggattttcaaagcacttttttttccttctatatgataggatactgtcataaatatttaatatttatgatctaattaacctacacttgggaagatgcttcactggacatttcaacatatctaggagcgtttagtaactcagcctacagaaaactaattaagtaatggagcattagagtgtcatactacaaccaatcaaatgtttacagaagtatcttttgctgcatatatgattggattttctctactctatctcaaggtcggacgatgatcctaatgtatttcttgtcaacgactttcaagatcctctacaggtatgttattatactttcttgtagccagacccataatttctttaagaccaccatgccctcaatagaaactttactgtccttgggaatatgcaaaacaatccttttagtaggagtcccttgtaaagctatatagtcatctttgtttagaagtccatgttctggcctatgtcttgcataagtttaacttagaacgattacttacccatgaacctcaaatccactttatttgatgccttatagaaaagtttgtcatcactggagcttcctggtgttgccaccgtagcaaatgccatgtcacgacagaactcactcagtttcactagttcagttgatgaagccagacatgggagtgatgccaaacatggggcatcttctagcatgactgaatatgtctcaaagcaaaagcacagatcgaatgatccgggtcgtgatctttctatccaagtactggagaaattttctctggttacaaagtttgcacgagataccacgtcaagtctttttcgggaaaaccacagtagtggtggtcatacttatggaaggcagcagcaagaatatgttttggacaacagagcaaatgataagtacaaagatcagcaaataacaccagataaggattctttgctgtcagattcaatggaggtaaccatatctttttttctattgttctttgttattcgtccactacaaattttggaagagagcaacaacagaacaactttttgaagcactcacaagtcatggagacaagcctttaaattttactgttatggttaattcatttttattctaattttttttgtctgaaaacagtaggggatgcacctgcgatatatataaaagaataagtaatacatacagagagagtaaaactaaaatacaatttcatattcacaattaggattaaggccatctgtaatgagaagaaacctaagctaaactagtattatcttctgtcatctgctcatgttcaaaaccattatctgccaacttcctttctattactagaggtagtattagatgtatcttctatgtattatttagcacatatttgttgtcactttagttggaaaacttaagggctgcaggaatt

SEQ ID NO: 54804 - DNA, 9655 bp, Oryza sativa
gcaggattttagtggaactcaggaactgttgcctcataatttgcaagccatgcttctcctggcaggagaattagcctttagcagatactgtatatttgatactaacaacttgttttctggaggtataaatagattgaaagggatagttacatggaaaattattccttttatccagtaaacatctagttatctgatcatgtcaagcagaggagcattgtgctggatacacacatgaaatattgtgctgcacacacttccattagtgaaaagatttgttttaccaaatggtagtttgacctttttcttcaactcaacggaaggctaagatttagtctggcattttacattaattaagaactgtatgagtttacgctgcacataatgtctttagtttcatggatcttctccaccaaccatctaataattatcatgtattgatcatgttgtaccactgttcctctcagaaacgtcttatgtttgtctgaaatttttattgcacagtggagatccttcttagatcctgaaggtagagttatggattcgaaggcgctgaggaaaaaggttttctatggagggattgaccatgttctgagaaaagaggttttatacttaactttgatttgctataaccactcaacaaggcattcttgtacatgagttttgatgtttaatatgtaggtctggaaattcctgttggggtatcatgaatacgattcaacatatgccgagagggaatatcttgctgtcatgaaaagaacagaatatgaagccataaaatcccagtggaaggtcagtcaaggttcataggttcaatgtgctgcaattcagtgtgcttattaatgctggctaggacatgctactaccatatatattgagtatatttttaaagtagagctcaagtgatgtagactgtcatttgcttttgctcagttttgttagatctgcggtatgtgattttgcttgatgggagcaatgtttctggacatatgattatccatttgctgttctctttatccctaagatcatgctgatagtttgcagtagtaacattacaaatgttaagacactttcagctgttcgtcataacaacaattcatgattcttttacattatggcatacattactcatcttttacatgactattcatgaatcatgattcttcttgatatattatttgcagagtatttcgtccacacaagctaaaagatttaccaagtttagggaaagaaaaggccttatcgacaaagatgtggtatgaatttgtctacttttttttctatctgaacttttcctccttatttccattttagcttcctctctgaccactttttatttttaactgatatccaaactgatcacttgttttaactgttttttggatatcaaggtgaggacagatagatcagttccatattatgaaggagatgacaatcaaaatgttcttgtgctacgggatatcctgttgacgtattccttctataatttcgaccttggctattgccaagtaagtttgcacgttctattacccttcacccgcaattatccaacatcagctgatgaagaaaactgcctgccagtttaagtcatttaagtgaaaaacactgcatttgctagaaagcttccactagatcacataaccctgattcttgttaaatataaggaatgtatacatgctgaatcacaaggcactgcagaatattcatttgttttgtagccatattattacaagtgacagggttaatcatgctacactaaatatttagacctataaagcatgaaatttcgttgtctaggtttctttgtttgtttgctcatgcagcgagcgctctttcttccagggaatgagtgattttctggcacctatactttatgtgatggaggatgagtctgagtcattttggtgctttgcaattttgatggaacgactaggagccaattttaaccgtgatcagaatggcatgcatgctcagttacttgcattatccaaggtattttagaattttccattcttcgagtagataagcagtatcatagtatcacaatagaatttttgttaatccgcatatcctgtgcaaatcttgcaaaaccgttgtgcttaagtcatatcgattgattatgtgtgtatcatttgttatatggcttcattaattgccttcaatcatgcgatgtggccttcgatattatgccaaaaatacatattatatagattgtaaaaaaatgttcaagtgacaagcagttcatgtttatacttcttaaacggcataaaaaaaatcccctctttagttttcataacttttcattattccttattctgccttcaatccttaccatgttatgattatccattatacaaatgtgtctgacaaacactgccagcttaggtgtcagaataactacttttatcaatataggagtattatactttttgtgactgcacaatactaaatttatgtgaaattttctatgtacctcatgcagctcgtggagcttcttgatcctcagttacataactattttcggaagaacgactgcttaaactactttttctgttttcgttgggttcttatacaattcaaaaggtaatatttctatctttccctatttgagttgtatgcattttgcaccttaaacagaaaatctaagttttcgtctttagctttgtaacactatattgctatgttctagttccctgcagagcccattatcttatatagaatccataaaaaatattgaaatctagatgatgaattaatgaaattctctgtagctccaatatttagctacattaagcaaatctaattcctccaaaatgttctcccgaaaatggaggtgcattttgtgtctaagaattagtgacacggattttcaccaaagattttgcctagaagcatgtttcattgttcacacctgttgggctgtaacagactgtatgatagtacgctgctgtcacgtatatcgggtaaaaaccacaggctagtaggaccagtaccttcaagttaccttattagttggtcggttggtccaatggcatcaatcatcgcgcaacaattttgaaagtttatgagctattcctacctttattaacaacaaactgcttatgagctggtgctcaactgaaacctgtaaacttttgacatgaattcaaacctgggttaacctgcaataccagcaccagtggtaacttgtctagaagttaattatcttctgctatctactatacgattttaattacattagtttgctaagaaattttacactgcatcattaatgcagtactccccacccaagcacttgtagaggaaaatgcagcctgcactccatcccctctaatagtctaattaagttactccaatttcttatggattgcagggagttcagtttcgatcaaatcatgctgctgtgggaagttctgtggacacattattggtcagaacatttccacctctacttatgcgtcgcgatcctgaaaaggtaccggtcgcggataataggagagcagatggatttcgacacccttctcaagttcatcaatgagctcagtggcgagataaatcttgaccgggcaattcaggacgcggaggcattatgtgatcaggcaggccctaacggggctgcctgcattcctcctggaaccccgccttctatgcccatcgagacggacggtggcctctacgtacaagaagacgaggtcatgtgagataccggcgattcagtggtcacctcatacgacaactgccatagaaagcattgcactggtttccataattccattgggtgcttggtacgttggtatatataaattatgaaggtgatcaaaataatgaaatctggctgttgtatatatgtacgttgaaatatcagttctcgatgaacccaacaatagttaacacaagtctcttttttttgcttaatggaaatggattgtcttttagacgcctatgtttggcttcactgcgtaaatatataatattatgtcacgtgatacttatcaactggcaaagttttgcagttgggtatttggataccagtaaaatcgactgtctgagtacgatttatagccttcaaggctgtttggactgaagtgatgttgagcacgtaattcgtttgtttcacatatcctccagttctctgctcaactataatccagcaaacctgcgagctgaatgaacacaaagcgaccttgtgaatttgtgatattaacggccattaattttatgtggctctgtgtagcttagcctgcataaaaccgtgatgatattgttttcgtacgtgtcttcctctcgcgtgataatcactctgttgggaaacaccacatccacacgttggaattctaaattcgtttcctttgcatcattgcacgaattgggatcacatgcagtttcattgcactaatctttataatttgtgctttgctctataagaccaccctatgtttgatatgaataaataaaagacccaacaaaacacacaaagtaacataggctagaggtcaacactaataacgcgataatgaaatcgtggatgtgggactgcacccactatagaatctttttaaggatgtgttagagacaacctgtttttttcttaaagataatgtaagttttttttgaactcagtcaattacattaagattaaggtgatataatttttttagaacactttcagcctttgcattactaaaatgcacaaagccgagcatataaaaccacactcaaaaagaaaaaaaatgacatagagcgttgagaataaagaaattcttggagctatcattttcctctagcattaataaaattcattggtgttaagaaaaaacttcttgtgggaaggttggctagagatttcttagaaaaagaccagcccctgcaaaggcaacagtctagaacgaggaatgagtggaggcgagcccggatccagagatagatggatgaatggtgtcgattcaagggttttttctattaattgagaattaaaatgtaactaaatagtcgagtgctattgagggccatcaattcaaagactaaatcgtcacccatgaacaactccttggccccctccttcaaaaggtcggagtattaagagccaccaatccttacgactggatcgtcattcatatccctaggtaaaaaactacttgaccaccttctccaaatgtagacatgccgcaaccacatccaaacacaccgcagtcactagatccgctgcatatggtaggtgttagtgtgtcttcggtgcatttttttttaaaaaaaaaagagaggaaaagaacacaaactgtggggaaatatgttgcgtcaaatgattttttttcttctaagttcaaacatgcaaagaaagatcaacaatatcaagaaactgaaattgccctcaaaactcgtgaaacattgctagccccacatccacacgagctaaacgcttcgcttgcctttaggaacaaagcggaatcttaggttggatctctcggtctgttcaaggggctacactgtaaccatctatccatccatgaacccccgacaagcaatcacgcagaagttcagtgtccgggcaagattttatcaccctgccccacaaaacattctttctcctcttcttgtcatggcaatgcacaccttttctcgagaaattcatctccctttccctcttgtcgccgtcgtcagatgagctgaaattcagagctttttttcaggggaaatttcagagttcgttcagagtaaattgctggtggctggatatgtaatgtgttgtgacgacgcactatgactatgctgtttaaaaatgagaatcgtggactatataatggcgaataattagaggtttgattgtgagcttccagctcggaaggcaactgacaacttattaaagaatttccttttgggaggaactaacttgttaaaccaaagacatctcaagcagcagcagtattaaactattagttaagaactgtggataagttagctgcacattccaaggtagtccttaatccaagggttgaggtcccatgtagtcgtgcacaggctctaataactgaatcacactttctgaagaaagacgattaccatacttgtacaacttgtactaaaaggtgtagttctacaggtaattataagggcaagttttatagtagaggtgactaccacatccaatttcatgcataacatatatcattaaattaagaggtaacatgtattataggttacctctatcatacaatccccaatatctctaacactctcacatgtttattgaagtttgtgtaggggttgccccttgtatgagaggtaactatttctctctcatatttcttctctcctccacctcattatttactcctatgtggcatcttggggcttatgcttagatgcccatagtacttgccctaagggcaagttttataaaagaggtggatgttgcatctaatcttgaccacatcatcaactaataaatgtagaggtaacatgtacaatatatcacatctatactaattctaatacactagccccaatgtttgtttgcccaatctactcttatcctctctccttttgtcttgaattttgtctggtggttgcctcttgcatgagaggtggctgcttatctctctcatctcttctctcctccacctcactattttagcttatatggcatttagaagattgtacttggatacctatagtacttgtcctaaccattgttcttttggcgtactgtgtagtattcagtattatgaatttgccaacttttgtctcctggagagcagaatcgtcagccttttcacttcatgagcaccagattagggtaatcaagacaccaggttagtactagtattataatacctgcatgtagaggatgatttgtaattgtgttagtacaaatggacattagaattttaagggtacaaagtgaatgtttgtcaggacatcatgagtgaaacttgatgggaatactggaatatttccactctttgtatgtgaaatcctgaggcaggattggacatcgggctatgacgttccctgcatgtgcagaattccacttctgaaaaagagatactccagtaaaagtcatgagattaatcagtggctactgccactagcttagcttagcagcgcttttgtctttaagctgtggctaggctatgacgcgaggcctaaccctgattagaggttcggacactaacacggtcggccatgataatctgttccgagcctctgtgatttctgtatcctgaagcatcacttccttttgtttcaatcggttcatttgcagatgtaggtagtttcagtctcgttgcagaacctttccccctcggatgaacatacaaaagcctataatgcgtcctcggagacctaagcttacaaaaaattgcaagttgcatactgcccgctgccctcatatatgcgaatatgcgatagattgtccaattgaaaagacattttttttcgaagatacattggagatttggagataggcgcatagcttaattagcatggagccaaagaaattttcagagcctgggcaagttgtcattcattgtacatagatgcatcgtaccaagattttgaatacatgtttcactgaaaattccggtgttgcaaagtgaatgtagctattctcaactgtgtagatttttttagtgggatctgtccatccggattcaactcctacatttagcataaacacgtagggatagtatgtatgcataccttatgagggtgtgcacagtgtgcatgtgagtgcaaaagaatattgccgcttttttcttagcactacgtcattgatactaagggctcattctaaactacggtttggataagctaataccttgatttcgttagcaagtttttcaaactaataaacaacatgtttcgtgtgaaaacttcctatatagaaattacttttaaaataatcaaataaattcattttgcaaatttttaataattagtattcaataaatcatatactaatgctcctcgctttacatgcaactaataatcaaaaaccaactcctcaaaggtttcgtggtgttcttttctcctgatgaagataagataaagtgttttacataaaacaaggttgtattaacatatgattaattgagttttaattattacaaattaaaaaaatagattaatctgatattttaaagcaactttcatatataaaatttttccacgaaacgtaccgtttagcagcttaaaaaatatgccactgagtatccaaattttcatccacttttttcaaaaccggttaccgacggccgacggggttaccatgctgtctcacaaaggcgtgagctaactaacttctttgtcaatccgacaaccgcgcatgcgcggccggctcatccattccccagctcaccgccgtccccacccctcccgttccgttcctaaacacaacacaacaccacggtggccccccaccacggccggccgaaaaaccagctcgccgccgccgcccggccagccggagtggcgtgcaagcgacggctttcccctctccgccgcagcaaaatcctggccgtaacagcagtagtgcagtacagtgcacactccagtatggcccaaacagcaacctgggcctcctcatgacgtctactctctctgtcccataatatagcagcctagtactggatgtgacattttatagtacaatgaatctagacatcctcctgtccagattcattatactatgaaatatcccatccgatactaggttgctatattatgggacggagggagtattcatttgattgggccatgctcctgggtagacctggtccaccgccctggtccatgaaccatgatgcttttgcacagccaacaagagaataaagttttttttttttttagatcagcaggagaataaagttggcatggatgaagggaaagaagtagtaaaagaagaggaaaggcagaaggaaaagggaaaggatagttccactcttaaaaaccctaatgatgaggaataagtgggcttatgagataaacaaatggctaaggccactttcagttgtgtgacttgtgtcttagctttgggacaaaagaaaattagagagagaaatgttttggtcccacgttgttgagagtatttaattagtgatggaggaccatggtttggaatatatagttgcaaaacattggttgtaatgaaagagatctcacttagtacaggcctttgtgatctgccaaaaatatttttcagatgtcatttgcgaatttggtactatgtttaatttttttgcagagtggccgcgctgataatcattggttatgcttagtgagttcggatgatgataaagaaggtttaaacaaagacaaaataatatagcattacattttcataacaaggacaatcatgattcggaaatgggaatctactaattaaaggttccatccgttaggtttggtacatcaaaatctctgtagtttattgcaggttatcttcaagtgagtaaaccttcagtcttcttgctcccaattaaaagaagatgcagaaaaaggcgatatatgtatcttaccatctggtttacttcgctatcacttgttcatagtttaggacaaatacgaccaagtactaatttggttatcttttcttttttttgaaagaactcagcaagctggttttatattatagaagaagtgagagaaactgtacagaaca

SEQ ID NO: 54805 - DNA, 3309 bp, Oryza sativa
acctgctgcatgaaggggcactccatgaagaggtgctataccgtttcgagatttctgaaacagagttggcagaaatagttatttggccagcccctgcattgcaaacgatctgccgtccatattctattttgtgccagcagccacgcgaagaatttgtgtttccctggtgcccaagtttccatacaagctcagcagaatccgaaaacgttttgcccatgaactgcatgacatatgctgattttgccgtatacaagccactggccgaccacctccagaggattgtgtcctcagccccttcatggatcacctctcctgcgttgtggagcacttcccatacgcatatatattcctgaagcagctgtattgtcacccctccgcggatgtcttcgatccaagcatcattagttattgcctcaagaaccgacctgtttttccttttggagtgtttgaagaggtttggggctaggtatttcagcggctgatctcctatccagttggattcccaaaatttcgcctttcgtccatctccgaccgatactttggtggcagcagcaaacagagcacgatcggtgtcatcacagggcggcggggttcctatccatgtttttttccgggcttgtccactcataccagagccaacgtagcctcagcgatcgtgagaacttctccaaacaaggtatgcccaatccaccatgtattgtcggagaacatacttgctgccaattcactttacattttccgcccaaactttcttggtctccggcccaaagaaattttcgttgcgctttgtcaacatcatttaggaatccttttggtggtttaagaacggtcagcaagtaggttggaatggcattgagaactgattgcacaagaaccttccgcccgctttgataaaccagcttgtttttccagccccccatccttgctctgattttgtccattaccggctgcaaatggacccgctttaacttccccgtagtaagaggcagtccaaggtaggtttggggaaaagcacccagctgcccatcgaagttttgagaaatatcttggagatctatgtcgttgcatcgaattggcgtgattgaactctttgttgtgtttacctgcaggcccgtggcatccccgaatttgttcaggattcccaatagggtttgcacttcttggcgtgaaggatttaggaacactgctgcatcatctgcatagagagaggttctgaattttagtgcccgcggggctacgcttgactaatttggttatcatttcaaaagaacagaaatgaatggagataagttaaaagtagaatgtttatctcacaactgacactaaaactgttacttattttggttggccatgagttgtaattcctccatagtattatacttgctctgagatgctcttcaatgagctaataaagtgttccgacggcaaaacactatcttcagtagacagtgacacttaactgaaaattattgagcatccttgtaactggccgtcagctactagtattatatactggactaaggtaaggtgaacgcataaaagtgcatagtattttttaagatgcatgaatttattagccatcagccaatgaaccaaagtttcagcatagattagcaaagacattatgaattagtcctgaagcacacagacgtgaaatgtctcacaaacagatagtacagcagcatcagtgcatcacaccaatgtttaccagattgatatattaagccccccccaagtgatcagtaatactgtacacaccttgacacccttcaaattacatgaaacccaagaaagtaattaacacaagccaaactatgcatgcatggatggatggattacgtacaattaattgcaaacatcaagatgatttcttctctcattttttcttttcgattttgctccatgatagtatgatccatggtcagactctgagcaggtagatgctgagctccgggccgccgctgccgtcagggttcatcatgtagaacgcctccgagtccctcgacccgaccacccgctcgaacctcgcgcgcatgtacatcaggtcgccctcctcggcggcggcggcggcggcggcgtcgtcggggagaacgccggcgccgacggacaccggctcgacggcgccaagaaccctccactcgtcggcgccgcactccctgcgcaccgcgaagccgcactttcggccgttgcagtaggcccgccacgtcggctcctccagcagcgcccgccgcttctcgcctgtacatggtgcaacgcaacgaacgtcgccggtggccgacaggccggccgtcgtggtgttagtgctcgccggcgctgaagaggatgaaggttgattaattcgtgtgtgtgcgtgtgtgtgtacctgggttgattggttgcttctcgcactcgagcgcgaggcggacgaggccggaggacatctccctgacgagcgcgccggtggagtaggcggccatctccaccagcagcaccggcggcgagcgggtgtccgtctgcagcgcgacgtgaacgcggccgcggcgccgcccgaagatggtgcccgtcaggctcgaccccagctgccgccgccgccgccggtgcgtgatcgccgccaggaacgccgcccgcagcctcgccagcgcgtccgcgcgcttcctcgacgacgacgacgactgcacctcagcaggctccgcggacgacgtcgcggagaaccgcgcggccctcgtcgtcgtccccatccccgccgcctcatctccacctccctccctctcctgtccacctcgccgctgcggcgacggcggcttggcgcccagccgcttcctgctcagccacgggaagttcccgcctccgcctccgccggtgccaccgctcgccgcggccgccctggagctggaggacggcagcggcagcggcgaggccgcgcggaacgctctcgccatggcaagccacacctccaaagcaaccaagcaagctaagctagctagctctccctcgacttgtcccctgcgcgcgcgcgcgtgcgtcccgttaataatgggcttttgctgctggctccaagcccaccagtatttggtagggggtttttaagcgggttagaacaggtacaatagcagactataagctagctgtaaacatagtttaagaagataaataagaagagagaaaaacatcgggctatagatttgtagccagctatagcacagactttaagatgcagggtgtgtatgacaggtgagaccaggtattaatagtgtattatataaatattgtatgaatgagttattagattagctgtatatgaattggagttagtaggtggctataatatta

SEQ ID NO: 54806 - DNA, 3274 bp, Oryza sativa
cccagctagaagccggcagccggggggcgtcgtcgccctggctgattggtcatatgctgcattgctgcctcgtgtcaaatgcatgcgtgcaaaaagaatgaaacttgcgtgtgtgcgccggtgcaaataactcggctgcctactgactaacgggcagccatggatcgtgccaaggaaacggaaagcagtttggtgcattggtactgtaacaaactactagtagcaggaggaaaccacgagatcgttggaaggcagcgggtagcagtgcaggcgcaatgtaaattatggtcaggtgggggtagtacgtataggagtagtaggcagctagcggtcccggtgccggcggcacgcgtgaatgcgtgataccggtgtgcaggggaggggaggggagggggccggcgacgttccataaataaccttcacctacttgggcggcggcagtgcagatcagatcactctatacgtacgggtgtgggatcgccgggttgccatataaacggcgagacgcatttggaggtcccttggattaaaatgggttaattgaattcatatattaaaaatttacaggttttaaaaatactattactatgtactccctccctacaattctaatattgttgacgttttgggatagaaaccaaagtatgcaatttttttgaagttttaggccctgtttagatcccactccaaaatttaacaccatgtcacatcgaacgtttgaacacatgcatgaagtataaatataagctaaaaaaataactaattgcataaattgcggctaatttacgatacgaatcttttaagcctaattgttctatgatttgacaatgtggtgctacagtaaacatttgctaatgacagattaattaggcttaataaattcatctcgcagtttactgaactaattagttttttttattagtacccgaacaccctatgcgacaccctgtataatacccgatgtgacgcttcaaaactttacacccctgtatctaaacacccccttagtctctgcctaagccctgtttagattcaaacttttttctttaaactttcaactttttcatcacatcgaactttcctacacatataaacttctaacttttccattatatcgttacaatttctttaaacttccaattttgatgtgtaactaaacacagccctatatataaagaacttacttgctcctgcatgcatgcatcccattacttcagagtgcttcgtttctcgaagataggttccaaaccacctaggatatacaacttgttgattccaattagcacaccggcacatttaatatgggtaaagtagaaattaggcatataataaatcattccttggtacgtaagattatgtctaaaacgtcaattaaattagaaccggagggatatctatttatagttatgctattaaaatttaatggttactcaatacattcatcataatatttaggtcattttgttctcgtctctctgtttttccctgttacctctctctcatttctagtgaacccgacctgatgaattgatttggattggtgcccattaagacctttcctaccgccggctatgtcactacgctgcaaaacaagatatcttcagctgattttgccgatgcatatggtagagaaggtgacagacaggcaacgggcatgcatgctgcacatggcaccaccgcagctgcggtaactagggttgaggaagctgaagagcatcccctgttagtacaagtacgacatgagcgtgcattgccagatctccttcacctccgcctgcctgcttgccttacagctactcgtgtgtgtcgacctcacctgtcatcacgatttctcctaggaaatgcacagcctctcgccgcgacatcccccgccatgacactacctgtcactccttgccgcctcaccggggacccaggcatctagcgcacgtcacaaattttcaagagaaatttgataaaaataccacctaatactcgcaatttggttatttaccacctaatccgtacgttttctttaatatgcaactagtattgcaaattgctctattttgataccattttttcctttttttttcttctcgggttgttggacatttttatccctgaccccacatgttgtatgaaaggaggtttttattacacatcgatcgatggaaaaatatatgatggaaacttagaaactatcgttggatcaaaatatgtacgtctaagatttatccacgtcatcactgagtaaaaatattactcatgagtaaatctaagaataaaatttttagttgtgatgacttggacgaatagcatccatttttcgattcatttgcactacacatgtggcttgctatacatattttccctcgatcgatccattcaccgctcccgcgacgccaagcgttcgcaccagcggcaccggtctcgccgccatgcgcccaagccgccgagcgctactccagccaccggcccatgccccatcccgcgctgccgtaggtacaaatttataatggcatgggtataattaacctaaaaaagcagacatttgtaggaagtgcagactgcagacgggtaagaaccctagaccagatcagagttttagccgaagtgcgagaggatagagggaggcggcgcgatcattcactaccggagcaccccttatgtggggcgcttccacggcttcgtgatgatggcggctagggctagggccaagcgtaggtaagatacagatagggagttctttgttgatgggatcgaagagatggaggaggagggtacaactacaatgtcgatgccgtggccatggattgtcaaataccatggtaaactttaccatccataacttgttatcatgggatttgatctggaaattgtaacctaatcgatgcaaaatagctaacgggcaatcgatcgcccctagcgcgcccccctcttctccacgtggtttccttttttgcaccacattacttttcaattttagtaaatttatgcacctaaagtttgtacacctcaagtttacatatctaaagtttagagacccaaagtttataaatcaaaagtttatatatccgattcaaatttgaatttgaattcaaatactttttatatatagtatttctatacatctaaagtttatacacctaaagtttatagacccaaagtttataaatcaaaagtttacatacccgattcaaatttgaatttgaattcaaatattttttatatatagtatttctatacatctaaagtttatacacctacagtttatagacccaaagtttataag

SEQ ID NO: 54807 - DNA, 3045 bp, Oryza sativa
tatttctatacatctaaagtttatacacctaaagtttatagacccaaagtttataaatcaaaagtttacatacccgattcaaatttgaatttgaattcaaatattttttatatatagtatttctatacatctaaagtttatacacctacagtttatagacccaaagtttataagtcaaaagtttacatacccgattcaaatttgaatttgaattcaaatatagtttatagacccaaagttttataagttaaaagtttacatacacattttaaattttaatttgaattcaatttttttatatatagtatttctatatataaattttttcaactttatttttttaaaaaaaaattatggtgtactgtagtaggaagagaagaaggggaggaggaagggggagaggaagagcgtatagggggaaggacaggtgatcgctaggaggatagggaagcaatcacccgcccactagcaatatcctaatcgatgtatgtattcccccgatttttttttattttttagaccttttaatgctttgattttattaatagactttctaaaagtatttttaagaaataaaccttttggccacgcctgcctggcagtggcagggtggtttggccatgccagctacagtgcgtggcagacaccggctgcgtgtggcgtgagagttatttgggcaccaaaagaaagattcatttcttgaaaatacttttagaaatggtctattaataaaattaaaacattaaaaggtctaaaaataaaaataaaattatattcccccttcacccttttgttcgttattgatgaaatcttagcgtgctgatgtgctaaatttcttaatgctccttgactttctattccgcccatgcccattaccttttcctgttagcgactatttccttaattgtttttagtcttgttagggcatgtacaatggtctttattagcggtctctttttattgtcatgcaagcatatttggtgacgtgaaagagagaggaagaaggaaagagaaagatagttgctacacatgacaacggcatagagtcgactcttaacatttattagaattttttttgttgcattaagtctaataaaggaaagataactagtaagaaagtattttggtacattaatagttagagaccgtattgttttaactattgtaaacgtgatagtctctaattaatgaattaacgtaccggtctctatctttatacttgcccttataatatttttgatgatctgtttggcaaacatgataagtcaagagcttaccatgtcaatgatttcatctttttttttccctttttgggtagtttgtactgtttggaaagatcttttggcgcgagcattgggatggaacaaactcttgctcacaaacttgaatgggacaaagatcttatcggtatcgataacagatcacttggatcatttcaatttgcgatacggtagctcatggcatttacctatatatggtcttagtgcatttttatatttttgaagaattccatctatttttagataatgtaccaaacttgtttttggaaaacaaaggcgtaagctctgccttagagatacacatcgacggctcacaccgaaaacaccatcctacaagaccaaacttagggcccctttgaaaagcaggataggaaaaatacaggaataggaaaaacgtaggaattgaagttgtatgtttttccaatcctacaggaattgaaaacataggaaatggagagaagagccatttgattacaccacaggatacactcaacaaaggaaagtttcacaagaggtctaacctcttgcttattttcctatggaattgatcataggaatacaatcctatggaagttttcctatcctcttcctatgaatcaaagggctctataggaaaaaatccttaggaaaataaatccttcaaaattcctttgctaatcctccatttcaaagggacccttactctcaaaatgcaaacacggcaagcatagctcaagcttttgcggtcttcagtcttcaccagccagttctgctctcataagcaaaaaccgtgtactagaacacgtggtgataaaacttctttgtgcataattttcatgtcttagctcactattgtattttttaagagtaattcaagcttttagcaagatgtacgtatatagggcatttagtttattgtggttactccatcgatgttgcaacttgtaacataatctccatactggtggtatggatgaatagtgctatgcctgcatgactgcgtcctttgcttacctggttacttcacttacccttttagcacaagcaagaagacaagattacacaagtcttcaacttctagcaatgttgaataaatgctggtcattagtcgcacttgctgcgtcacaagtatatcatgaaggaggcttcaatgcttcaaagggtaccaaaaaatagcttccattgaatgagatcagatttcgattacatacaggcaatcaatgaaaacgctatggccgacgactgctcgccttgatcagcaaaactgcagcatgctaaaatggtatttcccagctgcacaagagctctatttcgctaacaggaaacgacaccacaaggttaactcatctaattctatagtatgtacacggtgacatgggatacctatacacgggatggggctaccaggtctaaatgttagttgccaccactatctacaagcatcgactagaaaacatccagagtcatgcacggcgatcaaatgattctgatgtatcaacaccatgcctgctgacagaaagattgcctttcctgtcacgttaggaagcaatcaagcttatgcggttgcatgtagcgtctgatgaagcccagaatgttcaggttcaagagcagagctgctgcttcatatctcccaggtaccggcatattgctgcagcaaacacctgaaatggttgcgaggtcagttagctgaatccctttatttgcatccgaggcaagctttttgcaaaaactaattccagtttggagccggactaaagcattaaagtagcactgcaatattctcttg

SEQ ID NO: 54808 - DNA, 10218 bp, Oryza sativa
ataaggctccaacactaattcacatgatatctcccttgagttaacataatctgttccacccactgattcatgcatgtagatattgtaagcagcacggcagccccgtgtcttgagtatcctcattccaatgtaaaacatagaagagtcatggctagattgatagttccggaaaccatttgtctttctagaaaaaccaacaccctggcaaagcatggaatttgtttatatcaacatcatagtgaaatctccaagtacattaacattcaggatggaatatacctgcgtaagggtaataaatacatgtacaggatacagtgcatcccgtcctgttactctaagccggtactgaggattttgatgccatgagtcataatcttggcaaccacctgcactataaccacgccattggccatggacagagtaacgcatctcgggtggataaacacgacagacatatattgaccgaaagtggatctgaaaatcttgccaagacatccagaataccccattctttgactgcaaaaacaaatatgggtagggtcaaaactgcacacggaaataaagttgggaaaatatattttgtttttgtaggtacaatgccttaagctgaaatcaacaaactggaggggtgacaatcaacacatcggtttttttctcattctattttaaattaaactgtagtgtgctcactcaagagcacagtcaacgagataagcaacagacaacaattttatcatgctaaaaggaaccagtatttggtgggttcatctattaaatttgacgcagttgtgtatctttctaatcacaattagtggaataccagctgttcaagtacacggtcacagagaagagcaagtacctgtggaacatgcttaagtttgtgcttcattcgctcagtccactcttgtgatgagtctgaccacggaccattccattcaacttcatttgcccacggattctaatttgcacgagcttatggccatcaacttctcttacctgtaacatacaatataaatttgtctagcgcaaaaagaatgggaactaagtgattgccaaaagatacagacaagtcagagcaaacctgcaaaattgagtaagcatgtccctgaacaatgccacttgatgaaatatgagcatccgagccagaaggacttccagcaccaagaagaaagccctcttgtttaaaatgcaacaactgagaccacaatcttccactagcaagatcaatctgcgcttgggggctccgcatgtcaatctcttcaccagctcctcctgtgagatccactagagcatcttgcacaagcccaccctccaatgcctcataagagccatgaagctttgcataagctttttcaagaatggatacccacagctcattttgctttctactagtagcaaatgccggtttccccggagactcacaggggatccaatcatcaaccaccactgccacccattcaccctagtaatttacagaacattgaaatataagctcagatcaaactggtcaaagatagttcttcacaggacaatctcaagtcttttttgtgttggtgggaaatactccctccttcccaaaatgatcatcatatatgtttgtgcaccaagaccaaggataatttaaatcacatcaatcaagacaccatacacacattctcccacaatgcatgcatcgatcaaaacaccatgccaattacacctagcatgcacacattctcccatgctgcattaattgtattctgataaaatccgcgtctatgcggttatatgatgatcaatttgagaaattttgaattccattacatgatgatcaatttgggaaggagggagtaatccacaaggtctggtgaatatgagctatttatactattatttcacttttatcaacttacctttgagtttcatcgtaaaatttacaagcatatactgcatatgtaagttgtgcattagtgacttgttcactcatggttttcaatgttgtttatgcagggcataatgcacatgtgtaattgtatatattgtgtcattccatttgggaatttccctaaaactcgagcaagataatggtatgcattatgttcttcatggtggtatgccccttactagggtctcgcaatgttagcatttcagaagacgttggcattcttatatgcaccctatggaatatgaatagcaaatctaaagtcatgaatcccatttttcttaattaaagcatataggttgtaagcctatgtataaatatatattagacagctctaacaactgtttatgtatttatgtagtatcaacttgtccaaattaattatttcgaactagcggaatttatccaaactaaaatctgcaagtcaaggtttcactgagcctctaacagcactattaggtagcacacatatccaccatagctctagtaacttgtggctgttgtattatttctgattagaacttctttcccacaatgcagaagaaaatggcttgttgatatatgttgaacacaaagtaacaaagagaatcaacttgcagctcacaaatctgttagtttgcttaaccaattcaactttgatatttaactctgtatgagactaaaatgttaaatctcaccaagatggtgtgctctaccaatatactttaccaaaggaacaacccaagaaaatggaatggaggacagatgggtcagatcattgaatacctggatacagaatctgacagtgtaaatcccttcttcattatactcaggagtgattataacttcagatatacgggccatctctgtcaaaactgcaacagcgctcaagaaccaacagtcgcccaaccgaccctgaaaagaacaatcggacaaattggattgtgtgtcatgtataggaagatggaaatgtataaagttgaaattctagtataggggaagaccccacatcagcacaaagcaaaatctgcgtacctgacacacatctgacgaattcacagaaccagaaaataagcacggttgtgaactgatagatacctccttcgcaatatcagaaggcctcatccactcagagacaacctaaactcagaaacacagatgacagatcaatgtcaaagaccaagccaattcttagtgcacaagtcagaaactcagccagttcttagtgtacaagtggtagacaaatgcatgcaatagtacctgcaattttagagatgggttcatcggatctacaaacagagatcgatcatccggagggaactcttgatcagtaaaatttctctctcccttcgcaataagagcctctctaacagccctttcgacagaaagcatgcgctgattgacttcctctcgtgtctcaaatcttggtttccttggtcttctagcaaaggagtcaatgtcaatagctacagaatcacgcgcatgacgtttctaccactggagtactgtccatcccattcaacgtcctcttgatcatatagttcaaaatttgcttcttcactttcccagtcatccacctgttgaaacaatattagatgtatgaatatcacatgcataacttcataatcccttccatttcatggctctcaagaaaggtagaaatgagtaattgttcaggccttgttcgtttaatccctcccaaaagaggatttggaggggatttgttccacacctattgtgttgtggaatcattccccctcaatccctcactattggggattaaacgaacaaggccttaggagtttcatgttcccttctaattaatgaaataaagcaagataaacagtaggaatagattggtcgaaacaagaacttgcccttgcagaataacttccatgccaagcatcctcagcagcaagatcaaaaaggccatattcagcagaacagatggctgtatgcaacatagcaacctcatcttcagtcagacatcttccccatagaaaagcatccatgatctgcatctttgagtctgatccctcgctgtctgacctaccaaaggcatctaagtccgtgggtggcctagcaccaacccaaatatctgtcccaggttcccagatgccattatttctaggcaatggcaacgcattctgatatccatcgtagactccgtctatgaagaagttgcttcacctagatcagcatctatagtcacagtgacaagatgccacctgaaaattaacattggttacagtcaggcattaccaggaaaaaaaaaagttgatgaaatgttccacccaaaaagacatgcgacaagtccatgtaagactagtatttcgatgtgaatctgaacataaacaggttggctctcttgattctttttttttcatgcaaaagaaacagcagttgtcacgagctggtacctgccatcagcaatacttgatgcaccaatattccactcttttgcaacggttgtcatcctttcacccttagtcaccaatcgaagaccaacttggccagcttccattccctgttctgaccctgccaccaagatttcccagcacacttttttctggaattctgttccaaaaagacagactggacctgacaccggctgcaccattactgcaatggagaagctaacttttttactttcacaaagacacaaatcaatctctccacaatgacgcccagtactccttggttcatcatcaagtatgcaaacagtgtctggaatgccagtctgcacagttcgtaacaagtaaaagatccaaagagcatcagtaaaaaagtaattacaagaactgcatgtataacatatggtactaaatttataaacagaagaaatgattccaggctattacacgtaactaactgtcatgcaaaaattgatgctttgtcagataaccaactccaaaatggatggcaaaaacagataataaatatccaaagatgaatatgttcagttcatgcactcaaaaggtacaccatgagaactatatcatcattaaggtgtgctttagaagttgataaaatctaatgattacaggaacagtaacagaacctgctctgctcgccgagccaattgtgcctttcttatgtgacgagctattgacgagaccctgtcccttgcaaaagaatcttccagagcagaatcaccacccacagctctgacagctgctgccatggctgcagcatccctgcttccagcattaggaatagaagatagcagtgatatttcaagctccttccattttcgttcctctctctccaacaatgccttcctcctttcccttcccttcccttcttcctcgcgcctttgcatcaagacctcctcttccatttctttttcccttatgtagctgaataagcgaataagagaatttagatggcgggcacagaggtttacagggttgcagatagaaacattgcatacataaaagttttaacaataacctttcttgaataagttcaaaatgtcttcgatcttcaggcatccatttcttgatttctttggcacttaagtcagaaagacctatgctgtccagaaaaagtctaagacgaacttcatcctgaaacaacagacatttccaacattgttacagattttaagaacaaaaaagattaggtgggagtagtcccaaatgcatacctgtatttgctcagctttggcagtcaagccaagcagaagaagtaaataaccaccaaacttgtcccacatgtaaacccattcagtatcaattgcttcttccaaagccaaaatacgtgcatgggcacacatattcctccgataatctacatctacaggggatccaatcattaaacaattcttcactccacaaaagaacgatcctgccgtaatttcttcatttcttaaacgatctctcagcttcatgacatcagccctaggaagcacaaaattcccagccctgtccaacgtaatagcaggatctccaaccaaaagagcagcagaacttgcggatctctgaggcgccgagtaagtcccagaaatagcatttctcgtctgattgcacacaaagcatactattaacaatacagaaataataaaaatcagagtcataataatctcattgataagtactggtcctggatattggagtagataacaccagcagcacttatgtaagtgtcaaggctgacaaggagtgggaacatacatgattgaacttgatgcactagattaagaaaacatagttctgatctcagcgctagatgctaagtggtaggcttactgaggcaggtttaacagaaaagtatgcaagcaagaacagcatttacctatgttacgcagggatatgttgaatatctgaataatacaaatatacagcaaacttactttgttagcagaacgtgacattgcttgtacaactgtatccttactgagaaagtgaacagcgtcctccagcatctgacaaaaatttcacaattaattcaagaaggatcaagaaaaaagaggaaataaaggagtgtattattgccattggtattggcacttcaggatttgccaaccaatgtgccactgatgtgagcggctacatgtggtggagttgcaactggcaagtgctgaagtgcatatttttgggtgacaaatcctagattttcctaagagagagctcatttcaataatctgctgattttggataaacagaaatactaaccttgagagtcaggcatggtcgagaaacagcaaaactgaaggcaattacaagagtgatagcagaaatagcagccccaataaatggtggattcaatattagactggcaatgacaccccaaacttcagtagccaatgcaatcccatacaagataaggaaggcataactgtaaatacagcaatgttagggtgtgtgctcagatgacaatagtacttctaaaaatagcatagaagaaagaagttatgagttatgaccaatcctggtcaaaggaaagatatataagcatgtagaattagaaaggccatatcctgatatccgtacctaacatttttagcagagtctgcatgggcatcataaacataaacaggtaataccctcggtgaatacacgacaattggtggtgatagaaggacctgagaagagtacagtaaattcaatattacaagcataactcttgagataactcacaagtagcaaaactagcatgagatgttcaacagaaattatcttaaacatgtagctaacttaagttaagaaaaaagatatgaaacttacagtcaatgctcttcctgtgagaagaaatagaaacgagaaataacctatagatgccccaacgaaaggtttctctgcaaaaaatcatcagctgatttaagctatgtgcataatatgggaaactattatgtaactcggagaaagaaaaatagcaataacaggttgaaaagcatataagaagatgtagtcaccctgaaataagcccatcaggaaagcagccaaggcaaggagaaaagcaagggagcaaacaagtaacatttgtgtccttgttaaatagaaattgttagatgtccagtagtgaatgacaccaatagcaaatacaaggaacaagatgacaaggaggcatgcaactccaacctgcatagcaatgacagatcaattatgctgtctcttatcacaaatgaaatgaatattatgataaatttattttgaaaaccaagccacaaactttacttacagtccaaggtctaattgtaacaattactgcagatattgcaccaagcaataacagcactcccatgccaacaaataggtaaactccacgggaaatcttccaatcatcatccttcctgaaattatttgcaatttcatctcagaggagcacagtatgcaaggacgtacaaataataaacatggtttccaattttccataccatttatacatcccagtaaacaacgagaacacagcaggaatgcaaagtaatggaagtaaagctgccaggaaatcagccttcagaggaactccatcctgtcgtgaatttaccactccccagtaggacacaccacaaaaggatacaaggacagctgcagaaagtcaccagtcaagtgccagttatccaaaagtgtgatgtgctctatttaatatgcaatgagaacggaaaagaagagtagaacatacttgcaaaaaggccaacacatatagctgatgaaggtgaaaatcgataagtagcaaaccaagcgacaataggtatcaccccagtggcaagtacagcaatcgttgatgataatgcccatccaagatacatcgatgttgcatagggagaatagaaactctttttatcagcatcccatcccttgtagcccaatgcatctagaggttttgctgatactattgcaccaaggccaattactgatgcagtgaaaacagttatgctgatggcaaacagagcgcgctgacaagaagataacaacgatcagtaacatgaaaatcattaacaatgctggaaggtctgaatgcgttctacactatttataataacattagagaggtcaagaggtatgtgctgtaaaacagagcctgaattcttttcagtaggatagcctacaaaacaagattttatctaatgctgataggaatcacaacaatacagtgaaaattgattcagtaaacatattcaggcattcatccagaagttgttaacagtatattgacataaggccatatagtaagatgatactggttacagtacttcccttacaactacgcaaatagcttatacagacatttattggatatccaaatatataaacaaaagggtgtcctgctgctgaattaacaaaaacaacaaacctctttctttcctggagcttggcggatattttcacggctatcaagctcccctcccggaatccagaaacggtaaccgttacgcatccatatgggaatagcaaatgagagacaagccaccataagtgggaccgtgagtgacaaacccaaaataactgatgacttgctgcagaatggcagaggtagtatttcagacaaaagtgtaagtacttccccaatgaaatgaatcaatgattataaaaatctagtggctagagagtcatacatatgtataaacaaggcatatgcaagatgctgtgaatatgtcaattgtcaaaacaggaacaatagaataatcaagaagcacattttagcaagctaggacaccttatccagataaaaggagtaatccacttaaagctaaaactttgcatactaggaactcgaggcagcagctatgactggaatcttagaggcagcagtgaccaggaactctagatggtggtgttgaccaagacctggaggtgacaaagatggggagctcaaggcggtggtggcgactaggatgtggaggtgacggcgacagggagcttgaggcggtactgcgttagcgattgggacctagaggccgtggcaaccaggagctcaaggtggatccagcgatgatcaggaccttgagtaggctaatggaatggaaggggatcaagtaagagttttcaggctgagcgctggcagtgggtatgatggcaaaggtgggtaaattactcaaacaaatcccacaaaagccatggaggagcaaggaaatgagatctccttgtcttcatgaatgggcttccttttgtgagcaactcctgggatgagctagccgtgtgagaagtttgctagcttttttctgttcaaaagctggctaaaagctgtcccaaaggaggtctaagacaagactaccatatagcagcgcaaagcacgtcagagtataattttatgtacatcaactcaaaatgagctgtgcatagagaacttaacaagtaattgtaccatgatcagataacaagtggtgaggttatcttcatgaaaatagataggtctcttttgtttgcaacaaacaaaagaatgactcgatgacatttattcgtactaatgctaataataacacacatgatcaattctaccaatataaaaagattccaagcacaaggtggcgtagcaaatgaaccaggcagagacacagtattatagtaacagacttatacaataaaatgtacttgtgtagaatatacgaaacaagtggacatggctattatgctgtgcatgtatcatttgatacccatgtgaaacttctagtcaaaccagcaagacaccaaagcagggaaggaaaacaaatgagtactccaggatttacacaaggcaaaatgcagtagtaactaagtgaagttttaaatattaaataacaaacatgtatacctcaagaaagacagaagtagaccaacacaagtactcagcaaccatgcgatgaagccatactgtagatgggcagggctgcaggaatt

SEQ ID NO: 54809 - DNA, 1286 bp, Oryza sativa
aagattttgaaaaaaaaaatcaactacatggtcaaagtaagataaagcacacattgtaatcagatttgatattttgtagacgagttaaggaggacagaacatatctaaatgtctagtgaagaagcaaaaggacttgtcctgccatgattaaaaaataagtgcttggtattaatacgacaaatatatttcttttgttcaacatcaccttccgaggtttggatgtcatcgtcatctcttctgcacacagggaccaaatgaatgccataatggagcagacaactggtgatagaagcagtatcgagaaaccaaactcaaactgccaaattcgaaaaaggacactcttgattaacaacacaatcaacatttcaaagtttttatactgtctttgcaacaaacttacctgttcatgagttgcatttataaccttgatgggcttcggtcgatggacagccacagtaactgtttctatgatgaatattagggtaaaaacaacaaaagcacgtattggtgaacctgctacttgatgaaacatcagccttgaaagatttagccaattttctagcccacttctcctaagttcctctgatagcgagatctggtttgcaatagttgtatctaacctatctgaatcagtaccagtgacatctacatcatcttgatgctctctgtctgcatctaagctgcttctctgcagcaaagctaaaattcgtgggtccataaccttgtctttcatcatataggaaaaatttggatcaaggcctttatcctgaagaagattagccaattctacatctcctagtccaccattcctttttagcatagatgtgattcttggatcattcagtctgtcctgaaaaattgcagccaagttcaaatccaatagctgctgattacccgaggcagtagctgatccactagactcgcagccttgactttccaaaccactactagagcaaacaacgagtgaagcagttgggtccccatgcctgtccgctgaaactacagcagtttcagggtcttgtacagctacagcagaaaggcacgaattactgcgatgggctaaactggcacgtccactatctatgttcttgtcagagctctgtccttcttgacaactattcgatcgatcaaaaggaacattgttccaattgacacaatcgctttgtgagttgcttctgtacatagaatcagtagcattgccatgaggaccagcttcaacactgccactactacgcttcacactagatccacagccatctgatgagtttgaagaactagtttgcccc

SEQ ID NO: 54810 - DNA, 10457 bp, Oryza sativa
ctgcagcccaaattccagtctgtagaaaagaaaataagatgtcaaagaaatagatacatcatgcacaattagagatacaaggccaaatcattaccgagaatcactactgcaactgaagttaaagcacccagccagcgtgcttcttttgatgtcagaccatataagatggaatagacaacaagaaccatcaatgagcaaaggtaaagaagccctagatgcaagaccctgcattttaaggcattgatatgttaccaaaactactagaaattattgcttaccccagtaacagcataatagaacaagcacgttacttggggaacatatatgcctatgtagtatttaagagaggaaaaggtagtgaagtcacctgctggattttgtcatgtataactcactaggatctggtgggtcaggcgagcatgaaacaggggccacttcaacacaatcagaatatgcaaatttgtacaaccttcggacatactcatcaacatcgaatccacttcctgtacatgtaatgtatgaaaagttatgtttctcaaattttttatttacaggtgataagaaattcagcaaataaagataacggataagaattttaccattgaacagtattttacttataaaaagcatatttatggccaatgaaattgcagataccccaaagaagaagccagatggggaattgagctcagaagcactagcaccggttgtaacataaacagcacaaaactcataagcgcacagtagaccgactgccaggagtagaagataagcaacagcctctgcaacaaccaacatttgttaacatcagtaagatattaataaagaacaatgagatgatagagcggcccaattttgcagaaacagcacatacaaaataccacatgaatcaaagagttagaaattgcagttttataaagtgagaaaagttcaaatttgtagtagcatactagtatttttaatcctccgtgaagctttaaaagttttcctttgagtatgccaaaatgttccatttataccatttcctagttacaattgtctagaaacaaattggacccccaaaataagcagagaagtcctagacaatcatcgcctattagaatatcaaatttaatgaacccatgacttagaagtcatgaataaacagccacttatcagaatatttggtttaatgaaaccatgaccctaagtacaagcacattgagtagtcatcacaaaatgtcctagaaaataaaagcatgtaaacagtagaaaacttactggagctttgccattgcgttctccaccacaacattatagagtagaatgacagaagcaaagcaacaccgaccattataacagctagcccaattatgttcctttccaaaagagcaataaggatgcctccccatactaacaaaactgttattggagaaacgacgacaagccatgcaaaaagagtgaaaaagctgcacagtgtgcttagttgaggtccttgcacatatgctggccatttccttgcatatatccaactgagtaacaaaacaagaacgaaaatgttagtagcttaatgagataatccagctctcagaacatcaggaacaaatcaacataaacaaatatgcatagaagatataagaatagaaaaacatcaacgtttttcagggcactacttgtgattgtagttagacacaattacatgatcgtattccataatctacatatgaatggcaggcttaaaatatataaggtgtggtgttggattagcagcataataaagacacaataaataatttcagttgttagagtgataatgataccaaatctacattgttgtatgcactctgctggctgaaatttatggaaacataacgtatgattaataatgcaacctcgcagactacagatgcaaatgctagatgccaacagaagcacgcctaatctcgagcatacctatatagcctccacggcctccagttcacagcccataggatccaaaagctgagagggccaaggacagcgaagaggaaaccgcagatgctgcaaacaagaacaaccccgcggtgttcctcctcttccatcctccccctctgcaatcaccttctggaagctgatatcatgtatacaggctcaaacaaacctgctaaaaggtagaacatacaaggtccaatgatcaaaagaccaaatatacataaatgacactaagtatgcaggcaaccagattagtagtaattactaagttaattaagacaaactacgttgagttcaacgcatatggtaatattttctcaaaatattggcctaaatcagtccactacaatttacatgtaacagatcaatatatattctatatacaacaaacacccccaaagtcccaatgtggacatggctttggggttttccttaccaaacctaagcaccgaggatgagaaacttaagcttaatgcattttaatgaagccaccagcctgggtgcggctaacaactaaaaacttcactacctaaaaagggttattctgtgcatcacccaggtgctatagccctctaaatatggtatagataaaaaagaaatcccatgtatttgttctttatgcatacaacactacagattaagcccttcaaatggataaccaataaactaaacaagttgattgaaaagcaccagcctgccagctggagttaaaccattcagccagggtgctaaatctacagcaaatttggtggtaacccgataaaggttcactagttaaaatttattgaggtacctcgagttcaataattgaaccaaatattttcagggccacagaaaatataccacaatcagatttttagcacgaatcgctaaaaattaaagaataaggaacattaatatcacctgccccaacatttacactacacgttaacggatattaaataactgcattctgaggcttcaattatctaggagaccattttgccacgtaaaacatactaaatccgaccgttcctagaccgttttatgcccagccttatcccaaacatgaagtaagttccaaaggttgagattaaaccatccagaatgcatgctactgggtcaggacagatccaaccttcattgcccgtcataaccatcaaatctctatgcccagaatatcgcgagctgtacaaacacactaaatttcaccaagccgtttgctgcatgccctcccaaaaggccaccaaatctgtcaccgcgcgccaatacaatcctcctaagcaagcggcctaatataggctagaggacgagcagccatcgcgacctataagccaaatcccactaaaacctcaaccatcttccgcccccgcagcactccaaacacgccagaaagaacatctcctcagaaatccgcacctcccagcagccagtccaaccgtcggaggcagcagcctccgcgcgcacaggaagcgcacccccacaattccaccaaccccccgcaatgcggcggccccggagcccgcaattcccgcgaggagcgcccccgacagcacgccagccccgccagatccggggcgccccgccgcggaagcccccgaatttccgcgcgaaaaccctagccccgcggccgcagaagcagaaacagcagcagcaacggggcggcggttacctcagcttaggcgccgcggccccccggcggcggcgggcggggcgggcctcctcgccggcgaccgaaaccctagggtacggcctctccccacttttttctctctcctcctcctccctctctccctcccctctctctctctctctctctcccctcacgggatggcttcgattcgattcttctccgtgcgcttgctcgcgagcgagacctgtgtcgtgagcgagcggagagggggggagagagagagcaagcgcagcgcggcggggtgggggagacaaagagtgacgtttgtcaacttgggtgggctgcgtgctgactggtgtttggttggtgcggtgcggtgcggtgcgtgtgcgtgtgcgcgagcgtccgcctgcgcgactgaccgctctcgcttcggcctcggcgcgagcgagacttgggctctgctccgaccgagcgcgcgcgtccgcgtctccgcgaccgagggggagagtccactccactccacacaaccgcgagctagacgcggagccagcaaagccagccagaccagcgaggcgcgccgtttcccgtgcgataacgtgcggcttttcagcgtgtttgctagtgcgaaaggccgtattttgctgcgatttccgcgcgcgtactcgcagtgtctttctggactcactgtatcttgtgactttttaaccgggagtgtagtactttgtatggatggcagtttgtatcctaatgaaagaagatacgtaaagagagtggacatgatgaaagtcatatacgaagtacttgacgtgagatgtaacaaaatacgatagtttcctagcgtaagaaattttggaagactttgaaggattggaccgagaggaataaacggtgtactctctctgttccataaaaaaactaacttaatactatatgtgacatattctactacgaatctagacatacatctgtacagattcattgtattataatgtgtcgcatctagttctagattcgttttttgtgggactgacggagtatcttttcactatctttgttaatataagattatatacaaaacgtggggccatctagcaatatatggcgggaatgacaagaaacatagtggatatgctacatgatcaggagtgagagtaattctatgtgttcaccatgttgctccgtaaataggttattaagaaagtggtaggacagataaaaggtaactagctaagcgtgatagtttttttcaccgtacattatgttttggatcatacgctagagtttaatacttattttcttgtgcataactaaaagacataacggtaactctaactaggggctttctccatccaggatgatattattagtcatttaagctcaattggcagtctatggtaaaatttatcgctgaagcgattccattgaggtttatcacaagtttgtccctatgtattccgggtgttattgtttactatatcaacttttctgtacacgaagtgcatgcatggctcgcgttcgactcagttacttcagtgcttcgtctattgcacctgtcttgggacatagtggttatgttcacgcacatgtatactcataaagagaatttaagcgggagtatacatgtcccaagttgtgttaagggtttcaattgagagtagaaccaataaaccatagtttctgactcaatgtacaaggctaatgatgaggagatccatattaacaactccatggtcgtagtcatgaattccatgtatgaggtcgacaattaaggcttcatggccgctgactcattgggagaggccaacgaaaaagtgcccgtggttgccgactccatgatacatgcattaatccagctgagagcaatttggtgttggcttagatgacacgctcgacagtatttaataggagtcgtagaataggaaataggaatctcaataatttattgcttgtgaggacatatctaaaacgaccaatgatatcaatccaaagggagtataaaattaaggtggcgatatgtatatacgacggtctagggtaaaattaacgagtgatccgtgactatacatactataatagttgccatggacaacattttcaaaattcaccaaaatcatccattaggacctgttggtagaggtcatgatgacatatcattataatctaatctacactctggttgatcttcagttgctttcatatcaaaaagtataaaatggattcgactttgtacgaaagttcaaaagaaaagcaccatgttaacatacgcaatcaagaagcttagggacgtccttcctctatatatccattccgtttaagaaaaatatgcttcattcatccttcatttatccaaaaatatatgtattacattaacatagtcttaagacttcaattctgaccaccaatttccatgataataaaataatagtactgccgtgaaagtgcaacaactaatgaaatcataacgtcatggagtatctttcagacaaacatacacacgtcgttaaatgaatccaatctaaaacataaaaaaggtatcgacctaggaatgtttttcacaactgacaggaaattattaacattttaccatacacagtaagtaatacagtaagtaaaatctcaaacaagttcatcagataggttttccctgaattcctgatacctaggcaaatagcccaagagaaagaagaacgcccggctagcatgggccgggccgtagcattggttgattgcagccatcttctcgtggcagttacgagcaaaccttgttgcctgcctgggttctgaatcctttgacaggccgtcgtcctactgtccgaccgtactccctccgttatagattttgagtttttacttgcactgtttgaacattcgtcttattgaaaaaaattaaaattattatttattttctttgtgacttactttattatccaaagtactttaagcacaacttttcattttttatatttacataatttttttgaataagacgagtggtgaaacattgtaagtaaaaacttaaaatctcttatattatgggacggagggagtaattccgtaaacacaacaccttgccgtagattgtactatactgctccagtaataatgcttaccactactcctaccatgaaaaccaactgcctggagagcctggacttctgctcaagaagtgaaatcctttacaatgttagcttcagctgttgccgactcgctgtcatttgtcaactaccgccgccttctggtcaccctggacttctactacactgattttgatagcaacaccgcacgtcccatttcgaggttgatatctttcgtacctgcagaatcagccgcgatagaagccaactcggcgatgcttctgctgccgccgccgccgaacgatgattgtagcgtggaattagactggcagagtggcaaatgtagcgagagatgtggccgtggatagataggctgtgtttagttcacactgaagtttggaagtttggttgaaattggaatgatgtgattaaaaaattatgtgtgtataaaaggttcgatgtgataaaaagttagaagtttggaaaaaaactttggaactaaacagagccatagatagctggttggtacttggtagcagtggtctggtacgtacacggacaattcttctgccgtccatgtggtgggtaggcgtacatcctttattgtgatcaccaaccgtgccatgcacgcacacctaacattccggcacaggtctgtctgaaaatgtaatcactgctaaaccagcttaattatcacagcggagaggggtcgccagcccaccacaacttgattatgttattaatcactagtgctgtccacagatgatctccactaattagctctcttatatatctcacagagattttttttaaaaaaaaacagagtcaataactgaagacatgtttccttcaaaaaaaaaggagagaactgaagaaatgaactttggtatagaacatccataagtttgtatcaagaactgaatgtataatttatccattaatcagtgtacaaagaaggggggctgaaatctaagaacttctaatggtaacatgaagaacagaaggatttcaaagaacatttacgattacagactctaccacattgacatacatgtgtgatcctcttggaagcttggagcttggatgtgtagtaggctggaacaacctgtgaagccgaggcggcggcgatctccagttcatggctccggcggtggcagctcggcggcgggcgccacctcctccaccacgggcggcgggggcttggcctcccgccgcctggcgacccggcgaggcggcggcgacccccagcagcaccaccggcaagccagcgtggcgcagtcgtaccgctcgtcgggcccgtcggcgtggcgcgcgcacacccggccgaggacgcaggacagcagggtgagcaccagcaccgccgcgagcacggcgaagaacgtgccgatggaccccccgccgccgtggccccgcgccgccgccccttcggcggcggcggtgacggagccctggtagtccggctgcagcggcgccgcgaacgtcgcgatcgccggaggcggaggcggcatcgacgacggcatggcagtggccgccattcttgcatccagtgggggggtgtgatcgatggaatggaccagctgagtgggatcgtcgtggagttggggaggagacgatcagaattcagacgagcatagcatgggatgggatgggagcaggaatggaatattgagaggtttcgtcgaaagcgtcagctcgctttgcaaaactactactactactccacgatggtgatgtgtcgaaggatcagaggaggataggtgcagaaaagttcagaaaaaaaaaagagggagagcaaacagcaaagtctgcatttctgaaactgcaaggatggcttttgtttggatcgagtggaggactacatggaaagggaacaaaagtgtgatggctggtagtcatactatccgtggaaaattcaggaagatgcaaggggttgcgaattaaccttgagaaatgtatacatcagggactttactggtgttgtttgattaacatgcaaggtggtttcccatgaaacatttccaactttacgtttgtctttgtgactttgtccaggcacagggtagatgcagttatttctaccatttgttccatactctcgcccttttccgtttctactttctgctgttgttaattatggatgaacgtcaactttttcttccttgagtcgatgatgtgctgcgccagtcgcaaatactgccgatcaagcccaagcaaatcctactttaaggaggcccaaaggaattggcctgaaagtttaaattgggtctaaacatggcccaaaccaacataaaaactggacgctgctgggcctcgccccacattctcgaggcccttgcactcttgcaggcatgcacagccttatttatccaggccagctgtaaatccttaaaattgagcttcagatttcgccatgaatcagagatgtttcgcgtaatcagaactagctgggtggcccgctcacttgcgcggctagcacctaaacaaaatcatatattttttaagtatgattttactttaaatttattaaatagttatccccgtatcatccccgtatttctaattatatagtttttaaaagtcacatcagctgctaccccttacttctgtcatatccttctttatttgcttgctcggtctaccactatttctattcattctccttgaaacctttaaaaattggatctgttttttgagtttattatttcgttgggtttcgtttttataatttctggaagtctcgtcaaacgctgccattatactcctctatggcccgtccactgtcttttctctttattgtcattgggattttacaaatcgaacataattatcgttcgagttcattttttttactttttataagtcccgccaaaccgtcagcgtttttgccattgtactttttatggctcgcccgctgtcttctttttttattttcattaagattttaaaatcgaacatgattatcattgtttttttactttttagaagtttcgtatctttaaaaattggaccctgtagtttttaaaatttattgtcttgttgggttttattttttataatttttagaagtcacgtcaaacgatgccactatactcctctacgacccatccgacgcctactctttattgtcattgggattcgaaaaatcgaacataagtatcgttggaattcttttttattttctagaaatcccgccaaccgttggcggctctgcaactatactcctatacatcctgcctgctgcttctcctttttattatcattgagattttaaaaatcgaatataattatcaatggggtttattttttttactttctaaaagtcccggcaaccgccttacccgtttgcttcacggcctaccgatggttggtgggacttcttgaaagtaaaatatgaattccaacgatagttttgttcaattattaaaatgctaatgacaataaagattaagcgacggatgggtcatagaggagtatattggcagcatttgacgggatttctaaagattctatttggtgtattactaacagtttttatatgtcgaatcaaccgccaccactctactcttttataggcttgttatttaatttatctcaccgtgtgttttagatggtctcttttttaataatctttatttttatcaccagttttagttatttataaattgtattctattttaaatcttttttctttttctttttctaatttcagaattttttttaaaaaatatttaataccgtatagtgttcttttaatatttttatttttcatttttgaattttagttgtttcaaaattgtattcctacttgaactctcttt

SEQ ID NO: 54811 - DNA, 2814 bp, Oryza sativa
tcatctccttttttatttgcttgctcaatctatcactatttctattcattcttcttggaacctttaaatttggattttatagtttttagagtttattgtcatgttgggtttcatttttataatttctagatgtcccgtcaaacgttgccattatactcctctacggcccgtccattgtctcttctctttgttgtcattgagattttaaaaatcgaacataattatcgtttgggttcattttttactttctagaagtcccgccaaaccatcagcggctttgccattgtactcctctacagctcgcccgctgtctcccttctttattgttattgagattttaaaatcgaacatgattatcatttgcttttttttactttttagaagtttcaaatctttaaaaattggacttgcagtttaattttttataatttttagaagtcccatcaaacgatgccactatgcccctctacagcccgtctgccgccaaatctttattgtcattgtgattctaaaaatcgaacataactatcgttggaattcatttcttattttctagaagtcccgtcaaccgtcggcggctctgcaattatactcttatacaccccgcccgctgcttctactttttattgtcattgagattttaaaaattgaatatgattatcaatggggtttttttttactttctagaagtcccggcaaccgctttccacgtttgcttcacggcctgcttgacgtccctccttttaatcgtcattaggattctattttggtgatttattaacaatttttatatctcgtatcaaccactaccactctactcctttatagctatgttacttaatttatctcgtcatgtgttttagatggtattttctttcaataatctttatttttatcacaaattttagttatttataaattgtattccaaattgaaatcttaattttctttttctaatttcagatttttttttaaaaaaaatagttaatatcgtattgtgttattataatgtttttattttttattttcaatttcagttgtttcaaaattgtatttctgtttgaactctcttttaatttttctagttttagatattattttatttttattctaaattttaattaatctcgtattgggttcttatatggattcttctttcaatattgcttatttttacttccgaatttcagctaattttatattgtattcctacttgaactcttatttttttattttcttttgccaattttggatttatttatttttattctgaattttaattaatctcgtattgggttcttatatggactattcttttaatattccttatttttaatttcgaatttcagctatttttaaattgtattcctacttggactctcatttccttttctaattttggattttaatttatttttatttcaatttttgattaatcttgtattgggttcttatatgaaaatttatttcaatattccttatttttaattccgaatttcagttatttttaaattgtatttctacttggactctcatttccttttttaattttggatttttattttattgttatttcgaattttgattaatctcgtattgggttcttatatggaaacttctttcaatattgcttatttttaattccgaatttcagctatttttaaattgtacttctacttggactcttctttttcttttttttttcttttttttccgattaatgtgggaatttctaaccctcacagcgaacgtggtgtctcctttcaaagctgttttaataatataatagatagatagatatggacgctcagctgttcagtttgcctggacaatgccttatgcttttctattttctgtttaaaacaggtttgaacaaaattaaaaagaaaaaagttgatctctcccccacgcaaccacatcatatggtccataatgtttatatcattggctaatttttagtctaacagcagctttcaaaccgcattcttttttatttgactatgttgtactactttatccaagcctcagctgatgaagaggttcagagagatatttaattatttacactctttaattattccatatcttataaacaacgagtggtaaatagttaaacatgatatcttaaaagtagtaaatagttaaatgtttaggaattaaaagagagaaaccggtttacgggccgtcataccattaccagcagaaaacgctcgttaagattcacgggaaatgcgtggctttacctgacgcgtgcgtggcttccgtgcatgccttattagctccaaagaccaaaacttcagtacaagaaacgccaatctaggctagctgttagttgcctgtttaagggagatgagcaatgagttggcttgaaagaatcaacgagatcgatccgtcaagccactcgagcttctcaagcaacctaaactaacacctccgtctcactcctccaggcacgctagccacgatgcagttaggcatgggctagctatagctaatagctaagctcgatcgatctcttcttctcctcctcctcctatccactgtccaaaagacggtgatcgatctgtctccgactgccgccgccgatgtcgtcgtcgtcgtgcgcggcgggcgccgaggccaccgggctggtggccatggactgcctggtggtgtgctgctgctgcccgtgcctggtgctgcagatcaccgtgttcctcttcgtcaggctgcccaagaaggtggttgtcaagtccaagaggatcatcctccggagatggcacgggagaagatcatcatcatcggcggcggcggcggcggccaagagaggctgca

SEQ ID NO: 54812 - DNA, 7841 bp, Oryza sativa
  unsure (1)..(7841): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatcctaccaagttgttctatcccatgcatattatccttcacaagtttaccttagtactcctcatatagtcgtgttaggcttttagctacacacttacaccaactgacaacactatcatcaagctgatcaagcacaattaacttcacaatgcccatctggagttcaaatcaacatcaatcttgctccgattagcgccaatgtgtcataatgaatttgaatggagctcatagaagtccatcactattcacacaaaaccactttgactctgactatccaccttagtccttagctcagtacctctcatcacacaaatcagaagcatcttcaatcgcccaagctataccagcaaatctacacctgcttacaagaaattctctccatagcactcacaatgcgttctagcacacaattcttttattttatcttattattattattatttaaaacagagaggggatctcccatttctagcacacaaattcacccaagagcaacacaccccatcccacagctgatcaacttaccacaagcaaacagcaacgtaaacaagaatttcctacattttcagggaaaaccccatcaacacaaaccagccacgcatcctacagagccccccaaggtggcggcacccaagatccaccgggtcgtcggctgccagaccgactccagcgcagaagccccacatcgcgcggaataacacagattgaaatcgatcaaggcagcagcggaagtaacagcgagctaatcaaattttaatttaccggatgaaggcgtcggccacggcggcggcggcggcatcctcgtcgtcctccgcggtcgtcgcattcgcgggggaggacggcgcgtagaggccctcgctgccggcgtggaggatgaacgcattgcccttgttgaggaagccgagcccgcggtactcgtgcaccgacgcctccccgccgccgagcagcatcagcagcagcccagcgacggccacgcagaggctcatgaggtggtgcaggcgggcggccgccgccgacacggccgccatggaggtggggggcagcgaagcgaggctggatctgagcgtgcgtgaagtgaagtgaagacgacgaggtgagtgaagcggacgctagctcggtcggggagaaaccgcaagaggccaagagaagccgcggtaataaacgggaggaggagtaggagggggtttggttggtgagagacctcgtttattccttggtgagagggagtgtctccccgtgtgttgttgaattgttgttggttcattttggtgatcagaggagggtcaatgggacattgggacaattggcagggtaaaccatgttgttaaaaactaatccagggtgggtgggctagctaggactagttacacttattagagcagatacaatagcaggctataagtcaactataaatatattttaaagagttaaacgaagagaaaagagcagatctgcagcacggacttcaagatgtgatgtgtgtatgacagatgagaatagtatattatgcaaatattctataaattgactattacattggttataaatgatttggagttagtagtaggctatattattaaacttgctcatagggccctggactctgctgcttgaacaagcaaagtttacagtaaataatgcagtgggtgcatatgtgaagttctcattttattttatttcttgtttgtgatgttggagtgttatccttttcgtttttagcctctcaccattttccacacagcatataagccaccaacaaattttaaaggtgcatttaggtttttattcatcatagtttttttttaagtatttgtcttctaaatcgttcgtatatataaatgttttatcggtaaattatattcctattgctgctaagcccaaacaagatatcagccctatggcatgagataagacttggaacgaaaaatgagattacatgagaaattaccactgatcaaatctgagaacatgtttggaacagaaaccgctcctacgatcgtcgatcatgtctgtcgggtctggatcctagtagaaaagaagaaaattgaacggagattaattactgtactccacacagagctagtaagcacctttcatctttaatcatggcctctcttttctcctttagagcagatacaatagtaggttataagccagctataaacatattttaaaaagataaagaaagagagagaagagcagcgggctacagatctgtagctagctgcagcacgaactccaagacgtaatgtgtgtataacaggtgggaccaaatattaatagtatagtaagcaactattgtatgaattggctattacattggctataaatgatttggagctaatagtgggctgtactattaaacttgctatatcccttccctttcctcccagtcccagccaggttgcttctgatcagtcaccataccataatagtaggcttaaacacctagcgcatatatatatatgctccactgatccagtacttaaacactaggagcagtagcttaaacacgagggtacactcaggtagtgtctagtattgcaccggtcgccctctcgcgatccgagcggcgaggccacacgccgatgtaaaaccaccccaattctgcacgggaaacgagcacacccgcaccgtgcgccgcgatcgcttggctttcacggtagccgcgcgcgcgcaccaaggggaaggcggaaggcagcagcaaccagcaagtcccacgttttttagccgccgggattagcgcggcggagcgcctagtcggcacgccgctttttctactttaaccggtgaaccccccacgtcccccacctcgcacggtgcgggtcgcaccatcatcacggtcgcacggagccgtcggtggggagaaaccaaccggtcgggccgcgcgcccgtgaaatccccgtttcagtggaccgtgggctagtcaccaacctggcgcaaccgggccgcacgcccgtgaaaccgcgtgggctactcgggcgaaaacctggcccagactggcgctgcgcggccgccgatttcacagcggaatcggctcgttttcgcgaaggaatttttgggccggccttctcgcacctatgtggctgggacaatcgcacaatcaatggaccgctactcgtctgatggaggagtgcacgaacgcgaattatttctgcagtgcagtagattcgtcaaggagagttttttttttaacacatatcagacgcagacgctcgtaacacgtacacactcaaacatcctactcatataagtactttcggaaaactaggtcgacatattttgaggacgaagtcactataggcgtctcgctatcgacaggtacgtctaccctaccattgaaaaaataattagccgaacatatgtatcaattctagaatttcaatccgggtgaattggttccaccacaatgaaaaaataattagctgaacatatgtatcaattctagaatttcaatctgggtgaattggttccaccgcaagtaatccaactagtcgagctaagcttaatctgcgtcaaggagagagtttttttttttttgaggtaagtcaaggagagagttgatggagctgccacgagaatacgctcttctgccagatctaacgtaggggggaggttcaccggagcagcggttgcgccatgctctctcgtggacgagggaatcctgcccggccatcacgtatggccggggtacgggccggcagaatctcgccgatgtcaagcgtgtccaaccacaagctcccaagaacgtacagcagcaacgcaacgcaacacagacaggcgtccgtgcctgcaacggatggaatgtgcgttttcttctctgccacacggacaagatattacgctctgcccgtactgtaccaacaacgttgtcaatcttaccgttttattactctttattggagtgtagaaatcaggtgatcaaacagttattcagcaagtgttagagatgatgtgaatttaactagtgaattgaattggatatggcagacaactctggaatcaacagatggcaattgtcatagaagatagttgaaaaaattgaatgcgttctttacagtttcagggcagaagagagtagacacatggaataggcctttgtcccagaacctccttatcatgattcaaattacagatggttcatgtcagaaataatggaggagcattacatgatcatagagcttcattgctaactatatcccatatttatatcattacgtagtaacaccataaaccccaagcttgccaggacctttggaacctgcagattggaatcacactaatcagatcaaaacagagagacatgctagatcaaggataattcacatttgagttgagttgaaaatttggggatcaaagaaaggtatatacctggcatgaacgaactaacatattcacccaactttacatttcaagcacaatatctggaaacaagaaaagttcatattcagtcagttgctccattgacaaaagtggcaaaagaaaaggttcaattcatgataggcaagtatgctacttacactctgaatcagttttgacccattttgcaccatcatcgtctagatcacgcagtgcatcctccaggcactcattgatttctgtctcatctggcttccagtccaaatgcctcttagcaactagcgtggaagaattttgcgggtgtattttcttctgcaatattgccttgagcaactgcaatgaacatcatataagataataagaggacgagaaagtatgtaaaacttatcatgttacataagaaaaaaagaatttcactgtgtaccttctccattcttgattgaggaaatgtgttccttggttctggaactacggaggtaaagccacccttacacatgaataacttgagcaacgaagcgactgatctcggcttgagtgtatttcctttctttcctaacgaattctttgatttacttacaatgatccttttgttgatcaactgtctaatatgcttctcattgtcttccccatcggcacgcttttgtaaacctacttggtcatcatcatgcgagcgttgagcttctgcttgatctttgattgctagtagcgtttcgaattctttccgtatcttgtctacttcttcctctgtaaatttgacggtatcttgcactgactgcacattgtcggatgaattctccacctgagctacctcctcaatctgcttatttccaaatgtcccaatagcaagcaatgattggggccaatcactgaattcatcctttcgacaatctgacacgttagcacctgcgcattagaactcgattaagccgcaagatcagtaaacaaacataaatatatggtcctaagttcatattagcataaattggatgtctagagcatggaccacaaatttttaatccttaaacacccagtgattctcattggcctatcactctttaagtacaatgtctgcccatgcttactccactccctgatgttttcacctgccatttttctgtataccaggaataacttatcacagcagttgttaccacttaaacaatgcattctctgtacaatagtagtctttttatgtaatcttgagagataaataatgtactgtagtccagctggactagtggctcagatctgattccttagtacgatttacgaaaccatccgaggtcaggatattgtctgctcaaatcaaattcttcttggtcacaagtggagggttggggttataaatcaactaaataattgaagccatactgactagttggaaacacttgcttgcagggttgcacttagtcaagactttgacccatactgactagttggaagcagtgctttacagagatattggcgtggcgggcatcaggccatgaaatagtcctttgggggtataacatatgcacaaaaatctctcacttttcgtgctagggaagaggaaaataaaattgaaaactcctactgaacttaaagcgccgtttaaaatgcaggaattttttttccggaagtgcgataattgaactgtttccagtgaaattcctgcgttccaaacaacacccaagtgcatataagaaaattttctcaaaggatcagaaacaacattgtcataatacatcaatgtttgctccatcacattggcgttgtgataggttactcaggaatcaggggatggtaatccagaaaatcgcagagcgaaaagcgttctgttactagcaattaggagaaacctttaaatcgttcactcttgtatatggctaccaagacaacaaagtatatcagcatattcagaaatgaacatggcaaatgatgcctaagcggaaactgctaagaggtaaagacaccataaatggagcagaatgacagcaggaaaagattaaattaggacaaagcaataaagtatcatcgtatccagaaatgaataaggcaaatgatgcctaagcagaaactgctaagaggtaaagacattataactgcagcagaatgacagaaagaaaatatcaaattaggaaacggcttccaaattactgtccgtactctccctctcccctcaaggaacagggaaacatttcataagaacagcatgaagcctggtgaacaacaatcaccttagttctgaaagaatttacaaggaaactgaaagttcaggtacactcacggtaaggcgcagaagaatttgcgggaaaccgatttgcttcttgcttcccactgatcttgttggctacccagctgaaaatctgcagagaaaacccaagcctcatgatgccatcaagaaatggatcaacactaccaacacttcaaatctattaacctctctgaaatgattaatcacaccgatggtttgagcctttaccttcatatcctggcctgaagaatgagagattggggagggagaaagcagctagctgatgaagctaccaagaaatgcaagctcctagcaatggcagagagaggaggaaaggagagatgtaagacttgtagtggctgctattggcgatggaattggtgcagagaagtactactagtagcctactgggtgtgatttgaaggggttcaagttccaaggattggagggttcggtgcagcgtggctggctgtaggatagcttgctatacttcatctggcatgtcacttcctttaccttccttttatagatgactccaaaccgggttaccagctcaacaggtgagccatggaatgataacaggacacagctatatatataaacaatggaatttgcactttcttcggaagagaaaattcggtatttgcaactccagctaccgtacgcccatatgcgccatacggattgtaaatattgaattgatgtttctagatatagatagtgtaaacttgtgatcgacctcacacttttgaggaacccaaaattgtggtagctacacctcaacgggggtgcttctaccctacttaaattgtagagaagtttatggtacttaagaaagtacatgcaggacttgtacgatatttcgagacacctactagagatattaagttttacgataaaaaaccatcatctcgatataccttcttaagaatgataaaactatctgactac

SEQ ID NO: 54813 - DNA, 12743 bp, Oryza sativa
cagtctgaccgattaattttgtttggtttttcggtcctctcaaaacttcagcctctaaaatcaagatcgaaatttaatataaaaccgtaaaacctaaaatattctatcatttttatagttcggtcttcggtcatggccgagctgaccgatcaatttcgatacatgttttgagagtaaattttgcctgcaattcctcaatcccacaactgtagttgtcgttctcctccttcaggcactctccttcagcggcctggaggcattgtcgccagccacctacaagctagtggagggagcggaggcacaagatgggaggagagtgcgactgtgctgggacttagccagtgactgttggggaagacgagctagggataaagatgaaaataaggtggtgcttgaaactaataaagattaagattaagtaagagcataaaaaaaaagaaagttactaatggttaattaagttttaattattactagttggaaaattgatttagttaatattttagagcaatttctatgtagaaagtttccgtacgaaacgtacctttttagcggtttaaaaagtatgcgaacagaaatcaaaatatatatctatatcttaataaaaaaagcagggtaggtttgcttggtttcgtgctatatttctgctcaatccgtcaacggttaactgaggccttatgaccagaatttcccgtattagatttggttagccaagagcacagaccgaattctttaacgggaatgctacgggacgggatactgtcccccaacgggatgctcctcctccacaacacgattctcacccatgcgacgcggccgaagccctcaacgcgcaccaggcctgctcacccgccgccgcggccgtccctcgccgccatcgtcgtccccccccaccaccgccgcgcccatcccccaccgccgccgtcgccgttccccgccgccgccgcgccgtcccgtgccgtcctcgtctacaggggacggctacagtaggccggccgcgcgcgagtcgggatgctccccaacgggatgcccagctatatctagtaggaatcacctgatacctggtaggtatcatccgatacctcgcaagtatcacgcgatacatggtagaaatcgtctgatacctaacaggcatatcacatgatacctcgcgagtatcacgcgatacgtggtagaaatcgactgatacctgacatgtatcacataatacctcacgagtatcacgcgatacgtggtagaaatcgtctgatacctgacaagtatcacatgatacctcgcgagtatcacgccatacgtggtagaaatcgcatgatacctgataagtatcgcatgatacttgcaagtatcacctgaaacgtgtgtagaatcgtctgatacttgaaaggtatcacacctgatacctactcgggatcatcccattcgaaaacgggattccgttatatactacccccattctttaaacatatcttaggtttggccagtggggcgtatgctccaattttatgatattatatgatcctaccaaaccaaaatgatactgattctatctagtatcctacttttcatagtattttgatctttcttttcacacgatcatacgaaatcttaggtagtataccgattctacgatccccacgattctataaaatactatttataaaaagatggattcaaaataatatgaattaatatggttaagtttacataaaaccaattaaatttatcaaaattaatattatatactttaatttatacaacatattctatattccatataaaagtatatactttctaaattctgatagtttcccgattttatgatactacagataaaaaatgatactaccctcgatacttatcaccttcctcttaggcctagtttagttctcaaaaatttttcccaaaaacattatatcgaatctttggacacatgcatggagcattaaatataaatttaaaaaataattgcatagttaggggggaaatcgcgagacaaatcttttgagtctaattagtccatgattagtcataagtgctacagtaacccgcatttgctaatgacggattaattaggctcaaaaaattcatctcgcggtttccaagcgagttatgaaattagttttttcattcgtgtccgaaaacccctttcgacatccggtcaaacatccgatgtgacacctaaaattttttttttcacgaactacataggcccttagccaagagatcctcaatttgttaggcgcatactccattttgtagtagtacaacatgcgtacagtcggaatgtcgattacgaatctcacagtacgggaagaatatgctccgtcctttgcaactaacctgaagatccttcttcagagagagctttcaacttccaagttccaaagccccctggcataacgcaacacaccaagctactgctgtcactgcttcctctccagatctttcctgcaacctgtacttccagacagcaacgtaacccccctagctgcaaacagcggaccggaccgcgacgacacaccctgctgcttgctatgtgggcatgtggcgcatgaggtcggcatccggcatattatccttgttcgatccccccaccacagtactgtacagtcctactacactcgatcgatcagtccagtctcctccatctatccatccccacatgtacgtcctctcgccatcgccgtctcatgttcatgccatggacaacggcatccgtgcgagcgagatccatgacgagacgagagacagcttgcccagcttgtgctcgcaccgtcgtcaatttgcgcaagtctgccgtgccggcctgcaacgtgtgcttgccctgcaaaccgctagcaaacgactactggaagagtctccttgcctacactagctttgcgtacgtgcagactggataagagatgataatcaactagccctgtcgggagaaagaaggcgtaatcgatgtactgtgatgtggggttcaggcgagaaagcaaccgtaaaactgtgggtgctcacaagatgttttactatacaggtttagaagaaaagagagggctctaaggcaccatgttacatagtatagacgtcggatcacctcgtggcccacggatgacataacaacgcctacttcccatattctgccggtatactctgaagatagccctacacctaatagtgaaatacaggtacacagagaatttggggatcaatatcagcttggatctcccacgagcaaattcaggcatcaaattgaaataaccctgtgacggtccatgagtggtggatggatctagcctctaccccagaggtaccaaagaaaggcttgtgcaactttatcctcctggcataatgggagttttggaaggagcgaaattagggagtgtttagacacaaagaactatcggcaacatacttggttgcaaagatcaaagagaaggcaaagacttggaccatgacagaagcgaaagtactatgtaacatagtgccttagagcgctttcttttcttctaaacctgtataaaactattcatgtacagttttttcctactatattcaattaaattggcatactctaagtgccggtttgttaaaaaaaagatagttaactaattccctgatcgataataatgaatgcacaggtgcccccgcgtcgccctcccccaggcggctcaggaagcgacgcgcccaccgccgccttcctctccccgcctcctccgcctcgccgccgcctgagcaggcgccggcaaagccgcgcggccgcaaggacggcggcggcggggcctcgtctcgcccacgttgcgctcgaaggccgggggagctgtccatggcagcagtggtggtgaccagatccgtgccgtgtccggccagatctggcaggggggtggccggcggcgggggctgacggtggtggtggcggtgctggtggcggttgtggcagcgacgacgctggtggcggatatggcggcgaaggagatggcgacgacggcagcgggccgcggcgcgtgtcgcgacgccggccgggctcgtcaaggacctcgccgccacgacctccggcatgccgccctcgtcgacgctccctccatgacgctgatgacccgcgctgcgcactgcacctccagatccgcgccacccaggccggatctggccggctggcggcggtggcggatggcgacggtggcggctagcgatggtggcgccagtggtggtgatggttggcaggccatcacgaccgaaggggctgacagtgcgtcgttgttggcggcagcatgtggaggcggggaaggagaccgggtgtgggcgtgacgtcgacggcgagaagatctgtggcagtggcctaggctagatcgctaaagggaaaatgtagtcgaccggcgatgatccttcttgtgcggattggttgtgtgggtttggacagggaatcgctggcaaaagcctcactgagccgtttggctggctgacggcggcgacgccctttggcgtcgttcccctccctggaggcgtcgttttagcgtacccctctcctttccttaccattctccgggtgaaaaccttgcttcggcttccgaacgagcggtggcggcgatccacgtcgcgtcctccttgggggcaccgctttggagaaacttattcgtacaaggatgtcgttgattgtctatgcatttgcttcgaatcttttcagccctaggttttgatgagtcctttgctttctagctccaccttttgttttgcagtgacgacctcgctctttgtttgattttgctaggtggagtcggagctgcttcgtcggggtgacgaaactgggcaacgatgacacgttgcgttttctttctaggggttttgttgttggccgtaaatagattgtggcgcttaggcggctttggctgatgttcatcgtgggaagtcgaagctacttgatcatttgcagcatctaggtttagatggtgcatccggtttgaagtaggagctgccgtgtcgcgtggcggcaagctcggcaaagatgacacggttgcaaagtcggaacctcctatgttgttttggtcaaccttggtaacgacatcctacattggactctgtcagtggttttagctgttagtgagttcggtggttggtttttcttttcttgtaacccgtctagggtttttactcctgcttattgaaaatataattggcagctcccctaccggtttagtttaaaaaaaaaagataataatgccagcaggagctagatgatgatcgatacgatacctctcatgggaaaagatcagatcattccacggaccactgtttggccactgtttacaaggccaatcttgtatcatcgattctacctgccgacttcagagatcgacgcagctcagcctcgatcccaatcactgtcaagtcagcgtggcgactgatgaggagcaccactagcactgttccatttgtaagtactctgctagctactagcacaagcaaagcgatgcagggatcagctagggattcgtcagcttggccgtgctgataatataggaaatgcccttggtttacaggtctttcattggacgcaccggcgacggctttccccatgtggtgttcgccggggttagcgattttgatacatatatctggcaggtgaaggtgctgcgccgtcgagatgcgcgcgcggcgacttttcggcgcgtcaaacacgagaagcatatagaaggaatagaatagttacatggagctggtctttagccaaattctcctgaaatgggaaagcctatgggagaagcgcagatgtcaaccatcgacccttgcattatttggaaaattctaagcttagggctaatagcagtaggagagtgtggagtgtggtatggtcgaagcgtacaggccggtacatgggactgatggtcccatggctatggaggtctaggctggctttttctagcaagatatcatattattgtacaagcttcagctctcaaagatgggtggagatttggtggtcctgaaggaatgttcatcgccaagaatgcgtttttagtaggactagtgttcatcttgcctgcagcttttgttggcacactgcctgagttgaaaaaaaaaagaagagcattttgtgtacgaagtacagagcacagtaatttgtaaggttggacttggaggttgcaatggtcatatcttatcctccaaagtgagcggactagacatgttattctgtaattttcatagactgtgcatgattaatgagccaggacatgttttctcaaacttgctgcaattcacagatcatagctaatgcaatgcatcctaatatctctttaattaaccttaatagctattgtttgatcagaaggtcaacagagaccgatccaagtttggattgcattatttggtgtttccagtgcgatatcgtggatgagaaaataattctgaagcaactagtgtgcaagagttaagaactaagaaactgaacttgtagtttcagactacaagcaccttattccagtagccctcaactgggttaagcagacctttatgacagttcactcactatcagcacattagctatggatgttcagatagcatcggcactaaagttttttttaagggatgcacattagctatggatgttcagatagcatcgatactaatgtttttttttaagtgatgcacattaactatggatgttcagatagcttctttctattaaacatgtgtgctaagtttacataatcatgtgcatattgtattactcatgtagctggtgggtgatggcagcaagaacaaataataaatggatagatgataggaaataccaggctgatggtggatctgttcagcaaatcgagtcatgggctgatgggtctcccttatacacaccttggctgaattttgctacgtcttcatggctctttctccttgaccagctgctgcacatataagcccataaaaaaggctaatgctcaaggatcaagaattcaagatatccaaatatacgttgagaaaaaaaaaaacattgctccacatgattctaccttgttttgttgaatacgtacatctatttctacctatcaaacactggattggacagttcatctggcatcaggaattttgggggcagctaagttcgttccaattgcgattatcagtacattgattctgaagcttctagctgcagacacttatcagcatttacctgaccacattttatcgttatcagctatcacattatatcaagttatacatgctctcatgaatctttatccctgtcatcgtttccgaaactataatactagatatttgagtccattcctattatattcagttcagcgatctagtgctcatgaacaacaaattcatctaaaatattggaaaaacaattgtaccccatccctgattcatctaaagaagtggggaaggagtcacctcagttgagcccgaagacgaagaggaagagaggccgcggcaaccaccgggatcgcgactgcgatgggggcacgttgagggctctaccatctcctccagcaacgtgcgagcctcgcgaagtggctccacgctccctcgcctccggattccggcgccatcgccgatgtggggatctcacatggtgaagaaattctccaagctcgcctctcatggcgcgatgtctgaacaccggatgcggcggacccgctgctcggctatttccgaaggcggccgcggggtgggttgtcagcgagtttgggcgtcatggcagtaagagaaaagaggcgccatcaccgggaaaagatcagagcgccggcggcggcgacgacgaagacgacgggaagggcggtggcggcagaggcggcggaaggatgctggcccaaccaatacgggccgcacgtacaccaccagcccgttacgaggcccaatttccatatgcagcacgttacaccgtaagcccgtttaggcccaactaatatgggccgcacatacaacataatccccatttggcccaaatagtatgggccgcaagtatagtgcaatcccgttgcagcccaaccagtacggaaccgtcactttcctacctgagagagtcggagattgtgcggtgcaaatgaaccgtccgatccatcttgtgcggtgcagattgaacaaaggagaggtggcggttactgcgtatacgtattaccgtttgccccctctctggtgcggggtcgatgggtcccacttgtcggcgagatggcaagaacggggcctctctgtctcctgctcgagaatccgcggccgcggctgccgctcgccggagctccgccgacgatccggcggcggcggctcgagtttcgtaggtgcttcaactgttatcgtcctccggatcacagacgttgtttaacatggtaccaagtttgcgaagcagagttccctaaaaaagagtgcgaagtaaatcaatttgcagaggaatcatcagactgggaggaaataattgcgtcgatagcagttcagttctggtttgtttgttggtctgttgcgttcagtgtttcagacagtgtcaattgtcaagaccacatgcctcaaatgtcaggtgctgttgataatcttcagaaccgctctcccctctttcgtaaagcgtaaaaaatagcggcacttggccatgtgttatctgtgattccactaaactgaaagtgaattgtatataatcaacactagttgatgaagtgtttcaactcggcttacttccagtggagcacaggaatggcaccatggttgtttatttagttcatatcactggatatctggatcaccaggcactgttcagtttcagtacttcagttcagatatgcagagttgcagactgaataaatatcgtcttacctagttatttacatcatagatgtttcttttgacatgatcagaaggtgcttccatggacaacacatattctaaatctggagctcacatcgcatgccatgcacagttttcgggaatacgcaaggagcgcatttttttctattaagagaaataaaagttatttacaaggataaaaggaaaacaagtaagggaccaatacaggacgctatggaaaactataggaatatctcgcgctaaatttggctaccacgacctcataaaggccaaacagcggggatcccgtgattagccgactttcaaagcatggcctcctccgccattgctttcaccacttcggtccaagacctttgttgttgattgaagattcggttgttccgtttcttccaaattgtccaagccaccagtatcatgacagtgtcgaagcctcgacgatgccgctccccaatcttcattcggctctcacagagccaattgtggaaggatgactcgttgacaggtaatcagttcagactccttatcgcctgaagcgtccaccaccataattgtctcgattcagggcatgctaccaagatgtgatcaatgctttcctcctgctgatcgcaaagaacacagcgatccgggtgtggcaaccctcgactgcgcagacggtcaacggtccagcatctattcattgtgaccaaccacaagaagaagcggcatcgaggcggagcgagtgacttccaaattggggtggaaaggaaggtgacacgacccaaaaacaaggccttataggcagattttgagctgtattggcccgaactctcccatttccagatgattgaatcaggagtagtaggatcaagatccaccatttggacaagcgaccaaagctttagatattctagaataggttggatcccaagtgctcctcggatgtctttgatccattggcgacctgttagtgcctcagccaccgtccgacgccggcgcacgcatggtggaattttatcatagatgttcggagcaaaggaccgaatgcaaccctcttgcaaccagctatcttcccagaagaggatagtttgtccgtctcttaattgatagacggtagaggctgcaacgaagttcctttccttttgcgaccccggaatggctagcccctgccaaggtttgcttgaggaggtccattgcaaccatgtccacctggaacgaagagctatacccataagctccagattcggtacacccaaaccgccgtagtttttaggggcgcaaactctggaccaagcgaccctgcaacaccctccattagcttgcgcagttactcagttgatgcatgcaaagtgcctctctggctggggcccgggggagtttagagtcaacaaaattatgatgcagctttagcgggcaagcatttctcatcagttcatcaccaaagagatcacagatcggcactcccctgagctactgtatcactgtgtgctgctgaccattagtcaagtggcggctcagtgcagccaccgaaaggcttcaagattcaagaaaccatcagcccacagaggtaaagggagctcatgctcatggctgttactagtaacttttttttaactcatagaaagaatagacgctgctctgctcagtgctcactcggaacaaaatttccctttgctcgtgatgaagattctgctctgatcatgtagtgccacgaggttatcggatgaacaatcatgtactaggatgtatactctatgtacatcctgttcagagttcagacatggtgagcacgcatttgttttcatgtgcctaatcaaacatgaaaattgggagaaccaaaagatgacttgactgttcaccatttggaactggggttccattacgaaaattatatatatatttaatataatagttagtttggaccatatgtctgaagctgcaaatgtgcaaacccttgaaaggattagcaatttatagaactaactagatttctcagagtatcagaatatttggattaatcgaacaggccctaatggacttgtgcaatttttgtttcttcgtacacatgtaacctgtcatatagttttattttccatcagaagttgatgcccaattaatcacatgacagtgccattttctgaagtctgaactgaagaagaagaagaacagagattcgtatcagccaggccatttatgcgagaaaacaacatcaaaccaccaataattcacgctcgtttgttcgtttgcacctttcggatggcatcggaagccaagaaacaggcccatcaagagatgtccagctcctcgcatttataatctcttggatagaaaccatggaaggtgccccagctgttcagatggcttgtgatccagctgctgttggtgccactttacggtcaaccacgagcagtggtcgagggtgtcgttcagtggcagtctttctccaaaggcaaggtgaatggcactttctgcactgcagaagtgcagattggtggatgcttcggtggtcatggtgcactcaacagggcatgtgaccttagctgcatctttgctgtgaaactgtactaaaagcaagtggtttgttttcttctatcccgggaggcatatacctccttgacacgtctcctttagatccaagaaacatttcttatgagatcctttggaacaaaccccaattctataggaaaattaacatgagctcaaaccttatgtttgtttttttccctttgactagtaacatacctatgcattgcaatgggctaagacaatctagcataaagcagtgagctttttttatccaatcacttttcctctttttttctattcatttagcgtgtagcaaccatttcttttctctaacgatttttttagcgtgcaacaaatgttttccttttttttagcgtgtgctacgtgcgagggggagtggggggggataaagatgattgtacttttatagtagtagagataattctaatgcactctctccatttatttctctaatttctctttttagcacaagcaagttgttcaaaattgttgtatttatttcttgcaaaccatccaaatgaaccaactctaatatttatgtgctttagaatcatataggattctgaaacacatgaacattctattcttgcattgtgtttcagaatcatatgtcagggctcctttcaattggagtattttcgtagtagtttttctaactaggttgtttgggatgttggattgaaagttgctagattcttggattgcatacttatacctcattttaattttcctttgagaagcctaatacatcttggtttctctctctctctctctctctctctaaaatccatccaagttcatgtgttatttttttctgaggtatctaaacaattaatctttcaaattctcgtgttttacaatattcatgcgagatatgctaatatatgacatctcattcattccaaacaagccccataactcgagtccgtgcatctaaaatacatgcctatgtcatgaagatttggtttagtagtgaaacctaaatattgctacaattaataataatcagagaaaaaaaggaaaataagtggtggtctaaaattctccgtacaactgattgaaccacgtggtgttttataatttgtccaccgtcacaaaagttccataaaatagaaatgaaaataataaatagctcacctaatattaagaagctatggtgttgtgtaatacgttactctctttctactctgtataagaagtgaaaaaaaaacaattggtgtagatttaaggtggtttttggcaaggtgaggcatgaaagggggcctgtggatgtgagaattgtcaagtgggtgtgtattatatgaatgtttatataaaaatggtcaattggaaggttttatatgtatgggaggtgcatgcacatatttgggtttgtacaattgtgcacttcaaatgaatttgtagaagatttatagttgcatagcagggctgcaggaatt

SEQ ID NO: 54814 - DNA, 2760 bp, Oryza sativa
tattcaaacgagcaatgagcaagaaagaaagtacaagtacaccactcatcagcccaacaacaaaaaggaaagacagcaaaatacagtagacaaccacgtaccagctcactatctccatcacaaacgttgaaaacgtatagatacaacctacaagtcgtgaaataaacataacccagctggttagattttctctacaaaaataaatcactcggagttctagataatgatgctcgaactaattgataagtgtaaagatattgtgagcaactacaattaattgcatcatggtaaagaaaaaataactatacaattatacaaccagccaactgtccacctaatgctcagattaacactaatatcatctctactggctgccattagttcattaggtcccccactaatactgaccaccattaaattagagagaaaaagaaattaaaaaaaaagaatactaagaaaaatcaggctatccgaagttcccaacggtcacctcgtcgtcgttgccaaatctgccatgtcgccgccatggatcccctaatcgaggacccccccaacctagcggagacgaagaagaacgagaagggaagcccaccgcgtcgccatcattaactcctcctctcctctcgtctccctcgaaagcaccaccggatccgacgaccccctcctcccctttctcccctcctcacgaaaccgcctcgccttcctcttcttttctttttcgctcgcttcgcatcgctcacatgcccctgcctgccgccgcagacggggcgccatgtcgcgtagcggggtggaggtggtcgtgagcaggggttgctccaggctcgtcctccccgggatgcagccttcctccgcctccgccgcttcctcctcctccttctcgcgcggcggacatggcggcggcggcgaccggaggccgctgcccgatggccccttcgccggattggtcatctgcgtcaccgggctatccaaaggtgcgttgcttttttgcttcttgatttttttttggcccaaaatggtgaaatctctgctgtagtattgatgaggtgcgcttctttttttttgtgtgtgttcttggtggttggggatttgtgttgtgtgcagaggcgaggactcaggtgaaggaggcgactgagaggatgggaggcgagtacagcgggagcctgcatcccaagtgcacccacctagtggttcagatatccttgcaaagatcatggattatggtagcttgttatctcttctcttgggtctcctgctgtttttgtttgtcaaattcaggacggcatatgcttttccttagcgcgcagcacagcttcgccggccgcaagtttgagcacgcggtcaagcatggcgcgaagaatggcctctttgttgtaacacttggttggcttgtggattgcgtgcggaggagcagtaagacgagtgccatcctcttctgtttccagtgaattgtggcggcatcgtgttcatgttacggttgtttctatcgcagtgaggttggatgaatcgttatatagcatcaagaacattggggagaatggaatgccactcggggagttcaaccggcttgtcggcgctcctgttagtgggaattcttgccttccaccgatgatgtttcaggaaaaaacattttcagacacgaccgaaaagcatcggcttcagacatctagaaaagaacatgaccatgatgaatttctctttacaaacgactcgatctacattgaccctgggatatctggtgaaatgaggaagaaggtatgccccgctcttgctgctggattttattatggttggccttccaagtatagctttcggacagcaaaataggacttcaggacatttctcacgatggaacgttgtagcagagcatcatgtggatcaaagttttgctaagcatcgtgttaagagcaatgcaagttagatcgtttgatgcgattgtttccctctgaatttctttagttgacaaggataatttttattttccataccttcccctttgcccatcaatacaacaagacatctcttggtgaactgcatggctacgtttacataaaatgcatcttgtctacaggtatctgatgctgctactagagaaggtgcaaaattgttggaccactggtttattggctgtcatgagacatatgttgtgtgtgaggacgcttctgtcaagagatatgttggtcattcagacaacattgtaactgtaagcatgttgcctttggttctaaacttctaatgaagtttggcagattttgcttgtattaacattttctgcatttaatttgtcagccactttggatattgaaaaccgcaaaggaaaaaggtttgcagcgtcttgccatttgtcttcggacctggctaggcaggttgccacgattcttgaaaatgcccagacatttcaagaggtatgacatgctatacatgtaccttaatcaattatcctctcatccagtatacattttgtattcctaaaaaaaattgcctttcaagagatttggaaaatatggattttctcagacctcacaagctcctagaactaggaattctcctgtagatatctttttcttgggtacttccccgctctttttttctctggaaggaaacgaaaagacagtaaatgttacctgacatattacatgagcaatcctctatcttcataaaacgttcctgaaataaagaacagatagagatgggcagctaccctcctgtaatgtatttagtgaagagcagagaagactggtccacgtagatgggaaataatgg

SEQ ID NO: 54815 - DNA, 952 bp, Oryza sativa
ctgcagccctgcgtttatatttccagcatcactgcaacatttatttttccaaacgaaaaaggttccttggattaatgggacataattccgtaccagcgcatctgccttgtgtttttggacttgtttctgtaatacaatgccatgaaattcatcttggcatgtgtatgaaactatgaaccaggaactagaacacaatcaggacacatttcattatctgtagtcccttattacacaattgtgtacatataatgtataaaaacctagtacttttgtagaattatttggttcttctatattatataaagtttttgataaaatgtctaaattatggttttaagccagtcatgtgaagtaccaatccatccaatcacgcctgtgaaacttatggaatcaatctgttggaccgtatctgagccaactacgtccgcatgcatttatacggagttttcatggtcagacgatgcctttgagcaacaaagcactactttcttcgatgcgaatggggatggcaaggatgatcagtcaagcgatagtttcacccgcccactaagagaaaggtaatcaatgcttgatcttggtcaaattctttttaactgttgttctgatatgcttgtgttgttcctttagtgagaagagtgaagtgatctttaagaaccacttccttaccgtactcttccccattgatcgttttggtgagcttggaccttcctcaaggacattcttcagcaatggtggtttcacacgcatacaagtgcttgatcacatctacaacttctaccaggtacaatcagtatcttgttattaagtttgttgaattgagtgcaatactgcctctttctgacagaactcttgaccaatttttacagtggcttagattttgtgtttagcttgtaagctaacccataattatctttctcgtttgtgaaggaaaatatgtcttccgatgagataa

SEQ ID NO: 54816 - DNA, 1066 bp, Oryza sativa
aaagttaagtccccggatccaaacaccaccttagtccctaactaaactttagtccctctcacaaaaaaattagtccctaactaaactttagtccctctcacaaaagcaaaagtccctcccatagggactaaattttttgtgagagggactaaagtttagtccctccttgccaaacaccaccttagggacttcaattttacaggcttacacagactccaacagatgataacttcattacagtaatttatcaacaattatttgttccccttgtttgctaatgagtaaagtccatcaccggtccctaaacttgtaccgttgtgtcatcccggtccctaaactcgcaaactgaccgttcaggtcctcaaacttgttcgactatgtcatcccggtccctaaacttgcagatcactcatttaggtcctccaacttgttcggttgtgtcaccccggtccctaaacttggatttgaatatcatctgggtcaaataggatggtctaaagactttatatttaaaaataattcataactttttcatatgaattctaatgaagacaaactttatatcaaacttgtagccctcgacgcgatctacaactttgtagttgaattttttttatttaaagtcattttttgtcccaaaatgtaattttaaaattaaaatttcaaaatctataaacatgcaacaatattttgggaccctaaacagttttaattcaaaaacttttcaactacaaagttgtaggtcgcgtcgagagctacaattttgatataaagtttgtcttcagagttcacatgaaaaagttatgaattattttttgatataaagtttttagaccgtcctgtttagggaccggggtgacacaactgaataagttggaggacctaaacgagtgatctacaagtttagagactaggatgacacagtcgaacaagtttgaggacttgaacggtcgatttgcgagtttagggaccgggatgatacagcggtacaagtttaaggaccggtgatggactttactctttgctaatcattgtagtgtactagagtctctaaggaagccatcag

SEQ ID NO: 54817 - DNA, 32707 bp, Oryza sativa
  unsure (1)..(32707): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccctctgcctgcgcagcggcagcgcgccggaggccggaccggcctactccagctagcaacggtgggggggcactgggtttggggctagctgtgttgtgtgtgggcgcgcgcacggtgcgacgttcacggtcggcagcggtgccgcgcttgccgtgggccgccgccgcgtgctggctagctgggctcgcagcggagcctgcctgatctagtggcagacgatgacggcagatgaaacgaagcgagaacaagtccactttgattccttctaatatgagtccacggataggatagtcccttaaaagcaatctaaactatagatctagtagtatttaaggatctctcaactgcaataacacatcaactattaaaatcattataatttaatttcctcggttgttttaaatgtggttttcgcttatgtggctagataaattggtctagccagctgagccagcttatggagcccacatgttagcagatctatatcaataggctgggtataatagctcagcaaggtcatcgaacttgttagggatgaatcggctctgcgcccttgtcagctagagactcttatcttgattatgtttctcaatacgtaggatgaatttgaacttgttttttatagtattagatgtcaacatactttatattgctaatttcccataactatttatattgaatttagaaaaaaaaaagtacacgaaggatattcccttatcatattagaacccattccccatcttattggagtggtggagttttcacagggaccatactatattggtttccatgaagaggtcaattataaagtcactaacaatgttctcagctcaattaattaaaccttcacccacactctttgactcttctaggcttactctaagaaaaagagaaagagaaagaaaagaatcagaaaagctttgccacacctcacaccttgtgtccttgtgcctcctacaaatagctcttgccattcagtttcctctcagcagcccaacagtcgtcttaaaccatccagctagaagacaacatcctcttaattccggccttaatggaggtagcactctgtgcatcctttgttgccattctgctaaccaccatgctcttcctaaaagccatctcgacgaggtgccgccgtcgaaagtataacctcccgccgggtcccaagccatggccgatcatcggcaacctaaacctcgtcggtgcgctcccacaccgttccatccacgagctctcaaggcgctacggcccactcgtatacctccggttcgggtccttccccgtcgtcgtcggctcgtccgtcgagatggccaggttcttcctcaagacgcgcgacgcggcgttcatcgaccgccccaggacggccgccggcaagcacaccgcctacaactaccgcgacatcacgtggtcaccctgcgacgcgtactggcgccaggcgcgcagggttgtcctcaccgagctcttcagcgccaggcggatcgagtcgtacgagcacatccgccgcgaggaggttcacgcgctgctccgtgatctgcactacgcgtcgtcgtctggcggccgacgagctatcgtgattaaggactacctgtccacggcgagcctgaacatgatcactcgcatggtgatgggcaagaggtacgtgcagggcgaggtggtccatgaggagccgggatcggcgcggacgacgctggcgcagttcaaggagttgctcgaagagctcttctttctcaacggcgtcttcaatgtcggcgaccagatcccgtggctcgagtggttggacctacagggctacgtcaagaggatgaagaaggtgagcaaggcgttagaccagcttctcgaacacgtcgtggacgagcacagtgagcggaggcaacgtgaggggaacgggtttgtggcaggagacatggtggacgtgctccttcgactcgccgatgattctagcctcgaggtcaaacttagtcgggacagcatcaaggcatttactcaggttagcgactgcatagcgtacatcgtagtactccctcgtccaaaagtctaggctgtttggatggtattttcagtacatgtcacatcgatcggatgcttaatactaattagatgtttaacgtattaaacgtagactattgacaaaattcattctataaccctgactaatttgtaaaataaatctattgaacctaattaatccatgataaacctatgtgatgctacagtaaacatgtgctgattggcttaaaaaatttgtcatgaaaattagctctcatttacgtaattaattttgtaagtagtttatgtttaatactccaaattagtgtctaaacatccaatgtgacagggactaaaatttagtcccggggtcaccactagtcctagcatggtttagtttccaactttttcttcaaacttctaacttttctatcacataaaaacttttccacaccacaaacttcttaacttttccatcacatctttccaatttcattcaagcttccaattttggcttgaactaaacacaccccaagactaagaatcaattaaatcactcacgttgtgacaaaaccaatgaacatgtaactaataagtactaaaatggtttcttggttctcatcaataatttaatttagcacataatgactaaaaaatagaacttagacttttagaaaaaccaaagaatgaaataagttttagacttttggaatgaggaaggacatatcaatcaaggggaatagacaattttgtcccaaatttcgtccacaggtcaatttggtggttgatttttcattttgtctaaaggagtcctccagatttgcgcaggaattaaggacaagctaatgcctaaccttatggtaaaatcccagtgaagtatattagtccctccatacttcctcaaatactccgtttcaatttacctatcacgttcaagatttgttttaagtcaaacattttgatctttaacttcaatttctacaaactcatgtagttttacatcataaaatttatacttttggattcatcatgagaatactttaatataatatataattcacatgttgttaaattatacggatttctaaatattaatggttaaagatagacatgtttgagttaattagactaaatctaaaatgataagtaatataaaatagagggaataatgaaaaggaaaagtcactccagcggtctcatctattcgttcccatcaggcttgctcaatgcaagaaggtgaacaacagtagccagtagttacatcatgttagggggggtacagcacacccaggaattatctgagatgttaattaaagtataagaacaaataagggcaaagttgaaaactcttttgttctctaatgaaatcatattagattacttccaaattactaccttcgtcccatattataaggtaataaggcatgtattttttacacggtctttaataacatactttgactattaatttactacatgttatgttctcaactatgaaattagcatcacataaaagtacttaaaaatatgaatctagtaatataacatgcataatataattagtacaattattaataaaaaaaattaccgagtttgattttctaaaaaaaacatatgtaatttggaacggaggaagtaagaattttccatgaggctaaatgttggttctagctttgctcacacatataacaaacttaaaaaggtgggaccacaggacctttctaaacctgcagatatagaattgtaggaatcattttatgaaatcccaaaagcaaaatgattacacggtaaaccttttgataggcaaaattaatcagttattctcctccaccaaaaaaaagttaattattctcccccaagaataagtcaagcaaataactggcttggaacgttggaagttaaaagttcatactaatatgctgtgcaaatntagtatatgagttgtgaagtgtaaatgactgaaacatactacctccattttttaatagatgacgccgttgattttttctcacatgtttgaccattcgtcttattcaaaaattttatgcaaatgtataagatataaatcacacttaaagtactatgaatgataaaacaactcataacaaaataaattataattacgtaaattttttgaataagacgaatggtcaaacatgtagaaaaaagtcaacggtgtcatctattaaaaaacggagggagtatatatgaaactagaatttcttacatgcatgacgccaaaaattattggcttatatataggagtaaatatcactataggtcgccgtgcataatattttttacttcagtgcaccctttttttcatagttgacaaatactaatccatttttttgtcaaaaaatattaatccaatttgtcttcacaaccaatcaatcacatacgtggacaactgcagaaaatgcacattttttttcaaggagaacacattacaagaatataatcaaattaagatgttacctcctccgtcccaaaaaaaaaaatcaaaccctaggtctgaatctggatatacatatgtccagattcatatccagggtttgatttttttgggacagactagtaagtcgtttctgagttaactagtccaaaacggcatgtgtaggacctcattgctggcggcacggagagttcatcggagacaatcgagtgggccatctcggagctcctcaggaagcccgagatgtttgcaaaggccacagaggaattggatcgcattgtcggccatagacgttgggtcaacgagaaggacattcttgatctcccctatattgaggctattgtaaaagagaccatgcgccttcaccctatcggacctttgcttgcgccacgcctttcccgtgaggatacgtctgtgggtgggtatgacatacctacgggcacgcgtgtattcgttaatgtgtgggccattgcccgtgaccctacgctatgggacgcatcggaggagttcatgccagagagattcttgggtaagaaaattgatgtgaaagggcaagactttgagctattaccatttgggtctggtcgacggatgtgcccaggctacaaccttgggcttaaggtgatccaattgagcatagccaatctccttcatggcttcacgtggaggctcccgaaggacatggtaaaagaggatttgagcatggaggagatattcgggttatccatgccacgcaagttcccactagaggttgctgttgagcccaagctctctagtcacctctacaaaggtgattgatatatgtctctatgtcattactcatgtagctggtacataaaaagtatatgtatttctgaacaagaattctaagccctcaagagatgttctattatgtgtatgatacaaacagtcatgaaagattctaaaatatttgattatacagagtacaatgatatctacaactccagaaaatttctagtctaaactcaatatatatgaagcgggaaaaatgaaggcaatcttagttgtatgtatcattcctgccatgccaatataggtgtggcccttttttctatagaaacacggttctaacataggcgctcacaatgtgagtgtactcacccttatgaacacatagtctctacccctatgagcacctccaaaagtctaagtcagcacatcttgcgattgataaagtcaccgaagacgtctcgtttgtcaatgggtatgtcgtctaccactgaaagaataattaactgtaaatgcgagtacccatgtcaagtccaggacttgaacgtagacaatatagagaagggtgatgtgcatggcttcccttctttcctccatgtctttatgccagaatgatgaaccttccaagtttgaatgtttacagactgaacctacaatacaaccttgttgcatatgcaattaatgcaactatcatactcatgcgaatggcctatcatttggtccacaaggtatatcttttaggttttcttccacatttagagaggtatatacctctcctatttcaaaggtaaaaaaacaaatcagttgaagtaaacagaagacaagtttatgattagcaatgacatgacttctcttgttgttaggaggtacatcaaggtatatatataccacaaagtgtaagtctggaggtatataccttaaaaaaagatggaaagtcaaaaatatacttacaccatactctattagttttggtacttcctttcacaaagaggtctatattaaaaatgaagagatataagtatgggagaaacccttttatttttgtttttaggttgttgtaccatgattttttttcttgtttatcatgttaggagtatttggccttttgatggattctatgatagtgcaaactgtgtaatgattatgtacatcctagttagggcagagattctcccatcctatatttctagttgtcatgcttaacaatatttcactagcatactttcgggctagtatatatgaaaattaaactggaaatcaagatactaccactactggagaaaccatctttcgtgggttggtaaaaaaccacaatagtcccgattcaactaaaaaccgggactaaaaatcatttttagtcccgatttaaaagtgcaacgagtctatatgatatttagtcccggttggtgtatctgcctcccatgtcctaactcggccacgatcttatctctctcgagaccaagcgtcttcatcttctctctcgcctctctctctctctctctctgtcctctcctctctcgcaatggggtcggcagtagtgcggggtgggcagcgggagaagaagtggcgggagatgcgacggcagccgggcccgtgccggtggcaggacaagaagccacggtagggtggggttggcggcgcctctctccgtcctctcctctctcgcagtggggttggtggcggccaggcccatgccggtggcgggagaagaagttgcggccgggctgtgtcgacggcgggagaagcagtggcggccgagctggggaggcggcggcctcgccctcccttccgccagatccggcaggaggggaggcggcggcggtggagcgactgcaaccagaccggaagaagattttttttttaggatttgcgatgaatttgtttttgagaattagtgatgtttgatctgtgatgtgaatatgtgatgtatttgtaatgttttttttaaaatttgtgatgtgatttttttgagaatttgtgatgtatttgatctgtgatttggagattatttggggatttcacgatttggggatgtagtgaaatcaatattcaagcagttaaaagcaatgaaaaaaagaaaaagaaactctataccaggactaaattaggagcactagccacctgtctctaccatcttcaccaactagaacttaaaaatagatctttagtcccggttattttaatcgggactaaagatagtcttggattcgtagtaccagtttgcaacttaggactaaaggggttgcaaaccgagaatacagaccacttgttcactggtgtttttttttgcttaatatagagtgaagaagtttgggaatctgtggattgaacgccggccttctcaggtccaggcggttacgtgttgattgatagcacacgaatcggtgcgagattacatgtatatatagcacaccataccagccgtgattatctaacaaattaacaattaactgcatcctaaatcacagccggcatagtatcctatattgttacaatacggactcaacatttcaggtagttcaacactccccctcaatctaaaccataaaggttaagattgtatctaaatacagctagctgtttctcattcaagggttttgtaaatccatctgcaacttgatcttgtgaaggaacatactctatttccaacaatttcctagatactctttcacgaacaaaatgatagtctacttctatatgcttagtacgagcatgaaacacaggattagcagagagatactttgctccaatgttatcacaccatacctttgctgtttttggtacttctatcttgatctctttcaacagagtttgcacccacatgatctcagctgtgacattagccaaagccttatattctgcttctgtacttgatcttgacactgtaggttgtttacgtgcactccaagacacaagattaggccccaaataaacagcaaagccaccagtggatctcctatcatctaagcaacctgcccaatcagcatcagagaaaccactgacaagtaaagaagaagactttcttatcttaagaccaagcccagatgtttgttgcaaatatctcagaatcctcttgactgcagcccaatgaactgtagttggagagtgtaagtactgacagactttattaactgagaaagaaatatctggcctagttagagtcaaatattgcaatgctccaactatgctcctataattggtagcatcattaggtccaagaacatctccctgatgtattgagagtttctcagttggtgacagaggcgtactcacaggtttgcacttatccatattgattcgcttcaatagatcttttacatatttttcttgagataacagaataccatcacatacctttgttgcttctattcctaggaaataatgaagctctcctaagtcctttaaggcaaaagacttattcaggtcctgcaaaagagctgtggtggcatctggcatagagctagcaacaattatatcatcaacatatataagaacaaatataatgacatcacccttgctgtagaagaacagagatgtatcagccttggaaggcatgaatcctagctcttgcagttttgtgcttagccttgagtaccatgcccttggtgcctgcttaagaccatataaagccttgtctaacttacatacatgattaatcaaggatttatcttcatatcttgggggttgtttcatataaacctcctcttccaatatcccatggagaaaagcattactgacatctagctgtcgaaggctccaacctctagagatagcaatagacaaaataattctgattgtaattgcttttaccacaggactaaaggtatcttcataatctattccatacctctgtttaaatccctttgcaaccaatctagctttatatctgtctaagctaccatcagcctttcttttaatcttatagacccacttgcaatctataatattattagctttttctgcaggaactaaatgccaggttttattacccattagtgcctcatattcagcatccatagcatttttccaatttttatcatttaatgcctcatgtaaattttctggttcaccagaagctgtaaagcaagcatatttaactgtaccatctgtgtataccttttctttgcggattccactctgtaagcgggttctaggccgaactatttctggttgatgctgctcagccacaggagagctcgcggcttcttcatgcgatgcagaggattcagagacatcatcattacctgccatcgtcgtggcggacggagactgatcactcggctcgttctcaacacgcgtgcctgaagttgctgcatgcgtgtcactaccagacctgcgcacacacaagggtgtcacagatcccggcgactgcggcgatgatggttgctgctgtgacagctgctgcgtatttgcttcatccacccagtcctctgcacctatatttcctgtatcttctgcatgctcaacagattgatcaggcatttcattaggagaattaaacatctgatcattctcaagttctcccccttgatgagacgtgtgaataatgagatcagagggcaaaagagagatctcatgacgaatacgtgcgccagcattgtcatgcaatttagaaaaaggaaatacactctcatcaaaaatgacatctctggatatatagattctaccagaagcaatgtccagacatttgtatcctttatggcggtggctatgaccaagaaatacacattgctttgaacgaaattggagcttatgtgcattataaggacgaagattaggccaacaagcacaaccaaacactctaaaggatgaatagtctggtgtttgtttgaagagacgttccaggggagactcaaactcaatgactctactaggaacccgatttataatatgagtggcagcaagaaacgcttcatcccaatatttgagcggcatactagcatatgctagaagagataggccaacttctacgatgtgcctatgttttctttcggcagagccattttgttgatgagtatgtgggcaggagacatagtgagatatacctattttctcaaaaaaggaattgagtttctggtactctcccccccagtcagtttgcatggaaataattttacgatcgaacaaacgttcaaccaaattctgaaaatcatgaaatttctgaaaaacttcagatttgttctttaaaagataaatccaagtgaacttgctataatcatcaataaaactgacataatatttcttatttccaacagaaactggagcaggaccccaaacatcagaaaacacaagttccaaaggatgactcgatatactcaaagatttagaataaggtaactgatggctcttggcctttagacatgcatcacaaaccggctctttattggactcatctagacaaggtaatttattcttgctaatgactctggagataatgggtgctgaggaatgacccaagcgactatgccatctctcaaaggatggcgtgacagcacaaactacttttgcagatgatggaggagatgcagatggaactggatagagtcctttttggcgtctccccttaagaaccgttctcctcgtggcctgatccttgatcaaaaaatgttttgagtgaatttcaagaaacacagagttatctgcagcaagcttatatgcggaaataagatttttattggcttgagggacatggagaacattattcagatgcaatgggcgagtaggggtatgaactattgaatgaccaatatgtttaatctccatacctgaaccactcgccgtgtggatttgatcatgtcctttgtagacgtctcgagcggtgagtttctccagttccgaggtgatgtggtcggtggcgccggtgtcaacataccagttggagtcccgtgcatgggtgtggatggcagcagcaactagcttgtcgtcggggacgaaatcttcatcaaatcgatgccaacagtccgctgcaacatgtccgcgtttatagcagacctggcacaatggacgattgtcatagctgcgctgctgctggttgttgccgcgtccacgacctggtgcggcgctgcgcccacgagttgcgccgcgtcctcgcccagggtttgcgccaccaccccgtgagccaccaccaccacgtccacctctgttcgccatgttcgccgtggcctgcgcctgcctcattgctaacctgttttcaaagcttaaaagttgtgagtagacttccgcaaccgtgacaggttcaaccctgccaacaattgtggagacgacggagtcgaaatcttcgtcgaggccgttgaggatgtaggcgatcagttcttcatcatccagtggtttgccggctgctgcaacttcatctgcgagggtcttcatcttgccgatatattcagagatcgacgagttgcccttctatagagtcgtcagcgccaggcgcacgttgagagaacgcgcgcgtgtcctggacgtaaacatgtcgtccagggttttccatgcttcggccgccgtcttcacagcagctacttgtgagagtgtctctctcgtcaacgaggagaacaagaagccgaggatctgctgatcagcagcgaaccattcatcatagttcgggttggaggtcttgacttcctttccatcgacggtcttcgtgatttcagcaggaggagctgggtttttcccattgatgtgcccctcaagtctggcgccccgaattgccgtgagcacctgcgccacccagagcccatgattcgccttggaaagcttctcggtgacctgaactccgatcaagggattggagctcgcagcggagttggatgtagatgccatctgggtgctcttttcagatgcaacctcttcttcagatgactcggatgcaatctcttcagattcagatgcagaatcgatttcttcttccaatcgctctgataccatgaagaagtttgggaatctgtggattgaacgccggccttctcaggtccaggcggttacgtgttgattgatagcacacgaatcggtgcgagattacatgtatatatagcacaccataccagccgtgattatctaacaaattaacaattaactgcatcctaaatcacagccggcatagtatcctatattgttacaatacgactcaacattccaggtagttcaacatagagaatatctactagcagtacccatgaatctgtcttgtgcacaaatatcagagtccaagaacgaagaaaaccttattatcaagcatattattgactcactcttgccctattattccactcttacaaagacagaaaataatgcataagcaacaacaccagtactaatactgcaggcttaccggactgcagcgacgacagatgcagtaacaactgtaatcaacagacatgcaacacacagatatacatcagcaagcagacacatagaggtcagccgggagcttgggctcgacgacaacctcgagcgggaacttgcgcggcgtcgacaaaccgaagatctcctccatgctcagctgctccttcgtcatgccgtcgggcagcctccacgcgaagccgtgcagcaggttggcgaggctcacctggatcaccctcagcccaaggctgtagccggggcacatccgccggcccgacccgaacggcagcagctcgaaatcctgccccttcacgtcgatcttgctgccgatgaacctctccggcatgaactcctccggcgcgtcccacagcttggggtcgcggccgatggaccagacgccgacgagcacccgcgtgccagcggggatgtcatagccgtcgacggacgtgtcttcgcgggacaggcgaggcgcaagcatgggcgcaaccgggtgcattcgcatcgtctccttcatgatggcgtcgatgtaggggaggctcgggatgtccttctccgtgacccagcggccgcggccgacgacacggtccagctcctcggtgaccttggcgaacacctccggcttcctgagaagctccgcgatggcccaatccacagtggccgatgagctctccgtgccgccagcgatgaggtcctgtgcacgtgcagatgatgagcaacgttggagtttggaccggtgaatcaggtaaagaaacgagaacacagtcacaaactgaatattttgatcgatggtaaaatagcgtgcactgcactcggcacaacacatcttttcataatcttgtgttagttgctcgggttgcagtttatgttatgtaatccatgaacaatgtgtttcaccttctctcttcttagtataatacagggaagagcttccagccacttgcttaagaaaagaaaagaaaaagctctgcacaacatatgattaattagctagttgcggagacaatcaggttaatatttaggaccgattgggcgtcaacgaagtcaagatgtagctagtgcatggttatgtacgatgatactattataatccaactgactttctattccccataaaagaatataagtaagtacacatgcagtatttaaatttgtgtggattgttgcgttcgccagcagagactgtgagtgagtttgtttcgttttccacgcgcacatttctcacactattaaatggtgtgtttttttaaaaaaattctatacgaaaattactttaaaaaattatattaatccatttttgaagtttaaaatagtttatactcaattaatcatgtgctaatggctcacctcgttttgcgtatcttttcaatctctaaactcctaaaatatattggtttctgaacttgtcctatgtattatataaatccaaacagactccaaactgcttcatgtgctaatgtgacataccatgtcagtaggacttacatgtgagacacatataaactttttttttaaaaaaatatcctctctcctctctttttaattttattttttcaagataaaaaaatcattttctcctctctttttaaaattttatcaacatatggatcccaccgacaccaatatggcatgtccatgacaaattcaggaatccaaaaattccttttgatagtttaagaatggggcaattgtgttcttatctctactttcatatctaattgtgattttaccccctcttttttctagggtttgtgattttgccctcatttttttctgaaggaagctgtcgtttgcccctacattggatgaccgtttggtggacccaaaataagagtgtaaaaaatatagatgaaattactaagagaaaaacaatggaccattataccccagtgcaaagaacaacaccctgcattgcctttttcatcccacccgatccccattctgattacttgattagcctaaccctagtggcaccgccggcggctgtgcacaggcgagataggccggcggctgggcaaggctgtgatgcccagcgagcagcagcagatgcccacatcagcaaagctagtagggggtgttggcgcagtgagcaagccgcggcttcggcggagcgagtgaataggcggcggctccgagcctccgacggcagccgcaagcaggaggcagcttcggcggcacgtgcgagcccgcagcagcggcatcgcacgagaaggcggcggctccggtcgtgctgcagccgcctcttattttctttttcttttttccgatcttgtgctactttgtgaggagcttgtttgtttggtgattttttactggtgaatgcgatggatctttcgtacctggtgaaagttctgtgaaatcctatcaatgatatcgaagttctttcaaaatttgtccaagtgcgatcatatttttttggaaaatacacagatcctaaaagaaaagtagggccaactgtacagggttatacctgtctttttttagttttattgacaccgttaggtggttttaacagagtaggggcaaatcagagtttcgttttgaaaatgtgagggtaaaatcacaaaccctagaaaagaagggtaaaatcacaattgcatatgaaagtaggggtaagaacacaattgcccctttaagaatctagatgacacatctactataagattagaaaccaaccctacactacactcaaataatattaatatattgagatgctatttgactcggttaattacctgggtgaatgccttgacgctgtcacggctgaacttgacctccagcgaaggatcgctggcgacattgagcagcacatccaccatgtccttcgccacgaagctctccccctcgcgacacatccggttctcatgctcgtccaatacatattccaggaactgatcaaacatcttgctcagcttcttcatcctccgaatgtacccctgcaggtccagccagcccaaccacgggatcgaatccccaatgtcgagcacgccgttaagcaggaagagctcatcgatcatccacctgaaccgctcgggcgtcgtcaccacttctccctcgtgcaccacctcgcgctccaggtacttcttgccgagcaccatgcgcgagatcacgttcaggctcgccgcggacaggtagtccttgagcgccaccacgcgcccggacgccgcgtgcagatcgcggagcagcgcgcgcacctcctcgcgcggatgtgctcgtacgactcgatccgcttggcgctgaagagctcggcgaggcacaccttgcgcgcctggcgccagtacgcgccgtagggcgaccacgtcatgtcgctgtagttgtaagtggtgtgcttgccggcggcggtcttgggccggtcggcgaacaccacgtcgtgggtcttgaggaagaacttggccatctccaccgacgagccaacgacgacggggaaggacccgaacctgaggtgcatcaggggaccgtacttcttggagaggctgtggatggaacggtgtgggagtgagcccatgaggttgaggttgccgatgattggccatggcttaggcccaggagggaggttgtacacccggcggttgtgcctcaagatcagggttctaagaaataagaggatggtggcgagtgtgatggtaaggtaggatacccatagtagaaactccatctgaaaaatgtatcttggctggtgaagatgactgaaccacgggcgaacttttatagatcgcaagagggagtggcttgctaacgcaatagatataccattgagaattcaggctgcatatgggcattcgatcgatgttttgtttgcacttggcataaataaagacaatcattagtcaacttgtactggtcatgttaaaaaaccactgtggttaattgcccaagttgctaattaatctcgtgatctggaagggaatatatttcccgtgtacactcctaacacaccaactgacaaatgtcacagaaaaatccagaaaaaattagacacataattccaatggtattatacttacgtgtgaaatcttatattcaaatacattatattttagccgtaacaaaaaaaacaaatttctaacagatttttacttttaaattgtcagatttttcacttttttgttacggctaaaatataatgaatttgaatatgagactttgcagatatgtttaatactattaggagtaaatgttcaattattcgtagaaattttcgtgccatttgcttgttggtgtgcatggagcgtgcacgagaagtttgtacatataggatatgtacctctgatcaattggtatctattttacaatagaacaaattgcattgataaatggtgtactttttgtatgacctgttgaggtagtcattttcttttgagacagagaagctataagaaactgcaacaatgctatcaatgagtaagcaacagtaggtaggcatacagccgtgcaccatgtagagtaccccatacatctcaaaatataaacatttttaagaatacagtgacatgcaaactttattccaaacaagaggagtgtttaatttgcttcccatgtctaaccctctccatagacgatgtcttctgtttttatcaatttgctccacaactcttaactggaagtttcagttggcacatgtagaaagttagcagaaagcacatagttaaccagatcgagcctatttccataagaaagataaatggaacaggagacgagccttcttttaattctctatactattgggaagaaatcatgtatgagtggtttggtgagacttaaaggtaatccaaggtaactgaaaggaaaggatcgttgcgtcattgcagagtatttgtgggaatcttcatcttttcttctgacacattaattggcaccatgaatgatttgttgaagtttattcttagactagtcgagtccacaaaatgtatgtaaaaagctttgagtcaaaacaattgtctagagcatacatatattactaggagcgtgtcatccgcatattgtattactagtaagtcaagacacgtacaagttgaaattgtcagtgaagattgcaaggtccctctgttcataggtcatagctttattgtgaatagattgtaggaggtctgttgctagttaaaaaaggagagttgaatgagactccttgtctcactccccttctggattgagatttttttccctggggcactccattcaataaaatggaaaaagttgtagatttttagatttttttttctacccaatcaatccacagttgccaatccctttacatatcagaatctctaggattacactctattcagttttaccaaaatgccttctcaaaatcaagcttgagtgcaatcacttatttcttggattttatagtaacatatgcattcaaaaggccatgctaggcaaaataaacataatttatcctctgttaaaaaatatagctacatttctagtagaaatttgagctttttgattggttgtttatgacggtgggagtaattgaggacttttatgagaataaattctttaaatggttttaagagttgagaatgtttctttatacaatattaaagttaaagttaaagggtgtgtttggagtttggacttggggtggacaaaaaacttaaagctcgtagcgagcttggctcggattgagtcgaatttgtagtcttaataagtcgagccaaagtagacttttagctcatgaagctcgcgaactgctcgtttagctcgttaatacaagaaatcaacatatcttcatgtacttcgtgattttaactagtattcagtcatttaaatacaaccgaactatttatatttagtgaattatttattagttagtgtttattttcatgtttatatatgataaaatggtaaatgtgaaattatgaaggtagaataaatacgttaacaagcctaactaactagcttaataagtcaacttatgagactagccaagccgagctaagcttctggatcgttaacaggctcgttaagataacgagctcaaacgagccgagccagctcgtaaaaaataactagttgaggtgggcaatatggacttatcctacttcctacatatctgcgacagtggttttttttcatagggaatatctactgccagtatgatgaatctattttgtgcacgacactccaatatcgcataacaccttattatcaagcatattattgactcacacttgccctattacattcagctctacaaaggcagcacaggatgcataataagtaacaacgctagcaatacactgcaagcttaatgttggaccgcgacaggagcagtgcctacagtacagtcaagagacacagaacgtacacacgcacatcatcaaaggcatatcacatcaggcagcagcatagaggtgagcgggcagcttgggctcgacgacagcctcaagcgggaacttgcgcggcgtcgacaagccgaagatctcctccatgctcagctgctccctcgtcacgccgtcgggcagcctccacgcgaagccgtgcagcagattggcgaggctcagctggatcaccttcagcccaaggctgtagccggggcacatccgccggcccgacccgaacggcagcagctcgaagtcctgccccttcacgtcgatcttgttgccgatgaacctctccggcatgaactcctccggcgcgtcccacagcttggggtcgcggccgatggtccacacgctgacgagcacccgcgtgccggcggggatgtcgtagccgtcgacggacgtgtcctcgcgggacaggcggggcaccagcatgggcgccaccgggtgcagccgcatggtctccttcacgatggcgtccacgtaggtgaggctcgggacgtccttctccgtgacccagcggccgcggcccacgacgcggtccagctcctcggtggccttggcgaacacctccggcttcttcaggagctccgacagcgcccactccacggtcaccgccgagctctctgtgccgccagcgatgaggtcctgcacgtaacgatcgatgtgaattgctgaattgttgctacttagatggtgttgtaatggtgatcaacaatggactaagtaacactccagtgatatgatgcattgttataagatttaagacataatgaagagtgttgatctgcagtctgaaaattgttttttaatgttgtttttgttcagttataaacttattctgcactgtttagatcacaggagggggtcagtgctgcttgcaatgattgacgtcccatgcttatcagcaacggaatctgcaagctctttgggcagacaagatattcagacagttcatagttgtgtgggctagctctgtggcaagcacattcatttccctaatggatagtgacgtccatttgggcaactccgatcttttatgtaagtccgttttctgattgaaactagtaattaataatgtggtttggctatgataaatgacaaccctaccatacgtagtatcccaatatcctactaagaaataaataatttatgtcacggtcaagtttcagaagttgactaacaagaatgctacgagtacatagttgcagcctgcagctatcattctgagagtttgtgactgcacccattcaagattgttcctattaattacagtattagtatgtgattttccagtttattgaagcgtgtagatatttgaagttgatctgaaaacattttttgggggcagaaatgcagtgacagaaagactcacctgagtgaatgccttgacaccttccctcttgagcttgacctcaaggttgggattgtcagcgaactgcagcagcacgtccaccatgtccttggccacgaagctctccccctcgcggcggcggcgctcgttgtgctcgtccacgacgtgttccaggaaccggtcgaacatcttgccgagcttcttcatcctcttgatgtacccctgcaggtccagccagtcgagccacgggatggagtcgccgatgttgagcacgccgttgagcaggaacagctcgtcgagcatccacttgaactcctccggcgtcgtcaccgacccccccgcatccttgtccaggtacttcttgcccagcaccatgcgcgtgatcacgttcaggctcaccgtcgacaggtagtccttgagcaccacgacgccgccggccgcgccgtgcaggtcgcgcagcagcgcgcgcacctcctcgccacggatgtactcgtacgactccagccgcttggcgctgaagagctcggtgaggcacatcttgcgcgcctggcgccagtacgcgccgtagggcgaccacgtgatgtcgctgtagttgtaggtggtgtgcttgccggcggcggtcttgggccggtcggtgaacaccacgtcgtgggtcttgaggaagaacttggccatctccaccgacgagccgacgacgacggggaacgacccgaacctgaggtacatcaggggaccgtacttcttggagaggttgtggatggagcggtgcgggagcgtgcccaccaggttgaggttgccgatgaccggccacggcttcggccccggcgggaggttgtacacgcggcggctacggccgagcaccgctttcaggaacagcacggtggcgagcactacgccgacgaaggacgcccatggcggcagcatcagctccatcggtaaccggtcggtagtacgtggattggctgcaattcagttactatgttataggctgagctgcttggccggtggtggacaaccagagctcgagctagctacttatagaagacgacgagctcggaggtgtcaccatggcggtagtagagcgcgcgagcgtgtggaggaagttgaggtgtcatatggtgggaaaggacggggaaatcgatccaagacgattctcacgatgtctggaaagaaaacttggccgcgaaatgggccaaggcgtccacttgtgcaaattgtcgttttgccgagaaaaacgtggagagagaccgaggccacggaaccaccgctgctcagctaggctgcacaagcacaacgctctgctgcgtatgtgaagttgcaggtatccctctttgggggaaaaaaaagaacgtgcagaaggtgcaaaaaagtcagaatatttataccgtcatatttttcaacagaaaaaatagcatatatttatattggaagtttataaatttcatatgtaattttagtgtattaacaatgtaatttatatgtgtaatttgtaatttgtatttacactaaaattacatatgtaatttataaacttacatatttgtaatttgcggaaaatatgtaagtctgtgtaatttgtaatttgtatttacatatgtaagttatatgtaagtcaaacaaaatgtggtggttgcttgcatggtaaatgtcttggtttgtaatgctcaggtcatgcgttcaatcctgctcctctcttgggttcctttgatgtttttgtatgtactacacgaatcttaacgcatatcgtattatctaggaatcgatatatttttttctacaaaatatggcgtcacctttttagactctgacctatcgctaatcatagtacatgccctccgttttcggggtggcaagaagttcctaattttttttccgaaaaacatcacattaaatctttagacgcatgcgcgcgcgcatatatatatatatatatatatatatatatatatatatatatatatatatatatatatatatatatatatatacacacacacacacacacacacactaattgcacaggttgtatggaaatcgcgagacgaatcttttgtatctaattagtccatgattagccataagtgttacagtaacccacatatactaatgacggcttaattaaactcaaaagattcatctcgcggtttccaagcgagttacgaaattagtgtttttattcgtgtccgaaaaacctttccgacatccggtcaaacatccaatgtgacactaaattttttttttttgagaactaaacacaccctaactataaatggttgatcaggtttcggatttccatttcagtggctggcagtggcacaagtatatgtactatggacagtgacagatctttttggctctgcctgcatatactgtattatctatctctaatcagtgagcagacagagagtgggcgaaacaggaatacaagatgttgatcagacgcttatgaccacacagataggcatgcctcaccaatcatcaaccggtgtcacggtatggcaaaggaaatggagccgtgaaagctgacagatcttggagcacactccattttctctgggtggacagaatgaatcagagttctgccacactatgccttatctgtggatgagactcctctaacgttgtgcagtttatagttgtgccactgacatgtaggccataccaaagtgagacccacatgtccgtggcacaactgcagattgcacaaagtcagtgatctgtttcccttatccgcgtatgcactatcaggacctttacaatgatacgccgtagcattcagcctgagccgcatacgtcgacaatttctgagaaatcgaagccatgtttgtagccgggcccaccaaaacaaagtccacgcttccaactgaagcaacgcgttcttgggcaatatcgaagccgcgtgcggttgggagaaggggtggcaggcgtgttgtggggcgagtggcttctccctcgttcccaggcgcacgccccgacctccgcatcctagattcgccctcaccgtcaccctcgcctgtgcccttgccctcgcgctcacactccagatctttgttcaagttcaccaccaaaacaaagaaaaaaaaagaggtttatagtcgaagcgctaacaatttggacgtcgcctgtgatgctcaacagctgagctcagatgatttcactgtcatatgaacgtaagtcacaacaaacggggatcattttagttagtgtaacaggtagctagtgtgtcatccattaaatcatttagtaatttccccacgaaagaaaagaagcagggcatcctgtttcaccgcactacagagcaacgagatggatcgttactgtatcttcccctgcaaatgcatcgcgattagcagcaaacgacacggaaggttgtctgaactaaactgagactcgaggcaggcttgacttgacctgctcgagtttgattaaactaagaacaggcaacccccacatgctcgaccgtcagcaacttgcgtcgtccacagcaacgggtgctgcaagaagaaatttctgctcgatgccataaattcataatctaaggcaggtctttagaaaagaagtcttcggcaaaatgttcagatagaataataattaagatcagcaaattggattttctcaatgaaattggcacttgatcaattagtaggatttagatgtgtgaactaatatgtcggggcgtgtggacctgattgacttgcataattgtgtctaccactgaaattgcgagggggttttcacgggcatcactaagaaagtaagaaagtatagtggaggaacagtggacgtggactgactgttatttgaaatggttgactgaccagcagtagaccaacagtctcttctgggaataaacattccacttgtttcttttttacgtgtctgctgctctggcgatagagatgcgtcccttttttttttccaaagaaactctagaattcgggtgactccaccaggattaattaactacataattggaatgcatacatcatatgttagagaaattatatggaagccacacgcacgtatctcaaacacatagtacatcatatgtttgaaaagatatattagtttgtgcattgtttcatgttttatgctttttgttgagagaatgttttgtgctctctattgagaaaggttgattatgctatttattggaaggatacagtaataattgaccgtagtttccttgaaacaaaatctgaaatttgttccattatctaaaaaaatcactttaaccagggcagtgccgtcaaatttggaggccctatacaagggtctaagtaaggcataaatcaagtaccaaatatagctaaaataatatatatattgtaaagcaaatgtgatatatcaagaatagtatattttttaactcttgttttgcataataaaaaaatgtcaaactgaaaacggagaatgttcgttgctgttgctagcttgctgcctagtgccttgcttgttggttgcttgctaagttgctattcgctggttgaatgaaaatataaaattggatgagttggctggcggcctggtgctcggaggagacgagacgtcgagactcgagacgaactgaataagtcacagatacgaaaaaaaagagaatacaaaacgccgtggggcctcagggctcagagttgataatacgaagcgccacgcacgcgaagtcgccgcgcggagacatgcgcggactcgaacggggttctgacgctctcacctcacacgaatacatgggccttcttcggttggactgatttttctgaggccctgaaaatttggaggctctgtacggtcgcacgggccgcacgcccatgtgcacggccctgactttaacacaaattcgcacactgggtggaccaggaggtgattccaccaagccactcttcatgtccactcctctcatctgtgctagtcgggtgccttcctttttgctttctctaccaactacctcccacgcacattaacagcgcgaatctagatgtagaagggccaaagtcagggatgggggcagctgcggtggcacctagacaaacggatctgatgtgtcatcaacggcttcactgtgatggctttgacggtgaaggaatgtggctatcgattgtttcagtgacgggatggctttggttgcatcagctaagatgatgagcggttgggatggttttgacaccatcgagctagttttggcagcttctgctatagcgtcgattgcacggcggtccaaacccctcctctcgtggcgcgcattcggtccgaattagtgcggtcgatggctgtctccgtggagctcatcatctctcctcaacggtctatctgttgtcggcatgtgaatgctccttgccacaacgtctttatcactggtcatcttggacccagtatattttagatgtgtgcctattgatcttctcacgatgttatccttgtaaaggtggtgtgacgttatccttataaaggtggtgtgtccaacgaaggttatagcttcgggtgttcattctagctatgcaaagaccgataaccgaaagtgattttaattagttggatcaccttttaatgtaattatttaaaatcaataaaactttatttatcataaaaaagatatatgagctaacaataaatccacgatcttactaatcctacttaaaatgcattaacatgcgattgtaagagctaggatttaattttctttttaacaataaaaaaaaaaggcaaagtcatacgatcataacggtgctatcaataaagttaaaaaatacatcaataaccactcgactatcgtggttatcagagctggtccacattggaatctcaataaatcgatcgagtttaaaaaaagtaaaaattaaaactttgtcaaaatttattcgaattttatcgcttttcgtccacaaaccaaccaggcgtccagtgaaactgttgatgggctatagccgatttgcaattgcattatcaaactctggataccaactccaatgctcagtcataagcatataattaacatggtgttaggctgttagcgcacgcagggacggatctacagtgttagcatcggtgtcagacgacaccgatgactttcggcaaaacctacagttaaactgcttatccatatattataacacactaatataagtataattagcatgctatgacaccgatagacatattataacaccagtgaatcaattttctagatccgtcgctaagcgcccgagagacacgctaaccagtcttctcttcggagaagacgcaagctcatagagcctcatatggaagagaactttgttgaagcgtccagccgcccacagtttctctcgagaggtttttgtcatatcaattttttgaccgaccttgaccgacgactagtcagtagtagtagtcagtagtcactcatatcgttgtcgtcgctcatcgttgggtggcaacgcaacacgcgattttgcaggtgcgcgtcgtgtgggggggacctgtggttagttggtgcgggtggttgcccgagtcattttgtgtgcttgccttgggtcggaaaatgttgctctctctatctgtggacgggcgtagggcacctggtggctgtgtttgctactagggatgaaaacggatcgaatacggtcggaaacaagctctatcatattcattttcatattttttttctcggaatcgaaatcggaatcggaaacccggatacgaaaacggaatcgaatattatcgaatacagatacagagcgaatacgaatcgaaacgaatacggtaacgaataattatcaaaatattaagacccctcaaaataagcttattaaatcgaggaagagatgtagccattagttttcaacaacaaaatatcagtattttcaaattttatctctatttataagggcaagggggagatagaaaatgttgtgtttacttttcatacaaatttatgttatcatgaaacaaataattaatgtgcctcactgaaattttcataggcacattgaaatttttgaaaattggttgaatattttaaattttgggttgaacatttcaattgaaagtttttaaaaatttgagtggttatttttcagaattgaattttttatttgtttgtatgtggaccacttaaggacccacatggaaaaatcaatttttccatataaaggtgacttaagaagccgtatgcaaaaataaaatttgagaatttgaaactagtttatctcactcatatgaactctaaattggatgattttctttctaaatgtttctaaaatcatgccctatcatgttattgtgttcttactgctattattttggccatttttttcttgtgactttgttttatcaattaaaaatttgaattttaaaacttcaaataatattttgaagctgtaattaattgcagctaaaaaagttgtgaacataaaagttgtagatctcatcaagacatacaacttttattttggtcatttcttcatccgataaagtgataataatattgttcacaaagtttacatatctctattgtagtttatagaaccagatgagatagatgtaaattttgtgaacaaaggtactatcactttgtcggatgacgaaacgatcaaaataaaagttatagatcttgatgagttatactattttgttgttgataacttttcagttaaaatcatttagtattgcaaaatgttgtttgaagttgttatattttgagattcaaattcaaccggttcaaacaaagtcatatagaaaaatgaccaaaacaaaagttgtatatgttgatgtgttatacaactttgtttttgacaattttttcatttgaaatcattaactacccgaaaaattatttgaatttcttatattttaaaattcaaattttatatagttgaatcaaactcggaaggagaaatgaccaaaagaaaaatggtagatctcaataagttatacaattttgtttttgacaactttttcatttgagttgatttagttccttaaaattcgttttaaagagccacatataaaaaagaaatcgatttttacattgaaaaaaatccaccattttttcccaaccttatctactcttgactcttcctctcctctctctcacagactcacactttctactctatctccctctcacttccctcatccacagcggcacggggcggggcaggcggcgaccggcggctggccgagagcggcgcaacgcgtggcgggcggcagcggcgggcaggctcgcgcagtgggcttgagcggcgggcggcgacgggcgaaggcagcgggctcgactgccgcgacggcttcggtgggcgtcgacggcgtcggtgggtggcagcggcagggggatccggcggcgccgccgccggatctggccagtccctccgccttttggccggagtgctggcggcggcaccgtggggcggcgcatgtggagtggctcggtcggtggtggggagggccgctgcggcgcgaggcggcggagtccggcgcgtgcgtgggtggcggccggtgcacgcgtggcggcgcggagactggcggtgggcggcgcggatctggcaccggccgggggtgggcggcgcgaagctggcgcggccaactagggtttcggttttttttggctgaaaaatatcccttttgctagcatgtaaactaccggatatccgataaaaattccggatagtttccgaccgttttccgattccgtcggatatcacccttactgtattcgttttcgtatccgagaaaaaaatccgaattcgtttccgaattcgagaagttccggatagttccgaccgaatttttccgaatctgaaaattggtccggacggacgaaaattatccgaaccagtttcatccctatttgctacagaatgctagagcgtgcggtcccgcggaacaggtgcgtgccgtgccgcgggggctgaatccacgggaaacctaggctcgcgtactccgttcgcatgcaggcctcgtgtgtggactttgccttctcgttagtttgggccgagcagcaagcatgtcacgggcgttcttctagaattttggtaattcctaataccagaaatcttcaccctcgaatgttcaaaaccgtgcaatcaaggtcccatggcagtatatatgggtggtttcactgatgtggcatccttatcagcaatctgggcccacatgtaagtaaaaaaatcatatgtggtctgcatcccttctttccaccattttcttctttttaattttttttctcttctctttttgttattctcttgtcggcatgccacggagggggagcgacgagcggccagagcagacgggcaagtgcgcggcggccggcagagcggagcggcgcggcggcgggcgagcacgtggccagcagagcgaagcggcatcggtgggcgagtagaacgacggcggcgagcgaccggagcaggctgagaaggagatcgacccgtccactccgcttcacgtgttctggaagaaaagttgaatttaggtccctataatataagtcaaattctacttcgtatcctcaacagcaaaaccaggtatatcaatccctccaactattgttacatatcataaggtattttagatttgtaataattaagtcaattttgtttatgtttgacaaagtttattagaaaaacatagcaacatgtaaaacactaaattagtttcattaattccaccgctgaatatattatcatagtatattgttttgtgttagaaatgctgcttaggaaaaattaaaacactttacaatatgaaacatgagttagttaaaagaaatatgaaacatgagtaattataatagttataaatagagtgaaagtacttgaaagtttgaaccaaatggtatatattttatatgcttagtgcaattgtatattattatttgaaaatgcttagtttaactttctaaaatcaaaatactacctctattttaatgtaggacgcttttcgacggactatgcgtgcctaaggtatttgtagagtttggggaacgttggaactaaggtgtatgcgagatcgtatctagcagacaaggaacaagggtttatactgatttggggcttcaagataaataacaaccctacttcagtttataagtatatatctgaggaaacgtatcacacggattacaatgaaggagcaaagtggctaatctgatctacagactagaatccaccaagcaccgctcggcacaatcttatcggtcactaggcttcaacttccttcagatggtctctcgatgcggctttggctgtggcttgtaatttgatgtcttcaccttcacgggggtttgtatttatagcgatgaacaccttttctccaagtagcactcgaaaaacttgattggagatggaccaaggaggccttttttttaataggactctcacactttctatcccaagaaaataatttctttccagatttactgtattttattaattaattataccttctggtatatcattaagtatgtgatactcctatatattacgaaaccaactataggatgtatgccttattttaacactgacaacactagttattgaattttggaatttacatttgatcattcgtctgattaaaaaactattgatttattttatcattaaagagactagactcgtatttttttgcatatttgcattaactttttaataggataaatgattaaacgtcatttgataaaacttaacaacatcttatgtttaaaaacctaggatggcatacatcttatttaaaaaggtagtggagggagtatatatttcctaaattacattgtcggtaacctatttgcgaagtagcaacagtactgcttactatacaccgactaaaataacccaacacgtgcaagctacttgattgcgaccatacagcacgagcacgagcatctccatgatcgccgatcaaacctccaagctatcatgtaaggagtaccaacaggacactaaatatagtttatataaacttcacattatcaagaaaatagtgctttctccgtttcacaatttaagtcattctagcatttcccgtattcatattgatgtgaatgaatctggacatatatatctatgtagattcattaacattaatatgaatgtggaaaatgctagaatgacttacattgtgaaacggaggaagtatacactactctttcaaggtaaacatcactttttcatacttaaatttaatgctactttatctcacatgatgttttcgatgttgtgtatgtctcatgtaacatctggttttcttttctttacttatttattcacttggtacatcatctttcatttgaggtgacagtttatttaatactatagatatcatcttagtcattgtgatatgactggcctagtaccacgaagcaacggacaaaaacgacggtgagtatattttctcatctaaaaattacacatgtttagtttttttaaccgagttgttcactacatcaatgccagctcgacattttatgttcacaaatcacaaatggccagctctctttaatttgcatccaacgtgtagctcgatcatgttaattaagcgactttagcaagatcacttagaaccagcattaccggcaacaataatggagctacccccatggccctcattactggtcattgtgctcacagcagtcgtcttcttcctcgccaccattctctgccatggccgacgcgtgtataggctcccgctagggccaaagccatggccgatcatcggcaacctcaacctcattggcgcgctgccacaccgctccatccacgagctctccaagcgctacggcccgctcattcagctccggttcggatcatgcagggaggaggaacggcgccggcaaagaagaacgacgccgaagagggtggggcttcggccatcaatggcggatgagaaacgggcggcataaacggcgattaagagctctattgaaggggaaaacatagggaagataaagagggggaagaggaaaaccgattttcgcattcaattggaggagaaaacgcttgtggaggggtatcgacatgacggcggcgctagtttcttcggccgggagaggaacgggcggcggctggaggaagactgtagcgcccgttccgtcgtggcgcctagcgggaaaattatctcttaaaaaccctaattgcgaaatttgtttctttgcttgttgtctagcgtccgtgccatctcaagatctcaaatcctcgatctatcgtcgagatcaattccgaatccaaatccttccaaatcaaattcctccgcaaaagtctattttgcctcccccgggttcgatgggccgaatctctctcggcccatctcctcctccctcccgggcgctctctctctctccccctccctcttccgctctgcccgcgcgccgcgcgcgcgtgcgcgagcgccgcgccgagcg

SEQ ID NO: 54818 - DNA, 5970 bp, Oryza sativa
tgcccgcgcctgccgcccgtgtcgtcgcgccgctccaaaccaccccgccgtcatcgccgacgtcatagcccggcccccgccactccgcgcgcaagccgccaagggacggaggcagagccctcctccctctgccgcgacgcccccgctcccctcctccttttcccaaagaagaaaggggcgagccccctttctctccctccttttccccttttttctcccgccggcgtcatcctccctctgccctgtcgccgtttggacgcgagcgccgagcgccagctcgcgccttgaccgcccaagtcggttccaaaccgacattgccgcccttaaagccccgggcgccctccccctcttcgcctccacgacattgccaccgcctcccgtgctctgttcgccgtcgccgttcgtcgttgcgcgtgtcggaggagccggcacgagcaaggacgcggaaggggactccaggcgcgccctctccttcctcttccccggcccgaggccggagagattactcccgcgccgtcggcctctcgtcgttgcgcccgccctcacggtagtgcatctccccgttctccctcctcgttccatctcctccccttagactcgggtagtagcacgagtagcctccccgtagctagccggcgccgccccgaccgttgccgtcgctcgccgtgtactcgccgccgtcgccgcccgagctccgtagcacccgctcgtcaccggcctcgctcggcgtagctccgcccaatccgacgctagcaacggattcccgtagccgcgtagatgctctcaccaccgggaattggcctctcgtgacctcgtcgccgtttccccattctaccgccaccggttgcagccgccgcgattcgcagccgtcaagctccctccggggaatccgagccgttggctcgtctcccctcgtctcgtgcaaccacccggtgtgctcgctttcgcctgtatcgccgtggttcgctccgccgctcgccgctgtcgtccgccatccgttccggccggtgtcgtcgtctacctcccgccggcccgcgtggcagccacgtaggcgccacgtcggcgccagctcggccaagaccgggtcgagccgaccccggtcagcccctccccgtgcgcgcgttccaccgtgagccgtgaggctgcgcgtgggcccgccgcatccgcgtccaccgcgaaccgcgcgcgtgcaccgcgtccctccctcgcccgcgcgcgtgcgccgcgtgctcgctccgcacggtgaaccgtgtcaccgacaagcgggtcccacccgggaccacgcgtggtgagcccggtccaccggctctctctctcctcccctcccgcgcgcgcgcgccttgggccgccttgggccggccggcccatttagctcggccggaccgccccatttctctcgggccgcgccctagccgcccgaggaaagtctattttccctccctcttttcttttcttttcttttctttttcaaaaaggatttaattaaatccttttcctttagaccaaaaatccaataaacttagaaattcaatatcttcccaaccgtaaatccgtttgactccgttcaacttccaaaattcctcaaatcccgagatctatctaatggctcgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgatacgatcgcacttaatctgtttatcccgtctgcaaggcagattggcggacctacctagtttgttgcatttgatccttcctttgttaattgttataccatgttcccttgtaaccacccagttgcgcctcggaaatcatgaactctgtgcgagtaccgacggtcgccttcaaacttaaaatctgagtaacttcttgggtaaaacttgggttttacaaaagacttggaaaacccgacacctgggtcggtgcttgcgaactaaatggattttccaaaaccgcggaccggggaacgtaccgggtgtacggtttcccgctcttgcacctaaggaccgtttccttggaattttatccgaacataagacaagtacgaccacatgggtggaatgggacacccctggctgagtaactagcttatcagggaagccttgatgccgagagacatgtggattcgccggggtggtgtcggggaggacccctgggctttctggcacagtatggtctgggacctaacctgttgttggtctgggacccctctcgtcggcatatggtaaacctgtgtcggctttggaaatgccttgtcacgaaagcttggaggtctcccgacgtggctgatccccacgggctgggtgatccgggttagtaatgtcgtgtgggtaaagtgtacccccctctgcagaggttaacaaactgttcgaacagccgtgcccacggtcatgggcggatgtgaggtgattcctagcgtagttttgtttgactactgcttgtgaaattgctgttgtggaaaggggttcgatgtttgaaaaatctgcagctgatgggatcagctaggcccgggtggccgtttgaaagttgttggcccgggtggccgtttgaaaagctgttggccgggtgccaaccttgattcaattctaaagactgatacattgcacatactctgaccggacgagacgcactgtctcatccgtgtcgtttgagaagcactcacttagttgtttttagaaaagagttcaaataaaatcaattgcaaaaaaaacaacagcctttctttgaagcctgcattaaacacttatttcccatggcttgctgagtactcccatactcacccttgctctatataaataatcccccccagttgctgaagaagatgaagcggatcctgctgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagaccactgttgctatgataatccgtcttcctgtgataccagcactgtttcctgggactggtatcgattaacaggttaatttggagcgtcacgggctagttccggtcggtactagttcggggcgtgacaaagacgatgacggcgccttcctgggccggctgggccgcgcccgagcaagggagggggagcagatgggggctcggccgaagtggctgcagcccaagggacagagggaagaagaggctggccgaggagggaaggaaaaaagcggaaaggctagttagcgcgccggcggcgcgcgttttaggccaagaaggcccagcgccggcgcgcgccccctcctgcacgctctttttttttcctttttttcctttttttccctcactttttgtctgattttttttatccttttagcatgttttgagtttgaaagtttttaaattttgagttgaaaattttcaaatctggatttgaaagttttcaaatctcgatttgaaaattttcaaatttttcaaatctggatttgaaagttttcgaatctcgagttaaaagtttttaaatctcgagttgaaagttttcaatttttttcaaatctggacttgaaagtttttgaatctcgattctcgagttgaaagttttcaaatctcaagttgaaagttttcaaatctggatttgaaagttttcgaatctcgagttgaaagttttcaaatctcgagttgaaagttttcaaatctcaaattgaaagttttcaatttttttcaaatctagacttgaaagtttttgaatctcgattctcgagttgaaagttttcaaatctcaagttgaaagttttcaaatcttagttgaaagtttttaaaatttgactttaaaatttaaaacttaaatcgaaagttttcaaatctaactccaaaaaaatttccagaatattttcttaattactatcattagtgttaagtatattaactaatatatgtaattaagactaaaagggagttcgccaggtccttttgcggcgcgcacgcgcgcgctagcaatccctgggaaaaggaggcctgagaagaggggaaggggacctcagcggcaggtcgaggaaggaaaaatggccttaggatcggaagcgacccaaggataaagagagatttatttttagatttttcattttaattaactctaaatttggtttttgttgttttaaaattatttccggtgctttgaaaattcaagtaaaaaatttagggacccatttagagcatggaggatttcataaaaatactccaagccactttcgaatttttcttgtacatattttagtgcttgagatttcttttagacttttaataatttatattactcattttagaaagtgatttttaacttgggatgaatttatcaggatatgaaaatgttactcctgaaggtgaattctctattgtcatctctattttgactgtttcatgaagtatgaagtatgtacgactatcgttagacgaactctagtccctccgctctaaaaataaattaacataatacgagatataattagatttgtttattttaaagcagatgaagtataatttatcaacagtagtcacacatacttaataattcgtgaatatcccatagtatattagtttattttataacggaagatactatatattagtttattttggtacggacataacagggtagatagatacatagatagatagatagaaatagtcacgcttgctacatgtgagggagattgaagagtggacgtggactgaccgtttgaaacggttgattgacaagaaatagtctcttcttggctttatatctcgtggtgttaggataatgtcgtatttttatattagattggtttgtttgggatagagagagtaggggtagatagatagatataattaagtcacacctgctatagttttttaaacactgtttgaaacaattgactgaccagcaatagtttatttctgtctttgttcctaaaataaagggatgtaatatagcttaacactataaatctagatgaagagatgtccagatttacagtatatgatatgccaagtcctaccacggatggaatagatatctgttgctcgggtgatagagatagatgtctgtcctttttcttttggcaagaacaaactttaagtcgggtgactccgttaggatttattaacagcataaatggcattgcatattttgtatactaatgatgtcccgcgttttgttgcggacggatatatattagatgttggaaaaataatgaaatgatttggattgaaatattataaaaatgatttgagaatgatgatttagcatgtgtatgtttagtttcagaatgaaattaaataaatagtagatataactattatatgcttgtatgttgtgttttgtgtactaatgggttgatgtgacatacttgtatgtaggtttttaggagtgataataaatactatgcttgcatgttgagctttaagtgtttagtgggtattagctttatatagaaagaaggaatgacacatttgatatttttaatcagtctgacaattttaagattttttttcaaatagactagataaacattttttttcctttttaccgaattggacgtagactcgtttgatgcatgtcaactataaagtcataaaaaaatctttaaaaatggaaatatagattaaattgtgatatttcgatctataaatttgatttatacaggtagaaaaaaaatcttaatttgatttatatttgtaatttgtgtttctattgtgtgtatgtcgaatttgaatttgtatgtcatatattgatctatcttat

SEQ ID NO: 54819 - DNA, 4660 bp, Oryza sativa
cagcgcgtcgagtctcggcaagccgctgctcggtggtctcgcaggcagttgaagcacctgcctagaatttctatctagaagaagcgcatcaaggtgggttcaacctagcgaagttgcgggcggcagggataggccgcgcagcccctcactcgctagacaagtcgcgcatgagccgcgtgccgccgagccacagtgagggtgggcaagaagcaggtaaggagctagcgtcggaccgagcgagcaagcggtgggcgccggggccgtagtggccactggcgcagagatggtcgcttgtcgcttgcctgctagtctcccgttatgactttaaaatccttcgagaagtatgtggtcgaacacatctatctattatatactaaaagtacattaatttttctataatactgagaaaataaataaatgatctaacaattgatttttacttaatccaatgatcccataatttgaatcattagattagatctactttaaaaaagcccgaagtatcctatccacataggtcccctcccgtgtgtccatatgtgcgacgaatctacaaacacccataagtaccggcctccccatccctctgcctctcgtttcccttccaaatttctaggattaactcaaacaaagaaacatcccgatccctctgcctctcgttttccttccaaatttctaggattaactcaaacaaagaaacaatcaacatttaaatttggtcccatatttttttagagaagggtatttttacccggcctctacatccaaccggacatatgtagcctttctaacttaggaacttagcttatcaaatagggaacttagccctcaaataacacaatctaaaattcgctcctatggatatttgaattcaggaccttagggcgctactcaagtcactgcaaccactaggctacatgccctttcacggtcccatatattcttaagttgtatattcaattttgaatatgtttggactgttattttatttataattagatcaacaatttaagacacattgatatcctacaaatactactaagctacacgtgaaactctagagagcaaaatttatactttacaggcaataaatgaatttaaatatttgagtccacagtccaagttctacctccagcaaagagctcagaaatgggatgcgtactctggtccagattccaaaggaggcagagctgcaagatgtgatcagcaaaagtggatgctgacctactacaaggagtttgtaattaaatttcaaaaaaaaagaaacattcaaaaataaaacaaaattttcattaaaattagaaataaaaatatgacaagtccatgtagaatataaaatatcaagagtccatgtaaaggtataagttataaatatcggaaatttggaataataaaatgagtattaaaagaagaacccaaatacaacacaacacaatttaaaatccctaaaaaagacaatttagaataaaaataattaaactacaaatttgatttcaatacagatttgaaattataatcactcattcgctaaattcagaataaaaaaatactttaaaagagctttgctatctttattaattcacatccatgtatatgaatcaattaaagagaggtaaaataaaatacatttatttagcaataaaactttctcaatcttaagaaaaaagacagagacaataaacattcaattaaaaacaaaaaaatacctcactttaatttaggcttattttgttagacctatttccaaaacaaactaatatgcatgcctacgatttatttttattttttaaaacatttttaatataatattttaataacagtctatggcaaattttattttcaaatctaaaccttttggtcacgccaagaaagctggcattgcaaaataaccctataatgccacaagtattggtgtgacaaaacatgtcacgctggatcgagaagccacattgtacggctgccacgctagttaaactagcgctgctaaaccatgtagcaacgccaacatgcatagcgtcgcttggcaggcctacgtgtaatgcaagatgaaggtgaagtactactgtagtattgctactccctccatttcaggttataatacgttttgactttggtcaaaatcaaattgctttaagtttgactaagtttataaaaaaagtagtaacattttcaacccaagataaatttattatcaattaataatttgatgaaactaatttagtattataaatattattttatttgtctataaacttagtcaaacttgaaacagtttgactttgaacaaagttaaaacgtcttataacctgaaacagatgtaaaacagatgtagtactgttttgtgaaaaagaaccttgtgtttgtgggttctacatcattttcttatgtttaattcgtaactgaagattttttggttgatctatctctcatagcatctatccagatcatggtatgcccacatatctatgaaatgagtttaatatgtgtgtgtatatatatatgtgatgactgattacataattattaatattttgtactttttaatgattgtgatgaaatctagctctttattcttatgatttgtatcacattgaagttactcaaggcgcagataaatggctttttccttgttaaatatatataatttagatggttgcactgttacagaagcattttcatgtgtgtatgtgtttcccaaattgtcggttcagcatggcatgtttcgtcacgtcaattaatgcttatggtgtgacaaggttattttataacgtcagttttcttggcgtgatcaaaaagtttagatttaaaaataaaatttggcccgatctattattaaaatattttattaaaagttttaaaaaataataaacattccctacgatatttttattttaaaattctcactagctagctatttatctgcattaaaaattcgctgccttacaactcctagttaacttgatagtaaaacgtggccatgattcacagaacttagacacatccatatgaccgtatttagtttgttattaattactattattactattactattgaattctaaaagttatagactaaatttagccgtgcaatttggatggacccttgcttgttacatggccagttacttgtttggaaggtagcaacagtacactatacactgactaaaataacccaccacgtgcaacactacagatgctgacttgattgcgaccaaacatcacgagtgagtaacatgatcaccgagcaaacctcctagctatcgtgtaatgccgcacagcaaaagataaaacgacagttaatattttctcttctaaaagttacacatgtaacttgcttattgtgtttgagactttgaggtgaggaacacactcctaacgcatcgccggcgctttgatttctataagatataataaattaagataataaatttgtgtgatatacaaatatatgtactccctttctcactgagtaagacgtatacatgttttaagatccaactctttgaccaataatattcttttataattaaattgatttttatttaatatcattgggttgatatttgaatttactttcgtataactgtgattgtgttgctacaaacatcgtaatatttgagaaattcaaatataaatattagttttgaataccatgccaggtttgatcatgccataattagtacggtgaagggagtatagttaaagtttttttttatagcttgtataaattgaatttaaacttacatgttttctagactaatatactattaatctatcttttatcctttttataactagttactctaattcggattaggctttgtttaggggctggtttgcaacaaccccgcttttttttctctaaatcttaaaataacttggtctggtctctttgcgggctgggcgaaaaaaaaatatgttacacatgtctagattttcaacacagttagttcactatataagcatcagcctatcagctcgacattttatattcacaggtggccggctctcttctgcacacaacgtgtagctcgacaatctacttagcaagatcactttagaaccagaatcaccagcaaccatggagatggagctaccatcatgggcctcagtactggtcattgtgctcgccgccgtcgtcttcctcctcgccaccattctccgccatggccgacgcgcgtataggctcccaccagggcctaacccgtggccgatcatcggcaacctcaacctcattggcgcgctgccacaccgctccatccacgagctctccaagcgctacggcccgctgatgcagctccggttcgggtcattccccgtcgtcgtcggctcgtcggcggagatggccaggttcttcctcaagtcccacgacattgtgttcaccgaccggccgaggaccgccgccggcaagcacaccacgtacaactacaccgacatcctctggtccccctacggcgcctactggcgccaggcgcgcaagatgtgcgtcaccgagctcttcagcgcgaggcggctcgagtcgttcgagcacatccgcggcgaggaggtgcgcgcgctgctgcgcgacctgcacggcgcggcggcgcccgtgctgctcagggactacctgtccacggcgacgctcggcgtgatatcgcgcatggtgctgggcaagaagtac

SEQ ID NO: 54820 - DNA, 8290 bp, Oryza sativa
ctcgacctgcaggggtacatcaggaggatgaagagagtaggcaagaaactggatcggttcatggagcacgtcctggacgagcacgacaaggtgcggcggcagcagggtgataggtttgcagcgagggacttggtcgacgtgctcttgcagctcgccgatgaccctaacctcgaggtccaactccggcgtgataatgtcaaggcacttactcaggtgatcgatccctgctcatcatcctactgcagcttctttactcaggtgatcgtcctttccatggcacacggtgtaagctagctcttccatatgtggtgcaggacctgatcgccggcggcacggacacctccgccatcaccgtggagtgggccatttcggagctcctgaggaagccggagatcctcgccaaggcgaccgaggagctggaccgcgtcgtcggccgcggccgcttggtcaccgagacggacatgaccagcctcccctacgtggaggccatcgtgaaggagacgatgcgcgtgcacccggtggcgcccctgctggcgccgcacgtagcccgcgaggacgcctccgtcggcggctacgacatccccgccggaacgcgggtgctcgtcaacgtgtggaccatcgcccgcgacccggcgctgtgggactcgccggaggagttcatgccggagaggttcatcggcagcaagatcgacgtgaagggacaggacttccagctgctgccgttcgggtccggccgccggttgtgccccggccacagcctcgggctgaaggtgatacagctgagcctcgccagcctgctgcacggcttcgagtggaggctccccgacggcgtgtcggccggcgagctgagcatggaggaggtcttcggcctgtccacgccgaggaaggttccgctcgaggtcgtcgttaagcccaagctgccggcccacctctataccgggccctgatgtatctatatgtcagtacgtgggccattgataccaatacttcccatgatctctaccatggaataagtttgttatggaatattatctcctcgggagataagattctttcttgtgaaccaatcccaactagagtgagataagatttatctcctcctaaaaccgctgtatatggtaaacttgtaatcaagatcagatttataattaagagagatttcaccctatatatgtgttcactacttctgaaatgttcttgaaggcaaaaggaagggcatgagtgttctacacaatctcatgcatctactgctgtgagagggatagggaacagatccggtgatccactaataggcgtatttggtttataacaaagttcactctaggtcccttacgtccaattcaaatttcgtccttcgatgatatatccctcaacttataatactgatatacttgatgtcccagagcagtatagaatccaattttggttgatgtgatggctgagtcagcgtggtcctatatgtcagtgccccaatcttcttccacctctctcccctctcttcccatctcaatctaagcctccaaggcgacgagcggcggacggcagggagaagctcgacgacggcagccagtggggagaagccgctgcctaccggccaccgcccgtcgccaccgttgcactgtgggccacgcccagagggaggttgcgatgccactcgagctgtcgtggggtctatccttgatcatgggcacgcggaagactattcttccccatcaagcggcaccacttccttaccaacacccaccacacaacgacctcgttgacatcaccgccaccaacattgtcactgtctgcaccccaacatcactgccaccaatgttgtcgctatctacgtctcctgcctcaccatcctcatcgttcaccacatcttccctatgtaaggtagctcatcttcacaagaaaactacaaatggatatctcaatcatcaacaaaattaaattaccaccccaattcaagcttgatcatgtggacgccttcatggaggtagagcaacatacactcctggtcattcgagaccttgacagcaacttcactgtcaccgcctttaaagccagccacttccccagcaccgtaatgttcctcttctagggagactccttcggtcatgtcctccacactagcgactgtcacttgcccctcttccacctcctcactgactacgtcttcctcaaccgcaccttcgtcgccacctactctctccacttccccaccaagcaaggggaaaggaccggtagcagcaaagagaagaggaagggtccggtcgccaccgttgagcatctatctgctgaccgccacccttctcccgtcagtcaccgctcactgccatcgagcttctccgcactgatcgccctggaggcatagattgacataggaagagagggaagatatgtggaagaagattgggccgctgacatgtgggacccacgtgggtctcatgctaactcaaccgtcatgttaaccaaaaccagagactatattttcctgggacgttaattataccggtattgtaagttaagggactacggttcaatgatataattcgaaccatactttaaaattagagacctagagggaacttattcccgctgccatattggtggcgttccggctttagcacttattaggcctctttttggatcgacgtacatgtcatgtctcttattttctttgcttcgccgtgattaacagaagtacaacaccgtgaagtaaaattagctacaccgggagccagctgacggcgacgaactagagcggccttataatccctctttgggaaactcataaagctgaaagatatcaccggataacacataccgatgaccgcgcgcccagctagcttgccaggacaaccaacatagcaacacataaacgaagccagaattcttccagcctccggtcgaacacttccaatctcccatcttgcccgtcatgttagcatgctggttaattaatcgccgtaagcccgtaataatcgatacgtgtcacatcccccacgtgtacgatatcgggctgcgcacgtcgtgctcgccgttgctccaggtcagccacccgaacgcggcgtccgtcgggccaccgggcgtcgtcgacttgaacgtcacggtgtacctcagcttgtccccggccttcttgaacgcgagcctcgccggcttcacggccacggctatgtcgctcggcccggtgaccctcgcggtgtacaccgacctgccgtcgccgacgttggtcagctcgcgccggtacttgacggtggtgctgcgcgacgacgacgaccgccggccgaacacgacggagaacgacgggtagttgaggtccccggggctggacagcttccgctggcacgtcacgttgggcgccgccgtgatggcctggacctgcggcggcgacgtgccgacggagcacaggaaggcgacgtagtcgtcgacggaggtgtcgtagacgaggcccggggagagggccttgacggggtccacgtggccggcgccgatggaccacggcgtcgccgtggtgttgctggcggcgtcgacgatcggcgagccggtgttgtcgacggtgtatgcggtggtcatgagcgccgacttgattgcgctggggctccagtccgggtgtgccgccttgacgaaggcggcgaggccgctgatgtgcgggcatgacatggatgttcctgcgatatcacgattgagtctttaatcactctagttaattttatggctcaaaatatataattaagctgagagtgcagctttcagcaatgtaaattacgaatctactaccaaggttcagtgcaaaaaaagagagacatagccagacacatgtcagaatatcgtgcaactaaagtcatgccgactgtcgagcatatcatgccatttgggtgcatgcgaactgcactacagcacttgaaagctaaacagcaccatcatgaccaaatatgatcataacggcatcaaacagctactgttagctggtactgatctattctcgagcacgccggaccgtaaagtccgtgctcgaactttcggtgcaacacactaattactaattagagtaagcaacatactttcagtcggtatactacagtctacgtacagggctacttgcatggagggggcaaagcgtgcactgacctgacaagatgttgaacggcgaccgccgctcgtcgacggtgagcccggtcggcccgacggaccccgtccagccggcgaggatgttcacccccggcccgatcacgtccggcttgagcagctgcgccacctgcctgttcggcccacgcgagctgaacgcggccaccaccggcgccggccgcacgtcgagcgccgtgccggcgaaggttagccccacctcggcgtcggcgtccgactccacgtacctccttatggcgtcgccgctcttggcgccgacggccaccgcggggagaaggtggctgtcggccacgacctcctcgccgctctgcgcggtgttcgcgagcaccataccgacgccgccggcctgcttcaccaccagccccttctccaccctcgagttgccgccgcggtcgcacaggaccaccttgcccttcaccgccgccgcgtccagcgtgccctccatgcagagcttgctcgcattgctgccggcgcggatgcctttgttgtacacgaccgggagcttctcgtcgccgagcccgtcgccggagtagagcgacatgccggcgtgggtctcgccgttcccgagctcggcgtacgccgggaagttcctgtcgagcgtgcctgcaccgacggtgatcacccacggagcagtgttcaccagcgacgacggagaaggaccactgttccccgcggagcacgccacgacgatgccgcggcgagtggccgcgagcgcgccgaccgcgatggggtcacgcgagagcgggaacgcgccgccgccaagagacagcgagagaacgtcgacgccgtcatcgatggccttctccatgccggctagtatgtcggagctgaagcacccctgcctccagcacaccttgtacgccgcgacgcgcgcaccgggcgccatgccgcgggccgtgccttccgcgtagccgaggagtcccgcgtcggccacgacggcgccggccgccgtcgacgccgtgtgcgtgccgtgaccgtcgtggtccctcggcgaggagaactcgaggctgacgtgggaaccgttcccgccgccgccggccccatatccccggaagaaggcgcgggcgccgatgagcttgcggttgcacatcgacgacgggaagtcggtggcattggtctcgcagctcccgcgccaccgcgaaggcaccgggcccatgccgacgtcgccgaagctggggctctcgggccagacgccggtgtcgagcacgccaatgatgacgtcggtgctcgcaccgtcggcgtcaggggcgtcgtacggcgggaggtggaggaacagaggcgagcgcgtggtgtggagcgggaggatgacgtcttcatggacggacgcgacggcggggtggccgcggagcgccgcgacgtgcgacggcaggaggcgcgcggcgaaggctgacggcgcggcggaggtgtaggagtagaggagatgacgcgaggggtcgacggagagggaggccaggtgggcgtggtgccagtgtaggtgagtggcgtacggggccggcttgagtgccgggttcaggtagacaatgtaggtcgccgccccatcgccggcgccggagacgagccgcacgcacgacgagacaacgacgaggacggctagagcgaggaggaagggtggctgctgcatgctgggcagtgttagcgaatggagggagttgtctgtgcgagccgcgttcgattcaaatataggagtggcatggcatcaacctgggtagtacagcagcgcgcgtacagtcgtctcgatgtcctgctggtaatgtggtgatgtgccgtctcgatcgatcaccaccgaaaacgcgatgttcgtacgtgtagcgtccctagcgaacagacatgcaatcgttggagtcaacatcgacttttttttctccctggtgaccagctgcttcggcatactgttaaagaaaaaaaaagcgcattaagcactgggatcgtgttcatcatgcacgtcctcctccaggccagccttaacgcaattatttggctggcccttcctttacaagcggcacggtccgcggccgcgcacgtcgcggcgcccatagcactcctctccctagccctgcctcgttgtaacactacgacgcacttgagcggcgtgtgccgccgccgtcccgccgcgatcggtggtcgggtggatttgtggggggggggggggggtggatcgctggtgcgcgtgcccgtgcgtgcgtgagcagtgagtgagctctccttcctttccaccgaggccgcggccgtcagcgcgcgcggggcgcggtgcgtcgccactgcgagcgaccgatccagcgatcgcgtgcgtgcgtgcgacacttttcgcccgcccgggcctggtggtgatctgatcgtcgcgctctctaatattgcgtcgcccatgcctccactttctcgggcgatgaaccgcgtggctccacgcctcggcgatcgatggcgcggattggcagctagctggattctgttgcgaaaggtggacatggaagatgcactttcttactcgccatgttggggaggcaaaggcaggggcgcgatatgcgctatatcggcatatccagtgaaggagtggagtgatcgtcagtgcgtgtctgaatgccgccattgctgttcgtttggtgcgtgattgcgttttctcccttggtgatttgtcaatagtgtctgatggtgtcgagggattatttgctagtaaatgcaagcaagcaggactctttgatcaggaagctgcgagagattggttgctgcagcaaactgaagattggtaggtatcattgatctatctatcatgccaagttgccacactaactttgcagaagaactgtactataatgtgtgattgtgttcctttcttggttgtgtttagatggtggaaaagttggaaagttgagagaaagtttgtagtttggagaaaaagctggtagtttatgtgggacgtgacttcccgttgggcgtccgatgggagccgaagtaatcaaggcaattagcttaggttcatcccgaatccattccatgtttcttaaacaagtccttcaaaccatcgtgctaacaagccattctcctccgaaagtcccagagctttttctggtccatatgcatcaatcatcactgttttgttctgtaattccatttcattttatctattttcttcaagaaattccattgatgtgcttttctattgctctcattcattcctattcaatctattcaaaactatgggtactggtctcaatgggaaagagccctaattcgatatgtccttccatgagtttagatatctatgtatgaatctcttattcaatcccatactttttctcatttcagaacgatcagcatactgtgtgacttctacgtgacagttcttgcatttcatttgttgctttgcatgaacattttatattggaaagcccttaattaggaatttcatagatagagaaggacgggaaaaaagagagagactaactaactacccggatcaatgctgattgacgactgaataaatagccggaagcaacaactgcacgagagagaaagagcggatccaactaaggaaatgcagtacctgggcccaagtaggacaaagaaatgcaagtaaatgccctcgattcattccttttatgtgagtgggaaagctagctagaaatcaatgacaaggagtagaggctagagcaaaagggcctggcgtcaggttagttaaagcaagaaagtcaatgctcagtgtattattcgggaattggtttggaaagccttggtagtagtgcactcaaatcgacattgagattgggacatagccgcccaacgattagaccgaccgggggactggaagatctggaactttcctttggccgcaaaccttctttgaatacgaaagaatgcttgttttaaggcaatgcgagagcttaccagagaacaaaggagagtaatgagttgatagataggaggcaggcccaatgatattcaataaaggatagaccgaattccgtccgtataaacataatttttattttcttgtaaagtatttcttttattttagaggagtctctaaataatattcatcatcatctctaaagataaaggtgagttccagcagaatgtctattgaacaagagcacagcgaacttcgaaataagagactgaacttactttctttcttgcttgcttacttctgggctgcaggaat

SEQ ID NO: 54821 - DNA, 17196 bp, Oryza sativa
aaggcaaaccaccagaaccaagaaatgggagggatggggttaaaggatttgaattatttaacctcctagcgagacaagcgtggagaatgctgcaagaacaagaaagtttgagtgcaagggtgcaaatgtatttccctgatgaagacttcctaagagcagacgtgacttcccgtcgggcgcccgatgggagccgattaaaatcgggcgctgatgtcagcatgacgtcagcgcccgatttacgtgcaaaaactattttaaactgatttttctcttaaactacttatctaaataatgatccgattgcaccattaaattcgtagcaattaaatcttcaaaacaagaccacacatggatatattccgacgaaattttttttagcttattattgaattatttttaaatgttgcacgatgttccactaggtatatcggaattgtttcactaagtagatcgaaaatgtttcactcgtttaaatcggatgttgtttcaccttatataaaaacaatgtttcagcaaatagcgaaagattgtttcagttcactgcaacatttggttcatacataatgaaacattataaatacactaggtgaaacattttttggtggaacaaaaaataaaacgaattctcttaatagggggttccaaaatatgtgggttttttttgttgcaacggaatatttcagttcactgcaacattaggtctatacatagtgaaacattgtgagtatactaggtgcaacatttttggtggaacaaaaaataaactaaattcccttaatatagggtttgcaaaatatatggttgatttgttgcaagtggggacagatattatggtggggtcaatggtatcactgtgcgtggggatggggccgcagggggagcgcccgattttttctcccccgtcggtcgaccgaccaatagcattatcggtttatgtgtgtaggaaagttttcgatgtgatgtgatatgatggaaagttaggaatttagagggaactaaacaagcgcttgtttctaaaaaaaaaaagaacttggcatttcatatggaagttttgcgcctctgcttgcagttgtaatctgaagactgactttgctttgctgtgtaaggtgctcagctctgtcgtacactatgtcactatccaatctttaatttgtgtcgtgtacgttgacctgtgaaaaactaaaggagatataccgtcaaaagtcagatgcattcctgtgtctccgctgtgacaacaatacactgaaacacatttctgtagctcgtacactgtagtcgtacgaacgttcatactaacgattactgctgatcctaatcacaatgaacagaggataatttgttacgctattagccatttattactagcgttcatgaacattcaactcagcgatcgaccaagtgccgacacattcaggaagtaaacatactctagtcgaatcaaaacaagtacctgaaaacattgagctcagtgtttattgaaacgtggacgcagataggatcctatgcagtgactgatcacctttacaccataatggatcctcaactgtatgatcatcgatcatgcattgccattggtgcgggtgtgagctggtcaccgcacagaacaggatccatgcaaatgctttcttccctaatcgctttcaaagtgctaacttccattaatgtgtgtttcgtgtcagctcacagctgacatattcatgatatcagccagtgtcagccttaaccaaaaataaaatgacctcgatttaaactacacgtttgacgttcacgttcttcaaaatcccaaattaaagaagctcctcaatgtccttcagaactcagagttgtacatgttttcatgaaagtgacgcaaggcatacttttttgtttaataaaaaaaagaagagtatgtccaaattcgttgtattagaaatgtcacatcctagtactagattggtttttcttaggacgaagagagtatgctttactgcaaactttgcacaactacaagttctaactgctgaactatatgttaaggtttgttgtaaagtgagcataacttaactggttaaatttcttatggagttatggtgaaattttgtctacctgagttcaagtattaaagtattttgtcaacatttgaagggaatatttcagtgtaggtgatatattcgtcagtagcgaaacgtttatggtagttttgttaatcttaagatatgccggcttagtctttcagaagtgctcatatccttgccgtagtaactttgtcgatctaaaaatatactgaccaaatctttcagaagtactcataggaattaggtatgtgtgtgtggctttataaaaggtaagtgtgcggacgtcatgagcatagtaataagcattaatgtattaaaagaaattaaggtttgttagtgctagttgccgccgcttgaatcagcaaactgcagcagtcagcgttcggctcgacgctgttcgctctaccaactccacggaccagtctgtttggtgaacttgccaaccacacggtatttgcctattttgccaagccgtttcgccgttttagccgatccatctctgcattaaggcgtggcgcgcctaccatatcaaaccgtcgtcgtcggtctcttcgacacattcctgtcacggagagataatccctttcgcatcagcggcggcatgatattccgagtgtccggccgcggcgcccgcgcgcgccgggggcggccgaagatggcggtggcgcggctcggcgcgggcgcgggcgcgggcggtggcgcgccacggcggcgcaggacgttcttcctttggctgctgctgctgaggtcgcggcgcgctctggcgcggctcagggagtactacgccgagatgatgaggcggctcgtcgccgaggcggcggcgctggagcccgcgccggcgaagtcgcggggcggcgctatcggcgcggcgccggcgaggtcggcggccgtcgtgcccgcggcggtggcgcgcatggtgctgaggtgcaactcgcactactacatccgctgagctactcgagctctgatggcaatgaaagctttgcgcgcgtatctgtcgtgatattgtattttttttcttccatttctcgccgtgtaactagtaataaacttgtaaattcaatgcgtgactgtatatgttttgcagaaataatgtgtcaagaaaccctctcccctagtctccttgatgtttggtcatttttttcttttatcgtttattctgtgttgcttcttccgttcaacctctcgttgttggcttgttgccaacttgcacaattgctaattatggtgtgtttgttcagcagaaacaaaggtaactaaaacacgattagatcagtgtacacaatgaatcggccatttgctaagtaacactaaaaaacaactattagtagtccagtacttactactatcaatcattttaatgtttaatattgcgacttaaggaccataagaaaggtcaaaactgaccaaccaaaccgcaacgcatgaatgtactaaagctcacacaatgacgccaggcccggtgtgcgggcttatatttgcaaggccagatctgtcaaagcccataacgttatcaggctgaagtgccgaacagactagtacaaggccaggccaggccagccacagaatttcgccttccctgacatccaccaagcagcccaagtttgcaaccaagtttttggcaaagttccgagtctgcgcatgagcgactagccaaacatgcgccctctggaaaaataagctacagatgcgagtttcaggccttcagaacggcgatatcttttggcgaacgagacttcagtctagattgcgttaactgtgaacaaatcggtaaccctacaagaagcaatgacgatatgaagggtgatcaccatttctcacaagtcagatctgaacaaaaggtataactcactactggagcaacagacaaggggcgtgtcaatccaattgataatagtgctgctactattactgaagtttacgatggagtagtatcagagaagaaagaacttgctcttgcgttaaacctgctttaggagccagagcagagcccagtgacagcacagataaacaaacatgcacagaagcacatgagaccttccttcaaaaaagaagcacatgagactattcctgccaacgaagtgtttgacacagtccgatccataacaacaatacctaaaaagttatacatatcaattgcagcttcaagttcaagcagcaaaacaaacaacaccatttgggcgactttaaaatgtgtgtgaaagcttaatctaggcaatgcaacagttttttcccctgaaatggataaggcgaggcgcccattattacttcacatcaccgtcaactagaaaaggtctagttgcaagacaaagtcacaaagttgagcatctctcacgagggcaaccgaaagcaaccgataccactacttgtacatagttcatggcttcatgccacagatgaggaaatacaatacacctattgaacaagtacttgctgcagcaacatgcgctgtccacatgattggaggttgccaactgcctaggatcaatcaagcgtcgacctactcatttcatcatctcagcttaagattatgctaaaatatcaccatgcgagccaaaatgtgatgaatcatgaaaaagcacatatcttaactttcactccaagctctgaataaattgagtgcatggctacatgatcagtacccattagtgttttgaacttttcactaataagttcatatcgatcactgaacaagaaggaacccataaggccaaattgccaatgaatcatgagcaaaactataaacaaggcaagatcatgctcttacatgatccaaactacagtttacccattctcatactgtctctgcattcagtcacagggacagcatcatttcattcaagaagagcgagaaaagggagaattttctttccgtgatcgaatctaggctcctcatattgtcaattttcagttcttcagaaaagatatgcctatgcttatcatctttcaactgatgatacttcttagattcgttgcagctcagagagagaaagctctgtccattctagagttgattattcttcaatttgatctaagtcatctttatccattcctcattcacaaaggcatcaatgcatcaattggttggaaacacaaaagtagcagctttctcattttgtactctacaatttccccccaaattacagaaacaccggaatccccctgtcacgcaattggatttgtacacagatttatttctacttgtcatacaagatcgggaaaccaaacagaggagccacacctgggggcagccgcaaagccaaaccctaggcgcaggcgcaggggttgtcgaccacgacgaggtcctcgccgtcgctgctgcggaacgccaagtagcccgccgcgagcccgacgaccacggcgacgaacaccccgccgttgaacgacatgacggcgagcatgaggaggtagcccaggccggagttcaccccgaacagcccggccgtcgccagccgcgccggccagcgtccggcggcggacgaggggaggaggagcggggcccgcgcggcgtcggaggacgccgggggcgggatggaggccggcttggcgcccgcgaggagcttgacgcggatccggaacgcctcgaggtactggtagaaggcggaggcgaggaggagcgcgacgagggagaggaggtacccggtccacgtggccgtccgccagccgtcaaacaggatcgtcacgtccttcccccagtagaaggtcatgtgcatcatggtgctccggcggagtgactgctgctgctgcggcggcggcggcggaggcggcgagaggggtttggtgatctcgccggattgggagcggaggcgggtagtttggacggagaaggggaggagggatgaggattccggcgaaagagaccggtgggattttgaaggagcggccttcgttgcgaggtttggattttgggtgctgggtttggttgtatttacgttcgcgccactggactggaggttgggtttcccagcacggcaggtatttttgtaagatttattttagaagtttctgaatagtaataaccggtatcttccaacttaaatattctcctttatcatgtcctctgcttctgagttgagaagcactatcttgaagatgaataatcatgacacaaaattcatgtttacttatgataatagagaaataggaaaaacgtaggaataaaatgccatatttattgaatttatgtgggattgcgaaacaaaggaaagtctttaaactatcgtttgattagcacacatgaagaggaaaacatgaggtgagacctcatacttatttttctctaaaattgctctagtaaggtatattccatagaaatttcaaataaattgatagaaaaataattctccgtttcaaaggatacctctatagaattattttccataggataaaatcctctagaatttctataattttttctttgatttaaagggggccttctatcactaacatgcgtttctacttgatagtagcccatatgtcaataattcatgtcaaagcaagttatctgtatatccgatgttgattcctatatagttatgtataactcaagtaatgaagccaacgatatcgttgagtccaaacaattaatagtgtttttatcggctagctattttttttcaaatatcggcggtagtcggttgagcagggattgggatccactgacttcacataatgaagtcagagagacgtacagtgccattactttgggatattctcagttgtccgatttacagcgaatgaatgagatcgatcactacagtatactaggtacatcataaacaatattcgggaacactgtatttactgtgttttgtactgtacctatagtaattaactacaaattactgtccctactgtagtagcaggatcattttaccctacgcctctaccttcagcccctaaaagcagaggagctggctctgttgaggtgatcgtctgactagcttaagaggtggcttcccgctgcctaatttagtaatttgcaaccgtatggcatgaaacatgatgctttgaataagtgaaaagtttataggtggaagcaacatgtaggtatagtattttatcccataattttgttttagaaacatactacaaacgcacgcgtttatgacacgggtacactcatctctataaacacacacgcacacccctacccttatgagcctcatctctacgaacatatacacacgctacccttatgagcctcatctctatgaacacacatacgcacaccatatctctatgagcatctccaaaagattggacggacatatcttgaaattgacaaagtaaccactggtatctcgctgtcgacgggtacgctgcctaccactaaaaactaataagcaataaatacgagcactcgtgtcaagtttatgacttaacccggatgagttagttccaaaaaaaaaactaacaagataagttatactcacttcactttatcctagataatctgataatcatggttggtgatcgactcacctgattgtttagtggtcgttttatgtttatgacttgtccgacagatgcttcgcctcctagcttaaggccctacaaacaagctcgcgtgcgtcatgtttggaacgagtctgggtcaaaaccgccactatccaacgcttacgtaccttaccttccccctccttttcggccgctcgccggcgcattgccccgtccggctctccttcctcgagtgctgctgctgcattggtcatcatgctgtggcaactggcaagaggacgtaggagtgggaatcatgggcaagtggcaagaaacgccaaaccagatggatactataaaatactagtgctagtgctaatagatggcatcgacgccgaggctgtgggccgtggctcacatgtaattagcgggcaaagcgtgccctatcaaatggagcatcagcagcagtacaatcaggcgggcagccgaggcagtacaggggcacgacctgtactacacttgtactcccgcgtccgggcaaaaaagctgggagaggcgcgcgggctggcggaggccgcaatgccgtcgcgactcgttcttttttttcattttttcagttgcgggcgggcggcgagcgccttgcctaggccggcgtcgcatagcagcggtggctgcggtgcgcatagcgtgcccgcaacgtgcgcctcgtgcaggcgggtcagcgggtgtcaccacggcccacgcacgcgacgcgctccgttttaccggtcgtttcctcgacgacgaccacgcacacgcgcctcatacgagtgagtgaagagtcggtggaggctggagcacaggagcaggcgagcagccgcgcagcggcgcaggcactcgttttcttttggaaaaagtacaccgaaggtccctcaacttgtcatcgggataaaaaacgttctcgaaccacaaaaccagatatgtggggtcccttaactatataaaaccggtcacctgagattcttcagtggttttgaccccggttttgatctaggtggcagctgagtaagcatgggacccacatgtcaggtgacacgtcgtcacctctcttttccccctttctctctcttcctcctctctctatcttctctgtgctggcgaggcggggcgcgtcgactaccaagctccaccgccgcacccgacgacgacgacgatgacacacaagcgcgaggctgggcggagaaggggcggtgggcaccagccgcaacgtcagcctctgcctccacctacgtcgccgcacccgacaacaatacacgcgtgcaaggccgggtggaaaaggggcggcggccggcggagtggcggcgggcaccagccgcagcgtcagccaccgaggccttcgtgaggagggcaacgacagtggaggacgacgccactgctgccgacaaggccgacaggcgcgaaaaccggggcaagaacggcgtgcggccggcgggggtaaatatcccctccatcgtcacgcgtgcggagaggccgatggagtgcaggaactccacgcgcttgagggaatgtaggaactcgacgcgctcgcgcatgacatcgatggtggcgtggagctcgaggccagcgagctcacccgggtcgatgccgagagaggcgaggaacgcgtcgacgtcggcgcggcgggctgcacggccacgctccatgtcgaggaggctggggcgcgcgtagagggaggagaggaggagggggaggggcgggggctgggccggggcctggcatgggtgggttcccgggagcggccggcgcggggtggggaggaggcggatgtggaggcggtgagacggaggagcttgcagagatgggaggatggggggagaggtggcggcttggggtgggcggagaagaggacgaagagaggtgatgagacgatgggaactcggccgctcggggcctcggggtagagaggcgcaggtgaccggccgagacatcgatgaaggggatatcttcctctgaatatggatcgtcggcttccccatcttcaccgagaccaattgcacgtcggcgctgacatggccctagcactcctcggtgggttcccttttattgctgcaccgacgccgctacaagatcatggttgggccctcggtgacgacggcgagagctcccctgctcccgcgtcgtcgtcgtcgtcgccgtcgccgccaccgccgccacgtcgccggccgccagacctcctctcccgcgtcgcccagtctgtctcctcgccatcagtcggccggcggcgccggcctgccaagagcaccaaacgagaagagagagagagataggagaaaaagagatgagggaaagggtgattgtcgacgtttgatgtcgcgattccggtatttgcatagtatggggatcgtcggtactagggtatacgcgagactgaggtaaaagagatggagacgaggatttttatacaggttcgggcccctgaattgtcaggtaataaccctacatcttgttggccgaagccggtattgctcttattcaccataatcacaccagtacaatatttggggtagcctatctaattgttgtagatatggcggtctgaaggtctgactcgtagtcgacaacagggtagtcttcctcctcgagttcgtgctcggcgagatcaaagataacgctttcgtctctcctgacagtatccggagataccgtaggggactagtcgtgcttatctccgaaatcgatatctggcgtcttgtcttggcgtatgttggcttgtattggttcatggctttgtggcgtctatgttgcccgttgattgtccgtgtctcctctcctcctagggggtcttgtatttatacccatagatgtccccttgtccaagtagaactagagaaaccaatatggatacaatccgagtagtccttgtcgtttccatgtagaactctggttgtctttccttatccggaactccctccatatatccgcagtcagttcccgtataagacatggtatgtggtgggtcctgccgagatttagtcaactactattaggtatgtagtatccataaccctgacagtgatgatgtggctagctgacatgtggggtccatgtgggtcccacactgactcagccaccacgtcagacaaaaccgggttgaaaaccacatagggatctcgggtgaccggttttatatagttgagggaccctgcatatttggttttacggttggaggatgttttttttatctcgatgacaagttgagggacccttggtgcactttttccttttcttttgggctgggactccagtgagatgtcccctttgggccagcgtggagttggatcaatgaggcccatgcagttagccaggcgggaattagaataagtccacttcgactccctcaaatatatatccaatactaaaacccgatcagaataccatatatgttagaaccctcaactactaaaacccgtatgaaatgattccttcgatgattttgaaagtggttttcactaacgtgatgtgttgactagtccaatagttgaatcaataggtgggacccaattgtcagccttttctttcttctcctttcatctatcattagttctcccggcattgaccccctcccgacggcctccgcgttggtcggaccatatagcggcgccgacgaccatccccaccgctgcactccggccccctaccatgttgtcattgacactacttgcatccggcgtggccgctggcctccccgccacctccctctcctcccggtgtcggcgtcgagcttcctcccccgccttcctctctggtagcatagcgggacgaggaagtcgagcaggcgacaattgatggtgctggcgcggcatgcggcccatccaaacaaagttttaagggtgaggtcttattggtttgccaaaagctaattataagaggtaacatgtatagcttatatagcaataaaattaatttgtgtataaaacttttacatatatattcttagcgattttaaccaatgctaaaaaaagatacattgaaagtatcttaaaatcaatatcaaaattaagttttaaaatttaaattttggctttaacttttttaagttaatcgataggggtctgaatagtgaacctagctagttggctgaaacatactacctccgtcccataaaaaaccaatttagtactggatgtgatacattatagtactatgaatctggatatacttctatccaaatccgcagtgttagaatgtgtcacatatagttctaaatttgtttttttacagatggagtacatgtatttcataataggaaattgtttcaggtaattcaccgtagccaactctctctattcattgcaccaacagccatctacctactaggctactacattttttctttctttacgtacgtgtcgacatgagctacattcctccatgttcaaggctctccttttctgataaatctgaaaatccttccctgtttgcaggggggagcctgagagtgagtgtcgtatgggacaccctatattcctgcgcggtgggatgcaaaccaggtcgcttccatttcacaagccaagacgttgaaacgttcagccaacgagaaacaaaaacgaatcgatgtgtttgcctctttgcaacgacgactccggcctgataaagatcgtccttatcccaaaacgtctctccacgtacatgcagacggggaggccaagtgaagcacgcctcgcatcttgcatcctcgcaccgaagacgacgacgggcgacggcgcgcggaaagccgggaaatgcaagctacagaggggcatcgacacacggcacggctttgtgagctgtgtgctcacagtgacctactctgtcgctgtcatgtgtgcaattctgtaatacttttagctatccatgccaagcattattggcacagagggacaaatgcctttaatttgttggccaattgtgagaaagagagatggtgctcgcttacacagttacacttggacggctcgatctcctgtcagtaaaacgaggttaaaattactagcactccactgaagttactgttaaatctcagggaataaaagaataggtttgtacttcgatggttatgttgggtgattttttttggtcggaggaatgagatggaatggaatactggaacgggatgagacgtcactttccgagagaacacggattgactggaagtttacaattaggattgctcctcattgatgtggtaatataatatatttgtcaatttatatgaatcatatgatggtgacattgtgttttgaaaagttgcttacactatgagtgagtccagtagtaataccagggcgctctatcttgtaatgaaaagcgagttcctgtcaacttcagaaatctataaaagcgagctaattaagatcaccatcatatgattcatatatgaagcctctgttcattacaggtggactattctagggtttacaaaatcttatggttatcacacagttatcgcgattatgacgtacggtaaccttatcagtttttgaaccacaatataccttacgatatccgtgctgttatcacgataaacatcaaactataaggtgatggtaagcccatccaaaacggtttgataaattctagcctatttatggtccaactagtatgaatcctcttttctttcttttcaatcttgtgtttctccttaatctgcgcccttctgtattgaaacttcggttattgtacatttattttgttgtctaatctacctggagtatactcacatgtactagccaaaaccaacttattttgttgagtaattatctcagcttatactagctagccaaaagcaaattcatgactcttatccatgctttatttattgcatcacccgatcttgttagcataaaattcattttcagctgatgttggagtgtcccagctctccttttctcttatgtctagactttagagtgctttattatttcatttccttttttttcttactggagtgtctcttttccaaaacacggcagaccttatttggatagcgaattcgagtcatcatgacctataaagtcaaatgcaaatatagccaaaaccaactttatggcatgatagacatgtatacaacacaacaagtatagtagtattacgtacttaaaaaaaatctaaacaacaaaggaaaaaaacaaagaaaggaagtgatttttagcgtagctgtgtttgtagcgtaattgcgtaaagtcctttcaattttgctatatctcactcgaaagattttttcttatctctcactcgattttctcactcaaatttacagtgtattttcttgtaagttacagtgtaatttatgaaacttacactgtaacttttgtaagttacactgtaatttttgaatcttcacatgtaaattttaaattttgtattggatttggtctttttcttgaggatatggtaatttaatgttcattatggtgtttcttaattgctttttgctttttattatatctatcggattttaatacaaagattaaaaatctgtgtgatacgattataaaaatctttcgaaagatgtataggtactcccaagcccttttaagaaagtttttcaagacaaaagtttttggatgaaaggtagttatagggaaaaaggaatgtgcgtttatgtttatttgcattgcttattagcaaccaaaaactaatctataagtaaatcttttatatacgtgcgcttaataattcaaaagcaaattcatgtaaaataaaatgcgatgaagaaactttaaaaagttatcaaatttagattttattaaattttagtttacaagagcgctacgatgaaggctttaaaaagatgggaaaataaaacctttgacctttctggacttcaccaaacagctcacgctttcggcttcgtgccgtctcgtcccgtgctactgctaccccctcctgaccccacccgccactccacgctcccttctcctccccttcccgtgacacacagtccccactccaccgcctccgtataagtatcccttccttaccgccggccagccacagccaccgcctcccccaccccaccccgatcccctccccgccgtacgggcgcagaaggaacccgtcttctagaaggaggaggagggctacctctctctctctctcttctgccatggggagcttcgcgaggaaggagcaccagttcctcgccgagcttggcctcgcgccgcggaaccccgggtccttcgcctgcggcgcctggggcggctcgggccccgtcgtcacgtccaccaacccgacgaacaaccaggcgcgtctccccccacacgatccgctcggttctaggcgctcgatttggtttgggccgccctggcatttttggggtgtgtgtgattgtggtggattttgatgggggatttttttttgggtgttttgtggtttaggtcatcgcggaggtcgtggaggcgtccgcgcgtgagtacgaggagggcatgcgcgcctgctacgatgccgccaagacctggatggcggtgagtttcacttgacttgctgtgttggagtgctgatatcaattcgttcggatgatgaagtgctcgtactatgctcttgtgtgtcatttgctattttctgctgcgtgagagatctgactgtgtggaaaccagcaattgtgcaattcgaaacgttgcgatattatttgtttggaaatgctgcctcaaaaccctgtaacttgggtgttttgggggtttcagcttttggttacagccttacaggaatctgagtctgctatagcgctctaatgcagcaaacagtgttcggtactgtacctaatttactgtaaggataatcattactgtagcgaaagtgatgtaacaactcacctttaccattagtccgttaataaacgacaaggatcaagggctaattcctggtactatagccctatgccgtagcatggtgctacatcagaggatctccttcctttgagaaggtggtatggactcgttatatgattcaggaacaccaaaaatctgatataaaatgggaaatggcaaagtaacagtatgtccgatgttaaaatgctgataaagtagagactgtgtgcaatgtgcacactacgatttcatatttcatacatgttttaatttataagattgtgatatcaaaatttaattaaaatacacatgtatgtataagcacactatgatgtatagaagctagcagcactgttatgatgcaaaaattcaaatatgtggaagaagcgcagctgagatccctttttttaagttattttattgtaaaactactaacagttacatattaatatgtccagattccagctccaaagcgaggagaaattgttaggcaaattggtgatgcattgagagcaaagctccatcacctgggcaggcttgtgtcacttgagatggggaaaattcttcctgaagggattggagaggttcaggtaggtataattgccgccagttcttccactcagagcttcattgttttttgcactcaggataggaaatgaccactatattgtgtttcttcagaatattcagtgatttatctttagaacattaatggtgtgctcatcacgaatgcttcattatcatcaataccttgcctgctagaattaccaacttagcccctaacatgatatgcagttgtgtttccttttctctctgttaatcatctttctgccaatcgaatgtcttgcctaagaatttggccattattgagataatttcatgatcgaatatttaactgcgactattgattctccaccatgaaggcatgattatgttgacataaatgtaacctctgttttgtaggaaatcattgacatgtgtgattatgctgtgggcctaagtcgccagctaaatgggtccatcataccatctgaacgtaagcccattctccctttcctaatttatatctgatgcccgcttcaaagtatgataacagcagatacttctgatcatattttctctatttggttgagatacaaatattattatatcttaattctgtctgaaaaagaatacctcaattgatttaggtttccaggttttctaatgaaattagtacttcattagaataagcaattttactccattattactaattcgctctctggattatttcatgttaagtgattctccatttcactaatttgaacacacaatatacttgccattctagtttactgttctatacaaaatcctgtcccttgacatgccataccaccattacttatcaaaatgtgccatcacacgattttctgtagtaatgataagatattcgctgattgtccgttagacagcaatattttacagagttatgcccaaattatcaccattggtttttgtggttaggatagaaggttgagccatggcgttctcaattgtagtaatgttgccatttattcatacttatgggattgtaaaattcatcaatgctctgtttgataagtatactggaagattttctaatgctgtcttctactttttttcaggcccgaatcatatgatgatggaggtaggcacaaaccagttcttttaactccagatttactttctctgtttctcatgtggaagaaagctaatccctaaagctcattcaaataggtgtggaatcctcttggagttgttggtgttatcacagcattcaattttccttgtgctgtgctgggtaagtgtcttctcttagaatatcattagtgaaatcaacttagtgcattgcaatt

SEQ ID NO: 54822 - DNA, 6856 bp, Oryza sativa
  unsure (1)..(6856): unsure at all n locations
tcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtgaatctatacctccaggctaaaaacaagtaaacaaaccaagagtaagaaccaagagtcattaagagagaaatgaagtcataaccaaggagatgaaggtcacatgagctcctcttcaacaatgacaccagaaaactcaatgcaccagttatatttgataatatccatcaagtaattatgtttctgctttaaatggaaaagtaacgatgtttctatagccgcggatgggaatttaagcctaccaaatcagatttacttgaatcatcatcggtacgcgtacagccttgttacagtctgcagattcttatcttgtcgaattgtcaattctaggaaacatatttggtccaagaaaagctgtaagaatgtaggccacgttgtcttctgcacatacttcagatagcagcaacatgtaggataggcaggatatctccattatccactatatgatgtatacatgccgtgagcccactgtcttgttctagcttaatgatttaattgattaaattgcccttgtgtattgcatctgatgcatcagctgtgaaatctagatgctttactgactctacttttagttctctttctgcttttggtatccattgattgcgaagtgttgctgtatatgatggcaacaggtgaactgatccacaataagccaaatctttgtagcatgtccaacatgaataactcggtactccctctgtcctattttaagtgcagttgtgattttccgtgtcaaatgtttgaccgtctgtcttatttgaaaattttaacaaaaatgaatcatgcataaagtactattcatgttttatcatctaataataataaaaaatttaaaataagacggatggtcaaacgttggacacggaaactcatggctacacttaaaataggacggaggtagtattactttcagagtcattaacagattggagatcaaaccttgcaccaagttattgctgtttgttcagaactatattagaaaaaaatgttgtctgggggtgaggttgaaaagaacttcagagaagcagaaaataaaagaaaactaacatatgactggtggaatcctggaaattaccttgacgctgcagtatccttttcccttgattaaataattaatcatcccttggagtgtattcttgataaagtatgtccttggctagtgaacaaataccagtatctcctgatcacaccaaggaaaatgtgtcaaccttcagagagagttctgtattaaaacaaagtgagcaaaaagaaaaaaaaaatcaagtgttaccaaaagacatatatgaaacccttttttttatcagacataattatgcgccagctaggcactctactgtgacatgaccctaaccaaataggtcttttttttttcagtaaatagctacctttatcaaaaaaagtacaagggtgtcctgtgcacattgcaggcatgcatatagcagaattgtgtaatatctcaacagccaatgcaccaaacataagtacagtacactgaacatcacaagatacactttactcacctatacccaaaaaagtcttcatttcctctagagaaaatgtcctaaaagcatgttgaaaacggtttgcttttctctgattcttaacagttcccattctcctaggtctgttaccaattatcaagctgcacttttcaatcgcatttttagtttgatgatctaacaaataacaaaaggttcttgtctttttatacagacttgtgcactcattgtttaacttttaggtcaagctatttcctgtttccttcttcaaatttctctcttgtatcatagttcttatccttgtcacatcagaccacattccagcatcggcgtagatattagaaagcagaatatgatagccaggatcattgggattttgctcaaatattcttttcccaaccagctcagcaatgtccattctattatgcactctacatgctgccaagagccctccaaggacatcgatttctggctcttctgccatatttgacatgaaacaccaagcctcatcaagcttcccacatctgctgtagagatcaacaatgcatgagtagtgttccttctctggagaaatattgtagtcatgtaacatggaatgatataagtgcaaacccttgtcaatgagaccagcatggctacaacaagatagtagtgccacaaaagtcactttatctggagcaattccatctctcttcattagatcgaaaaatgatagggcttgatcttcatggttatgctttccaaaagaagaaatcagtatgttatatgtaactgtattgcgttctgtcatcagttgaaaaacctctttagctacttctaggaaaccacacttgcaatacatatctagaagtgcattattgactgagcagactgagttaatacaatacttgatcacatatgcatgtagttccttaccctggatgagcatatggtgttgattgcataaaggaagaactgaaacaacagtcacatgatcaggttttaaacccactttctgtaataacctcaatgcgcagaatgcagagtctgaatatccattcacagcatatcctgcaaccattgagttccaaatggctagatctttgtccagcgtaagccaaaatatagtttctgccacccttatcaacccctgtttgctgtacaagtctataagtgcgctcactacaaactcacttctctcaagtccatgtcttatagagaagcaatgaatttcttttccactcctgattaacttcagcacagaaagacaaggaagtatgcttgccagagtactagagttggggtttatccccaaagagatcatttcacagaacaaactgacactcacattatgcattccattttgtgaataccccacaatcaagctactccaggagacaacatctttggaatttgtagaccagaaaagacaatcagccatctctacgcaaccgcatttgcagtacatatctaccaaggcgttggaaacatatatatcaccacttgctccacttttcacagcacatccatgcaatgcagttccaacctgcaattcacctgctctcccacacgctgaaatgacagttgcagcaattagagagtcaaccccaaacccttctgatctcatgtgattgaacaaatccaccacctcaagccagttccctgaatgcacagttcctccaatcatcgcagtccacgcagccaaatccctcacttgcatgctctcaaaaacattccttgcttcatccaagcacccacactttgcaaacatatccacaagcgcgcactgcacaaacacgttgggcctcgcattaccgctggcaatgtcagtctccaccatctcccataccttcctcccctgcgcaacagctccaagcgcagcacacgccttgatgacaggcggatacgtgaaaccatccaccgctaccgagccatcgttcaccatcccccaaaacatctccagcgcctccgagaatctaccagcgtcgacaaggcccttgatcacggcgttccacgcgaaggagttcctcctcggcattccgtcgaacacccgcagcgcgtgcgcgacatccccgagcttcgcgtacgcgcgcaccaactgtgcgacgaggacggtgccgtggccgtggccgccgacgaggaccgccgcgtgaagcctccgtgcctcctggaaatccgggcacgactgcagccggaggaggagcgacgcgtgggagacgacttgagacgcggccgcatgagagccgcggcgagcggtggcggcgggagcgggagcgcatgtggaagtcgtcgccggcgaggcgagaggaggtagccgtggccgcgatttgatcctccccttgacggcggcggcggcggcggcggcggcggcgagcatggtctccgcgagccctccgccgcgcggggtttcatcagttcaacgtaggaaactgcctaaactgacgtggcgcagtggcagttgaaacactctcaagtttgaacaaacgaaatttttcataggcaaggttgaactattgcgctagtttgattttcagacaagcgaatttgaattttattcctgtttgaatcgagaaaagtctcctttcaatttttcatttcatacgtgtcagtcataaaaaaaataaaaaaaattggcaacacagattaatataaaatatatcaaaattcaacttctaccagttgtaaaaaaaaattaacaaatataattgcaaatgtgcgataactattttcagtttaatttgttatttttgttgcatacttgtagaagttgaatttggttttacatgtttgtacagtgatatatttcgtattgatctatactagaaaaatgcctgtgcgttgcaatgggtgaagtttttagtcttattattgttatatggtttagttaaaataaaattcacttaaatatatatatatatatattagaaatcatgagctgcagttaggagttcgatcgtctcaagttagcatgcgagttttttaatcatatttcttatatgattccttctatattaccaaaactgaacgatcttaagaaccgacaaaaatacagatatgtatttctaaaagcaaacgaacttaaaaactgatacacacactaataacgtaccaaaataccggcaaaaacatctttaacttttataatagtagagattgttatttttttaaaaaaatttaataactatttacatggacatgcaaataacgtcctcccgaggggtgacgaatcgcttgtatccacgtcacgcgtggacgcgtgtgacgaccatggggaggccgtgcttggggcggagcgtgatgacgtcggtgggcgcgtggacgtactccggcgagagctccagcctgaaccgcctgagtatcgcggcgacgacggccttcgcctcgaccatggcgaagctctgcccgacgcacgccctcggccccgtggagaaggacagcagcttggccatggcgccgccgccgccgtcgaacctcatcgggtcgaacaccccggcgtcggcgccccacacctcctcgtcgcggtgcatcgtcgcgatcgggaacgtcagcatcgtgcctcccggcaccgtcacgccgcccatctccaccgccgccgccgtccgcctccggatcgccggcaccgggctgtacagccgcagcgtctccagtaagaactgatttagctgccaagggaaaaaaaaaacgaagcatccttccattaatggtcacatcgaaagctcactccaccattaatggtgatagctggagatggattctaattattcaagtccacccgtttgtttcatatcaaataagacatgctttagttttcaaaataaaagcttttcacccatcacatcgaatgtttggatatatgtatagagtattaaatacgaaaaaaaaacaattacacagttcgttaggaaattgcgagacggatcttttaagcctaattatgccgtgatttgacaatgtggtgctacagtaaacatttgctaatgatagattaattaagcttaatagattcgtctcgcagtttactggtggaatctgtaatttattttgttattagactacgttaatacttcaaatgtgtattcgaatatccaatgtgataaccaaacttaaaatttttctccaaccaaataagacctaaatggttatgaaaaaaaataaaaaaatagacaagatagattaatatgtaaatatatcactccacgacatgtaagttcaaatttaacttaacaaattgcattcctaccagcttcagcttgccgagcatgtcgtaggtggggagctggtcgtcgtcgtccccggcgccggcgccggcgcactctctcacggcttcttcccggagcttgtcctgccagtccgggtgcgtgctgagaagaaacatggtccaggagaggaggtgcgaggtggtctcctgcccggcaaagaagaaggtcttgcactcgtcgatgatctcgtccatgctcagcaccggcggctgacgacgcttcgtgcccagctccggtggcgcgctggcctccagcatcagcccgagcaggtcctcgccgtagccaccgccaccgccgccggccttctccttcgcggcggcggcgagtctgttgctgattatctgcatcagcgtactcctcaccttcctgtccagcctccatactttcagattcttcttggttggaaaatacctgcaaacaaattatttcagttcagatgaaatttgacatggtaaagtgtttgtacctacctggagcctgggatttggacgctgagaaggcttgagaaggcgatgaactggagctccttgatcgccatgaaaacctgcttcccctccgcgtagctgctcccgaacgccgtgtgagagatcacgtccgcagtcagctcctcgaactggctgctcagctcgatcaccaccttcccgccatggctcgccaccttctcctcccacctcgacaccatcgaccgtgcgacgccggccattgtcgccgtcatcatcttacaccaaacaatttttcagtttactacaagccatggcgtcctgcgtcagcaagaagaaagcaatatgtgatgtgatgtaat

SEQ ID NO: 54823 - DNA, 31462 bp, Oryza sativa
ttcctgcagccccttcttgtgtcgctgccactcgtcgccgttggccaggacgagccccctgccgaacagcttgagcagcatcggtgtcgtcacgttcttggggaacagccctgtcctgtccgagagcacctgcttcgccacctcgacgtcggccacgcacatgtccggcgtccatccaaaccagtacaagaacactcgccctgcacacaaaaagaatcaataacatcacataggattcagacgaagacgatagctagctgcagctctgattgttatgttaccgtagagagggatccattggcggaactgaggctggacgaaggggatgaagtcgtgggaggcgacgtcgagcgccgcggcgccgccggcgccggcggcgtccgcgcggagcttgttgatgtcgccgaggctcccgacgagcagcctgtacccggggccgcgcacgccctgccgccgcagcgccgcggccacggcgcgcggccgccacacgaggcgcgacagcgcgtcgagcaggcaccacgtcgccagcacggcggcgagcgcccatccgtaacccatttgcgcgcacgcggggcgagtgtgagatagatcgatgctgctgttcccgattagggccggaaatcgagaggaagaagatgcgtacaggaagcgtacgacgacgagctgtatgcctgtatgctaggagtaattgatttttatggaacactgcaacacatcacatctgatccgtggatttttcataaacacgttactacatttcattttctgctttaaccgtgcgtcagcgtcattttccttttctatcgtgtggcttgcgcgctcccacgcggaacgctatcctggagggcccatgggccttgttgggccatgcatttttgtagtttcaactttttagtgatcttctgtgttcggctccacagtttcccaactcctctttctcgtcttccgcgcacacgcttttcaaactgctaaacaatgttttttttaaagtttctataagaaagttgcttaaaaaaatcatattgatccatttttgaaaaaaaaatagctagtacttaactaatcatgtgctaatggaccgctctattttccgtgcacaggagttaggttgccatctcccccaaacgagcaaagctagtgatgtatacggtggaccgacggtgcttaaacttgtgtgtgtgcgccatttaggtcctaaactcttatgtgtaaagtttctatggctgatacttatatgtacaattttttacgtttctataaatataaaatcaatatgctgaatatttttatgacacaaagtttttatatgtgccaaaatgtatatgtatatgaagtttttaaggtataaatgagtgttgttaggctgcgttcgttctcctgagttgggaacacattccctccgctccgcacgaaaaacaaagcgatgcattttcttatgattaattgaatatttattttttttaaaaatagattagtatgattttttaaagcaactttcatatatatatatatatatatatatatatatatatatatatatatatatacacacacacacactagcaaaatatatccctttgcacgttagacacacgacacaaaaacaacggtatgctaatatgctacttctatctagtgcggttcttgatgcaagggatcattacaaagctttgcttgcttgctttgcttttacgggtccgtccctctctcggactccgatcgattgatcaagcgagctaaccaacgccgtctcgggaaagatagttaaccaacacatgtacagaaaaaagaattaagccgtcaccttcccttttaacgttgcttccttgatacagctttaactaacttgccccacccatctcatgccattgccatgcacacgtacgaacgaactacacacatcacccaccccgacctccagctgctaaaaaaatattgggtaattggggattttttttggctcctgctgtctctcgcgatatgatctcccgtggccgcgacgcccaaacgaattcgtgaggctttttaggtgcgtcgtctctgctttcgtttggcggcgacggcaaccgggatcaggtcggctagcttacacacatgtgctcggcgatccaaatcaatcagattagttatggacttgtttgttggtacgtgcgagtgaagacatgcacgcacgcgatggcgagcgcactgatgtgcaggttggacctgaaattaattcaaggggatatgcattagtatttcttttcaatgttattttgtttttcaagttccctggattggtagtgtactattgtccctctgctcaaattaagcatggttatttggacatcgatttcgtgccgaagatttcaaatcatgcacttgaaacgggtaattatgtggcagtacgatgtacggatatgtccatgagaaacttgttggagctgaaccatcactgtagcgtgccagaggctttgttatgggcctggcctgcttacgtgggctggtcgatgtcaatcgtgggccacgaccagagccacagcgatacggcataggaaaaagtacaccgaaggtccctcaacttgttatcgaattacaaaatcgtcccccaaccgtaaaaccagatatatgacatctcttaacttacaaaaccgttcattttacatccttcggtggtttttacccggttttattcgacgtggtgggtgagtcagcgtaggacccatgtgggtcccacatgtcaagacaccacgtcatcaggctatctcttccccctcctctcccttcctctctctctctcactcatctccctaggcaggctggccggcagaaagatttacaaaaaatagaccctgcggctctccatttgggcggcaagctgacgtggcacacggcgtcgtgatgtgccgtgtgcgcattttgagcttagacccttggggctaaatgtaatttttgccttgctaaaaaaaattgactagttctttttacatctgggccccttgctgcccttgcgaattttgcacggaggctccttgccgcccagacagagggcggcaagggggccacgtgcaaaaaatcgcagccccccaaaacgaccgtcctgcaccgtgtgccacgtcagcttttcgctgatataatatttttataaatattaaaaaataaatctaaaaataaaaaaaatcagtgttcaacatctactctgaaacagtgccaaatatttcttgtagtgccaaatatttcctgcatccttcgtacggcccatagttaaatatattttctccgctacaaaatgttggtacctagaatgaaatttagataacgaatatggataaacttttatccaaatttattgtcgagtctgtatataatttctatccagattaattgttctagtatggattaaatctcattttagattacaacattttaagacgatggtaccttcagaatagacaaaatgccaggtaaacctcaataatataaaactcgaaaatgtaaatgaagtctgctctgccttgtgaggctaggctgtccagggaagcaggaaccaagtcaagcatggactgtaacatatccatcgtggcatccaaaaagcatgaatgaacaggacaatctgcagagtgcagttatcaaagatacagggtatctcaactccccaatgttgagatgcattgcaactctgcaagttcagtaaaatttaaaagaagcttagcatgaagatttattatcacatattggcagaaaaggtgtcaactgtaaggcctttgttgtatttctgcataatctgacctttaaggctgtcataaatagaacagtatctcagtgccttataattaatggagagctcataagataatcacacctcacaatccatgcacgtaaactcggttcatacaagtgaaactctcatccatcagaaatgtctaaaactattatcccatttacaagtgggtcctattattattattattattattattattattattattattattattattattattattattattattattattggtggttgttctttcgtgtaaacaccatatagtataaagactaggttaatgtaccacatgagtaaataccaaccttaatactgttccgtgagtcgttatacacaatttttttacgactagtagcatgcccgtgctaacgctacggtaacatgtcgtaaaacatattaaatagtcaaaataagatgtggtaacaactaactatagaatgagataggttggcataggaaatatcatttttgttaaagtaaggacttgtggtagcaaaccaatttcacccaaaaggaagctcagtcagttctggtacaacttttttacagactttcttacaccttttataaaaaagaactgattcattcagcaccaaacacagcccttggatctgccattagggaatatccacatatatatataactaacctgaagaattatcttcagccgtggttagtgctggttcgtgccactatgtgtaggtagaaaatagtactaactggtagcgccaattaaatttaggaagaattaactggatacaattacaagaatgttgattccattatggagcagcatatgctctcaggcggcataaatagtgcacccgcaccctaccgtcgaggaaaaaaacataattttgcaatcaatcggattagaattaaattagggttcaactcaataaatatgttccacggtgcttgcaccaactaagtgatgctgacctgtagttagaaatataacaaaacataataacccatgataaaactgaaagcatcttgttattaaaatcgatagttgagttagttctctgacagtttttgtagagtaaatacatctgaaaataaagctccagatttaccagggtgattcacacgatctagcagctttgctccaacacaaattgaacccatatgcaaatgtctgaaataaagtacagttagctattttatctcatcgaaggaaataaagtgcgaatgctttttcatcctaatcctttgtaaatataactccatcaaaatgcagtgtatgcagagaaatcctatcattttgaaccatttgaaatcctatcattttcaaccattttctttaacatcaaagtcgattttcagcatcaccctatcatcaaagtccattttccacatcgtcctctcatcaaagtccattttcttaacgtcgagcttcattttcagtctccctcccctgtgccttcctctcatcttatgcagagtatgctcaacttcatagatttacagtaaaagatccaaatcaaatttggcaataaaatctttattaacttgtttgaggatctaggaacagaggatacattgccttaacctgcatactcagctgctccttgatcaacaaattgcagcaccaaggctgcagagtcccctaacctgcgagatgctcaatttttcagcctgctacgcagaagcaaaaaaacaatctgcagtccgcttatccacttggcaatctgccatacttcccagtacttctacagctaaaaatgttgccacaatcaagcaaatgctataaagggaggtcaaatttgcaagtaagatatattgattgtattgtttcagtctacccgcttctctaaataaccactatttgatgtaaacttaggatagaacttggttttaaatccagcgactattctgcatcagattaaccgtactatatatactgaaggtctgaaacatgcaaaatcatgcctaaatttgaccaatttgtcaacggatatgctagacggaggaattcaggaatcataacaccatttaataatgggatacatgtggacacaaatatgcaggccaaaattaaggcagcaagaagagaacattcttatcttttcaaaatactgtaagagtgtgattcatttcttgcaataaagatactacattacgctattctgcatcttaaaaaatggcattgaaatgggaccgttttccatatattccaacagattgcagtaaaaaaaatgaaacccatgccacaaataactcagggatatcacattggtgcaatcaaagaatcaatgaaacacttttagcatgtttaaactccacagcacaagcctgatacacaaaaacacaaatttgtttggtcagcgagctagatattagttagtaacctgattgcgacagcatggatcacatcggtcccctgcaccactgcagccacccctaatgatttcttattcttacaaagatggcaaaacaggagctgaagaaagcaaattaaagagaaaaataagagatcgggtagcttacttggtgcagcgtaggcttgatgtcttgcctggatgccgacgacgccgccagatcggagcttcggagctggtgctgatgcagtgagctagtacatgtgggattttgtccgtgggtatctaaaccatacatcaggggcaaatgacggcacctggcgagaggacggccagcttcaagacggcggcggatgtggttttggcaccgcgcgaggctgttccagggatcaggcacgctgggcggagatggccgtcgacgacggtgctcggattttcgttgaggctgttccccgaagactccaggcgacggcgatctggcggcacggaggcgggcatacaaagatcggtggcgtcgcgaacgagagtaagggtagagcggcgggcatcggtgtcacggcggcggagaggcgaggagccggcggcgacgagttgtgagcgacggcggcgaatcgtgggcagcgctcgcagaggagaccggcgtggtggagaggcgaggggcggcggcgcggtgtggggacggcgacggattgggggttggcgtgacgcggggagagagagggagcggcgatggcggtgcggtagattggagagggcggcggtgatcgcgggtctggtgatgaggcgacgcggcggcggggcaaggaggcgacgcagggaggagggcgaaggacgcggcgtggggagggagaggagatcgatccgagagaaggggagaggagcgatgcgcggtggggaggagatcgaggccgttggatatggcaatcggatggttgagattacgtgtgtctgtcaaatgcgtctgctgtgttaggaatcaagaccaccactaccgattttttaagtagtagatatatatatatatattaaaaaaaacaccgtttagcagtttgggaagcgtgtgcatggaaaataaggtggagggagttaggaaacaggcacacagctggaatgaacgcagccttaatgcatatatgaatgggctgcaggtacgctcatgggccaaaattgaaagggccaattagagtgggtacaatagcatagtataagctagctataaacacatcgagatgataaattatgagagagaagggcagtggtctacatatttgtagccagctgcagcacagattataagacacaatatatttatttcaggtcagaccatatattactaatgtattgtatgtttataggtaactatttaatgaattggctattaaatcgactataaatgatttgaagctaatagttggctatgctattaaacttgctcttaagacgtctgctgcaccaagaatacaaacgacgagtaaaaaactcccatatattacaattagaacgtttgtacgcacgcggaaacaagtaaaaatctggcgagcctggccggcgttggatgatgaccaaatcaacttgctacgtgggataagaccatcgtccagaccgcttagtggtaaaacgaagtaggagtaggttctattactctctccattccactgaataagacgcggttaaaattggtacggtatctaaaactattctttaactataaaactttccgtatattacaatgtttttagtaacaagattataataataggaaagaaaattcaaatatcaatccaatattttttttcataaaataaagtttaatttataataaaataaatagctaaattttaaaacacgtgcatatactttatttagtggagtaggatgaagggagtagttgacaagcatctgtacctggtttatggtcgggagaacaaaatcgggatcatggtttttgtatgaggggttctatatggacttttatgtttttctctactcctcagctaggcccatctgtggtccatcaggcctcggctgagagaggagacggcctggcacggccaaccccacgccggccgccgccgccgcgacgatgtaccttgcaaatctccgtttccatcgtgtcggaggggttcggagtttgaaacaacgagcctctctatcttttttaatttttgttttattttttacttttgctggttgaattgtcgtattagagcatatacaatagctgactataaaccagctataaacatattttaaagagataaaagatgagagagaaaagcaacgggccacagatctggagccacctgcaccacggactctaagacgtaatatgtgtgacaagtgaaaccatatattaatagtatagtaagtaactattatatgaattgactattaaattcgctatatatgaattatagctaataattggtcatactattaaacttcttttatcagagggagaaagaagagagattactttacgctggttggcaaagagatggtgcaggacaaagtcaactgacgtactaaaaccctgaacgctggttcagtgaacgagccgcgttcatcatggttaattaaattgacgcgtctaagtagttactctctttatcccataatatagcagtctaatattaaataagaacattaaaaaaacataggataatatatatcatagtattataaatctgtaaaaaatattctagtactacgttcgggagagtctctctatccaaattcgttatacgaggaaccatttagtagggagtagaacaatagctactatatttatttcaaaacattttgggatggaggaaaaatagcagggcccatcatttatattattcggggaataagccaaagcatatttataaacgaaaaataatttgtatacgtgttcttagcgatttaaaagtaaaggctaaaaataaattttgataaaaaatcctcttaaaatcaactttaaatttaaagttgaaaaatttaaatttggactgataagtataagcataaacgaaaagacgaggctgtgagcttcctcttcacgcggcactcaatcgtggccgttgggagtgcacactgattatacaaactcaacgtatatgatagttcttcgagctacttagatggatgacatagtatgctagaacttcttttgtttactccctttctcttctccttgtagtaatttgttatcttctgcaagtggttcccctagtcaactggacatcatttgcatttgttttgttgttttgactcggcccggatccacgtacgtattcatattgctctagtcaatatcttggctgatgagctaggaaacaccaaaagttctgatatccaaccaacggtcaaagcagagaaatctgcacctgaatttcgtacaaagggaatatatatcatacaagtatgataaaagaataacaaaaccgatctgaagtgtgtaacatttggaatgccaaacaagtaaacaaccgccatatccgaatcaacacgcttataacgtcacatacaaaggcagcgtaaatacatacatttcttccacatattcaggctcttttttggggagaaaaggcattacacatttctacatcttcagacattttgtggattaggctttcgttttgttttatcacttgcatccaaatcttttataaactattatatgtttcagacccagctatcattaattattacaagtaatgtctactgtctgacctagagcactaattcagatgatgaacacgtgattttgcatacaaacgatgcatatttgcataatatatacacatctccttacacatctgattaactaatcttcaggctacttgatgaataagatagtgacatcttatatggttcttacgtttaatttaaagacttgctccgtttctctgcatatatatatctgttttcttgtcttgactgaagcatatgaccttgtcaacgataatttcgtcttttgtttttgtatctccgatccatactgctcaggccaagagtaatatactagtagtaccttggttgatgagatagaagtacccaaaacttcttaaatccaatcaacaagcaaactagatatatttacaccccaatttcgtacaaaatggaatcaatgcattacacacagtaacatcatcagtaggagcaaatgctcatgaacaaaaactaatctcgtgtacaacaaagaagtactaaaataaccccctcctaatgaacaacttctacaccttgagactcttgaggatcataggcagcccatactttggccgaagcgtgatcacgtcggttggcacgtggacgtacttgggtgatagagtaaaggagaacctctgtaggatcattgcaattacggccttggcctcgatcatggcgaagttctgcccaatgcatgccctcggcccactggagaaggagagcaacgcgttgggatattttcccgcctttgacaccccattcttgaacctctccggcttgaatatgtcggcgtcctcgccccacacctccttatcgcggtggattgttgcaatcggaatcgataggacagtgccctcagggaccgtgatgccgccgagttctagctcggcgttgaccctcctctgtatgaatgcaacagggccatacaacctcagggtctcgaggaggaacatgttgactagcttcagcttgttgagcatgtcaccggtgggcaccttgccgtcacactccgttgccacctcctccctgagcttctcctgccactccggatgtgtgctcaataggaacatggtccatgtgagaaggtgtgaggtggtgtcgtgccctgcaaagaagaatgtcttgcactcggcgatgatctcgtccatactaagttgtggctggctctccccgtgctccggtgcacatgcctccagcattaatccgagcaggtcgttcccgtatcctgcgacatctttgttgttgagccggctcttgatgatgtccgtgagcatgcttctcaccttcttgtccactgaccatgtctttaggttcttcttggtcgggaggtagctggaccccgggatttggatgctaaggaaggtggagaaggcaagaaattgaagctctctttgtgccaagaacacttgcttcccctccttatagctgctcccgaatgctgtgtgcgagatcacatcagcggtaagctcctcgaatcgtcggctcagctcgatctccactatatcgccctttgtccccaactcggattcccactcggaaatcatagattgggcacaatcggacatagtcacagtcatcatcttgagcttgtccatgttaaatgccgggtggactactttgcggtggcgcttccactcatcgccgtcggtgagcacaagccccttgccgagtagtcgtgcgaagtatgggttcgacacgttcttagggtacatccccgtccggtccgataacacctgcctcaccatgctcacgtctgccaagcaaatggtaggccgcgctccgaaccaatacatgaatgtcttccctgcagcacgtaaataaatacgaaaaatacacatatatcataaactagcactaggatatatatatatatatatatgatacttacaacatctgattttgtaagaatcaaaagaaaactccttatcggtgaagtcacggagagcgtaccatagagggggatccatttgcggaagtgcggctgcacgatggggacgaagtcatgggaggagacgtcgagcacgacgccggcgccctcgtcgcggagacgcctgatctcgccgaggttgccggagaagaaccggtatcccggcccgccgacgccctgcgcccgcagccgcctggtgatggcgcggggcctccacaccagcttcaccaccgcgtcgaacgcccacgacgccaccaccgccgccaccgccgccgccaccatccaccccagattacccatggctactagacgtacgccgcgagatcacctgaaccagtcgccggagtacgtacgcctatactgtagctctgcttctgcttcgatcggctggttggtgagaccttgagagagatcgaagagctaccggagctatggcttagttcgtcgttgctgtttgtgtggtgagatatcgatcgatggacttggtggctgccggaggctgtgattttatacgttcgacgccgcgcggccatgggccatggccggtttgacctccgggtggctatagcttggtgtgaacgcgcggcgacgatgacgcgtacatgccatgtcggaaagagaccgtgacatcagccgtgatgccagcagttttggcttcgctggcgatcacgtgccgtttccgggctcgctctcccgtgcggacgacagtattttttacaggacaccgacgtacacgtatacgattaatacgtacacgtacagcagtagttgtatcgatttatttatctgtttattattactccgtcggtttcgtattatatgtcgttttgaaatttttttcataatcaattttctttatattgatcatgtttctaggaaaaaaaggtaatattttgaacacgaaacaaacatattatcaaaatatattcaattttatgtttaataaattaatttggtgttacaaatgttgttaaatttgtccatacacttggttaaatttaaagaagtttgactaggaaaaatataaaatgacttagagtacatttgaccatttgttttatttgaaaaattagtataaatataaaaaagaataagttatatttaaagtacaatatatatatacgtgtcgttggccatgtacaaaatactgtactgtaatacgtacgtgtggaagaagagcacgttttagcaaagcctgagaagaaaacaggagataatgagagattgatgattaattggccataggagtagagaacaatcagtgctaacctactgacctcaacacggtgtctgagttgtcaatttggcatttgcagagcaaactttggcgcgttagtcaccaaatccctaatgattaatgaacatactggtccaaggattgggaggttcccattgacttgtcctggatttcatttcttgtcaatcaaggtcggagagatattcagataacgtttctagaaggacaaataaatgagaaaaacaatgggcagcacgtaagatgatttatatactccatactataaactgcatcactgcagctagcgtcccactcaagagacaatagcattactaacccgtagtaagaaacagtggcgaactcagaaatgggccccatcgtttagcttattggcgaaataagcgaaacggcatattcacaaacgaaaaataatttgtgaataaaacttttatatacgtgtttttagcgatctaaaagtaaaggctgaaaaataaacttcgatgaaaaaataccacaatcaattctaaatttaaggttaaaaaattaaaattttagctgataagtataagcataaacgaaggttgccttattagagttttggtccaataaaatcttacatgctgaaatttcgaagtgctccgcgagtcttttgtcttgggcctcgggcatgcatggcccgtgtaatttagggtgtaagtcctccctgaactcataaataaagtatattttataacaaaagtaattttttcttatcaataagcagatcggaaataaaatcattgttttaaaatctttttggacggaggaggttgttagctaggcctgtttggctggcccaggctgcggctgcaccacagtcaaccggaatagtgccgctagagtacagggatgaaactggttcggatagtttccgtccgtccggaccattttttggattcggatagtttcggtcggaattatccagaaattcagaatcgaaaacgaatacagttagggtactatccgtcggaatcgaaaaacagtcggaaactatccagaatttttttttcagatatccgcagacattgagcaaattatataaaaaacacgtatatatacataactttttcatatagaatcagatgaagacaaactttatatcaacattgtagagctcgatgagatctacaactttattattgactattttattatttgaggtcatttataggtctaaatattcattataatataccatattaatttttataaaatctcagatctacaattcaacgacatctgatggagatgtgttccatatcaaagttgtagagctcaatgggatctaccactttgtagtttataacatttgtatttgaaaggatttaaagtataatacaaacataacaagtttcgaagatgtgaagtaaaataaataaaatcttcaatttatacaatggtaagtaagttatacatatagtaggtcttgggaatagaaaatgataatcatatttgcatatggatctcttagagaaacagccgtaaaaatcgattttcacatacggttgtgagaccgtctgtaaaattgacgatataaatattggagatgttgaactaaaataataagtgatatatcttccttgatcaagaaactcaatttgaggggttttttatataccggtaaatactcgctaccgtattcgttccgtctcgtattcgctccgtatctgtattcgataatattcgatttcatttccgtattcgagttttcgattctgattccgattccgaaaaaaatatgaaaacgaatatgataaagctagtttccgtccgtttccgatccgttttcatctctactagagcatacatcaccattaaagttgtgtctgttttgatgattgcaattaggccgtatttagttcaaccccaactttcaactttccatcacatcacatcacatccaaaatttttctacacacatgaacttctaacttttttttctaaattttcaactttttctaaacttgtaactttttttttaggaactaaacacagccatagtgacactactgctgaacactgatgacacggtgttcaggcaaacgttctttttacgcagtatatgtgcctttgattgaggcaattactgtaccgtgatcatcgtctttgccttgtgtcctggcatcgattttactacattagtttcagatactgtcattcggtttacaggtttagatatacgacgaaaacgcttttcggcaaaagacctcaaaagtcaaaacacgaacatgatggtgggaaacgttgcccactgtcacggaaaacggtacagttcattagcgcgtgattaattaagtattaaaaaacttgaaaaatggatcgatacgatttttataaaagcaactttcccataaatttttttttaaaaaatatcacaccgtttagccgtttgaaaactgtgcgcgagaaaaactagggatgagagttgggaactctcagcgctgaactcaaacttaatgaccaagtgaacactcgggagaatatataggtagcccgctagcagtaaattcatggaaaatagcaacttatgtagcgccaaattattaatattttaaactgaacttcttatttatcacaagtgaatgaacatgttgaacatagaaacccataactatatttaaaatgagacggatgtagtaaatgcgacggtttggtttgaagccaatatgttgataaaaaaatgtttaatttggtatagttctaaaactttcttcactataataaaaaatttgaattccaaataacatcgagccaaacacactttttctttattaacctgctaaaatattggtagtcagaacttatgaaaatactgatactatcaaaaaatattttgatagggtactaagtcacaaaagccctacatcttctgagattggccattgcgacttgcaagtcaagactgaagtaaccgattatacaactgagcatatgaagtatttgtttcttcgagctatttaaggaataacatattaaacttttttttaaacatggtctccctttctctcctagtagctagtcattataaacttctctgtttaaacatggaccttataaacttttctatttacgccgagtttagatccaaactatttcttcaaacttctaactttttcatcacatcaaaactttcctacacacacaaacttctaacttttccgttacatcgtacaattttaaccaaatttctaattttagcgtgaactaaacacacccttaaacattgcctccctttccttgtaacctgactttaatatcttacgcatgtgattcgttcagtcaactggaggaacgcgagattttagacaagcactaaatatttaaatagtatgaccattcgtgttatttacaaaattacataattgttatttatattttacctattttataactaaaggttttttttaatgagatgaattgtcaaatgatatttacaaattgatagcgtcatatgcattaagaaagtgagtaatcatctactccctctatttccctctatttcatattataagtcactttgatttttttcctaataatattttgtaagtttgattaagtttataaacaaatatagcaacattttcaacacataaaaaaacacattatcaaatatattcaatgtgatatttaataaaactaaattgatgttctagatattggtaaactattttcgctacaaacctaaagaagtttgactagggaaaaagtcaaatagactttttggtggggttgagaactcacctcctacgcacgtaaaacggacagactcattagcgcatgattgattaagtatttgatatttcttttgaaaaataaattaatatgattttttaaaaacatctttcgtatataaactttttgtaaaatacacactgtttaatagtttaaaaagcgtgtgcgcagaaaacgagggtggggagtagagaactctctcaaaagaacgcatcgttatcctatacatgaaccagagggagtaactagctctttaatgaataatatattgtaattttaagtggttagttgttacatttgtttcaagacttgctccgtttatctacatgtatattctattttcagtgttgactgacaagcatataacattgtcgacaaccatttggcctgattggaaccacagagtatcatatttatcgactcaagaaacttattggttgatatgctagaaatacgaaaacttcttatctccaatcaacaagcaaactagaaaaatttacatcccaattctgtagaaccgaaatatatcagtacattacacgataacattattagggagcaaattcttgtgaacaagactactcgtgtacaacaaagcagtgctaaaaaagaagtgtaagtaagatattccttggatcttacctatctctctttaccttgaggctcctaaggatcattggaagaccatacttaggccttagcgtgatcacactgattggcgtgtggacgtacttaggggacaacgtgaaggagaacctttgcaggatcatggcgatgatggtcctggcctcgatcatggcaaagttttgcccgatgcacgaccttagcccgatagagaaggagagtagtgcgctggggtgcttcgctgcattcaacactccattctcggacctctctggcttgaactcatcggcgtcctccccccacacttccttgtcacggtggattgttgcgatcgggatcgttaggatggtgcccttaggaaccttgatgctaccaagcttgacgtcggtaccagctctcctcgttacgagtgagacagggccatacaaccttagggtctcgagaaggaacatgttgaccaatttcaacttgttgagcatgtctccggtgggcacctcgtcattgcacaccatcctaacctcctttctgagtttctccatccaatgttggtgtgtgctaagcaagaacatggtccaagtgagcaattgcgaggtggtgtcatgcccagcgaagaagaaggtcttgcactcagcgatgatatcgtccatgctgagttgtggctggctcccgccatgctctggcacgcatgcctctaacatcaatccaagcaggtcattcccatatcccatggtttctttgttagtgagtcgactcttgataatgttcatgagcatgctcctcaccttcttgtctagtgaccatgtcttcagattctttttggtcaggaggtagctgaaccctgggatttggatggtgagaaacacggagaaggcaagaaattggagcttcctctgtgctaggaagacctgcttcccctccctgtagctgctcccaaatgccgtacgcgaaatcacatcagcagtgagctcctcaaaccaccggctcagttcaatctccgtgcttccgcccttcatccccaactccgattcccactcaaacatcattgattgggcgtagtcggatatggtctccgtcatcatcttgagcttgtccatgtcgaaggctgggtgaaccaccttgtagtggcgtttccactcatcgtcgtcggtgagcacgagccccttaccaagcaggcgtgcgaactgcatgttatctatgtacttggggaacatccctgtacggtccgacaacacctgcctcaccatgttcatatctgccaagcatatgtttggccgtgtcccgaaccaatacaagaacgtcttccctacatcacataaacacgcaaacatatacagggatatgtttatatgctgtagatgatttcaaatatcagaaaaaaagctcagaaacatggcgtaccgtagaggggaatccatttgcggatgtgtggctgcacgatggggacgaagtcatgggaggagacgtcgagcacaaggttggcgccctcggcgcggagacgcctgatctcgctgaggttgccggagaagaacctgtatcccggcccggcgacgccctgcgcccccagccgcctggtgatggcgcggggctaccacaccagcttcaccaccaccgcgatgaacgcccacgacgccgccaccgccgccgcggccgtcgccaccgtccactcgaaacccatggccagcagatcgaacaagttctgaatttcttcgcctgaatcaatcaaccgttcgtgttctgcttgcttggtacagctggttgctgtcttgctgagagagtgatagatcgaacaagcaaagctaagcttgagacttctttgggagtcgctagctggtgtttgtgtggttgagacactggtcgtcagtcgtaaccggaggctgtgatttaattatacgaaagaattgcatgtcaatatcgtaatcggcgactaagcggccatatctttttcgcgagcgcgcaaaaaatttacatgtcaatatattaaaaaagaaaagaacctttttttacatatcacaattgaccagacatgcctaggctagggggaagaaaaaaggtaaaaaaaaaactaaagctgcagctagggaaagaaggggaaaaactactgcgaagaaaagctactctaatcaacaaggaggtggagacggagaaacactaaaaaaaaaaaaccctgagatcccatccatatcaaaacactgcttccttcgttacaaaatataacaatttttaaccttaaaatctattaaaaatataacaacttattcatcaatgttctcttcgcaaccaatcataacttttcaccattcaattttcccacccaacttcacttctcatccaattacaatattccccaatttaatttacctattttttaatatcagcctaagcttatctctaaaaatccttatattctggaacgaagatagtagtcatatttacaacagtatctgggaaacttgttttaatttgatttggaaactgtttttcaatttttctacctattttatttggttggtcagttttttaggtgcacctgtttctctttttgcggagcatttattttatacgtgagggtaggatagacaggaagtgaaggagggcgagtaaatcaaagagatagccatttctcggttgggggcaagataaaaagaattcaataggtcagttgaaggggcaggcagtagtctacaaaatacagttccttttaaatagcaggattgagaaaatagaagaaaaaaaaaataaaacatgatgaatagaagtgtaaaacagagaattacaaaatatataaaaaaagagagtaattttcatataactacatgtactttaatcaaattatcataaaactacatatttaacactaaatttgtcacaaaacaacacatttaaagcgaaatatcacgaaagtacagatttaataacaaaattatcacaaaactacatgtttaatgataatttaatcacaaaacttgaacaattaaatgactggatcgaccggatagcgtttctaggggaactactagtgaacagcaattatattatttgaattttgacgttgacaagtgtacgattcgtagtacaattgtacaagtgttttcttctgttctccttttctttttcgttagttaacctccgttatgtcttttattttcttttcctcctcctacgcaatgtactgccaatacaaacgctttgggttcaggcaattgaaccatgatctttgcctttgcatgccctggcatttttacattgtaattcagttctcggatctaaaattgacatcaagttcttgtttgatccaccgctattatcacaatatccgtccggtcagagctatcaacgatgaatcgataatttactatccatttttagctttttgaatggaagaaaagtaatgaaacctacaatggctattgaataacctcctttccatttttttatacgaaaccgtttggccattttttcttcgtctgccaaattttctttagttctacccaaactcagttttgtctcaatctttattgaagaagaaacggttttccagccgctaaatccaggtatcccacaaaatcattaaacctggctgttatttcggtaaaatacgctaaatcacaaattaatgaccaagtgaagactcgtgagaatatgaagcgtgctagtggcaaattcatggaaagtagtagcaacttatgtagtgccaactatttgaatgatttttttaagaaaaaaaaggacacagggatggggatggggtagtaatatacggaatgcagcccaagtcaacatcaggaagcaattcccagtctacaagccaacatcacaaatttacatccagttttgtagaaatgaaataaaaccgatctcgtgaacaacaaagcagtgcataaaaaaaggaagcataagtcagacattccttagttcttacatatctctcttacatcttgtaagatcaacgtgtgttttgattcttattctgtgatgaacaattggcatctgtgattattggttttgatatttggagattacagttgaagttgttttggagataattgattttcaagtgatgaacagggtttgctgttttgttgggaccggtcagaccggacggtagttgccggtcagaccggcttgtgttgagcggtcagaccggccggcccgcggtctgaccggccgacgctgtgtcggttttggtttcgggttgtttctttggatatccgtgattgtttcatggttatggcttctagatggatactatacgtatgtaatactgttgtttgctaacaatgagtcaagttggtgatagcttggtctcggaatatggtttctttgtttgtttcatgtgtaggtgattcgatgcctcgggagagtatttgcggtgatggaccgggagtcggcttggtggtaagacgatgtccgtggtggtcagatatcatgcgggatacttatgctagagttgatgcacgtggttggtgaagattccatatggcatatgatggaggtattgtgtgcgtgtgagatgcggagtcgaatttggaaggagtccaaatttggtatgattggttatgtaaagtttgtttcttatactatagggtttcctaaggtgtttaggacttctagtatgagtttggttcgtggctttaggctgcctacctcatgtataaatagagggggagagtgaagcttcccggtatcgcttttgagagcaattgagttgctagtttagttagggtttcaagtttagtcgagatttttgtaaggagtgctgttgatgcactttgtaaacatagatagaagcaataaagttgtcatctactttaagagttcttcgatttgtgtttaatcgggttcggcggtctaaccggtgatataccggcggtcagaccggcggcaggcggcggtcagaccgacggaggagaggcggtcagactgacggaggagagacggtcagaccggcagcgacttcaggcgtggcagacgatcttcaggcggttgtaccgagtgatcaacaccggttagaccggcggcacgagcgcggtcagaccggcggatcaacctcggttagaccgatctacatcgaatttgagggtaacttttatttccactaaaagtttaggtttttgggtataccaaccattcacccccctctggttggcttagttcttgtgattccatcctacacatcttgaggctcctgaggatctttgggagaccatacttgggccacagtgtgatcaaactggttggtgcgtggacatacttgggggatagtgtaaagaagaacctttgcaagatcatggtgatgacagccttcgcctccaacatggcgaagttctgcccgatgcacgacctcggcccgctagagaaggagagcaacgcattagggttcttcgcttctttggacactccattcggcaaaagacctcaaaacacgaattaatgagcaagtgaaaactcaggagaatatataggtagcgtgttcacggaaaatagaaacttatgtagcgccaaactaatatttgaaactgaacaactttcttttttatctgaagtgtacgctatctgaagtgtacgcgtttggaggacacaaagatggaggcctcatcttttcgtttatgcttattcttatctggacacaaagatggaggcctcatcttttcgcttatgcttatgcttatctgccaaaatttaaattttcaaccttaaatttagagcagattttgtggttttttatcgaagtttattttttagcctcttagatcgctaagaacacgtatatagaagttttatttacaaattattttttgtttgtaaatatgtcgtacttattccataaattacttttcggggcttaggagtagtaattgttgtaaaacaaatctcgccgccggcggcttgtacgaatggctcgactgggccgtttttgagaggatgtgccgatccgaatgggatggcatgggcttcttctggtgctctttcgctgactcccgcatgtattgggcctcctttaagcccactgtcaaacgaccgtgttgagccaatcgctaaaaaaggtacaccaggtcatttcggattgatgctaaaacatgtctaccaaaatatattttgatagtttgaatagtaaatgagatagtttggtttgaatccaataagttggtaataaaaatgtttaatttggcatagttattaaacttccttcactactatacaaaatttgacttctaaataacatcaatccaaacacaccttttctttataacgtgttaaaacttatcaagattttaacactattattattttaatagggcactaaaccaaataagctctacctcttttgagatgtggctgttgcgagttgcaagtcaacactgaagtcaccggttatacaaactgagcatatgaagtatttgtttctttgagctatttaatgaataacatattaaacatttttttaaaaaaaaacattgtctccctttctctcctagtagctggaccttataaactttttatttaaatagtctccctttctctcctagtagctggatcttataaactcttctattgaaacagtgtctccctttctctcctagtaggtgaaccttataaacttttctatttactccctccatctatttttgatagtcatatttacaaatctaaaaaatttatttttgataggcatatttcaatccaacaatctatcctcttaatgactttcttggatttaatgcgtgactctctattcttacacacaagattggctacctgggcatcgagaaatgtaaatattaatgaatcgcttgtttacgaggaataactagtagcatgtttaaatgataagtagaattacttatccttgatctgtgtgccaagatgaaatatgactatatggagggagtattatttaaacattgtttcccttcgtctcattgtaacctggccttaattgtcttctgcatgtgactttcccgatcaactagaggaacacctgattttagataagagctacatatttgaatagtaccattcgtgttatttacaaaattacataattattatttattttgttgcgacctattttataactaaaggttaattttttaatgagatgaattgtggaacaatgtttaaaagttgatggcgtcatatgtatcaagaaagtgaataatcttctactccctccattttatattataaatcactttgatttttttagtaaaacttttttaagtttgatcaagtttatgaaaatataactatattttcaacacaaaacaaacatattatcaaaatatattcaatgcgtcagtgttatgtacaaggcatacccaatagttttgggttgagctcggcgaagcctaccatatactaagttttatacaaaatcatgcatcatatatggaaggtattccggataaggaaggagaaacagagctctacatggaaactacaatgactagtcggatcatatccatattagtcttcctatttctacttagataatgggacatctataggtataaatacaagactccctagggggggactaagacaagcctagctagaatagacacgctcagtcagaatagacaccaatagacgccaccaaacatcgacgttggagataaacctagacagacccaatctagtgcctcagagtccgacaagaggtatctagcgctatctctgatctcgccgtgttcgtattcgaggaggaagactacctcgtcattgactacatgtggtgttccataccgccaagtcgttgacgactagattggttatcccaaatattgtgcttgtgtgattctgataaataagagcaacaccggcttcggccaataggactagggctattaccttagagataaggggcccaaacctatataaaaatcattgtttccgtctcttttaactcaatctcgcgtataccctggtaccaacgatcctcatactctgcaaataccgtagtcgtgatctactccgtcgacacaataatatatttaacgaaactaatttgatgttgtagatatcgttaaactatgctataaacttagctaaacctaaaaaaagtttgactagaggaaaagtcaaatcgacttatagtatacacaaacgggagggagttgctctttagttaataatatattgattttttaggtggttaatttttacatttctttcaagacttgctccttttttctacatgtatattctattttccgtcttgattgacaagtaaatgacattgtcgacaaccatttggcctgattggactcacaaagtatcatattgctcgactgaagagactaattggttgatatgctagaaatacagaaacttcttatatccaatcaacaagcaaactagagaaatttacatcccaattttgtataactgaaatatatatatcaatacattacacgataacattatcaggaagcaactcgtgtacaacaaagcggtgctaaaaaagcagtgtaagtaaaacattccttggatcttacagatctctttttaccttgaggctcctaaggatcattggaagaccgtacttaggccttagcgtgatcacactaattggcgtgtggacgtacttaggggacaacgtgaaggagaacctctgcaggatcatggtgatgacggctttggcctcaatcatggcgaaattctgcccgatgcatgacctcggcccgttagagaaggagagtagtgcgttggggtgcttcgctgccttggacactccattctcgaacctcgccggcttgaactcgtcggcgtcctcaccccacacttccttgtcacgatggattgttgcgattgggatccttaggatggtgccctcaggcaccttgatgccaccgaatttggcattggtgccagtcctcctcgatatgagtgagacagggctgtacaaccttagagtctcgagaaggaacatgttgagtaagttcatcttgttgagcatgtcaccagtgggcacttcgtcaccgcacatagttgtcacctccttcctgatcttcctcatccactccggatgtgtgctcagcaagaacatggtccaagtgagcaggtgcgaggtagtgtcatgcccgccgaagaagaaggtcttgcactcggcaatgatctcgtccatgctcaactgctggctttcgtcatgctctggcgcgcacgtctccaacatcaatccaagcaagtcgttcccatatcccatggtgtccttgttagcgagccggatcttgatgatgttcctgagcatgctcctcaccttcttgtctagtgaccatatctttaggttttttttagttggaaggtagcggaaccctgggatttggatggtgagaaacatggagaaggcaagaaactggagtttcctttgtgccaggaagacctgcttcccctcactatagctgctcccaaacgccgtgcgcgagatcacgtcagcagtgagctcttgaaaccgctgactcagttcaatctccgcgcttccacctttcatccccaactcagactcccactcagacatcattgacccggtgcagtcagatatggtcaccgtcatcatcttgagcttgtccatgtcgaaggctgggtggaccaccttgtagtggcgtttccactcgtcgccatcgatgagcacaagccctttgccaagtaggtgtgcgaagtatgggttagttaagtccttagggtacatccccgtacggtccgacaacacctgcctcacaatgtttatatccgccaagcatatgttcggttgtgccccgaaccagaacaagaacgtcttccctacaacacataataagcacacaattatatatatatatatataagctaacaaattaaaataattggtactcatggcattttaaaatatcgaaaaactaaacctcagaaaacatggcataccgtagagggaaacccatttgcggaagtgcggctgcacgatggggacgaagtcatgggaggagacgtcgagcacgacgccggcgccctcggcgcggagacgcctgatctcgccgaggttgccggagaagaacctgtatcccggcccgccgacggcctgcgcccgcagccgcctgctgatggcgcggggcctccacaccagcttcaccaccaccgcgatgaacgcccacgacgccaccgccgccgccgccgccgccaccatccacacgaaattacccatcgccactggatcgaacaagttggctcttcgcctgaatcaatcaacagtacgtgttctgctttcttggttcagctggttgctgtcttgctgagacaatgatagatcgagcaagctaagcttgagactttttgggggtcgctagctggtgtttgtgtggttgatacactggtcgttagtcgtaacccgaggctgtgtcttaaatactgctccctatgtcttaaaatatactctctctgttttgttttaaaatatttgacaccgttgactttttaacacatgtttaaccgttcgtcttattaaaaaaatttgtaaaatatataaaactatatgtgtacatgaaagtatatttaacaataaatcaaataatatgcaaagaataaataattacttaatttttttaaataagacgaaatcaaccaattacaatccttcatcatttaatttttctacccaccttcacttcttatcaaatcacaatattccactatttaatttatctactttttaataaccgtgttcaacctttaaaaacccttatatgataggatggaggtattagtcacatttacaacgggatctaggaaaattttttaaaatttatttggaaaatgttttttttaattttctccctattttatttggttggtcagttttttaggtgcacctgtttttcttttctggagcatttgttatatacgtgagggtaggatagagaggaagtgaaggagggtgactaagctttttaaaatcaaagagatagagaaagaattcagtagggcagttgaagggacaagcagcagtttacaaaatactcttcctttaaatagcaggattgagaaaatagaggaaaaaataaaataggattttgacatgaatagaagtgcaaaacagagaattacaaaatatagaaaaagacatgaataaccattcatttgattagaagacatgaaaaacacaggaatttaataagagataaaaaacacataggaagctttcacgaggtgatcctcatactgaaattcagccaaaacttctatggattcattaggaatttcgtaggattcagttatatccaattctttgtttaaaggaaaaaaatatcatgtacgattgaaatcctacaattttttatattttccttcaaatcaaaggagccttacaattttattataaatagcaaagtagccgtacgttgcaatggaaataaataaataaaaatacgatgaacatcaatttattagggtttaattttcctaattcaggacccgagtaaatttgcaatcctaattaaccatgttaatttgtatatcagttaataattagataattaataggtattgaactcctggtaacttttttctggtatctcgagatatgttggtctagcctactcttttcgaggtgccatagagtagggtgtacgtgtatgtgtttatagaagagtgggtgtgtttttaaacagaaaactacatatttttcataccaccattttatgcaaatctataataaaaatcattgaaaaaaatgcaacagaaattatgtatgaatctaaaaagcataccgaaattgtaaacattcaaaactgccagaggaagaaggtgccgattgcttttataacctctatagctaccatattgtcacaacgccgcacgagcacgacacaaccagcgcccaagcgttcttgtgttgatgggtttaattaaccggatggttgctcccgtgttcgagttgatcacggaattacatatataacttccgcgtgacgttgcgcgcacctcgcccgcgtatcggatgatggacggaagaattttgaatacaggatcacctataaattttacaatatgtaaagattttaaatactaaaattaactatattttggaattgacgagtacctgccctgttggaaagagactgcgtagttgcagacttgcagtgacatcaacggtgattctagcagttttggcaacgagttacggagttatcgatctggctgagaaaaggctttgttctaaactctcaactggtgatcacacggaatcactgacataatcagaattgacaccaaattccaataattttgctgccaatcagaccggatcgaccggatagcgtttctagaagaacaagtgaagagcaattatatggcttgaattttgacattgacatgtattttcttctgttttctttttctttttcgttagttaacctccgttatgtcttttattttctattcatcctacgcaatgcaaacgcttttgattcaggcaattggaccgtgatctttgtcttttgccctggcattatatattacattgtaatatattcagttctcggatctaagatcgacatcaagttcttgtttgatccaccgctattatcacaatatccctccggttagagctatcaacgatgaatcgataatttactatccttttctttggctttttgaatggaagaaaagaatgaaacctactatggctattgaataacctcctttcttttttttttctatacgaaaccgtttggccatttttttctccgtctgccaaattttgttcagttctacccaatctcagttttgtctcaatctttattgaagaaacggttttccagccgctacatccaggtatcccacaaaatcattaaacctggttgttattttggcgatagcactcttcagtagatgatgccccacgctttactgcgggatatatgttagataatggagaaatgatgaaatgatttgaattgaaatattataaaaatgatttgataatgatgatttagcatgtgtatatttagttttagaatgaaataaattgtagatataattactatatgcttgcatgttgagttttgtgtgcttaatgggttgatgtggcatacctgcatgtaggttttaggagtgctaataaatattatacttgcatattgagttttatatttttagtgggcattagctttatataaagaagagatacgctaaagcacaaattaatgaccaagtgaagactcgtgagaatatgaagcgtgctagtggcaaattcgtggaaagtagtaacaacttatgtagtgtcaaatatttgaaagaaaaaaaaagacacaaaggatggggtagtaatgagtgatggcttttaactaattttgtttgagttactgatgctctgtttatttcaatttaagattattgtaatcctgattattgagttagattgctataaattggattactcaaatctgtatttccacgggtgtattctttcagttccaggatgtacatatatacaccgagcctgagaagaagggaggagaagatgaaggaaaaagtacacggaaggtccctcaacttgtcatcgagttacaaaatcatcacctaaccacaaaaccagatatatcacattcctcaacttacaaaaccattcaaggtaatgcggtcgtctgccttacctcctcctcctccgcgtgccgtgcggcgccattgctgtggccacgcgttgtcgtcggggtgaggcggcgacgcacggtggtgcgaccggcgcggccagcggctggtgagggaggagcgcagcggggaggatgttaacgaacctgaggactagacgcagaggagtcaaatctgaactggttgaagaaaatgaaagagcaggcccatcagcgaggatgacaaggaggagtttgagaagctctaaagctgaagcagttgaggctgctcaagaggtgccatctgcagcaggaccttcgcagtcaaccaggccatctaagagaagaaagaagtgatgagattgatctgtgcttgctagtgagattttcaggggcaccgcgccgatcgagccgcttcctctactcctccgtgaagctcacgcctcctccggtcaacgccgtcgagaacaccatcacgttcctcggcgcctggtggaacgcgggccacgg

SEQ ID NO: 54824 - DNA, 15562 bp, Oryza sativa
tcctgcagccccggaagctgggatgcagcggcgtggtgccagtggcggcggcggcggtggcggcgcgtgtcccggcggaggagacgaggacggcagcggtggcgcgggcatggggtggacgcggtcggccatggggtggttgtgaggcaaggtgttcgacgagtcggctcgagtggagagtaggaagagagacaacaaaagaggggaaacagagagaaagatgacgtgtcatactgatatgatatgtgaagtcgatatgggttccatgctgactcagccgctacgtaggataaaaccggatttaaaaccatcgaataacctattgtgaccggttttgattagttaagagatgctggatatttggttttacggttggaggatgattttgtaactcaatgacaagttgagggaccttcggtgtacttttccgaagtgaaatgttgtggtctacatgggcctgtccaggctaggtattagccgcaggccatgagcccaataattgcacgagcataattgggccgaaacttggctatttacatcgaacaaatttcggcccaaaacttcgacgtacgcatcacagcttttcaaattcgaagttgagcaaatcatagggcctcgaattgaattgttcacccaatttctgacctgcggaaacttcttatatccaatccaatcaacaagctagtgaactagacaaatttacaacccaattctgtcatggaggggaggtagtgaagatggttgatgcgaacacgttccatatatatctcgagtgactggtaatggaggaggaacttttgaagggaggtagtgaggatgtgcccctacctcctaaacggccctagatgtaaaaccatcacaagccccaagatccaccatagttgcaacggctctcctcatcgagctcggggaggacattagcaagtatagatggccataaggcccgaggcccgaaggcccggcccacggcactactttttggcccggcccaagcatggctcggcgaccgagccgtgcctgggcctccccactggcacgctgggctggcccggcacggtcgggccggcccggcacgatgggccggctggctaggcccggcacacaaagtatagggactaaaaatagacatatatatgtcattgtccaaagaatagggaccttaaatagatttattttagctatttatataccacagcccaaagaagagggaggtaaaatagacgttttttagctgtatatatgtcacagccaataggagggatgaaaaatagacttattctgagaaaaagcacaatggcccatcatgcctacgggccggcccggcacggcccgaggtgtgttgggccgtgagtgcggcacgtgggctggcacggcacggcccggtgcgtcggtcgggccgtgccggcccgacaagcctcggcggcccacatggccatctatgttagcaagtcaacctcagcgatattgcaagcaatctcgatcgatatccaccagtagctgattcatcccaccaccctttgtgtcgctggctagggatttcaaagagggatagagaaagtgcagcatgagagagagggaagtggttttctctatctattacttgtcacgtttgttctactgacaaagtgtacaccatatagaaattaaatacaatgtatattggcgtattccgaaactgtttataaaagtaaaggggtttaattcgtccagtgtaattcgaacttttcccttttagaagcatggcgttatattttctgcttattcattgacaaaaaaagtgaaaacaggacgagagacatgacgtacgatcaaggtcataattagcccccctctttttgtcggttacagaggttgctggccatgcgctcatgatcagtgtatctaagcagggccgcaccaagtgtatgcatctttttgtcactagttaattattactccttcccactcataatataagtattttggagggatataattctttaaaatcctttatattatagaacagacagagtaattagtactacttaaaacaataataaaatttgcatatataattaatcatctgaactctgaagtctgaagtagacgcgagacgcgaggtgaggtgtgtagctagatccatggacgtgtacgtaatacgtgtcagattttgtaatgggcggattacgtattttaatttgcgctgcatatatatcacgacacgagaaatgcatgttagttgctctttaattaattaatttcctaaataaaaatgaatcaatcaaggccatcttttgccggtcgccattatacactgacctgcaggtgtttgattagcactcctattcctattcctatagtcctatttgcgatagctgcctcagcatctctccatctatggcgactcaatgatagtgattattgagtgtgcccattaagctagcatcatgagttcaaaatgcagccggaaacagttttattaatcgatcgtgagaatattccctcatttctgtgtaacaatatctaaagtatattctcagctcatatgttgatcgagataaaaaaaaagataaatccagcatttaaatagtattgtatactcaaatttatcttttttttaattaattagtgtgtatcactgtactctgtattgtcaagtttttttaaatattttatgaccatttgtgttgaatttagttggaaaagataaacaagaggatatcctctcgagcggttaggcacttaggccatccccaagactgcataccatttagtgtctatagcattaaatatattattacataagtaaaaatatgatgtggaagagagttaatgatgagagaggtaaaagatgaagaaaccattcgctagttttttttttttgacaaacaaaaccattcactagttacccttcaattcttcaacacaaagggcatgtttagttcgtgaaatgaaaatttttgggtatcacatcagacatttgatcagatatcggaaagggttttcggacacgaatgaaaaaactaatttcataactcgcctgaaaaccgcgagacgaatcttttgagcccaattaatccgccattagcacatgtgggttactgtagcacttatagctaattatggactaattaggctcaaaagattcgtctcgtgatttcccccctaactgtgcaattagtttttcttttagtttatatttaatgctctatacatgtgtccaaagattcgatgttatgtttttgggaaaaactttttagcaactaaacggggccaaagtgctagctagctactgctgcttgcctgcatgtgtctccatccacgtatgtacttagttcgccaaacgctagcgtttgatcgcgagaagattaattaattaaacaaaatagcatttgtgaaccgcccaattgtgtgctttactctgcacatgatttatatataaaaactggctactttaaagatcgacgcacatgcatggtttacactcaactaattggtcctctccatttgcattattgttaggtttgctatggctgtatataaatccatgtcgatcatgtttacactcaactaggaatgttataaatgtccaaactaaaaaatctcaaaccattgatatattgatcaagaatattaatattcagtatccaaaaattgatatcgatgggttttattacgaaacaaacttgcaacattttttctaaaaaataaaatcgctaaaaataatagtaaatttcacttaactataagtactttggttaaactatcacaaaaatatagagttaacatgatgtatcataaaattatagatttaactaaatttatcacaaactacttacagatttaaggtgaaatattgctaaactgcatattttaagtaacaaagttatcaaaaatttaatcataaaatttggacatttataactcacacataacattcctagttttgtaataattttattattaaatctgtagttttgtaatacttagccttaaatatgtagttttgttgattgttaaatatatagttttgtgatatatcatcttaaattatagttttgagtgaaattttgatcaaaatatttgtagttttatgaaatttacttaaaaaatggtaatactttgtattatcaaaatatttgatagaagaaagaatgcagagagtacttgtctgcatgtatctactccctccgtctcaaaaacccaacctaatattagagatgatattttctagtacaacgaatctggacaaccttatgtattcaagtaatgctctcttgctctcttttttatgaaaaaggtagtacaactcttctagcctctgcactaattaaatgtctatacaactatgtttacagacaccccgtacgatttgaactctagtggttagagttatttagtcacaagtacgatttcaaccctagtagcataattttcagcccttccagcctctggtactcacgattttaccaacgtaccattgatgctttcccatccagctaatgttcataccttgatattataggttggtaaagctaaatagtttcttgtgttttaatcaagctgtggttttataatttatatttttttcgatcgatctgtaacttttataataattggttgtaacttcttggaagcaaagatgggaatgaattccattattaaaaacaatccatctagtgctcatatattgatctttcaggaactagtgaggtaattgccaaccttagcaaaggtaaattaacacatgcaaactaaattaattactaagttgcctttccaaaactatgattgaacggtcacgttctaggcagatctctgtgctagctagctaccggacaaatagtgtacagtaaaagtacatcttgggcatggatgtttaattagctcaatcattggcaaattgaagcaacgagccacgtaattacacacgggaccaacacccaactctgaaagggagaagaaacagacacgaatatatggccggacgaccccattataaagctatgcactgacagtctgacactgattaatcaccaccattacttaattaattaattaattcaattaactgaccactcaaatatgaaatatagaacaccatgatcacataatatatttacacgtacggatttcagcatcaatgtctatatatatatttatatatatcatcatatgaagaactttacatgttgtacgtgtaccggcgatcgagattaaagactttaattatcatcacaatcatgtcactcaaaagcagcaaactaatgcccgatccatcgatatctctcgatcgatcgatcaaaggagagaagagaaatgaaagaaactaaaccaaaaaaaaaaaaaatcttttgacaacccaaaaacctctcaccaaacatcagctatgatcttaattacgtacgcgccgacttaattaattcacacgcgcgtatacacgttgaaaacttgacccgtaggtatacgtacatttatacgtagcagcatgcttgcatgcaattatggcgcctactaattgatcggctgatcattgctatggctcatcgctcgccgtcggtctcgttgcgcctaatttggggtggattcgagcttagctagatggtactactctgtcccataaaaaaacaaactttagctatgaatctagacacgcatatgtccaggtttgtagctagaattgtttttttttttacggaggggtagctgctagcaccagttgccgagggcgtgggcgtcgaagtgcaccgccgtgtccttgctgtcgccgccgccatagatgccgccatggttgtacggaggtagctggtggttgtagccgtcgaacacgtaatcggaccacttgagctcgtccagcgcggcgccgtagtggtcgaacgtggcggcggcggcggaggaggagggggtggtggtgcttgggcccagctccagccatgggaggtggttggtgttgccgtactgctcgtcggtggtggtggtggtggtggtggcggcggggcttaggccaaccatcgagttcagcgtgctggagctcgacaccgacgggataaccgccgccgtgggcgccggcggggcgccaccaccggaggaggtggggccgccgccgccgcagtgcagcagcgcgctcgcgctggcgccgtccaccgcgaactccgctgtcgcttggctgtacccggacagcgacgacagcgacccgtcgccgccgacactcgcggcgccgcactccgtgctgtaccggctgccatcatagctctccggcggcggctgggcgccgatggaggacaggatgagctcggcgtcgctgaacaccgccggcgtgcgggcgcaggcggcggcggcgacgacctcggcgagcggcttgtgggtggccggatcgatgccgcgctggcgaagcttcttcttgatgtaagagttccagaagttcttgacctcgttgtccgtccgacccggcagctgagccgcaatctgagaccacctgattcaattcaagctgattaatttcctgtttgattgattaattagctagaaatcatccaagctataattaattaagagaagtagttaaattactagtatgataatctagtagtaatgtgtatatggatttgtttgagttaattacttgtttcctagcatggaatggagatggatgatgaggtcttcttcttcctgtgagaatgctcccctcttgaggtctggcctgaggtagtttatccacctcagcctgcagctcttcccacatctctcaaggcctaatgcaaccacaaattggaatttctaatgatatatatcaaattcaaactaccaattaattcctacctaaaaaggttcatttcagctcaattcagttaattaagtgacatgaaaatttcgtaattaagcacaattgcacaaatcatgcacagagagagtaactagtattatggcactaattaagctaaattacattgtccatctttgtagtagtactagtgctactagagctatgaactatgtatagttagatatagctagtgagtgtatatacctgcaagcttggggacggagctccagcagccatggccatacttggcaatgtggttcatcagcttctcgtcctcctccggcgaccacagccctctcctcagcttcttcctcgcgccgcccgcccgcttcgccatagatggccaccaccaccaccgtgctcaatgtcgcaattgccgccgacgacgaccgagagagaacaaaccaaaccgccggcgatgtcccgacgacgatggcgaagacgaagacgaaagcttgagctgggacagaggagagggggggggggggatgggagggggaagaagacgaggtataaaaggcgggagagagagagagagagagagagaggtgattgcgtgggcgggaggcgggaggtcgctctcaggtaggtggccattgtggtgtgcagagtgttacactctctctgatgagtgatgaagcatctcatctcatcatcttcttcttcttctcgaagactttctcttctcagctcaggtctccctaccttaagctctctcctctctctcgatcacttgctaatattttccaccacctttactaacttcaacctataatagtactcactttggtcataaatgtttgtcgtttaatttaagacaagatttaggtcctctttgaaacgcaggataagtaataggaaaaatgtaggaattaaaggggtaggaaatggaaagaggagcacattgattgcaccattggaaaaaaaattaaacccatgaaaagtttccaagaagtctaaccttttgtttatttttctatgaaattgatcatagaaatatgtaatcctacgaaaatattcatatcttgttcctacgaatcaaaggatcctatggggaaaaaattccgaagagaattgaatatttcaaaaattctttgccaatcctctatgtcaaaggaacccctcgattgatgttttggaactttgaccatcactaacttctaaaacaataatttagaaacgtaaaattaatataagtaaaattgtcttaaaatgtacctaccataatatcataagtgtgggtggggagaggttaatatcataaatttgtcttaaaatgcgtaaatcaataagttaatcacgtattacacacaacgaagcagaaaacggttgcttctgctgctaatggcagcttcaccaattatctccagggtatgtgtggtgatcaggtgtagtaaccatccacccagctcatcatcacacttcgtcagatcagccgtgttggtagggctagcagcagctgcatatgttggactctttttctgccttaagctttttgcctcttatctatctttctcctgctaacattatgttcaccttgacacttttgcatcgatcgatctgccactaactactgcagatgctattgctagctctgcatggatgcatgcccctgttggactttgtacacacacattcgctttgctttagcatcacttcattctcgaccagtgatttaattggaacgcaagcaaccgaccaacatggtttaattatcggtctcatcttctcaccatcaattaattaattaattaattaattaacaattaattacatgtaataattaattgctagccagatatgccacagcacacacagaatcttatcatgcatggccatgggggcctaattaattagcctttggttatctatatctatagcttggttagggacagacaaacagtagtgctagctagatagagcggtactgcatgtgtggaagagatggcatttggatggtaaccacatgttaaataataataaggcaaaatttgctacaggacacgcaaaaaacgtgtaattagctggaagacaccgtgaaaacgtgatacggctaacggacactacaaaaattgtgtaattagctataggacacttgtcgtattattttattattttcggatcaaaagaggtgagatatttttctaaatgcccagattgccccttctctttccttggttttctccttcgccgggatcgcgcgcagtggggcgaggttggcgaggtcggcacaagaggacgcctgtgcatgctccgacttgcaaatcagagaccagatcgagcccctgaccggctgcagctgcctcctggctgcctgctcaagctctcaagcctgaagtctgaaggagctcgccattgctgcctgctcaagctctcaagtctgaattgaaggagctagctagccatcttcttgctggtggagcgagctcgccggcgcatgcttggctgctgctagctgctagctggccggtcttcctcttgtccggcgagatggaggtgggcgccgtgagctgctaccggagagggagttggcggcgatgcgccgctgctctcgccctcgccgtagtcgtcgtcttcgccgcggacactcagcgccttcgccgagaacaccgagcgccttctcgccctgccgccccgctgccgccgagctcatgcccgcccactcgcgccgagctcgcgccgagctcatgcccgcccactcgcgccgagctcgccgacgcctccccccacccgcgcggcagcggtcggcgacccctccccccgggtgcctgctctaggcccgtcgacctcgccgtcatcgtcagcggccccgccggcctcgccgaggcgggcctctccgtctgccgccccgctgccgccatcaagctcgcgcctgcgccgacctcgtcccatcgcgcgggttcccggtgacctcgccgacctcgtcccatcacgcaggttcccggcgtaggagaaaaggaaggaaagagaaagggcaatctagacattcagaaaaatatatcacttgttttgactcggaaataataaaataatgcgaccagtgtcctatagccaattacacaaattttgtagtgtccatcagccgtgtcacgttttcgcggtgtctcccagctaattacacgttttttgcgtgtcctgtagcaaattttgcctaataataatactatttccaactgcctttctctttagcatgcacagtgattactattgatcgccttagtaattgattaatcaatagttgatgtgaacatgtttgtgtgatccctcatttgccacaccacaattaagctagctagcaattactagttttcatgacaggagggagacctctagctagttgcatctatatatctcttgcatgatgttaatttctctctcttggagaaagctgctcaacatgtacacatatagatatgcagtacctagctgccaaatgcaattaccatcctcgtcatgacagagatatatcgaagaatatacatgacacgtgctttttatcccctcttcaccgacagaacatttatctcttcccgcgtgttgatgattcggcaataattagtatttcacacgctacacatgcatgcaaggattttgggcaattagtagacactagcttccttattcaagcttttgatcgaaatcaaattagtagggtagcatatttagtgtgacggtgaagttgtaggtgcatgccacttgctaactaagggttcaaaatcttagtgtcgcacagttacgtaggtgctctttcggtaggaattgagtaaattttacaaaataatgtactatagattcattgaacaaactatcacaaaattacataagatggtgtatgaaaaaaaatgtagatttaacactaaatttatcataaaactatatgtttaaaattaaatataaaaccatagatttagtaatcaagttatcataaaactacatatttaacgtcaatttaatcatgactataatgtttaatagtgctaggtattatttaagctctggattatatagttttgtgataaattaatttttaaatatatagttttgtgatgttgcaccttaaatatatagttttatgtatgataaatttggtgtaaaatctaggtccccgttgtttggtttatataaagaataagccaacggcatatttacaaacggaaaataatttgtgagtaaaactattatatgtgtgttcttagccatctaaaagaaaatgctgaaaaataaacttcaatggaaaaaaacttcaaaatcaatttcaaatttaaggttaaaaatttaaattttggttgataagcataagcataatcgaaaagataagactgctagttttgggatacaccatcttaaatctctagtgtcttgtgatagtttggtcagactacctacatgtaattctgtgaaatttacttgtaggaatttcgtgggagataagtggagctacttcatggatttattcctaacatctgtattttgagtacttgtagacgtatattgagatacatgtgcatctgcttctaagaaataggggtaagtatagttgtgtgagtgcgtgatgaggacatcctccactattacccactggcaaagacgtcaaagtcaggcggcgaccgtgtgagcctttgaataatcctataccttgcttaacttgggaggaggaagtcaccttaaaagggagagtcacccttcttctattagactagtcttttagggtgattgggcattttcccgagtgggtcggccaaccccacctaggccggattgtgttatcagtgcgtctcctaatgtttttctaagaaaaaaaaacatatttcagagttagctaattaattatagggtcaattgcatggtatagtacgtacgtacgtatatatgcgtgtggtacatgtgctcgcggcgaattaaatccggggaccagctgataataaaaatctacgtcgacgcgtacgtatatacgtacgtgcattgcattaaaccgcgtcaccgtacacgtatgcatgtcaagttcaactattaaagccgctacttgctcaattaaagcaggactagctatattacattgcttagggccttttgacacagctacagcttcagtgctccacctcttttgaagctggagctcagccaaacagttccagcctagagcttagtggagctctctcacaaaatgagggcctgtttagtacagctccaactcctaaatataactccaggagttgagtctggtgtggacttgtggagctgcctaaacccgaatccacaactgtaggagagtttgtgagaagctccacccaactccactcccagttttggtggagctgaaactgtttggctgagctcgagctccaggaggggtggagctggacctgtgccaaacaggcccgaactagagagaggtgaagctgggtttaggcagctccataattctcagacccaactcctataattaaatttaggagttggagctctaccaaacagaccagagttaactaatttgccggtcatatatatttatacgcgtgtgggctctgtgcgtataaataggtgtgattttcagtatttatatgtgtcggccttgttgttttcgcaaattaatttttaattcgggaaatcgttataatccaagagatattgattaaagaattttaaaaaattagctttgcagcgcacatgtacaactggttgtctttgtctacgtataaattataaacatatatatgcatatatcaccaaaagcaagtgaatagtttgtttttatttttattttttttagggggggaggggggggcagcttcgtataaatgatcaattagttacacacacttaaaagaattgaatatgaatagaggtagctaaattatttttactaatcagaatatattatggattactgcaaaattaattagtccataattataaactagcccattatggaattaatgtggtagattcctttgatcatatggagctggaggcatgcagacataatgcatgcatgcatgcgcatgttaggtacaataattatatgtacatgtacattattggggtttgcaaaatagcagcttaatgtaacgcgtacatttgctaataatgaagataaagtttaaccgttgtgatatactataacgagtacgatttaaagataatcccaacctaaaaattatcaagtactattattatagtttatgtatttattatatcatatagatattatgtatagaaactatatctcagtgggcgtggcttgttcaaaataaattttcatccaattaccttttttttcttattttattcacatatccttttattttcagtttttttatgtatagagtttttttttcatgagaaatggtttcttcatctttttttctttctcttctcattaactcttatgtcacattagctttttatgaccttaactttttattttcgtgataatacttgctatagaaactatctgagttggaaaattgggaggccctaattgaccctctaagggccagcacgaccccatgcatacactatgcattgatctactcctcaaatattatccaaataaatataaggagagttatgatgatacaatatacatttaattaccatgtcctttttgcattgttttagagagttttaatttattgctattggctaatgatcgatatctgctaagctagctagggattaaaagaataacatatgtctgatatgatctgataattaataagctcatatcaagttatctaacttaattatccttcggggcagtcggatgcatttctctggacaacacaatataatatccaccgttaccaacatgatacacatctagtagtaatgaatatatatgtatgcaattttacgtctatgtatagactatgatatggaggtagaaatattacatatatattgtacatgcatggaaaattcgtcggtggcatgataattctaattacctcgatcagcacacaccgtaccaaactctaatattaattgtttaaagcagcatagctttttcattattgcttaattaggacttcagtaaaaaaagcctgaagatgccaaactcatgtatctatatatgtatattacatttaatagagccattagagaaaggaacatagcaccaactctggtggggcacttaattaatcagctgggtcaatataagcacagcagtgttgataagcttacagggacaagtgagaagaaagcagccacaaattaaatagttcatgttacagttaacgtaagttacaaattaacatatggtctagctagtaggtaactctaattcacacgtaatataatgaacgtgcactgaaatggagtgaatttcacttcaatttgcattaggtaaaacacaatgcaaattgttccacttgttgcattgggctatatcaaaatacttttttctttgtacaaggtgttagatcagtgttcttgaaataatatatgaaacttcgtgaattttgactatgtttgaacttaactaaaagggtaatttatgtattttgagattattataggctaagtttaatgatgcccttcggtgcaaagtggaatttattagtacaaaacatagtgaaaagtgagagtgggtgaaacaagaattttaattacctcgtgcagacaattgtagtagtaaatgcatttctagctctgagcttgtactgttgtacagatacaaagctagaaatgtactcagtgcgggacgatggagatagtagcaaagtttatacgtttattagacaattatccatgtgtagtatattcatgaatgatatttatataaaaatagacatatttaatgtgatttctacatttatgcagaaaatactagatgatatatgtacgtatgtgcgagttctaataagcataatatatatgatggaatttttttttttgggctaactgaaaggactgtcgatccagcccatagtcctgataatctttttttaaatgcttaaaatatcgaattgatgtgtaaatttcttgcgccgcctaaaagatgctcgacagttgagaggaagttaaattacctatatcatccaaagtgtagttctttcttggtcggtggctgagacagaaggacggccagtggcctggcccctccaacaaattatttttcatagctttcaacataagccgggtctctggcctttttctaaaaaaaaacaaattatttttcacacgtaaccccacctaattagttaggtaattagcctaagtaatagtgtattagaccctactccaagactcttaggccacttctatgttttaatcgtggcttcgccactgttcttgatagactacttgggcatataaaagggactacttactgatctttcgatgaattaggggtttcaaatcttatataattttcaaccaatgtatacaacctattttaaatgaaataaaaaaacaaacatgtcaaacatgtaaatctagagatagaaacaattgtaaaaaaataagtttgatgcattgtagctgagcataagtgcattgtaagtgagtgtaactgtaagttagatatacagggacacgaatcttaatgtaagatgctacgaacgaaaaaccgatagacaggagctcaaaaatctatcgcaagtgaaataacaaaagtataaaaattccaactgcatgcacgtaggtgtacgtaacaaccgacggcgagggatcagaaaccggatacatgcaaccagtggcggagctacatttacaagagaggggggctcagccttcttcctcctcccccccccc
